United States Patent 11,096,956 (ANTISENSE OLIGOMERS AND USES THEREOF) - sequence listing, part 7

SEQ ID NO: 61542 - RNA, 224161 nt, Homo sapiens
aggcgggcggcacugcgccuaagcugggccacaaccgccagucagggcucuccccuuccccucccucccccccuccuccuccuccucugccgcccagagcgagacaccaacauggagcccgaggaucugccauggccgggcgagcuggaggaggaggaggaggaggaggaggaggaggaggaggaagaggaggaggcugcagcggcggcggcggcgaacguggacgacguaguggucguggaggagguggaggaagaggcggggcgggaguuggacuccgacucucacuacgggccccagcaucuggaaaguauagacgacgaggaggacgaggaggccaaggccuggcugcaggcgcaccccggcaggauuuugccuccgcugucgcccccgcagcaccgcuacucggagggcgagcggaccucccuggagaaggugaggcgggccggggagggguguggagccgcggcgaguuggggguggaggcugggccccgagcgcuccgcccgcccgcaggucacgccgccugacggagaaaacgcgcgcagcugaggcuaguaggcggcccagacuccagcccaggugccggccggcugcuccgcgucucccaggcuuuguggcaaagacuucucguuuccucccccucgguggguccugggccuuuugaacucccguagacguucaggggagccugcauuccccgugagaaacgcugagagaggaccacgggugugucgagccuugaaggagggaaaaggcgguguaggaccggagcgagugguugccuggggagcaucuuguuggggagacagugaacagaugagcuugacugaauugcaggacuccccugagggaguaauguggauaauguacaccgcgcgaucacuuagucuggagaggcuccccgcggguuuuccuccccuggaccaucauuuguagcaauaaagggguuccccagccgauaggaggggcuuggaaugcaggaggcuugugaugcggcuccaaacagucugcaaaacuacaaagcacagauaauacacaauggagaaagccgauuucaugguagacccccgaagaucauuuugaaaauaacucuccauuuaauuugcugcccuuaccccccuuuuuuuaacuuacugcuuuucgaggagcaagaccugcccugcucaguacaguagccacuggccacguguggcuuuuuacaucuuaaagagaaaacuauuauaguuuugaguaagaguuaaaaauaaauuaaaugaaaaauuccaugcgucuguucuuaccgguuuucaagugcucagcagccacacuaggcuaguggcuaccauguuggacagagcagauaauggaacaguuccaucaucacagacagugaagguguagaguuuugucacuaaugagcaguaguuguuguuuugucuggugaauauuccaggggguacuuaauucauugaacauguauuauuagaauucaccaugugccacacauugugcugggugcuaaggaaagcuuggugaacccaaacauuuuuggucucugccuuccuuguguucauggucuagacagggaggcagacagauuucagaugaucacauaaagugaaacuaauauaugugcuaauauucuaugaaagcauaaaguaagauaaucuggccuugucagugaaguugggaaagccuucuugaggagguuaugauagagcugauaucugaagacaguuuaagguuaaucaggcaaaggggagggaaagagccgucuagcugagggaaaaacacaugaaaagguacuguugaugagagagagcauggcauuuuccaggacccagaagccaacgugguuugagcacagacugcaaggcuuugugugcuaugccaaggauuuaggggcuuuaucucuggagcuuuggggaguugaagaaaauauuugaaacgaggggauguaugauaaguuagguguuucagaaaggucagguguauagcagaguguggaacagcugugauagcaaggugggauggggagcaguagccauaggucaagggcauaaauuaggagaccauugcagcauugcccggcaaaagaugaugaaaguuuggaauagggaaguguugguggauacagggaaaaguggacugauuugagagauauuuaagaggcaaaaucaucauacuuaauaacggaugggaugugaaaggugaaguagccagguguuagguuauuguuugaaugguugugccaauauuaagauauggccagauuuaugguggaggugguggcugugagugggugguggaauugguugggugagucuuaagauuaugaguuugguuuugaagauugaaggagaaggcugggcuagagauuucaaguuguaagucauuuacauagagaccauaauuaaagccacacuuguugacuaggucuucuaacuuuuauuuuguccugugacuucuugcuugaauaacuauuaauauucaaacuuuaucuugaagccuagaggaggaguuuuuuaaacaaaauuuuaauuuaauuuuagauuuggggguacauaugcacguaauuaacauggauauauugcauaauggugagguuugggcuucuagugaaccucucacccaaauaauauaccuuuguacgugauaguguaacauuguacuugauagguaauuuuucagcccuucucuccuccuucuggagcccccagugucuguuuauuuccaucuuuaugucuguggguacuuauuguacccauuuaucuuuaugccucuguguacccauuguacccacuugucuuaccagugagagcaugugguauuugauuuucuguuucugaauuguuucacuugauaaauagccuccaggcuccauccauguugcugcaaaggacaggauuucauucuguuuauagcugcauaauauuccacaauguauauuaauacauacuacauuuucuuuacccauucaguuguugauggacacuuagguugauuucaugacuuugcuauugugaacggugcugugauaaacauaugagcacagauuuuuuucuuuuuuuuuaauggcgucuagcugguguagaacaccugggcucaagugauacuccgccuuggcuucccaaagugcugggauuacaggugugagccagugugccuggcucagaugucuuuuugaugaaaugauuuaauuuccuuuggagagauacccaguaguaggauugcugggucaaaugguaguucuguuuugaguucuucaagaaaucuccauacugcuuuccauaggaguugaacaauuuacauucccaacaacaguguauacguguucccuuuucuucucauccuugccaacaucuguuuuuugacuuuuuaauaauagccauucugacuggugugagaugguaucucauugugauuuuaauuugcauuucucugaugcuuagugauguugagcauuuuuucauguuuuuuggccgcucguaugucuucuuuugagaagugucuguucagucuuuugcccgcuuuuuagugggguuauuuguuuuuucuuccuguugauuuguuugaguuccuuauagaugcuggauauuaguccuuugucagaugcauaguuugcagauauuuucucccauccuguagguugucuguuuacucuguugguaguuuauuuugcugugcaggagcucuucuaguuuaauuaaguuccauuugucuguuuuuauuuuuguugcauuugcuuuugaggucuuaaucauaaacuuuuuuccuaaguauucuuuaggauuauuauaauuucgggccuuacauuuaaaucuuuaaucuaucuugaguuaaucuuugcauauggugagagauagggacccagaggaggaauuuuuaagcuaacccucuuuuacuacagccaaugugagaaaauuauuuuccuguuuaauaaugaacuaucuuuuuuuucccccgccgagaugaagucuugcucuguugcccaggcuggagugcagugucacgaucuugguucacugcaaccucugccuccuggguucaagcaauucuccugccucagccucccgaguagcugggauuacagguauccaccaccacgccuggcuaauuuuuguaguuuuaguagagaugggguuucaccauguuggccaggcuggucuugaacuccugaccugugaucugccugccucagccucccaaaguguugggauuagaggcaugagccaccgcgcccggccucuaaucgugaacuaucuauggguaauagaaaaucuuacuucugagagcccagaguauuuuuuccuccccacaguuuuuucuuuccccugagaaaaauuagauauuuucuuauuuaccugagagaauauaugauaauauauagaauauauagaugauuuucuguauuaaagguagauuuacaaugauacaaggaguguucagauaauuuuuccuuuaguucacuggcauauugaaacuuacuggcauagguuggaaaguguuuaaggaaaaaaugcuuaguauguuucuugcuagaaauuuaugaacuaugaaauucuuagauguguuguauaacaucuaaugcugcguauuuagaggaugagaucaaauaauaggaaacauuaauuucauccaguuuacucucaaguuaaaugacaaaauuguguuauucaauuuacucucauaucucacuagauaauaagggaguuauagugguguuauauaaggcagugauuaaguuuguaguccuguuacuaaggcugaguuaaacuaugauacuguuuaaauuugaagcaaaauaugaccagucuuauaacuaagucuuuuuaagagggaagugagugauucagagccuuauguuguuuuuaugcugguccuacagaccauucaggcacuucuuguaauuccuuaaccugaauuucugaguugugcuggggaagauaauucaguucucuggguuggcaucacuagaaauucuuggucuccaacuuuuaauugggucaucaacagugcuuggaaaucuuuuuuuuuuuucuuuuuaagauggagucucucgcuuuugucaccaggcuggaguggcaguggcccgaucuuggcuaacugcaaccuccgccucccggguucaagugauucuccugccucagccuccgcaguagcugggacuacagaugcgcgccaccaugcccagcuaauuuuuguauuuuuaguagagaugggguuucaccauguuggccaggauggucuugaucucuugaccucagguuauccacccgccucggccucccaaagugcuggcauuacagaugugaugagccacugcgcccggcccaacaguguuuggaaaucuuuaguuuccucucugucagcuucuuuccccaucuucccucuuaacuucugucucccacccagaguucaacauccccccauaagcagguuacaguuucaaagaagagaacacaggcugaaccucucccguuucugcuccccaucuccaaauuuaucuacagugcacaauuuauuuuuuuaaccuauucauauacguuuuauucuuuuuuuuuuuuuuuuugagacggagucucgcucugucacccaggcuggagugcaguggcgcaaucucggcucacugcaaacucagccucccgaguucaugccauucuccugccucagccucccgaguagcugcgacuacaggcgcccgccaccacgcccggcuauuauuuuguauuuuuaguagagacgggguuucaccguguuagccaggauggucuccaucuccugaccucgugauacacccgccucggccucccaaagugcugggauuacaggcuugagccaccgugccuggccuuguauacguuuuauucuuaauauuaauccuguuuuguguuccuaggguaaaaacuauuuagucguagugugcuuuucucuugaggaacugcuagauuuuauuugcagauauuugauaaugguuuuaaauguuuuucuguuuguuuuuuguuuucuuggccaguauuuaucaaacuugacaucaauauuaugccauuuucauaaaagguacuuggaugauuuuuguuuuucuggaacaguguaaguacaaaggaauuuuucuuucuuguauguuugaaagauaucaccauuuaaacuaucucuguauuccuuucaggguuguagucuauauauguucuccuuucuuggguuaauuuuggugguuuuccuaggaaaucauucuuuucaguaaggguuucuaguuaauuuuaauggagugcuacacaguauucuuuauuuuuucauuugccucugugguuauuuucacuucucauucccaauuuuguguaauuaugcuuuauuuuucuccugauuugacuagguagggguuuauuuaauuuauuuuucauucaaggacacagcucuugauuuaaguuucuguugcuguuuauuuuuuaauuauuaaaaauuauuaauuuuaauaauaaguucaguuuucaucuuuuacuauuuccuuagguuuacuuugauguguguguguguguguguguguguguguguguguguauuuccuuguguugagugcuuaauugacuuacuuaaaaacauuuuaauagcuuuuuugagauaucauucauauacuguacaauucaccuuuaauuuaaagugcacaauucagucauuuucuguauauucauagauaugugccaucaugaucacggucaauuuuagaacauuuuaucacuucuaaaagaaaccccauacacuuuagcugauaucccccgucuuccauuccccauaugcaacuauuaaucuaccuucugucuauagauuuaccuauuuugggcauuucauauaaauggaaugauauguguuuuugugacugggcuucuuucacuuagcuuaaugguuucaggauucaccugugauguggcauguaucaguacuucauuacuuuauauggcugaauaauauuuuauuauauggauaugugauauuuuguauauccauucaucaguugauggacauguuuuuuuuccuccuuuuuggcuauuauguauaaugcuaccguagacauucuuauauaaguguauguguggacauauggauucauuucucuuggauguauaucuaggaguagaauuuuugggacauauggaauucuguuaaccuuuuaaguuucugccagauuguuuuccaaaguggccuuccuauuagcaguguaugagaguuccaguuucuccacauccuuaucagcacuuguuauuaccugacuuuuuuguaguuuugauuugcauuucccuuaugguucaugcaucuauucaugugcuucuuggccauuugugugucuucuuuggagaaauaucuauucaggucaaacuuuugcccauucuuuaauuggguuauuugucuauuuacuauuggauuguaagaauucuuuauauauaugcauauuacauauauaaucccuuaucaaucaagggauugacaagauacagucccuugacaaaugugaggucaugaggaccuacuauguuuucuuugagauuuuauaguauugcuauuacauguaggucuuugauccauuuugaguuaauuuuuguauacgauaugaagaaaggguucaaacuuuauucuuucguaugugacuauccagcacuguuuuuuuuuuuaaauuuuauugauuuguguaaauuuauagaguucaaguauaauuuuguuacauugauauauugcauagcgguaaagucagggcuuuuaguguauccaucacuggaguagccuacguuguacucauuaaguaauuucucuucauccaccccacucucacacuccccacccuuccaagauuccacucucugucauuccauacucugcuuccacauguacuuguuguuuagcucccacuuggaagaauaggcaguuugucuuucugcagcaccauuuguuaaagaggcuguucuuuuccccauugauuggucuuaguacccuuguagaaaaucaguuagccauagauauauggguuuauuucuggauucccaauucuauuucauugaucuauaugcccaccuuauuccaggaaacacuuuuuuuuuuuuuuuucugagauaggugucucuuuguugcccaggcuggagugcaugcaguggugcaaucucggcucacugcaaccuccaccuccugggcucaaguggaccuccuaucucagccuaccaaguagcuggaacuacaggcacaugccaccaugccuggcuaauuuuuguagguuuuguagggauggaaucucaccauguugcccaggcuggucucaaacucuugggcuaaagccaucugcccaccucggccucucaaugugcugggauuacaggcgugagccaccaugccugacuaggagacacucuuuugauuaauauugcuuuauaguaaguuuugaaaugggggaguucuccaacuuugcuuuccuuuuucaagauauuuuagccauucuggagccccuugcaauuccauaugaauuuuagauuagcuugucaguuucugcaaagaagccagcuaguauuuugauagagauugugaugaaucuguagaucaauuugggaguauggucaucuugauauuaaaucaucugguccuuuuuuuuguuguuguugagauggugucuugcccaggcuggagugcaguggugcaaucucagcucacugaaaccucugccuccuggguucaagcaguucuccugccucagccuccaguaacugggauuacagaugcacaccaccaucccugguuuauuuuuguauuuuuaguggagacgggguuucaccauguugaccaggcuggucucgaacuccugacuucaagugauccaccugccuuggccucucaaagugcugggauugcaggcgugagccaccgugccuggccuaaucaucugguucaugaacaugggauauccuuucauuuauaguugugucaauuaaugaugaggauacauucugagaaauguuucauuacaguauuucauuguugugcaaacaucauauaguguacguacacaaaccuagauggcauagccuacuacacaccuaggcuauauagucuaacuguuugcuccuaggcuacaaaccuguacagcauguuacaguacugaauacuguaggcaguuguaacacugugguaaguauuuguguuggauacguuuguguaucuaacacaaauacuuagaaaagguauaguaaaaauaugguauuuuacauauauauguguauauauauauguguauauauauguguauauauauguguauauauauguguguguauauauauauauguguauauauauauauauauauuuuuuuuuuuuuuuuuuuuugagacagagucucgcucugucaccgaggcuggagugcagugacacaaucuccgcccacugcaaccaccgcuucccaggcucaagugauucucaugucagccuccugaguagcugggauuacaggugugugccaccaugccuggcuaauuuuuguauuuuuaguagagaugggguuuugucauguugccuaggcuggucccgaacuccugacucaagugaucugcccaccuuggccucccaaagugcugggauuagaggugugagccaccaugcugggccgguauuauaaucuuauaggaccaccauuauguauguggucuguaguugauggaaauguucugauguggcauacaacuguaauuagaucuucuuuaaauuucaauaauguuuuauaguuuucagaauugcacuuuuuuucuuaaauucuucaaaauacuguuuuuaaugguauugucaguggaauuauuuuucuuaauugaauguuuggguuauucguuguagauguuuaaaaacacuugauuuuuauauauauuaauauuguuucugaaucucuucugaacuuguuuauucauccuaguagauuauuuguggguucucuaugauuuucuuguaaagaucaugucaagggcaaauauauauagcuuuauuuuuucuuuccaaucuggaugccuuuuauguauuuauuuauggcuaauugcccuggcuagaaccuuuaguaaaauauucaauaggagggguaagaguguauaugcuuuuuuauuccugaucuuagggcagggguguccaaucuuuuggcuucucugggcuacauuggaagaauugucuugggccacacauaaaauacacuaacaauagcugaugagcuaaaaaaaauugcaaaaauauaauguuuuaagaagguuuacgaauuuguguugggccacauucaugguccucggcuguggguuggacaaacuugucuuagggagaaagcauccugucuuuuacccccgaguaugauguuaguuguggguuuuuaauagaugcccuuaucauauugaugaaguuucuaucccuaauuucuuaaguguuuuuaauaauaauuuugucaaauuauuaaucgauguauuacauuaauugauauuagguuauuaaaccagccuugugaaaauaacucacuuugucacaguguauaaacauuuuauguguugccugucauagaaauacacacacacacacacacacacacacacacacacacgcuuguauuuuguuuagaguuauuccaucuauauuuguaagauauauuggucuguaguuuucuuuugaugcuuuugucugguuugguaucaggguaauauugaccucauaaagugaauugaaaguauuccuauugguuuuggaagaguuugugaaggacuggcauuaauucuuugaaaguucgauagguuacaucaaaugggucugagcucuuuuuuuuuuuuuuuuuuuuugcaggauggggcauaguauuuuaauuacuaaaucacucuuuuuucuucuuaugggucuauucagauuguccauucuuuuuuuuuuuuuuugagacggagucuugcucugucgcacaggcugggggugcaguggcgcgaucucagcucacugcaagcuccgccucccagguucaugccauucuucugccucagccucccaaguagcugggacuacaggcgccugccaccacgccuggcuaauuuuuuguauuuuuaguagagacgggguuuaaccguguuagacgggauggucucgaucuccugaccucgugauccacccuccucggccucccaaagugcuaggauuacaggcuugagcuaccgcgcccagccugguuaggcucugguaaaauaguuugagggcaaguuuucuaagaagaacaaaauacucugggaauauucaaaaugguuauccccaacccccucccccuaacugggggguagguauuuuucucucaucuuaacugugguaacaugcuagggguuguggagauaaaacuuacagaagcauggaggcccuucauaagacugguuucccugcggcuuuuaauucucaaaguugucgcauugcaccuccagcaauuugucaauuacacuagauuuuucuucccuaguacuaguuaguucccacagugguuucuguucuugggauucugcucugguaaguugugauucucuguguauguaccucuccaauuuuuggaacaauaguuugcccuucaucucaguucucugauggauauaagaagaguuuugauuuuuuaguuuguucagcuuuuuuuuuuuaugauggggaugggagugauuacuuccaagcucuuuauaugcuucaccagaccucuguuuugggguuuuuuuguuuuguuuuguuuuugagaugguguuucgcucuuguugccuaggcuggaaugcaauggcauuaucuuggcucacugcaaccucugccucccggauucaagugauucuccugccucagccuccugaguagcuggguuuacaggcauaugccaccacgcucagcuaauuauuuuucuuguauucaguagagaugggauuucaccauguuaggcuggucucgaucuccugacuucaggugauccaccugccucggccucccagagugcugggauuacaggcgugcgguuuugcuuuuaaacagacuuuaucuuuuagggcaguuuuagguucacagccacauugaaugggcaauacagaguucccaucugugcccugccccucuccauagccucccucacuguuaacauccugaaucagagaugugucuuuugcaaauauuuucuuccagucuauagcuugucuuuuuauucuuuugacaguguuuuucacaaagcagaauaaguuuuuaauuaaauccagcuuaucaauuauuucuuucauagauuauaugccuuuaguauuguauccaaaaagccaucaccaaacccaaggacaucuagauuuucuccuauguuaucuucuaggaguuuuauacuuuugcacuuugcauuuaggucuuuuuauacuuuugcacuuugaauuaauuuuugugugugaaggaugucagaucuguuucuggguucauuguuuugcauguaaauguccaguuguuccagcaccauuuguugagaagacuuucuccauuguauugccuucguuuuuuggucaaaaaaucaauugaauacauuuauaugggucuauuucugggccuucaauucuguuuuauugaucaaugugucuauuucguugauacaugcugucuuuauuacuguagcuuuaugguaagucuugaaguuagguagugucaguccuccaauucggagucuuuugccccuccauauaaacuuuagauugaauucauugauguguauuaaaaauugcugggauuuugauugggauugcguugaucuuaauagaucaaguugggaagaacugacaucuugacaauauugaguauuucaugaaguugaaauaccuucucauuuauuuaguucuuugauuucauucaucgaguuuuauaguuuuccucauauagaucuuacauguauuaaguuagauuuauaccuaaauauuuuauuucuuggguuguuaauguaaaugguauuauuguacuuuuaacuucaaauuccacuugauugcugguauacaggaagugauugacuuuuauauauuaaccuauauucugcaguuuugcuaguuuuacuuauuaauuccaggaaaguuuugucaguucuuuuggauuuucuuuuuuuuugagauggagucuggcacugucacccgggcuggagugcaguggugugaucucagcuuacugcaaccucugccucccggguucaagcgauucuccugccucagccuucugaguagcugggauuacaggcgccugccaccaugccuggcuaauuuuuguuuuuuuuguauuuuuaguagagauggaguuucacuauguuggccaggcuggucucaaacuccugaccuugugaucugcccuucucagccucccaaagugcugggauuacaggcgugagccacugcgccuggccuggauuuucuguauagacagacagucaugucaucugcaaacagaguuuuauuuccuccuucccagacuguguaccuuuuauuuccuuuucuugucuuauugcauuagcuaugaccuccaauacacuguuggacaguggugagaggguguauuaugucgucauuguguugcuaugaagaaacaccugaggcuggguaaguuacaaugaaaagaaguuuaauuggcucaugguucugcagaguaugagaagcuuggugccagcaucugcuucuggugagcuuacaaucaugguggaaggugaagugggggcaggcgucucacauggcgagagcagaagccagagagcaagggaggaggugccacucuuuuaaacaaccaggucuugugugaacuuagagugagcgcucacuuaucacuaagggaaugguguuaaacuaaucaugaaggaucugcccccaugauccagucaccuuguaccagaccccaccuccaacacuggggauuacauuucaauaugagauuugaaagggacagauauccaaaucauaucagagagggaauccuugccuuguucuugaucuuagaggcaaagcuucgaguuucauuagguaugauauuaguuguaggauuuuuuguagauacucuaugucaaguugagaauauuccccucuauuccuauuuuaaugagaauaucgugaagagguugucaaauguuuuuucugcaucuguuauaugaucaugugguuuuucuucuaaagcuugucaacaugauggauuauauuaauuguuuuuuuuuuuuuuuuuuugagacagggucuggcguugucacccaggcuagagugcaguguugccaucuuggcucacugcaaccucugccuccaaggcucaagccguccuccuacuucacccuccugaguaacugggaccacaggcaugugccaccauaccaggcuaauuuuuguauuuuuuuuagagguggcagaggggggucucacuuuguugcccaggcuggucucgaacuccugagcucaagugaucugcucaccuuggccucucaaagugcuggaauuacaggugggagccacuguguccagccuuaacugacuuuugaauguugaaucaaguuugcguacgugggauaaacccacuugucaugauguacaauacuuuuguacauuguuaaauuugauuugcuaauauuuugcugagaauuuuuacauugauauucaugggagauaauggucuguuguuuucuuuuuugguaauauguuugucugguauuggcaguaggguaauacagacuucauagaaugauuaagaaguauucucucugauucugucuucugagagauuuuagagaacugguacaauuuccuccuucaggguuugguagcauuaccagugaaccugucugggucuggugcuuucuguuuuagaaggcuauuaauuuaugauucaguguuucgaauagauauaggccucuucauuuugucuauuuuugugucagauuugacagauuaucuuuuuuaagaaaucguucauuuuaucuaggcuaucaaauuugugggcauagaguuguuuauaguguuccuuuauuauccuuuuaauguccaugagaucuguugugauguccucucuuucuuuuuucuuuuuuuugagacagagucuugcugugucaccgaggcaggagugcaauggcgcagucucccucacugcaaccucugccuccuggguucaagcgauucuugugccucagccaccugaguagcugggauuauaggugugugccacuaugcccggcuaauuuuugcauuuuuaguagauuuaggguuucgccacuuuggccaggcuggucucaaacuccuggccucaagugaucugcccacccuggccuuccaaagugcugggauaacaagagugagcuaccauaccuggccucauuuuugauguucauaauuugcauccuuuaucuuauuuuauuagccuggccagagguuuauugauuuuauugaucuuuucaaaagaaccagcauuuaagcuuuuacugauuuucucucuuuauuugcuauucucaauuucauugauuucugcucuacuuuuuauuuauuuucuucuccucacuuuaaauaugauuuauucuucuuuuucuaguuuccuaaguuggaagcuuugauaauugauuucagauuuuuuuccuaauauauacauucgguguuauaaauuucccaguaagcacuacuuuugcugcaucacaaauuuugauaaguuguauucuuacuuucauuuaguugaaauauuuuuaaauuucuuuugagaguuuuuauuugacccacaugcuauuuagaaauacacuguuuaaccucuuaaguauguugggauuuuccagcuauuuuucuguuauugauuucuaguuuauuuuuuccuuuauuguauauauuuauacaucaugauguuuugauauacauauaccuagugaaaugguugccauagucaagcaaauuaacauauucgugaucucacauaguuacugccuuuuuuuuuuuguggcaagagcuucuaaaauccuuuuagcaagaauccuaaauauaauacaauauuauuaacuauaguacuuauauuuuacguugaauugcuaaacuugcugauccaucauaccugcaacuuugaauccucugaccugcaucuccccauuuccuccccuguuccucacuucuacuucuuuguacuugacuuuaaaaaauagauuucauauguaagugagaucaugcaguauuuuucuaucuuccagguuuauucaugugacaaauggcaggaucaccuuccuuuuuaagguugaauaauauuccucccccuuccccuccucguguguauguguguguguguuaugugugugugugugugagugugaguguaugugugugugucuuguaguuuauucauucaucaauggaugcuguaguuguguucguggcuauugugauaaugcugcagugaacaugggagugcagguaucuguaugagguggugguuucauuuucuuuagguuuuuacccagaaauggaauugcuaggucauacaagaaaaguaguccuuuucuuucuuuucuuucuuucucucucucuuuuuuuuuuuuuuuuuuuuuaagacagaaucucgcucuguugcucaggcuggaguacagcgguguguucucaacucacugcaaccuccgccucccgaguucaagcgauucuugugucucagccuccugaguagcugggguuacaggugugcacuacccugccugguuaauuuuuguauuuuuaauagaggcgggguuucgucauguuggccaagcuggucucaaacuccuaaccucagugauccucccaccguguuuggauuacaggcacgagccaccgcgcccagucguaguucuauuuuuaauuacuuuagaaaacuuuauacuguuuuccgcaauugcugcacugguuuacauugccaccagcaguguacaaggguucucuuuuuuccacacccuugccaacacuuaucucuugaaucuuuuuguuuuuuaaauaauagccauccuaacaagugugagaugauauuucauuuugguuuuaauuugcauuucccugaugauaguaauauugaauaucuuuucauaugcugauuggccauuuuucuuuucuuuuuuucuguuuuggagaaauguuuguucagguccguugcccauucuaaaauuagguuguuuguuuuucuucuacugaguugcacaaguucuuuauauauuguggaaacugacuccuuaucagauauaugguuugcagauauuuucucaucuguaguagacugucuucucauuuuguugauuguuuacuuagaugugaaacucuuuagcuugauuuaguucuauuuauuuauuuuugcuuuuguagccugagcuuuuguugugauauccaaaacaacauugccaagacaagugucaaggaguuuuucccauauauuuucuucuagguuuaugguuuuaagucuucauguugaguucuuuaaucaacuuugaguugauuuuugcuggugguguaagauaaagguccaauuucauucuuuugcaugaggaaauuuaauuuucucagcaccauuauuugaagagaucuucuauucccuauugugucuucuuggugcccuugucaaaaauuagcgaaucauauaugcuuggguuuauuuuucucucucuauucuguuccauugguuuacaugucuacuuuuuaugccaguaccacacuguuuggguuacuauaacuuuguaauauaauuugaaaccaggaagugugcuuccuccaacuuuguuuuugucuuacagaauuacuuuggcucuuuagagucuuuugugguucuauaugaauuuuagauuuuuuuuucuauuuuugugaaaaaugccauuggcauuuucauaaggauuguguugacuuuguauugcuuuggauaguacauacauuuuaacaauauuaauuauuucagucugugaacauggaauaucuuucuauuuauuuguguccuuaauuucuuucauuaguauuguaguuuucaguagacagaucuuuugccuucuugguuacauuuauuucuaagucuuuuuauuuuguuuuuugaugcuaucauaagugggaugguuuucuugauuucuuuuucauauaaguaguuauuuguguacagaagugcaacugauuuucauauauugauuuuguauccugcggcuuuacuggguuuauucuuuuuucuuuuugagacagagucucacucuguugcccaggguggagugcaguggcucgaucccugcucacugcaaccuccaccuccuggguucaagugauucuccugccucagcuucgcaaauagcuaggacuacaggcgcgcugccacaccuggcuaauguuuacauuuuuagcagagaugggguuucaccauugcuggucaggguggucucaaacuccugaccucaagugauccacccgccuuggccucccaaagugcugggauuacaggugugagccacugugccuggccuauucauucuaacagugucgauuuuagucuuuggggguuuucaguauauaggacuuuuuccuuucaauuuauauuucuuuuucuugccuaaucgcuuuaguaggauuuccagugcuauguugaguagaagggugagagcaagcaucuuugucuugcuucugaucuuagaggaaauguuuucaguuuuucaccauugaguaugauaugagcugugggacauacagcuuuuauuauguugagguaguuuucuucuguuuauagucuguugacuuuuuuuuuuuuuaaauaaugaaaggguguugaauuuugugaagugcuauuucgguuucauuugagaugaucaugugguuuuuguccuuccauuaaugugguguauuacauugaucaauuuuuguauguugaaccauccuuguauuccacgaauuccacuuggucaugguguguaauccuuuuaacguacugcugaauucuuauugguaauauuuuguugaggauuuuuacaucaauagucgucggggauacugguuuauagucuucuaaugucuuugucugacuuugguaucaggauaaugcuggccucauagaaugauuuggaauguucccuccugugcaauuuuuugggauuguuucaggaggauugguguuaauucuucuuuaaauguaugguagaauucuccagugaagcuuucuuguccuggaccuuuuuuuuuuuuuuuuuuuuuuuuuuuuuugagacagggucuuacuuugucacccaggcuggagugcaguggugcaaucucagcucacugcaaccucugcccuccaggcucaagcaguccuccuaccucagccucccaaguaacuguuaccacaggcaagcaccaccauguccagcuauuuucguuguauuuuuaguagagacaggaucucaccauguugcccaggcuggucucuaacuccugagcucaagcauuucuccugccuuggccucccaaaguacugggauuacaggugugagccacugcgccuggccaugggcuuuucuuuugugggagguuuuggauuauugauucaauuuccuuguuguuggucuguugagauuuucuuauuuuuucauguuacucagucuugguaggcuguguguuucuaggaauugaucuguuucuucuaggcuguccaauuaguuggaguacaguuguucauaguauucuccuaugauccuuuuuauuucuauggcauugguugucauguccccucuuucauuucugaauuuaguuauuugaggccuuuuuuuuucucagucagucuagcuaaagguuugucaguuuuguuuauauuuucaaauaacuauugguuuucuugauuuuuuuccuacuguuuuucuauucucuuuucuuuaucuuugcucuaaucuuauuuuuuccuucugaucacuuuggguuuaguuucuuuuucuaguucuucaagguguaauguuagauuauugacaugaauuuuuuuuuuuaaauauaggcauuuacgacuguagauuaccuucuuaguccuacuuuugcuacauucaauaagcuuugguauuuugugcuuuaauuuuugucuuaauguauuauuuccuuuguuacuucugucgugacccauugucuuuuuaagaguuuguuguuuaauuucuauaaauuucuugauuuuccacuuuucuuucugcagcuaccuucuaguuucauucuguugugaucagaaaagauaccuaauacuuuguggccaacaugugguguauccuggggaauguuucacgugcacuugagaagaauguauauugugcuguuguuggguggaguguucuguauauguauguuagguccaauuggucuguagugcuguucaggucuuuucuuuccuuauugaucucauucuauccaucauggaaaguugguuauugaagucucucacuguuuuuggagagcucccuucaauuuuaucaauguuugcuuuaaguauuuaggagcuccaaugucugacacauauauaauuauuauaucuuauuugugcauugaccccauaguguucuccuuugucuaugguaucaguuuuguuuaaaaauguauuuucucugauauuaguguugccgcuauugcucucuuuugguuaccauuugcauggaauaucuuuuugaaucuuuuuacuuagagccuguguguguccuuaguuccaaagugucuuuuaaacagcauauaguuggguccuguuuuuuaauccuauggguuuuuuuuuuuuuuuuugguaauuucuuuguccuuucauagcuuguuuuucauuuccuccccuucuuucuuuguguuuagucaauuuuuuugguagggauauauuuugauucucuuauuuccuuuuguguauauucuguagcuauuuucauuguaguuaccaugagaauaucauaaaacuccuuaggaggauaacaaccuguuuaaacuaguaacaacuucacuucaaucacauauaaaaacucuaguccuuuauagcuuugccccccaaccuccaccucccggguucaagugguucuccugucuuagucucccaaguagcugggacuacaggcacaggccaccaugccugacuaauguuuacauuuuuagcagagaugggguuucgccauuguuggccaggcuggucucaaacuccugaccucaagugauccacuugccuugccucccaaagugcuggauuacaggcaugagccaccgcaccuggccaaaguuauuaguacccuguuaacaacauuuuacuggugucacaaguaacauguuuauauauuguuuaaccauuaacauacuuucuuaguuuguuuucucuugcuuauaacaauacuugaaacuggguaguuuauuuuaaaaaguuauggaggcugagaaauccaaggucaagggugagggccugaugagggccuucuugcugauggggacucugcagaauccugagguggugcagggcacauggugaggggguugggcaugcuagcucaggucucucuuccucuucuuauaaagcuaccaguccacucucaugauaagccauuaauccauuaauccaucaagucauuaagccguucagaucugcccucaugauuaauucauucaugagagcccagaucccugaugacccagucaccucugaaagguucuaccucucaguacugccacauugcggauuaaguuuuaacaugaguuuuagaggggacagauacucaaaucauagcauguagauuuauaguuaauuuuuaugcuuuugucuuuuaaauccuauaaaagaauuaagguggaguuacucaccagaauuaaaauaauguuuuuauauuuguccauauauuuaccuuuaccagagaacuuuauauuuuccuauggcuuaaaguuacuaucuagcauccuuuaauuucagcuugaaggacugccauuagcauuucuuccaggugaggucuagugguaaugaacucucucagcuuuugugaauguuuuaauuuucccuuuuacaggugcaugccaucaugcccagcuaauucuuguauuuuuaguagagacgggguuuugcuauguuggccaggcuggucuggaacuccugaccucagguaauccuccugccuuggccucccaaagugcugggauuacaggugugagccacugugcaccuuguaucuuucuuugucuguucgaggaucugagauacuauuuuaaaguccuuuggaaguauaguuuguaaucggauuuuuaguaagaggguuauuuuuuuuuucucuuugugugcauucuucucuaccugcucuuuuugugguuguuucugcuuuguccuuuauggcaucuucuuuagaaggaaaucuuauauuggaagcucuggguucuuauucuucaggguuauugggaaaaaucucaagaaccagucccugaaccaguggguggcuugaccaggucauuuuuguuuuauugccuguaaucuguccauuuguguuccuucagccuuuggcuauggucacaacguuuauugccuucuuucacuaguaggagagcgcugcuccaaccccuuacuucacaaaaugauucugacuuuuguucccacuucuugugcuaugaguugauuucagucccuauuauugggguugauuuuuaacugucucaaccaguaagauuuaaaaauagacaacuugcuuguuucuguuugcugcuuuuaccucuauggguaaaggagguuaaggaacugcugugguuuaugcaaaaguaugcuguguccuaacugaguaaccuuaaggauaauagcuuguauaaugguugugaaaucaaaaugucguauaugugaaagggcuuuauaaacugggaaguauggucuaaauauuaguuuauuuuuguuguauaaucauagugauuguguuauuacucuauuuaagccugcuuuugauuuucagauuguuccauugaccugucauguauggcaacagauaguauaucaaggcaauaguagaacacaaauuucugauacuaauguggucuguuuggaaacaacagcucagcgggguucuggggaugaucagguaugucuucuguaacuggcuaacuuuuuuuuuuugauaagcagcacaagaaauucugauuuagcuaugaagaauggaaaaauaaauuaauauucauuaauauuauguuuucuugucuuuuuuuuuuuuuuuuuuuuuuuuuuaagacagggucucacucugucacccaggcuggagggcaguggcaugaucauagcuuacugcacccuccaacuucuaggaucaagugauccuccugccugagccucuugaguagcugggacuacagacauauaccaucaaacccaccuaauuauuuuuaaaaaauuuuuuauagauggagucucgcuuuguugcccaggcuggucuugagcucuuggccucaaaugauccuucgccuuggccucccaaagugcuaggauuacaggagugagccaccacucuuggccaaauauucuauuuuucuaauagauuguuguaaacuuuauguauauguagaagagcaguucacuuuuuuugaaggcgggucucaggacucuuauuuuuauuuuuaguuuaaaaauuuuuuauagagaugggagucucuguguuuacugggcuggucucucauuccuggccuuaagugauccucuugccucggccuccuaaaacuaugagauuacaggcaugagccacugugccuguccucaggacucuuuauauucuucacaaguauucuuaagagcuuuuguuuauguggauuaucuauauagauauuuagcauacaagaaauuaaaacauuuaaaacuauuuuaaaauuuauuuugaaagaacaaaccuauuacauauuaccauaaauaguauauuuuaaaguaaaaaaugacuguuuuccaaaacaaaaaaauuaguuggaagaauagcauuguuuaaauuccggcuuacuagaacucaguugguauauuauucaggguucuccagagaaacagaaccaauagguuggagauagauacaucuaucuauuuauacacaucuguguguauguguauauauauaucuuuauugauauuuauuauauagaauuggcuuaugugaucaugaagacugagaagucccaagaucugcaagcuggagccccaggagggcugaugguauaguuccaauucaaguccaaaggcuugagaaccaggagcaccagugauguaaguuuugaucugaaucugcagguagaauacccuccagcuggaagaccaucaggcagagagaacacauucucucuugcucagccuuuuguuguauuuaggccuucaagguacuggaucaggccuacccacauuggagaggguaaccugcuuuacuuaguuuccagauucaaauguuaaucucauucauacacaccucacaggccaggaacaguggcuaacgccuguaaucccagcacuuugggaggcugagguggguggaucaccugaggucaggaguucaagaccagccuggccaacauagugaaacacugucucuacuaaaaauacaaaaauuagccaggcgugguggugcacaccuguaauugcagcuacuugggaggcugaggcaagagaaucgcuugaacccaggagguggagguugcagugagcugagguugcgccacugcacuccauccugggcgauggagcaagacuugucucaaaaaaaagcaaaaaaacccaagaaaacaaaacaaaaaauaccacacacauacacacaccucacagacguauccaaaauuguguuuaaccaaguaucuggacacuccaugauccagucauuuugauacauaaauuaccuaucauagcuggauucucagucugcucugcauuucauuuguugggauguauuguuuugguugaaguauaugaagacaaucuugccuuacauagaugaaaaaggaguuagggaaaggaggcugucauucagucccugaaagggugucagugacccucagggauuuuuggacuacacuuugagaaccacuuuucuagaacauaguuauaaacuuugaagaaaugaaacgaucaugagcagauaggaaaaaagcucauguagaguuauuggaggaaaaauguuauuaguguuacuaauaaugguuaaauauuuaagguugauuaauaacuugaguaucagauuucuccuauuaccuucaguuuucuuuaaauugcagugauuaccuguuagaugcaagauauggaggaagggagauacacuaucacugaggcaaaguaguuaagacaaucccugaccauaaaaaacauaguaccuggggccauuaaauggaagaggauuguuuugggucgaauugugcccucccaaauuauauguugcaguccuaauccccaauaccucagaaugugaccuuauuggugauugcagguguaauuauuuaagcucacacuggaguaggguuugcucuuaauccaaucuaacugguguccuuaugaaagaggaaagcaccaugugaggagaaaaacauacaaggagaagauggccgugugaagauggaggcagaaauuggaauuaugcugccacauccagggaaugccuggggcuuccagaagguagaaguagcaaggaaggacccuccccuaggggcuucagagggagcaugacccugccaacaccuugauuucagacuucuggccuccagaacugcgagauaauaaauuucuguuguuuuaagccacuuaguuugugucacuuuguuauagcagcccuaggaaacuaauaccgggucauauuucuaaauaauauucucugagggcauauuuuugguagagcacaguccaaaaauugaugucuuccuuuuuuuccuguuucacacaauacgaaccaugauggacccuaaagcacuucauuucauccuuuacgccuggguucgucagaauagcuggaauauuaugccgcuuucuaguucacuuccuucuuauucuuucgucguucaucuuuguuacugucaucugaguuaccuuuauuuauucauggaaaacuagcucuugcuacauugucuuccucucuuuuauugguuucuuucacuucagcauacauuucccauucagugccugaaguucucauauauuucaucuaaucuccagugaucuuuacuuccguaccuccuuccagucuucuccuaccuguauguaguuacucaucccaugaucacagucuaucuagacuuugucaucaccagcuacuuuacuacaaaugucucguccucucuucccuuccggcuacugcuucggucaauauucugcucccuguuacagugaaauuuucaagaguugucuauacauuuucuguuucuguuuccugauauccuaugcucauuuuuaaaaagucagguuuauuguagguauagguuaaacauaucaaaauuuacucucuuagguguacaguuugucaagugagcuuugacauacguauacagucaugcagucaccaccacauuugagauagacagcacugccuucacaaaaaggaacgucacaaaaaguuccugugugccccuuuguagucagucacuuccccaacuccuagucccuggcaacuacuuauccaauuucuuucucuuuaguuuuaccuuuucagaauaauacgguguguagacuuuugaauuugacuucuuucacuuggcuuagcuuuugagauuuauccauguuguugcauguaucaauaauuuguccacuuuaauuuuuauuacugaguaguauuccauuuguguguagguuuuucgguagacauacugcuucauuucucuuggcaaauaccuaggaauggcuggacgugguggcucacgccuguaaucccagcacuuugggaggccgaaguggguggaucacuugaggucaggaguuugagaccagccuggccaauaugguguaguagaaaccccgucucuacuaaaaauauaaaaauuagccaggugugguggcacaugucuguaaucccagcuacucgggaggcugaggcaggagaaucgcuugaaccugggaggcagagguugcagugagucaggauggcgccagugcacucuggccugggugacagaaugagacucugucucaaaaacaaaaaacaaaaaacaaaacccuaggaauggguuuguugagugauaagguaauuguauguuuaacuuuauaagaaaguaccaaacuguuuuuccaaaguggcuguaccauuuuguaucccaguaguauaugagaguucugauugcccugcauucuuggcagcuguugguaucaucaguuuuuucuuuuuuucuuuuuuuuuuuuaauuuuagacacccuaggagauguauuauuggugucucacugugauuuuaacauucauuucucuaaugacuaaugauauauagcaucuuuuugugugcuuauuugcccuccauguuucuucuucagugagagaucuguuaaaaucucugccugauuuuuuguggcugguuuguuucauuuuuugagcuuugggaguucuucauagcucuagaugcaaguccuuuaucaguuguuucuuuugcagagacagucuguggcauguuuuuguauucuccugucuuugaaaggcagaaguuuuaauuuugaugaaacuuguuuauugauuuuuuuuccuuuuuugguuuauauuucuuguguacuaucugagaaaucuuggccuaauccuaugucacugagauuuuucuucuauguuuucuucuagaccaggguuucucagccuuggcacuauugacauuuuggguugaauaauucuucauagugggggucuguccuguguguccuaaaauguuuaacagcauuccuggccucuucccacuagauaccaguaauagucccccaauuuguaaccauccggaaugcuuucugacauugccaaauguuccaugguugaagggagaggcgugucaaaaucucucccaacugagaaccgcuuuuucagaaguuuuguaguuuuacguuuuacauuuaugucuaagauccauuuugaguugguuuuuguauauggugugaaggaagcauccaagcuguauuuucuuacauaugaauauguaauuguuauucuagcaccauuugcuaucuuuuuuuccaguggauuucaugacaucuuuguaaaaaaauuaauugaccuuguauaugugggucuauuucugcacacuauuccauugauuuacauauguauccucaugccaauauuacacucuuaauaacuguacugucuuaaaaucagguugugugauuuuucccacuuuguuccucuuuuuaaaaauugauuauuucagauucuuggaauuucuauauaaauuuuagaauuagcucgcccaauuuauauuuuaaaagccugcuggaauuuuuuauuaagauuucauugagucuauaaaucaauuugaaaauaauuuugacaucuuaacaauauugaguuuucuaauccauaaacaugacaguucucuuaguuuauuauuucucuuuaaugucuucaucaauguuuugcugucuucagugugccaaucuuacacguuuuguuagacuuacugguauuuuuagaaauuucuauuuccuauuauucauuauaaguguauagaaauauaauugacuuuuuauauugaccuuguguccuauuaccuugcuaaucucacuuacuaguuuuaguagcuuuuuuaaaaaaauauuuccuuuaggacuuuauaugcagaguuauauuaacuaugcuuuguuuuuuacuuuuaaauagauaugucauuucuuuuuuuccguuuuuuuuuuuuuuuguuuuuuuuuugcuuuauuacacuggcuaggaucugccuauucuucuacuugaucuacuuuguguucugaccccaauucuuugaaaggaaguaucaccagcaauauuuauguagcugaauacagugaauacuuuucuguccuccucuuagguacgauaaauagcauuugacacuauuauuaaucauuacauaacuucuuuaaauuauuuccuuucuuggguucuucugguuuuuuuucuacucaucuggcuguucucucucaguauccuuugcugcuuuaucuuccuuuguuaaaccuuagaaucagaauuuguaagcuguggacccaaguaugacucaaaugugguuuucaaaaaccauuuuuuuuggcauaauguuuuaacacuuuugaaauagaauacuuuaaagugaacaugcauaguuagccacaaaucccauuacucuccaauuccagguuggauuacuucauuugucuuacccccauaccccuauacacauuuaguuuucaaccucugcuugaaacgcuggaauguucgcggucucauccagauccaggacuuuaaauacaucuguauacugauaaaucccaaagauguaucucaaacuuuuuuucucccucaaaauuuguuuguauuugucagaaugcuuauauguugucccuccccacaucugucaaaaauauuuagagauuuguuggccuuuuuauauugauuuaaaagguauaacacaaagaauauuugaugauugaaauguaucaagaaaauacauaaugcagaaaguuaaaaaagguugaacagagguuguuuuaaaaauucaguuuauaaugggaaauuauaagaauauguuugcauaggagaggaaugauucaguaaugagagaaaaaugggugaaggaaagugggagaaucacauaggaaggaaaucacugaaaaaaauuugaaugagauaggaaggccuuugagaggcagagugacuuuuuuuuauuuucaagucauaagauagaaaucugguaauggggauuguagaucuggugguugaagacaagggaguuccucucuccugcucuacaauuauugaaggucaucaguugaaaauuaggagcguucaauaguucugaggagggaagguaugaaaucucaacucaccaggaaaauguaguaggauuuccaggcaauauugagugcccuucagguuuagugacaucaauuuaaagaaaagccagucaguuugggagugugauuucuccagcaacgugcugcugauuggauucaugcaaggagacgguuccaucaguguuagcuuuugcugagcaaauaggauaaugggagaaaaacgcaagaaaguuaaggguguuugcaaggcagugauuauaaggauggcucugaacucucagaggggcaaagaaggaaauacagauaagaaaggaauaaagaaaaguauaaaugugauaggauaguugucuccgugaaguuaaaaaauuauugcaguagaggaacuagagaguaagugaucuguggaggucagaggauggacagaaagacuaauggauacaucugucacuauuagagaggagugaacuaugggauacaggcucaaaccauggucagagaggcuaagagaugacucgggaccagugauuuuugcuuuagugagucacaagaugauuggaauucugcuuuaaaaccuuuuguuggcucacuaaccuguccccuauagaaaggagugcccucuaaagaaaaaauguaaaauuaaucauucucauauuccuuuuauuuucaaguaucagaaaggugaaaagcauguuuccaguagcaauuugauguuauagaucugauuaauuuauucaguguagaagggauugagguauuuuggaaugucaaaagucugcuauuccauaaauguagcauuaauauucuagaauauuucucuccacauuuuuuucuuugcauguauuuguauaacugauauuauguaguggauaguggguaucuuuuuucuuaaacuuacuauaugaacauuuuguuaaugaauuuuaaauauuagaaaugucucuucaaagacaaaagucuugcuggaaaauguuugcgaaaauauuuguaaauuguaauacaucuucuuuuuauggauucuguaccacccgggaauuaaaagauaccuauauucucuuagaaacauuugaguugaucaaggaagaagaguccaguaguggaauacuuacaaaauaaugaaaauacauuauaugucuaaaguugcugucaauauaaugccacuuucucauguuuuuauuuaaauaaauaaagcaaauugaaugaauuauuuaaccaaagauuuuacauaaagacucaaaaacuuguaaucccagcacuuugggaggccaagacaggggaaucgcuugagucuaggagguccagaccagccugggcaacauagugagaccccugucucuacaaaaauuuuuaaaaaauuaacugagugccugccaguagucccagcuacucaggauacugaggaugacaggaucacuugagccuggaggcagagguugcagugagcugagauugugccacuguauucuggccugguuaacagagcaaaagccugucucacacacacaaaaaaagaaaaacugcaaauagaggaaacgugguaaagagaaaaacaaguuauaaaauauaauacaguuguuaaauucaagaaauagagaaaaaauagauauauuccuaguaaauagaguugcgaaaaaaaucucaaugaaauagacuuucuacaaaacuaugaguauuucauagagguagacuaggauuacugaggaggaaauugagaaaguuauguuaguaccagcuaucaaaaagauuuuuggaacuaauagauuugcugauaaaucuuuuacauuuuuaaagaaaauugaaguugcuuaaauaaauacagaacaacguuaugaaacaagaaaaugagggcauucuaaaauacugauuaaucuuaguugugaccauauaugugugaaaauguuaaagaauaugcuagcaaacauuuaaacgucugaucuaccacuacuguguaagaaaugugaacauguuucaauauaaagaaauuuugugacuugggaggcugaggugggaggauuaagcgcuuuagcccagaguuugaguccauccugggcaacauagcaagaaccugucuaaaaaaaaaaaaauuauugcuauccuuuaucagguuuaauuggggaaaaugaugcuauaacauaguuugagcuaauuuaguguucauuucuaaucaaauuauuugaaaaugaaaauacuuucauaucaugauagacuauacuuaauuauuaacuaauauuaaauucaaaaggaaaauaccuuuuaaacuugucaccauuaguauuuaauacgacuuuaauucagcauuguuauuuagugugaucuguagauuggugccaguccaugauuugcuuguuacuggucugucaagagguaaguauagaaauugagaggaaguguuuagaaacuuuuauaguaguuggauagaguaauuuuaucuuuuuuuagaccuagaaaucaaacauuugggcuuguguuuuauaucuugggcuuauaguaagacuuuuaauuucauuuuucuaguuauuuuuacugguuuuaaaaauuagcuuauuucucauuaauuuuuguuagcauuuuaguaaagugucaguaugugaugacuuggaaguaggaaaaacugguucuucccuauagguaguuugagaagcaguucucuggaucuugccacuaauuuaagaguaaauauuugaaggagacaaguguaucacauucaugggugauaugauaauguuauauauacugagaagagccagggaucguuuagaaacuaguagagcuaauaaaaauucagucaagugaauucccaagcuaaagcugaagugaaugcuucaguaggucccaugaaucggcccagcccuugcgugcaccaaguuuggccccucuagcaucgccgccacgaagaaaguggcucaacagcuuuggcugaaggcccggcucaacuguguaaaaauuucccaggcagcugcagacuugaaacaauucugucugcagauugcuuaacaugacucucugcugacuggaguaucuucaaguacaaauuccuucauaccccagaaagucuguuccuuuuuguaguaaaaugaaucuuucagagguuucccaagccacuucucaugauacagugaauauucaaaagagagcuacauuugaagccuguacaaaagcuuauccccggaacacaugugccauaauauacaaacuucuacuuuugucaguccuuaauaucuaccucucugaauuuucaugaauuucuauuucacaaggguaauuguuuuauauacacuggcagcggcguacaauacaacuuaguauaaaagguuuuuuuguguuaaaaaaagauguguaguaaugggaagaggucuaaaauguaguuaauauugugagaacaacagcuuuacauuuucuauacuuugaugagaaugucauuaaauaggaagcuauauaauacaugaguggacauuuucaucuaaauauuaauauguaugguaacucaguuaaugacuuagcauguuuuccuuuaacauuuuucuagaaaacagaaucuuggcauugucuuccucaagaaauggacucuucccaaaccuuggauacaucccagacuagguuuaaugugagaacggaagauacugaagugacagacuuccccucucuggaggagggcauauugacgcaaucagaaaaucaaguaaaggaacccaacagagaucucuucuguucuccacugcuagguaaugccuguuuauuuuaacuaguaguaauaccucacauuuguaaguuuugcggggacugcaagucuuguaacuuuccccuuuuugaguuaaggagcucuguagagaccuacucagagggauuagcuuauuucuguuuuguuuguuuguuuguuuuuuacuggcuagcugaucuaauuauauuaagugugcaguugccucucauuuuaucacuucccguugcucacagaaggcagaaaggugauaacugucuacugugugugccuccucagucuugaauuugcagaguuuuugggaugaauaguauacuuugguuaucucagcaauggagacuccaugaucccccacaaaaaacaaaaaacaaauguucauauuuaccuuuuugauuuuuagaauuaauuaaggcauauguuauuauccuuagcuuucaaaccaaaaauugagauaaagagguugaguggcuugucugagguagaucuugcugcuuuccucuguuuaguauggaacugauuuauuagcucuuuauaaaagauaaacuuuaaguacuuuuaaaaucauuaagggauucaauuaugaagaugguuuuauaguuuuguagagaagcaugaauagaacuuaauucagcaaguucuuugccaacauaaacuaaugcuauccaaaucaagguauuagugccaacguuuucuaugauguggauuauuaaagucaauuuuagguccacauuuuaagaaagguugacaaaauuagaguaccuuugugggaggagaggacuaucuuuugauagacaaaagagaagacuuugcuauggucaaauauuugaagggcuguuaugcuaaaaaggaagcaacuuauuuuuuauucauucauguaacaaauaucuaagugccuccuauguguuugaugcuagggguauauagaugaaagcuaccuccucuucugggaaggcaauccaguaaacagaaaauaacaguaccaugggauuuguauuauaaugguguagagcaggagucugcaaacuauagcuuacaggccaagucuugauuuuguacuguccaucugcugagaaugauuuuugcauuuuuaaaggauuguaaaaacaaacaacaguaguauguaugaccaacaaaaccgaaaauauuuaccaucugacccuuuauuaaaaaagguuugcuaacuccuagaguuuaaaauggauacauaacuuaaagggaagcuauuuuucaaauugauguaaaaaagagcuuucuaauagagccauuuaauacuaaaaaaggcuauauaacaacaacaaaaagugagcuucaugucacugcaaaaugucuagcaaaauucuguauuaggauuuuagcacuggggaggagauuguacuucgugaccuaaaauguuuucuaauguaaaguuuuauaacucuggcuucucauuuacuauaguuagggcagaacauuuuaaauuauuggaguagauuccuggaucucauaggcagaggaaauuuuaucauugcuguuuuguuacgcauaaguacuaacauugugauaaauaggcucucgccaauggcaaauguaauugaugauggcuggugccagaaugguuagauaccucaaaaaagagggaugcaagccaguaacagauauccacacuugaggaaacaagaagcaguugaaagcuguaagaaaaaggcauggcaaguaaaauacaccaccuucccaucacacacacacagauaauguuguacacuugagaaucauuaacucuucagcuuuggccugcuccuuuagcaaauacauuugccuauuuaugugauuuaacuguccaacuccacccugagauauucuuaaauauuuaaggagaugcugaaaugcugcuuguaacuuacuuguuacuuacuauuccuuacuuauacuuaaauagcuauuuuagguacugaggauuucuguagguucugaaaccuaguuaggguuaacucuaauuuuuuuugagaaaagacugucagauucuuuaaauacucagccugcaguuaacuggaaauaguaaauuugcuuuacuugcccaaaggucccccuuguagcaucagcucuaguguauuuggggacuuuguuaaaaacucuucaugaguuuuagaggggugaaggacuguuacggagguuuaagacugcuucucugugccaagaccaaagaggaacuguaccaauuguuccuugguggcaaagguuauuguuacauaucaguuuuucauuuuuaauuaauucauucaguaaauaaauaacucucuuuugaguaccuuuuaaguguagcagguacuuugcuaggcacugaggauauagcuauggauaaaguagacacaguugacaauuuagaugggaaguggauagacugaagauuaaaacaagagggugaugaauuauauggaagguaugcaggguauauaagcagugacaguauguguuuugacuaaguaaaggacagaugacaacauggugagcucugugaacucuagauuugcaguaauuucagggggaacaguaaugugagagaggaguccucacuuuguacacaguguugcaggcauucugaaaucaagaaaguauacugauuaaaauaagaaugauuuaagucaacauucaggaaaucacaagaauuuuuuuuucauuaaagcagcaguucaaacuuuuuggguaacaggauucuuuuacacuuuuaaaaauuacugacaacuccaaagagcuuuuguuuauuuggguuauugauauuucccacauuagaaauuaaaacugaaacauuuaaaauguauuuauuaauucauugaaaaaguacauauuuuauaaaaaauaacuuuuccaauacaaaaauguuuagaaguauggccauguuuuacuuaaacaauucuauaaugucugacauaauagaaaacaucaagacucucaugucuguuucuguauucaaucuguugcuguaucauauauucuguagcuucuggaaaaugucacuguaucuuuuugagagaaugggagugaauaaggcauaugauaucuuaauauuauuuugaauaaaauuuugacauuagguacccccuaagagugucuuagggcccaggagcuccugugcuaugcuuugacauaacggguguagucuauauuauguaagaugggaagaaacacucauaauaguuaagagcguuugcuaaaaguugaaaugcuuggguucaaaucucacucuggcauuucagcuacuugaauguggacaaguuacuuaaugcuuuguaaguuuuguaaucauguuuccucaccuauaagauauauauaauaauaccuaucuuucaagguugucaugaggauuaaaugaaauauuguguguuaagcaccuggaccuugucagacucucaauaaaugguagcugcuacugcuguugcuuuuauauuauuauucuaaugcuuguagaauucuccauauggcagcauauguaggugcuuuaaaguauuauauacguaaguaaauaaucaauuuucagcauuacccagcauuuaauauuugaaacuuuacagucauacaagauagcuuugcuucuccugauuugccuuugcugaccuguuugacacaagaccaagaauuugcgccugauucuuuauuucaucaaagugaacuaaguuuugcaccucugagguaggaugauuuauuugcauguaaccuuucucacuucuuguucuauguuuuuacuaauauuagugacuucaggcuaaggugggacuuugagguggggcuuagauacucuuaggacacgcccugaagguaacaaaguccuguacuaagacuugaugcauauuaauuuggcagaguaacguauguguagagaugaaccagaugacaguaguuuauuuaaaaauaauuccuaauauauucaggcauuucaggcauauuuuaauuuagaagacacacuggauuuuccuucuuauaaaccuccccaucugcugcccaucaucucucuccucccucucacccuuauucugcaaaaagcauuuauuucuuguucacuaacuuguuuggcacucucauuuuguucagcuguuauugaaugagacuaguuagcucuccuuaccuuauaggaggugucaauaugaaguaagaagauuuuuaugaacagacauauccaaaugaacagauacuccaaauucauguccuuuagaauagucauaaugggagaaaagucuggaauuuucaaaacauauuuggaauuauucaagaauauguuuucuucuuuuagaauugaaaacccaccuuaaauuaaaaacuauagauguuuagaaaguaaaaaguaaccucuguccuuauacuauauauuuaccugauaucacuuuuaugaaaagugaucuauacacauuagaucaucaacuaaugauuaaguuacuguuguguuuugggaauagaucacuucuuaagugguuucuuucucuuucucuuuuuguuuguuugcuuuuuuuuuucuuuagauggagucuugcucuguugcccaggcuggagugcaguggugccaucauggcucacugugaccucuaacuucugggcucaagcaauccuccugccuuagccuccacagcagcuaguacuacaggcaugugccaccaugcccagccaauuuuuaauuuuucuguagagauagggucuugccguauugccaaggcuugucuugaacuccuggcuuuaggugauccuccugccucagccucccagagugcugggaucauaggugugagccacugugccuggccuugcaugguuucaagagcacaauaaaugaugacuaguaaaaaaguuaacgcagguuaaaugaaaaaucaugguaggcgucauuaugaaaaucacauucugugucuauuguuuuaggagaagucugagauaauaucaggguuauagggugguaguucaccuuuuaguuaaaaagaauuugcuuuacucagucauuagccaucuuagaagagucugaaauuaggagagcuguguuuuucaauacacuuuucaaauaaacuugauuucagugacauauguauuuuuguguuaguacuuaaaaauuaaauguuuuuaauguuauuuauuuauuuauuuuuaacuauauauuuucaggggaauuccugauaagucugaagauacugaauggucuucucgaccaucggaaguuagugaagcuuuauuccaggcuacugcagaaguagcuucagacuuagcaagcagucgcuuuaguguaucucagcacccgcuuauaggcagcacagcuguugggucucagugcccuuuuuuaccuucugaacaagggaauaaugaagagacuauuucgucuguugaugaacugaaaauucccaaagacugugaucguuaugaugaucuuuguucauauaugucauggaagacacgaaaagauacacaguggccugaaaacaauuuagcugauaaagaucaaguuucaguugcaacuucauuugacauaacugaugaaaacauagcuacuaaaagaagugaccauuuugaugcugcucguucauaugggcaguauuggacacaggaagauucaucuaagcaggcagaaacauauuuaaccaguaaguacccugauucuuuuucagauucaucugacacaauugauaaaaauaaaauucccaagggaaguaacaauuuuaguguccccuuuuccuaugugccauggaacaaagagggaacuuugcaccacccagaaacguguguaaucaguaaggacuguuuuuccuuuccaugugaaguugcugcucaucaucaucaucauaaaaugucauauucuuucuuguguuguuuguuggaaagaagaggaaaagggguucccuugacuucugauagucauuauuuugagaauguuuauuuaagggcuccagcugagauugaggugaaacaaaagauggauucuuuggaggguuaugaaagaaaugaagaagguuuacagaaagaaucaucucaauguuuugaacuaacggagacuagaaauaauuuaguaucuucagaagugcaacccagauucuuagaaauacaguauauuaggaauguuauagcuccugauaauucuguaaaaguuucagaagcacauguacucuccaggggacauaauaccucuaaaauggaggcuucugguuggauuguuauauccaacuuggaugagauaucagaacaacuguauuuucaagaggaaagaaaccaaaagggaacuucucuuuuuggugagaaaaauauugaugcugcugaaaauauagccuuugaggcaguuauugccucuauugagccuucuaagaaagagaguacaguaaaugaaauccaagcugacaucaauaaauauuuaacagaugacagccgagagagagccaaaaaauccagaucuuucuccauuaaauuauaaugaugaaaccucuuuauuugauaggcuuaaacauccaugcuaucagucuacuccugggguguuugaaccagcagcuucaaaaccauuguugcauaaaaaggguaauaaugauagcuuccuauacuggcauccaaauuuaaaauuacccccuaaugcucuucagaaaauguucauuaagccacuuuguguuauuccagagcuuaagucaucugcuucuuugagugaaaaaucuuacaaccaggcuguuggucuuggcaaaacacagucagcuuuauuucagugugauauaggcaaugaaccauuucuucccuuugggaagauaaagucuguuccuucucuugaccuugcagagaagguaggaucuucagauguuauuuaucaugugaaaguauuaacuucagaaucuuugguuuuacaagauuuaaagcagccaaccuuugaagaaguugcagauuacucaaacuuuaauuuggguaaggauguuaacuguagaaaugccauuaaagguccaccugcagcuguaggaagcagcuuuucagcaaacuugguggcaugugaugcaaagucacaaggugcuuguaccauugaccagugaugcaucauuaauugcagucgcccaagagacauugcugaaagcugauauaggccaaggugaaaguccuucgugugugggagcugagccuaguuuuacuauacauacaauuaugcaaaaugacuccuauuuuguagagggccugcaggggaagguugagucugacgucauuacucuggauggccuaaaugaaaaugcuguuguaugcagugaaagaguugcugaacuacaaagaaaggugagacacaauaaaaugauaguuguaagaaacguggccuuuuucaguauuguuucaggaaaugguauuguuuguuuuuauuuuacuuuuuacuguuuccuggguacaugaccaaugucauuugacuggugaguacauugagcuagcagcuuuagagaaauuucauggugaucuagagaugcaugacagcucccugcacuggcagccuacuuuacaacuaccaucugagaaggaaagcaauuuugaaaagccuguaaguuuuucuauuugacauuuuuuucugggcggggagggaauguuuuauuugaaaaauuuccaaauuuuauuugaaaauacuuuauuugaaaaauuauauccuucaguaccagcuuguaacuuguaccuguucuucaucugauauccaggaauauguuccauuagagguugguauaaaagaaauguuuauguuucauagacuguaagacuuaguucuguggugucuuggaaaaggcaucccauggggcuccaggccuuucauauugaggcagccuaacucuuccuaguugugccagcaagagucuuuagacaguguuaagauuaggcuuauucaugggaacauccaaaagcuuguacuuugaauguuucccucuggucuucaaugcacaagccuugaaacagucccuggaauauuuaaguauuucuguuuagaagcucuugaaagacuugacuucagaggugucuugaaaauuguaagacccauguuugaccaggaaggauaaugaagugcuuaacguccaaacuggccagugucucuucaaagggaaguaucuccuucccaaaugagcaacauacuaauguauauacaugucucuucccucucucuauuuauaucauuauuaccauuguguguguguguacuagaaacuggcaacucuaggaugucauaaaaauuuuauaucagccuuuuuuuuuuaaauuaaguucuggggcacaugugcagaacgugcagguuuguuacauagguauacaggugucauggugguuugcugcaccuaucaaccugucaucuacauuagguauuucuccuaaugcuaucccuccccuaacccccuaccccgcgacgggcccuggugugugauguuccccucccugugucauucuuuuauagaaggcuuuuauuugcuuggauccuuggaucccuuggcauuaauguuccucuggucccguugaaugaauauccucuuuuguugucugguacuguaagucccaaggugggcccuacuuccuugugauauagccuuauauccuguuauucauuaaauacaguuagauaaaauagugauguacuuaauguuacuucucuuuuccuauguauaagauugguauguuuuuguaaagcucuauuaguuuggguuacaaccacauuuagaccuuuagguucagauuguugguagaaaaugaacaaagauauuaugaugaacuuuuauuuauaauuuauuacauuuauuaaaguuuuuuuaacacagaaucacuagguuuauuuucuucaguauuccaaacuaggcauuuuuuaauuuuaaucugauaacuggggaugaaaaugauaguuaacacuuugugcucaaguacugugcuaagagguuacauguauauaucaauucguuuuuguccucugucaauccuaucaaauagaauuguuagagauuauuaucaucccuauuuugcaauugacacuuagaggauuuaggaacuugcucauaauuauucagcaauugggggaaccaguauuugaaacuaaccauaucuguguacuuaaccaccauaccauaaacuguucccccuccccccaccuuuuaacuauucuuggugaaacuaagguuaagauuuugcauuauuuuggcaagaguagagguuuugaaggagauugccuaaaguugaguucaauaacaaugagaaacaaaguaacaacuuuuaaaguguucuaaauuuuuaauacuacuuuugugacuuacaucaaccuuucauguagauaaaauguauuuuaaaaauaaagauauauagguucaguuaaugugcagagacuagcuuugaccacugcuccaaauuuuaaucuguccuuaaauauagccugaaguauuauucuuucaaucuaaggaagaugcuauuauucccuguauugucuuucaguuguagcucuaucugucuuagucuuagaucuaggaguuauuuaaugucaauaucagaaaagcaaggagccagaugugguaguacuuuuucugcauggcuuagcuugcuuucaggggcuugcuuacuccuugguuuuuccuuaugcuccucaucugugucacagaagagucauucauaguuacuugguucacuuuuauaucuacuccucauaaaugauuauuuggguauccacguauguaugauggagcuuggaacugugaaaagaacauagagauuuugagucaaaauccaguucaguuacuuuguuagccuugugucuugagcaaaugacuucggaggaucacuuuccugaucugcauaaggaaauaggaauaguaauaaccuuauacaucguacuauuaaaugggguaaguuauguagcauuuauauagugccugguuguuaguucucuucacuuugcugaaacuagacuacuagagucucuggugguuuccuacuuucuaucauuauuuuguuuuucuuucuccuuuuucuugguagcagcacauaauuaauaugcuuuuuuuuuuuuuuuuuuuugaggcagaguuuugcucuugucauccaggcuggagugcaauggcacaaucucagcucacugcaaccuccaucuccuggguuuaagcaguuguccugcugcagcgucccaaguagcugggauuacaggugccugccacuaugccuggcuaauuuuuugucuuuuuaguagagacgggguuucaccauguuggacaggcuagucucgaauuccugaccucaggugauccaccugccucagccucccaaagugcugggguuacaggcgugagccaccgugccuggccuaauaugcuauuuuaguaccucuuguuuuggccauuuagcucuaaaaauuauuuaagguuuaagccuuagauuucuuuucucuccccuucauauccccccaccuuuggagaccuaguugccugucucuguguggaugauuaucaccucuguuuuuauacccuaauauuugucuaauuuauuuugcauguuuucuugugaacauugucaucaccccaaauucaacuugcucuauagcaaaauaacucauguuuuuccuaaaauuagacugacuuguagaguuccugaguuuuuaugaaagguauuaguauuuuucugguuucuuggucaucuuucauucuuucuucauuauugauuaaacauugggaagauaaacgaaucuugauuucuguuuucuccugguucuuuccauuuucaauuagcaaugaagaucugcugguuucuuaaauaaauacuucucauauuuuucauuuuacauuuucuuuuguauuaccuacuuuuuuuuuuuuuuuuugagacagagucucccacuguugcccaggcuggaaugcaguggugcggucucagcucacugcaagcuccgccucccggguucacaccauucuccugccucagccuccugaguagcuuggacuacaggugcccgcccccaugcccggcuaauuuuuuguauuuuuaguagagacgggguuucaccguguuagccaggauggucucgaucuccugacuucgugauccgcccgccucggccucccagagugcugggauuacaggcgugaaccaacgugccuggccgguauuaccuacuuuaauaguucuauauuuugaaacuuuaacauaaugaaauuuuuuugacgucaagcuuguaauaaaaauuuuucuuucuguguuugaaagcuguagaagaaaaacugcuguaaacuauaaacacacacugucucucacaagugucuauauauuauauauggucaugccacauaaugauauuucaguuagugacagacugcauauaugaugguagucccauaagauuaaaauacuguauuuuuacuguaccuuuccuauguuuagauacacaaaugccacuguguuacaguugccuacaauauuuagaacaguaacaugcugauagguuuguauccuggaagcaguaggcuagaccauauagccuagguguguaguaggcuacacaguuguagguuuguguaagucacucugugauguuugcacaacaacaaaauugccugacagcacauuucucagaacauacccacaucauuaagugaucuaugacugcauauuauauauaugcauauauauuuauauauauuuauguguauguauauauguguauauauauagccuguacuucagagaaguuuccuguaggagugagguaauugaaaacuaugaacuuugugcuauguggagagcagggcuucuuagcagccuuaucauuuugaguuggauaauucuuuguuauggugggaggcguguuuccugaguauuguaggauguuuugcaucauccaucccuggccucuauucacuagauacuaguaacauccccuccccucacaaguuaugacagcaaaaaauguuuccaggcauugucaaaugucccuugauggguacaaaaucuucacaaguugaaaaguagagaaaccuguaugggcaguagauguagauauagaaauagauauggaauguucauuuccacacuucacauggcuuccuaagaauguucauuacuacacaaugaaaaauugaugaaagaggauagaaaaauucaugcuuauguacauuuuuagacuucauccugagaagaugugacugaaauaaucuuuuuagggaaauaaagacaaucuaaaaaugauauauauuuuuaugugagggugcacugugaauuuggugaaaaguuguacauguuuagguauuaaugucaccaauauugguuucuaauuucuuuucuagcaagaacuugugacuugaugaaacauuaggaacuucuuuuugagcaguuacccuuuacuucacuaccaauuuauaguuuccacuacuuuuguuuuaagaaguuugaggacuuaugcuuguugguaaccgaucacaguuauaguucuuugauacucucauuuuucuucuaaacauuugugaguuucuagaaaauauuccuguuuucuuuuuccuucuuacuguuucuuguccacagugcaccucucuaccuuaaaaagaaauaccugagcuuguccagaauaaucccaugguucaaauucugcgaugaucauaaggagcaaacuucugaguaacagaacacuucuaagcauacuaucuauaauauuuuaucuagacagauuucuaagcccucaggaugauuuagucuucuagaguugacccaauaaaauaugaccuauauaugaauucagaagguuugagauuaugaucuuaaguaacuaguauaacuucuuaguguuccucuuuguaaaaaugaaggauuauuuuuagcagaugagguuugaaauuaauaucuuauuuucuucauuucuucguaggugggucauucuaaucugggcauuaaugagucuuuuucauuuuuauugccuucauuuguuccacauaagccaacaagagagucggaauaucacucuucagaucucagaauguugaggaugucuccugacacugugccaaaggcuccuaaacauuuaaaagcagguacguagaaaaaggagauaguaaauguccuacuuacggauaccuugugaaaaaauaucuuguuaggucuaucuaauuuuguauuuuuuaauaucuauaauaauuauacuucagauuagauguguuuauaaauccugucuuagucucuuuagacugcuauuacaaaaauaucuuaguacuuuaaguauggcuuauaaacaacagaaauuuguuucuugcaguucuagaggcugguuccaagaucaagugcugggagauucagugucuugugagggccuguuugucauagaugacauguuccucugugcccucccaugguggaaggggcagggggucucucuggagucguuuuuuguaaugggcacuaaucccaaacauguggccuguguccucaugaucuaauugcuuuccaaaagccuuaccuccuuaauuucaucaccuuggggauuaggauuucaaccuauacuuuucaggggggacacaaacauucagaccaucacaaguccccugauguuuuauuagaggaaucauuugguuuuucaucgcauucuacauggcaguguuuagaacugaauuauauggaggagucugauguuagaaucuguuuauuccuuugugugacuugaagggaaaaaggaauugauugagcccaagaugacaagaguggaugcagauaaguuuguagagaggaaauugagagaaaucaguuuugagguaaaagcaagauuaucugcugagggaggugaguagugguggaauuagguuagaggcauugaggagagugguuuggugaagacuuacaguuuauguugaagugaauuugagauggagcugaccaagggaaaguaaaaggauuggagggcaguucugagaagucagcucagguuagugauaaugauuuuauaauauugucagccuguauagaaucucugauuuguuuuuccugcuaacacucaggaauggagaugaugaauuacaguauugauccuugguucaggaauacauugaauggguaugguagaaggauagcagucaaagagagaagaguugaucaccuauugguuucagccuacauagggaaagagaagccagaagaguuguuauucuaggagaaaauagaaggaccagagauuucuuuaugaaguugauuagaugaggugggaauaaguuacugagagcacuagaagaauagguaauuuuggucagauugaauaaguagauuuaaaugaggaucaguuugaagggugaugaaauccauuaaauagcccugggauuggaugguagaaauugaauaaaaauuacuggaguaaauaaaauuuugggucagguacagugucuuaugcuuguaaucucaguacuuugggaggcugaggugggaggaucacuuggaagagucuggaaaggauugguauuaauuguuuuugaauagaauuuacugugaaacuaccugggcuguucuuuguaggaaguuuuuaaauugcuaauuucaucucuuuccuugccauaagucuauuuagauuuuauauuuuucaugaaucagcuuuugcaauuugugucuuaaauagaauuuguccauuuagcuaggcuaucuguuuacauauaucuguucauaauauucccauguaaucucuuucauuucaguaagguuaguuacaaugcccucucuuucauuccugauuuuaguaacuuaaguuuucccuucuuuuguucucccuuuggugaaucuaguuaaauuuugucaauuuugcugauuuuuucaaauaaacugguuucuuuauuuuuuucuaaucuuuauuuuucuuuucugauuuuuguuucauuuauuuucauucuagucauuauuuuuccuuccuuccauuugcuuuggguuuaguuugugcuuuuauucuguuuuuuaagguggacaguuagguuauugauuuaagcucuuucuucuucuuauuacaaauauguauacaaauugauaaauuccuaagcacuguguuagcugcauguccuaaguuuugguuuauuauauuuuuguuuuaguucaucuaaacuuauuuucuaguuuacauugugauuuuucuacauuuacccuuugguuauuuaggaauguguuguuuaauuuccuucuguuauuauguuucaucugguucaauuuuuguuggaaaacauacuuuguaugauuucugucuuuaaguuuuauugaggcucguuuuauguuuuagcauguaguuuauucuguagaauguacaguuuguacuugagaagaauguguauucugcuguuguuaggugguguguucuauagaugucuuucagcucuaguggguuuagcuguucaaauuuucuguuuccuuguuggucuucugacuagcuguuuucuccauuuucaaaagaaggguacugaagucuucaacucuuuuuguuuaauugucuauuucuccccuuuuuucucucagauuugcuucacauauuuugacauuaugauguuagauccauauauguuuauaauuguuauauauuccugaugaauugaccuuuuuuuggagacagagucuuguucuguugcccaggcugaaaugcagugcguggcucacugcaaccucuaccuucuggguuccagcgacucucgugccucagccuccugaguagcugggacuauaggcgugugcccaccaugcccaauuaauuagaauugaccuuuuaauuguuauaaauuguuccuccauauuuugaguaacuuuuuguuuuaaagucuguuuugucuuagguuagaauagacacuucagcucuuaugguugcuguuuguaugguuuaucuuuuaaaaucccucuacuuucaaccuauuuguauuaucaaaaaugauguaucugcuguaaagagcauauaguuaaaucuugaguuuuuaauuuuaaaauucuaucuguuuuugccuugugaugugauuauuuaaucuguuugcauuuaaugucauuauugaugugauuggauucacauuuucuggcuuacguuugguuuuucaugugucuuguguccuuuuucuguuccccuuuuauuauugcaugaagugaauauuuucuaguaugacacuuucaguuuaauuuuuaaaaugauuuucuagguaguuuuuuuuaaaguuauauucuuagugauuacucuggggcuuauaauauuuaucuuaucagaauauacuucugauucaauuuauacuaacuuaauucuaguaugguacagaaacuuuacucccguauagcucuauucccucuuuuuuuuuggugcuauuauuguuauacauacuacucacacacguauauaaaugccuuuaaguuuuuguuuuuuuuuuuagucggggacuugcucuguugcccagguuggauugcaguggcaugaucauagcucacucuaaccugagcucaagugauccuccugccucagccuccucuguugugaggcccacagguguguaccacuacacugagcuaauuuuucaaaaaauuuuuuugguagagaugggaucucacuauguuauuagucuugaacuccugggcucaagcaguccucccaccuuggccuccuaaagugcugggauuacacgugugagccaccaugccagccugcuuuauauauuuucaaauugcucuuuaaaucaguuaacagaauacaggaaaugaaguaugucuuuuuguaguuaccgauguaguuauuuuuacuagcacuauuuguuuuguuaugaaaauguuacuacuaucugguguuacuuguuuuucagccuuuggaacuuccuauguuauuucuuguaagauggaucugcaaguucccuguuuuauguaucuggcguguuuuuauuucaucuuuuugaaagauaguuuugcugggcuuggaauucuugguugacagucuuuuucuuuucagcacuuugaauaugucucuucacuaucuucuggccuucauaguuuuggaugagaagucagcuguuaucuuauucauguucucuuguauguaauuuguuuucucuuguugcuuccaagauaugcucuuugucuuucacuuucaguaucuugauuaugauaugucucuaugugaaucucuguguuuauucuacuuugagcucacugaacuugucagauguauaguuaauaucuuuugucuaauuugggaaguuuucagccaucauuucuuugaggauuuuuucugcuucuuucucuuuuuugcccaguuaucaucucuugcaucacaguccacauauaucagcaccccuaaucuugucucacuggucucuaagccuuuguuuguuuuuguuucuucuuucuuugcuucaguuugcauagucucuauucauuuaucuugauguuugcugauuuuuuucuucugucuuguccauaucuacuguugagccucuagugaauuuuucacuucaguuacuguacuuuucagccuuagaauuuccauuuuguuauuuucuaaguucugucuuucauucuguauuugaugugacuuugccaucauaccuaucuuuaauucuuuaagcauccuuuucuucccuuugaauauguuuauaauagcugcuuuuaauuguuacuggcuaagcccaaugugugugcccucugaaagguaaauuugccuauuuuguucccccugugaaggggucacacuuucuuuugcacaucuuacuuuucuguuauuguucuaaacuggacguuuuggauaauaucuuguugcagcucuggauauugaucccuucucugggcugguaacguuugauauuuuuguuguuucguuauuuagugucugguuuggauuaguucuuaauugcucaccaccaagaucuccauuguuuuugucaguguccuuaggcuugagcuuuuuaugcucuguuucaaacaaagucauucuccuuauggagauguguggagcucucuguucuuauggcuugccucugcugggcagaagcuuuguggcacugcucuguaucugggggcagguucauuggucuacuucucuuggaauaacacaccccuucucuaugauugugaugcugaaagggguaguaguuagucccuguucuuggauugccucuccuggaguggacccucacuccaccuacaagugagcuggggguagggaugauuagagcuugguauucucagguugggauaaaucuuccacucuauaaguggggacugggugaagguagguugcuucuuguguuguuucuuuuucacuuauuagcuaacaucaacagccaguguucuuucuuuacagccuuucucccaugacaucccuuccauucugccuuguuacuuuauggaucguaucuacugauguacccaguuguaccauuuuaauuauuugguuaaaaugguacaucucauuucuaccaguaagauccugagcuccucacuuaucucucagaguaguauugugcuguaugggcugacauuaaagauuuaauauuaugcacagucuugacaucugaaacugcgagguccucaaagggccuaaccacaaguuuaccugccagauaugcccucuacucaguggagaggcuuccuacacagccaguucuucuaucaacgagaccaacuguauucuaccugguacucaaccucagauuuccaucccaugcuaaccugugaaauuauucaaacaagccaaucacacccuccuacagaaauaaaaaaaaucacgcucuuuucuugcuacuacaagccugccuccuaugguuccuguuuacucguucuguucccauguacaaucccuguguggcccugcauguccugugucuuccccagcugugaguauaugugacuaauaaacuaccgucagucuccucugugcaguguuguauuuagccaauccagaucuaucaggcagcaaucccucccucaucaauagggugaagaggaggcaaaagaaagaaauauuuguguccauguuugauucauauuguauugaaauggucccuugauauuaguugcccugauuucuuauuuuuuuauuggcaaaccucuggguccuauuuuauaacaagcagaaaguaacugccaagcuucauuucaaauuggcuccaaaguaugagucaagauaauuuacauaucagguaaaguagacacacuuaacauaauuugaauaguuuagauuacaagauaaauuggaaacaaguuuggaucuggauuauugaaaaagaaucggugacaccauuagaaaguaggguagugaauuuaguuuuggacauacugaguuugauuugucgggagaucauuugguuugaagugucuucaaagccaguugaacaaaugggaaauaggaaauacaaauuuggaagaucuuaaauaauuugugauuaaaauuaugccguaagaguaguuaagcuuucugaaggagcauggguagagagaaaagcaaaaugucaaggaugguaccucauggaauacaauagcagaaagaggccaauagaaaauaucaaaaaagacagauauuuuguuuaaauucuuacucugauuuaguucuuaccucuucaguuuccauuccaauuucuuagugccuuuacuauaucacacuggauuuuguugcacgaacauuuaggauugcuuugucuucuugguggauugauccuuuacaauuauguaagaauucucuuugucccucguaauuuucuuuguucugaagauuaucuuauauagccacuccuauagaauaguucuuuucuuucuucuucuuccucuucuuccucuccuccuccuccuuuuuuucuucuuuuuucuucuucuucuuccuccugcuccuccucuuucuuccucuuuuuucuucuuucuucuuucuuuuucuccuccuccuccucuuuuuuuuuuuuuuuaaauaaagauaaagucucacucuguugcccaggcuggagugcagugauaugaucauagcuccacagccuugaauuccugggcucaagcaguccuucugccucacucucugaguagcuaggacuauaaaugcacacuaauaugcccagcuaaucuuuuuuuuuuuguagagacaaggucuugcuauguugccuaggcugguuuucagcuccuggccuuucaaagccugauccucccaucuugacuucacaaagugcugagauuacaggcaugagccaccguacccggccuuuuuaucugucuuuuaguuucaaccuuacuaugucauuauguuugaagugaauuuuuuguagacaucauauaauugggucauuuaaaaaaaauccugucugcuaauaucuguauuuuaguuuguuuguuuauuuauuuugagauggagucuugcucugucaccaggcuggaguacgguggugugaucucggcucacugcaaccuccaccucccagguucaagcgauucuccugccucagccuccugaguagcugggacuauaggugcacaccaccauaccaggcuaauuuuuguauuuuuaguggagacagggugucaccauguuggccaggauggucugcaucucuugaccuugugauccacccgccuuggccucccaaagugcugggauuacagguguaguuuguuuauuuauacaauuuauaccuaaaguuaauauuggucuauuaugccuuaagucugcaauuuuauuauuuauuuucacuuuauuccuguuucucuugucuugccuuacuauggguuucaugaacauacuuuagaauuucacuuuaauuuuuaaaaauuauuuauuuauuuuugagacagagucucgcucugucgcccaggcuggagugcaguggugcuaucucggcucacugcaagcuccgccucccggguucacgccauucuccugccucagccuccuaaguagcugggauuacaggugugugccaucacgccuggcuaauuguuuuauauuuuuaguaaagacgggguuucaccauguuggccaggcuggcuucgaacuccugaccucaagugauccaccugccucagucucccaaagugcucguauuacaggcgugagccaaugcacccggcccuugguguggauuucuuuggguuuuccuguuuggagcugacuuacuuucuuuaaucuguaaguuuaugucucaucaaauuugggauguuuucagacuuuguuucuuugaauuugacucaucuuauuugcaucauuugaucgucuucucccucucucucgcguucgcugucuuucucucucucucucucuugcugucucuuucucucucucggcucacugaaaccucugcuuccgggguucaggcaauucucgugucucagccuccugaguagcuggaaucaugggcgugugcuaccacgcccagcuaauuuuuuguauuuuuaguagagacgggguuucaucauguuggccaggcuggucuugaacuccugaccuuaagugauccacccaccucagccucccaaagugcugggauuauaggcgugagcaaccacagccagccuugauugucuuuucucaguuugugauuuuccugguucuuagugguaaaaaugaauuuugauuauauccuggacauuuuggauauuauguuaggagacuuugauuccuauuuauaaucuucuguuuagcaggcaguugcucuauuuagguuuuccauauaggcucuggccuauuuauguggcugugaucccaaagauaauuuaguuuucaggggaguugcauucuggucuacuucagugguaccauugaggcucccacucagucccuguuggugaugcuuauguggguggaauggucuuccucaaggccugcuggugcugugugggaagggggagaugcuaacccacagaguagagaacauuucccugggccugccccuggaccaacuggugucagugggucacccacuugauucuuguugauggcauucauggggguagaaaaugcuuuucuaggccuccugaugcaucuagguaggaugcugggccccugcgauggagaacauuuccuugaaccuacucucuggguuucucaaugcugguggacuucccauucaauuuuugccagugccacuggggaaggaaagugccuaccugagcugucuuuuaccacaggagaguuaggagaugguggaccuaggucuucuuuuguuacuggcuagaggacagggagaugccaaaccuguugggacucucugccugguuuuugcuggcacuacaguucugguggugcaagccuaccuguugcugcuggguuggaguaggguguggggagaugggacugucugcuaagucugcugggcugcccguuucuugguccauggcccacagacagcaggcuuuucuuggacuucuuucugcccuccuuuguucccuuucuccuucccacuauuccuauuccuauuccuauuucuggucuuaguuccacacugcaggccucuccaggguccagccucagauauaagagaguuaaaaagaaaacuaaggaagucauugccauguuguucuccagucuggagguccuuagcuagucugcguuucacuuucuaccuuucaguuuuuuuuuugucuuuugguuucuagggaaguggagggaaaagcaaauuuauaucauuuugucagggaccagaagacaacuggaguuuugaaaacuugacuuagaugugcuauugucuuugguuguugguagaaauaaucauaugggggaagugagguaaagaucuuucucaggcaauauugaauaaacucagggaucucaagccacagaagauggggacaccuaugccaugaaacuuuccuaacuuuucuaaaaucugcagcccguguccugaacuauuaauaauagcugacauuuauugcuuguucacauugcuaagcauuuuauguauuauuauuauaauguauauuauauaauacagguugagcaucccuaaucugaaaaaccacaauccagaaugguccaaaaucuggaacuuuuugacugcugacaugauauucaaaggaaauacucauuagagcauuuuggauuucagauuuuuggauuagguaugcacaauauguucuuuuaucauauuauuauuaugccauauuguuuuauauuuuuaaucugaccuaugaugaugggcacugcuauuauucuauuugcuaucugagcaaaaugaaacuuagagugacuugcccaaagucccacuuucucuaagaggauuuugauagcuucauuccauauuguucucucuguuucucaaguuuuaaaugccuuuauaaccuuaccauaaacauaucacaccaucaguuuuuccaaauucuuucucagagagggcaccaauuuaauuucuauuauauacuuaacacuaaucuuggcauaugauaaaggcaugaaagagucucgaugauuguuugcuaacugaagaguucaucaguuagugguacaguacuggcugccucagcuuguuuacagcaucagguagugacauaguaggaaacaaugcuuugugcaagaaaggauuuuaacuucuuccuagguaauaucaacacccagggcuucaguuauuuccuaugacugaugaguuccaauuguaggacucuaucuagauauaucucauacuccaaauguuuguaucugacuacuaugaaaugucuucauuuggaugucccauagguaucuuaaugucagaacuuuaaaaauggagccaaucaucucuuuaaaccuacucuuccuucucuauuucuucucagugaaugagugucuacuuauuagccaagcuagaaacuuguauucuucuuucacccucaucccugcccaaucacuuaaucucguugauucuaucagacucccauucucuuuucugaauuacugcauuaguaauggaaaacugaucaucuucucugccacuuauuuucaguauuaagccaaaauagucuguuuacagggcagacuugauaaugucacuuccuaguuuggaguucuugcuuuccauuguuaaccuugggguaaauucuaaacuccuuaguacauaguagaaggucccugcuuaccuucuuagccuuauacuugccucuuuuuucauagugaacuacucucauuucuucaugaugcuagacccucuugucuccuugaucucauagaugcuauuuucucuacuuggaaugcuucccuauuuuuuauaugcccaucuuugccuaauuucugguuuuuauccuuucauucugagcuuugcugucuuucaggaaaauguuucuguuuuucacuguucaccaugacucuuuaagaaagagccagauacuccuuacauauguugcuauaguauccuguaaacagccucccuaaucacugcccuuacacugaauuuaguaauugcuuuuuuuuacuuguuucugucucccacaggacuuuaagcucuuugaggguagagcucgggcuuugcuaauauauauauuuuugcaccuggcugugaaagcuacucaauaaauaucuguugaaugacuuuaugaauugaugaauauuaaaugaauuaacaugccuggguagacugggggagggguagaauaagaugguaggcuuuguauuuuggcagggaucaguucucaagaaaguggaucaaauaaauguaaguaucauauuucauugacuauaugucaguuguaaugaaggccuauggauuagugucuuaucacuauuuuauugaucucugguuaacaugaggcugucucugugacuugaauggccuauaugucuuucuuuauguuuuuugguggguauugggguuuauguucccugccucuaaaccuaauugauuuaucuuuuaguuuuccugccauaauuuuuauugacgcccagucuuuuguuuaaccuuacuaccuuagguuguuauuuguuggauaucuucucccuugaagaugcaaguuacucagggcagggagggaaccugcguguggcucagaguaagggaggacuuuaguuuggggcaggacuuugaaggguucucuuaaagaugaggagccuggaagcaagaucugaaauuacaucuucuccugucccagagggaauuucuuugaguaggggugcaccuaucagggugguuugaugacuggguauuacuaugaccagguuauaacuuucccaggguuauucuguuaggaaauaguguuugggauuugauguuugaguacagaguucaugaacuuuucacaacaccagcaguucauuagcuuuuugaaaccucugcccacuuaggaaugaggaagagucuauaacgcacuuuaccuaacaauuccugcuuucgcauugaaaaagaacuuagugauagcaacaacaaaauuaggaauuaaauuacaggcuauaauguuagcucguguaugugauuuuuguguuauaaaacagugcccuauuaucuuuugaaacuaagcaauuuuauuacauuuaacuugauuuuguauugcaaguuauuuaaauggcauacauuuaucaacaggacaacguuaaugaauuaucaguaugcaggaacuuuggaaggguuauauuuacguccacugugguaauaaggguaucaaaaauccuguuugaacugugauauauuguguuaaguuuaguuaugagagaauauaguuuaagauaaugaauguagagauaaacaucuaugaguuaacugagggauuaacgaaauacaacacaauuauaauuauuuaguuaucaauaauuaauaauuaggaacuuauaaaaaugauauaguaauuaauuagaaagcaagaauaacaacaaugaagacaaagacccauuuaaaauaucacuggugucuuuuuaaaaaaacaugaauuugaguuuacuucucuguacacacaauaggugcuuuugccagacuuuuuaaaaaaaaaucuuuuuuauuuuuaauauuuaugagaacauaguagguguauauauuuaugggguacaugagauauuuugacacaaacauacgauguguaauaaucacaucaagguaaauggaguaucugucaccucaagcauucauuauuucuuuauguugugaaaauuccaguuauacucuuuuaauuuaaaaugcguuauaaauaauuguugacuguagucaccguauuguacuauaucauauucuagagcuuauucauucuaacuacauuuuuguacccauuaaccauccuccucacuaccuucccagccccguuacagacuuauuagugacugaauuagagggcucaaaaugagagcuauaguaauuuauuugugugugcuaguauuaaaacccauaauaauugacuuggaacgauuacuaguaagaggcucuuagucauauguaaaauggaaguauggaauuguaccucauuuugucugugagaaauaaagggcuugcuuauucuucuuaugucagaauauacuuggggaaauaaaaccgugcugucuucgucaccuaggaagccuucuguguuacuaagcaccuuaguauggagaagaguucuugaguaaauuguacccagguuguuagucuuaaugucaucucuaagaggcauacaguucccacccaauauacaacuuugguguaguauagucuuuucuggcagccaucuuccucuucuuggucgaaacuuaccucuucaacucaccccuaguucugaaaaugaaucuccaaagauuauaucaguauguaguaauauuguuaacacucacacuuaguguauucuucuuucccagggcugagagaauaauaaggacucuaaaaacauaccauuuuucaucaugaacuccuuauguacauagacacauuuuauaaaucauaguuaauggauuugugaucaccauucuucugacaguuugacauauauguccuuaacuuuauauagaacugacaagaauucuucuuuaacaucgugcaucuccucccucgcuuuuaacagcuuaaccuauagucguucuuccaguuuucuuuacuaaucuuuuccuuuaccccugagguuaaaaagaccuuaucuuauguaaccuggaucuuucaaggaccugggcuguacaucuuaacuccuuagcuauuuaucucauuuguccccauucauggugucacuaauaauuuguaauggccaaagggauauaaaaacuuugagaaaucaggaaaucauuuagaaaaacaagguuuuguuuuguuaaucuguuuugguuuauuagcuucuugagccuguuuuguuuccucacaaaaacuuuucuuauuuucuuuagacccagcaggcaagaaccucacaaaauuuuguaacucauauuccuucucagguuacaaugcauguuacauuuuuaaauuuuuuacuuuucuugaagaguuaauacuugauacuucuaguucuuuacuuugaaauucacuccucaacccauuucauucuauauucagcuccuuugaagcucgucaguggccauagaaagccagucaguuguaguggaaagagcucagaacuuggauuuagaguuuaaggguuaaaguaccaguuuuugucacuuacccaccuacaauucuagaaaaacuauguaucuuugcacuuaaaauguggucugaggaccaauaacauugggcaucccuggggagcuuguuagaaaugcagaauuucaggucccacccagaccuacugagucagaaucugcaaguuaacaagaucccaacauugagaagcacuguuacauggucaucuuugcaacucgguuucccuauacguaaaaaauagauaauacuugcucuauauaucaaucaucuuaacaccaucugacacaucauauguuuuaccaauuuauugucagccuccuccugcuagaauacaaauuagcucugugagguagggauuauugucuguuuauugcuguauguagaacagugccuggaacauaguaagcauucauguauuuugaaugaacaaugaaugaagggacagcuugucaaauccugucauuucuguugcagucacuuacuuuacacugcuguuuaaaacugcuuucauuuagaauuauuguauuagugcaaauauagaacauuucuauagaaauguuuguuggauugugcaaccuagauuuuuacauucccuucucacucaucuugaaaacuuuaaaacuguaaacaacuugccaugcuauacagaauuaaguuaaaacucuucagaguaaccuuuagaguuuuuucaguuuuauguacuuaaauauauauauauuauacagggugcauuuguugggagaguccuucaaacucacugcacgcauagcaucccucuaggccauauuguacugccccugugggacuugggggcaggaggaacccgugaaaauaagcugaugagccuuugcuguaccagggaucaugaagucuuuugucucugacugaagaccuuaugucuucugccagccugcaagacacaauaacagauuguaaguagggugaaaucaaauccuagacccaauagcauuaucccaucucauugaaaauucucuuaaaaauccaaguuguaagauccauauaauauuucauccacuggauauacuguuguuuauaaccauuacucuguuguugaagauuuaaaauguuuuuacuuuaguuuucuaauuaauaucuuugugugcaaauauuuaucuccuuugauggcuguuuccuuaggauucauuucuagaagcuuuuuaaaggcucaaagcuggcuuuuuuuccagcacauagaauuuuaaaauagaaaauuuuauauacuauuaacaaaucucuuuuucuuuaggagacacuucuaaaggaggcauagcuaaaguuacucaauccaacuugaagucaggcaucacuaccacuccuguugauucagacauuggaucucauuuauccuugucccuugaggaccugucucaguuggcuguaaguucucuagaaacuacuacuggucaacacacugauacucucaaccaaaagacauuagcagauacucaucuaacugaagagacucugaaagucacagcuauuccugaaccagcugaccagaagacugcaacaccaacaguacucucuaguucccacucacauagggggaagcccagcauuuucuaccagcagggcuugccagacagucaucuaacugaagaggcuuugaaaguuucagcugcuccuggacuagcugaccagacaacuggcaugucaacucuaaccucuacuuccuacucacauagagagaagccugguacuuuuuaccaacaagaguuaccagagaguaacuuaaccgaagagccuuuggaaguuucagcugcuccuggcccaguggagcagaagacgggaauaccuacaguauccucuacaucccacucacauguagaggaccuccucuuuuucuaucgacagaccuugccagauggucaucuaacugaucaggcucugaaagucucagcugugucuggaccagcugaccagaagacugggacagcaacaguacucucuacuccccacucacauagagagaagccugguauuuuuuaccaacaagaguucgcagacagucaucaaacugaagagacucuuacuaaaguuucagccacuccuggaccagcugaccagaagacugagauaccagcaguacagucuaguucuuacucacaaagagaaaagccuaguauuuuguacccacaggacuuagcagacagucaucuaccugaagagggucugaaaguuucagcuguugcuggaccagcugaccagaagacuggccuaccaacaguacccucuagugcauacucacacagagagaagcuccuuguuuucuaccaacaggccuugcuggacagccaucuacccgaagaggcucugaaaguuucagcuguuucuggaccagcugacggaaagacugggacaccagcuguaaccucuacuuccucugcguccucuucacuuggagaaaagcccagugcuuucuaucagcagaccuuacccaauagucaucuaacugaagaggcucugaaaguaucaauuguuccuggaccaggugaucagaagacugggauacccucagcaccaucuaguuucuacucacacagagagaagcccauuauuuuuucccagcagacccugccagacuuucuuuucccugaagaagcucugaagguuucagcuguuucuguauuggcugcccagaagacugggacaccaacaguguccucuaauucucacucacauagcgagaaaucuaguguuuucuaccagcaagaguugccagacagugaucuaccuagagaaucucugaaaaugucugcuauuccuggacugacugaccagaagacugucccaacaccaacaguaccuucagguuccuucucacauagagagaagcccaguauuuucuaucaacaggaguggccagauaguuaugcaacugaaaaggcucugaaaguuucaacuggcccuggaccagcugaccagaagacugagauaccagcaguacagucuaguucuuacccacagagggagaagccuaguguuuuguacccacagguguuaucagacagucaucuaccugaagagagucugaaaguuucagccuucccuggaccagcugaccagaugacugacacaccagcaguaccgucuacuuucuacucacaaagagagaagccugguauuuucuaccaacagaccuugccagagagucaucugccuaaagaggcucugaaaauuucaguagcuccuggacuagcagaccagaagacuggcacaccaacuguaaccucaacuuccuacucacaacauagagaaaagcccagcauuuuccaccagcaggccuugccagguacucauauaccugaagaggcucagaaaguuucagcuguuacuggaccagguaaccagaagacuuggauaccaagaguacuuucuaccuucuacucacaaagagagaaaccugguauuuucuaucaacagaccuugccagguagucacauaccugaagaggcacagaaaguuucaccuguucuuggaccagcugaccagaagacugggacaccaacuccaaccucugcuucuuacucacacacagagaagccugguauuuucuaccaacaggucuugccagauaaucauccaacugaagaggcucugaaaauuucaguugccucugaaccaguugaccagacaacuggcacaccagcuguaaccucuacuuccuacucacaauauagagagaagcccagcauuuucuaccaacagucguugccaaguagucaucuaacugaagaggcuaagaauguuucagcgguuccuggaccagcugaccagaagacugugauaccaauuuuacccucuacuuucuacucacacacagagaagccugguguuuucuaccaacaggucuugccacauagucauccaacugaagaggcucugaaaauuucaguugccucugaaccaguugaccagacaacuggcacaccaacuguaaccucuacuucuuacucacaacauacagagaagccgaguauuuucuaccaacagucguugccagguagucaucuaacugaagaggcuaagaacguuucagcgguuccuggaccaggugaccggaagacugggauaccaacuuuacccucuacuuucuacucacacacagagaagccugguaguuucuaccaacaggucuugccacauagucaucuaccugaagaggcuuuggaaguuucaguugcuccuggaccaguugaccagacgauuggcacaccaacuguaaccuccccuuccagcucauuuggagagaagcccauuguuaucuacaaacaggccuuuccagagggucaucuaccugaagagucucugaaaguuucaguugcuccuggaccaguuggccagacaacuggcgcaccaacuauaaccucuccuuccuacucacaacauagagcaaagucuggcaguuucuaccaacuggcauugcuagguagucaaauaccugaagaggcucucagaguuucuucugcuccuggaccagcugaccagacaacuggcauaccaaccauaaccucuacuuccuacucauuuggagagaagccgauuguuaacuacaaacaggccuuuccagauggucaucuaccugaagaggcucugaaaguuuccauuguuucuggaccuacugaaaaaaagacugacauaccagcaggaccuuuagguuccagugcacuuggagagaagcccauuacuuucuaccggcaggcucugcuagacaguccucuaaauaaagagguugugaaaguuucagcugcuccuggaccagcugaccagaagacugagacauuaccaguacauucuacuagcuacucaaauagggggaagccugucauuuucuaccagcagacccuaucagacagucauuuaccugaagaagcucugaaaguuccaccuguuccuggaccagaugcccagaagacugagacaccaucaguauccucuaguuuauacucauauagagagaagcccauugucuucuaccaacaggcccugccagacagugagcuaacucaagaagcucugaaaguuucagcuguuccucaaccagcugaccagaagacuggguuaucuacuguaacuuccucuuucuauucacauacagagaagccuaauauuucuuaccagcaagaguugccagauagucaucuaacugaagaggcucugaaaguuucaaauguuccuggaccagcugaccagaagacugggguaucaacaguaaccucuacuuccuacucacacagagagaagcccauuguuuccuaccagcgagaguugccgcauuuuacugaagcagguuugaaaauuuuaagaguuccuggaccagcugaccagaagacuggaauaaacauccugcccucuaauuccuacccacagagagagcacucugucauuucuuaugagcaggaguugccagaucuuacugaaguaacuuugaaagcaauagggguuccugggccugcugaccagaagacugggauacaaauagcauccucuaguuccuacucaaauagagagaaggccaguauuuuucaucagcaggaguugccagauguuacugaagaagcuuuaaauguuuuuguuguuccuggacaaggugaccggaagacugagauaccaacaguaccuuuaaguuacuacucacguagagagaagcccaguguuaucucucaacaggaguugccagacagucaucucacagaagaggcucugaaaguuucaccuguuucuauaccagcagagcagaagacugggauaccaauaggacugucuaguuccuacucacauucacauaaagagaaacucaagauuucaacugugcauauaccagaugaccagaaaacugaguuuccagcagcuacccuuaguuccuacucacaaauagagaagcccaagauuucaacugugauuggaccaaaugaccagaagacuccaucccagacagcuuuucauaguuccuauucucaaacaguaaagcccaauauuuuauuucaacagcaguugccagauagagaucaaaguaaagguauucuaaagauuucagcugucccugaacuaacugaugugaauacuggaaaaccaguaucucucucuaguucuuauuuucacagagagaaaucgaauauuuucaguccacaggaauugccagguagucauguaacugaagaugugcugaagguuucaacaauuccuggaccagcuggccagaaaacaguauuaccaacagcucuuccuaguuccuuuucacaucgagagaaaccagauauuuucuaucaaaaggauuugccagauagacaucuaacugaagaugcucuaaagaucucaagugcucuugggcaagcugaucaaauuaccggauuacaaacaguucccucugguacuuacucacauggugagaaucacaagcuuguuucagaacauguccaaaggcuaauagauaauuugaauucuucugacuccaguguuagcucaaauaaugugcuuuuaaauucucaggcugaugacagaguuguaauaaauaaaccagaaucugcagguuuuagagauguuggcucugaagaaauccaggaugcagaaaauagugcuaaaacucuuaaggaaauucggacacuuuugauggaggcagaaaauauggcacugaaacgaugcaauuuuccugcuccccuugcccguuucagagauauuagugauauuucauuuauacaaucuaagaaggugguuugcuucaaagaacccucuuccacggguguaucuaauggugauuugcuucacagacagccauucacagaggaaagcccaagcagcaggugcauacagaaggauauuggcacacagacgaauuugaaaugccggagaggcauugaaaauugggaguuuauuaguucaacuacaguuagaaguccucuacaggaagcagagagcaaagucaguauggcauuagaagaaacucuuaggcaauaucaagcagccaaaucuguaaugaggucugaaccugaaggguguaguggaaccauugggaauaaaauuauuaucccuaugaugacugucauaaaaagugauucaaguagugaugccagugauggaaaugguuccugcucgugggacaguaauuuaccagagucuuuggaaucaguuucugauguucuucuaaacuucuuuccauauguuucacccaagacaaguauaacagauagcagggaggaagagggugugucagagagugaggaugguggugguagcaguguagauucacuggcugcacaugugaaaaaccuucugcaaugugaauccucacugaaucaugcuaaagaaauacucagaaaugcagaggaagaggaaagccggguacgagcacaugguaagaagaaaguuucaggcuuauaaacguuauaguuuaauaauguguuuaaaguuagauauuuauguuuugaggaagcuuagccaaugaaaaauacaagcaagaucaagaaaaaaaaugaaguuagauauuuggaguucuaaauguauuuuccaauagaauuguuagaaugacuauauuucuucuaacaauccauaaaaagccuauuuaaccaauaauguaguuaaguuacaguauuaauaguaccagccugaguuuacguucuuguucuuaggagaaguagauucugauguaugacagagaguaaagaggucgcuugggcuccugagcuccuaaagcuaucacguuucucuaauccucccauuauaguauccuuauucugaaggcagaaagagccuccaauuugcugugcucuaaauugcuuuuuguccuaaaacuacauauauuuucucuuucccuuuucuaauagaacucuugguguugaucucagacauuugaaaaaaaaaucaauguauuuuauacuaaaacuuggguuagagguuuaaaagagaauauuuacaaaucucauuaauuucuaauagaauuccauuaaaaacaaaaaucuguaagacaauauggggaauauauuuugggaggcaauuuaaaagcaauuuaggccuaccuagaaaucgucccuugagguuaacuuccuacgcuguucccugcacauuuuuauucuacaaaaaaaccuccaaguuguauuuauuacuuuuaaauaucagcugucauggaauuaugaguaauuguagcaggaacuaaagggagagguaaagaaacucaugauuaaaaggaggauuaagauaaauaugauugauuacccgauuuaaaguggcuuuuuuguagaauuaucuauagagcaugacuuaagaaaaucagacuuugcagugaaaggaucucugucaagaauuucuaauagguugucauaauugagaagaagacauacuaagcauugcaguggguauuaaauugcauauauugaugaucuucuguguugcaauuguugacaaauuaucacuuuugcauuguauuaucucaaguguaugcuuucucuccagccuggaauaugaaguucaauuuagcacaugauuguggauacuccauuucagaauuaaaugaagaugacaggaggaaaguagaagagaucaaggcagaguuauuuggucauggaagaacaacugacuuguccaagguauaaaagaaaucuggaaaugaagaaaguaaauaugaaagaaugggugauggaauuaggaucucuuacuugggcaucaguugaguugcugauaauauuuggcuaaagccuuuuuugguuuuguuuuugagacagucuugcucuguugcccaggcugaagugcagcagugcaaucacaggucacugcagcccugaacucuuagacucaaggaauccucccaccucagccucucagguagcugggaccacauguguguaccgcccugcucggcuaauuuuuaaauuuuuggcagagacagggucucuacguugcccaggcuggucuugaacgcuuggauucaagcgauccucuugccuuggccucccaaaaugcugggauuacaggcaugagccacugugccuaggcaggcaucuuaauuuuucaaaaguuaagauauaaguauuagauucuuacagucuagauauguuguuuuuauugauuccaaauucauauuuugaaaaauuuaucuucuuagaaaaauaagaacugauuugcuuguuuuaucaauuuuuuuuuuaagaacagagaagacuaaaugucacccuuauuuucucuugaaagugguaucuugaaauccagcuauuuucaaauguuuauuuuaaauacuugaguacacagcuauaauagcuuauguauaaauggcuuucauuuuaauaguacauauuuuccuucuauuaacuauuucauauguagaaaagagcauauaugaaucauuuauguaaagaauagcagcaaguaaaaauaauucccauauauuuacuaucgagcuugagaaauagaacauuaccaaauacuguugaaguucuuuguuucuccuuucccagucauaucuuuuuuauuucuuauuuugauauauaaugauuuuccuucucuucaguaugguuuugaacucuaagauggaaucaauaugauacauauucuuuugagaacuagguguuucacacaguguuaggguuuugagcugcuucuauguagaugugcagaguuuucauuuguuccuuauuacuguacaguauuccagugugugauuacaugauaauuuauucuuucuccuguggauaaggcauuuugucugcuauuuugcauaguaauaggguauaauaaugccuaucguagaggguuuugguguggauuaugugagauaaugccuauaaaaugcuuaguagaacgugugaugucuaguuaguacucaguaacuggcagcuauuauuacuauuauuaauccugaaagaauugauauagcuaucaugcaaggauuucauggccugauucauacaaaguuucuuagaaaacuauucuccagugauauaguuuauuuggauuaucucaauuuuggaaaaguuugaaaaguacaaauuagauuggauuuuagguuuuacguauaugcuugugaaaaacaaaauugacaaaauaauaagaauaauaaaaugggcaauugguugucuuagcaccauuuguauauaugcugccaaagugagcacuauccuagcaucauuuguuuaaaauuacauaguuuucucagugaucuguguuucccuauuuuuaaaaauuauuuucuugcguucauauuuccagaucccucagcaagcaaguugccuuccuuuggguagacucugguuugucuguguuuuucuuaaaauaagguguccugaauuagaugaaacacaauuucacuucugaucugaccagcaugaaguauauucaguaauucucuuucugucaauguacugugagaucuuuaauggucacagcauaauugggcauuaaaaaaaaccauguacugcuuucaaaacuuaaagcuguaggaaaaaagcaaagcaaaacaaaccaaacaaaaaccaugaacugcugccaagauuccuauucucauuucuuguaucuauauaauacuuuuuuaaaaaucuucuuauuuuugagacagagucucacuuuauugcccaggcuggacugcaguggcaugaucuuggcucacugcaacuucuacaucccagguucaagugauucuccugccucagccucccggguagcugggauuacagcugugugaguggcgcaugacaccacauccagcugaucuuuguauuuuuaguagagaugggguuucacuauguuggccaggcuggucuugaacuccugaccucaagugauccgccugccucggccucccaaaaugcugggauuacaggccauuacgccucgcccuauguaauacuuuuuaacucuccuguauuucuuuuuauugcuuuuauaucaguguucaagccuauuggaaugauuuuuaaucaaauuugaucauuuauuuuauuaaaauaucccuuucagcuuugugccauuuauauauuugauaaguauuuuuauccaaauuagcaauaaaaauguuuacuaagggcuauggauaaaaagucuaaaacuuuuggcugggcgcgguggcucaugccuguaauccuagcacuuugggaagccaagguggguggaucacuugaggucaggaguucgagaccagccuggccgacguggugaaaccccgucucuacuaaaaauacaaaaauuaccugggugucauggugcaugccuguaauccuagcuacucgggaagcugaggcaggagaauugcuugaaccugggagguggagauuguagugagccgaagauugugccagugcacuccagccuaggcgacagagggagacuuugucucaaaaaaaaaaaaaaaaaaaaggucuaaaacuuuugaauaagauuacucucacaccuauuuugaguacuucacuauacugucauucaaccaucuuguguuucaccaucuuaugauugacuuuuuucagucuauuaacugaguaguugcgaaauaguguuugucuagauaugccuuguccuuagggaacccauauuggccacacuguguacgguuuuggaccuuuuauuuuuuuaacuuaaauauauuaggauuucccuuuaaaacuucucuaaaagcauaauuucacagguauguaauaucccauuguaugaacauaacaauuuauucacuacccuacuguuggacauuuauucauucauuccaaaaauacauauugaaugccugauaugcgccauccucaucuauagccugaggacacaccacugaacaaaauagacaaacauuucuucaucaugagcuuacauuaaggaagaguauaugaauaacaaccaaacaaguaaaauaaaugucagauggugggauaagagccagggagacaaagcagaauggucaacacagaaccugagaaagagguauugaauuaaauaucugaguaaggugagaaaguaaggcaguuaacagugacaagagcauuccagacagaaauagcaugcacacaguugcugagguaaagugugugaaaggaaagggaguguuaaaggaaagggaggaggccaguguguuuggagagugagagugaaagggagaagacuagauuguggaaggcagugguucuugacggguaguaaaugccucccaaagagauauuuuggaaaauuaugugauuuuucuugggucaucacuguaauuggggauuguuucuggaaugcaguagauaggugucagguauguuacuauuucuauaauguacaagacaguuccacacaaugaagaguugucccuugucacauacagcuuuugaaugucccuguagauauuaauguugaugaaaaaccuguuauaaauuacuucaguguuugucauguuuuaaaugauuuuuuuuuuaguauaggguguuucuucuguuuuuucuuucuuucaugacugacauuuuugaagaguacaaccuaguuacuuugcagauuucccucaaauugaauuuaucugguguuuuaucaugauuugauucagauuugauuuuuauguaggaaagccacagaagugaugugcuuuucaugcuugucaggaggcacauuauguugauuugucucaauacuuguaauguuaacucauaccacuuaguuaaggugguaucugcugguuuguguguuuuacauauuaauuaauaaguuaauaaauauuagggagagauucuuugagacuguaaauaucucuaguuuaggaucuaguguuuauacuugccugaauaauuuauuaauaaaauagcuuuaauuugguuauugaaaaaaauuccaucauugcuucaacauuucauuggaguucugugguaaguuaaaagugucccuucuccauuuauuuauuuauaucauuauggacucuuggauuuuucguuuacucaaagggucacaaccuaucacuaucauuguuuauuuugauacucaaauuaucccacacuugcccacuggaaccauuuuaagcugguuccuguguguucuuaugaucccaucauuucaugagcauucacccacuuucugagcuaggaagacacucuaggaauaucuuauauuuucuuuucaccaacccuagagcuguccauuucuccaaggggcgcugguucuuuuuagcagagaguggcauguagaaacuaagaucuguaugcuuggugugcuuauugauacuaugaugcuguugccuuuaugcccuuucagcagacaauguguguguacauaauuacacgcaccccccucuccccuguaggccuguuuccuuaucuauuacuuuuauuauaaaaugagagcugaguuuauacuaguacauccaauuccauuccaguacuacaggguuauucuagccuuuuuuucuuucuuuauuuguaacucacuucccugauaguaagaaacuuggcucccauuauccuccauauauuuacuuguuuaaacucccuuguauguuucucccucagccccacugcucuucaugccugcaacagauugaauuucuuucccagccccaacucuuucaacccacaaguuuuauauguaauauaauuauuauuauaccauuccagauauuuuuaaauuuccauuaugauuucuuucaacaaugaauggugauauauuaggaugauaccuucagugugcugaaagaaaauaaauuauaucuaucuagaauugcaugucagugaaaaucuguuuuaagaaugugguaauauaaaaaugauuuuagacaaaaacaguucauucagcacucauuaaaaaauucggguggagccaagauggccaaauaggaacagcuccggucuacagcucccagugugagcaacgcagaagacuggugauuucugcauuuccaucugagguaccggguucaucucacuagggagugccagacaguggguguaggacagugggugcagcgcaccauucacaagccgaagcagggcgaggcauugccucacucgggaagugcaaggggucagggaguucccuuuccuagucaaagaaaggggugacagacggcaccuggaaaaucgcaucacucccacacuaauacugcgcuuuuccgacgggcuuaaaaaacggcacaccaggagauuauaucccgcacauggcucggaggguccuacgcccacagagucucgcugauugcuagcacagcagucugagaucaaacugcaaggcagcagcgaggcugggggaggggcgccugccauugugcaggcuugauuagguaaacaaagcagccuggaagcucgaacuggguggagcccacuacagcucaaggaggccugccugccucuguaggcuccaccucugggggcagggcauagccaaacaaaaggcagcaguaaccucuguagacuuaaaugucccugucugacagcuuugaagagaguagugguucucccagcacgcagcuggagaugugagaaugggcagacugccuccucaagugggucccugacccccaagcagccuaacugggaggcaccccccaggaggggcagacugacaccucacacgaccggguacuccucugagacaaaacuuccagaggaaugaucaggcagcagcauuugcgguucaccaauauccgcuguucuacagucacugcuguugugcagccaccgcugcugauacccaggcaaacagggucuggaguggaccucuagcaaacucccaacagaccugcagcugaggguccugucuguuagaaggaaaacuaacaaacagaaaggacauccacaccaaaaacccaucuguacgucaccaucaucaaagaccaaagguagauaaaaccacaaagaugcagaaaaaacagagcagaaaaacuggaaacucuaaaaagcagagcgccucuccuccuccaaaggaacgcagcuccucagcagcaacggaacaaagcuggauggacaaugacuuugaagaguugagagaagaaggcuucagaugaucaaacuacuccgagcuacaggaggaaauucaaaccaauggcaaagaaguuaaaaacuuucaaaaaaauuagacgaauggauaccuagaauaaccaaugcagagaaguccuuaaaggagcugauggagcuaaaagcaaaggcgcgagaaccaugugaagaaugcagaagccucaggagcugaugcgaucaacuggaagaaaggguaucagugauggaagaugaaaugaaugaaaugaagcgagaagggaaguuuagagaaaaaagaauaaaaagaaacgaacaaagccuccaagaaauaugggacuaugugaaaagaccaaaucuacgucugauugguguaccugaaagugacagggagaauggaaccaaguuggaaaacacucugcaggauauuauccgggagaacuuccccaaucuagcaaggcaggccaacauucagauucaggaaauacagagaacgccacaaagauacuccucgagaagagcaacuccaagacacauuaauugucagauucaccaaaguugaaaugaaggaaaaaauguuaaggacagccagagagaaaggucggauuacccacaaagggaagcccaucagacuaacagcggaucucucggcagaaacccuauaagccagaagagagugggggccaauauucaacauucuuaaagaaaagaauuuucaacccagaauuucauauccagcgaaacuaagcuucauaagugaaggagaaauaaaauccuuuacagacaagcaaaugcugagagauuuugucaccaccaggccugcccuaaaagagcuccugaaggaagcgcuaaacauggaaaggaacaacugguaccagccacugcaaaaacaugccaaaauguaaagacugucaaggccaggaagaaacugcaucaacuaaugagcaaaauaaccagcuaacaucauaaugacaggaccacauucacacauaacaauauuaacuuuaaauguaaauggacuaaaugcuccaauuaaaaggcaaagacuggcaaauuggauaaagagucaagacccaucagugugcuguauucaggaaacccaucucaugugcagagacacacauaggcucaaaauaaagagauggaggaagaucuaccaagcaaauggaaaacaaaaaaaggcagggguugcaauccuagucucugauaaaacaaacuuuaaaccaacaaagaucaaaagagacaaagaaggccauuacauaaugguaaagggaucaauucaacaagaagaacuaacuaucuuaaauauauaugcacccaauacaggagcacccagauucauaaagcaaguccuuagugaccuacaaagagacuuagacucccacacaauaacaaugggagacuuuaacaccccacugucaacauuagacagaucaacgagacagaaaguuaacaaggauacccagcaauugaauucagcucugcaccaagcagaccuaauagacaucuacagaacucuccaccccaaaucaacagaacauacauuuuucucagcaccacaccgcaccuauuccaaaacugaccacguaguuggaaguaaagcacucucagcaaauagaaaagaaauuauaacaaacuaucucucagaccacagugcaaucaaauuggaacucaggauucagaaucucacucaaaaccgcucaacuaccuggaaacugaauaaccugcuccugaaugacuacuggguacauaacgaaaugaaggcacaaauaaagauguucuuugaaaccaacgagaacaaagacacaacauaccagaaucucugggacacauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaauuaaugaauccaggagcugguuuuuugaaaggaucaacaaaagaccgcuagcaagacuaauaaagaaaaaaagagagaagaaucaaauagacacaauuaaaaaugauaaaggggauaucaccaccgaucccacagaaauacaaacuaccaucagagaauacuacaaacaccucuaugcaaauaaacuagaaaaucuagaagaaauggacaaauucuuugacacauacacccucccaagacuaaaccaggaagaaguugacucucugaauagaccaauaacaggaucugaaauugaggcaauaaucaauagcuuaccaaccaaaaaaaguccagguccagauggaaucacacugaauucuaccagagguacaaagaggagcugguaccauuccuucugaaacuauuccaaucaauagaaaaagagggaauccucccuaacucauuuuaugaggccagcaucauucugauaccaaagccaggcagagacacaaccaaaaaagagaauuuuagaccaauaucccugaugaacauugaugcaaaaauccucaauaaaauacuggcaaacugaauccagcagcacaucaaaaagcuuauccaccaugaucaagugggcuucaucccugggaugcaaggcugguucaacauaugcaaaucaauaaacguaauccagcauauacacagaaccaaagacaaaaaccacaugauuaucucaauagaugcagaaaaggccuuugacaaaauucaacaacccuucaugcuagaaacucucaauaaaugagguauugaugggauguaucucaaaauaauaagagcuaucuaugacaaacccacagccaauaucauaccgaaugggcaaaaacuggaagcauucccuuugaaaacaggcacaagacaggggugcccucucucaccacuccuauucaacauaguguuggaaguucuggccagggcaguuaggcaggagaaggaaauaaaggguauucaauuaggaaaagaggaacucaaauugucccuguuugcagaugacaugauuguauaucuagaaaaccccguugucucagcccaaaaucuccuuaagcugauaagcaacuucagcaaagucucaggauacaaaaucaauguacaaaaaucacaagcauucuuauacaccaacagcagacaaagagcgagccaaaucaugagugaacucccauucacaguugcuucaaagagaguaaaauaccuaggaauccaacuuacaagggauggaaggacuucuucaaggagaacuacaaaccacugcucaaugaaauaaaagaggauacaaacaaauggaagaacauuccaugcucauggguaggaagaaucaauaucgugaaaauggccauacugcccaagguaauuuauagauucaaugccauccccaucaagcuaccagugguaauuuauagauucaaugccauccccaucaagcuaccggugacuuucuucacagaauuggaagaaacuacuuuaaaguucauauggaaccaaaaaagagccugcaucgccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccacauaucuacaaccaucugaucuuugacaaaccugacaaaaacaagaaauggggaaaggauucccuauuuaauaaauggugcugggaaaacuggcuagccauauguagaaagcugaaacuggaucccuuccuuacaccguauacaaaaauuaauucaagauggauuaaagacuuacauguuaguccgaaaacugugaaaacccuagaagaaaaccuaggcaauaccauucaggacauaggcaugggcaaagacuucaugucuaaaacaccaaaagcaauggcaacaaaagccaaaauugacaaaugggaucuaauuaaacuaaagaguuucugcacagcaaaagaaacuaccaucagagugaagaggaaaccuacaaaaugggagaaaauuuucgcaaccuacucaucugacaaagggcuaauauccagaaucuacaaugaacucaaacaaauuuacaagaaaaaaacaaccccaucaaaaagugggugaaggauaugaacagacacuucucaaaagaagacauuuaugcaggcaaaaaacacaugaaaaaaugcucaucaucacuggacaucagagaaaugcaaaucaaaaccacaaugagauaccaucucacaccaguuagaauggcgaucauuaaaaagucaggaaacaacaggugcuggagaggauguggagaaauaggaacacuuuacacuguuggugggacuauaaacuaguucaaccacuguggaagucagugugucgauuccucagggaucuagaacuggaaauaccauuugacccagccaucccauuucuggguauauacccaaaggauuauaaaucgugcugcuauaaagacacauacacauguacguuuauugcggcacuauucacaauagcaaauacuuggaaccaacccaaauguccaagaaugauagacuggauuaagaaaauguggcacauauacaccauggaauacuaugcagccauaaaaaaugaugaguucauguccuuuguagggacauggaugaaacuggaaaccaucauucucagcaagcuaucucaaggacaaaaaaccaaacaccacauguucucacucauaggugggaauugaacaaugagaacacauggacacaggaaggggaacaucacacucuggggccuguugugggguggggggaggggggaggggggagggauagcauuuggagauauaccuaauguuaaaugacgaguuaaugggugcagcacaccaacauggcacuuguauacauauguaacaaaccugcacauugugcacauguacccuaaaacuuaaaguauaauaauaauaaaauaaaaaaauucuaagugguuaccucagacuaaacggaaauaaucuaauaugggaaauuugugauguaggaaauauuaaagagcaaaagauguguuaaguauguggauaaauaaagcuaaauacuuaaguauaugaaacaaaaauacuaggaccuucaugacugagaugaaauguuauaaacuuaaaauauaugacaacaauaucuuacagguuagaagcugcauaaauggaguuaauuuuuuccaaguuucuuaaguguuugggaaaaagcuguuauuuacuuuagcuugauaacuauauguguuauaauuucuauaauaacccuguccccuacaucauaccuuacuacaaaauuaauuugagauggaucauagacuuuacuuugaaagguaaaauaaaguuucuugaaaaucucuucaugauguuggguuaggcaaagguuucuuaaacaagaacaaaaauacacuucauaaaagaaaggauugcuaaauugcucuucaugaaaguuaagaaugguaaucaaaaggcagcaugaagagugaaaagucaagcuacacaguggaagaggguauuucggauacauauauuugauaaaggacauaaauucagaauauauaaggaagucaugcaaaucaauuauuccuacccaaagacuucacuaggugucucauaaaugaagauauccaaguggacaguaagcauuugaaaacauugucaauaucacugccuguuugguaaugcaaguuaaccauaaugagauacugcuucauaucagaguagcuaaaauuaaaaagaacaaugcuaaauauugguaaaguuaugaagcaacuggaauagucauuuauugcugaugggaagguaaacugguacacaacucuuaaaauaauuuauaguuauuucauaaugguaaacaugccuuaccugggacacuucauuccuacuucuuuuuagguacguacucaagaacuaucaguacauauguucaguagaagacauggucaauaauaauuauagccccaaacugaaaacuacauaaauguauaucaagaguagaauagaugaaucaauuaugcuuuauucauccagugaaauccuguguagccauaaaagauagcaaacuacuacugccucaacaaccuugaaagcugucacacacguuaugguuagcaaaaaagccagacacaaagagucauacugaauaauuccauucauaugaaauucaaaaacuaaucaauggugagaaaagugauaagaaugguuaccucugguggagucaggugugugguauugacugggaagacgcacaagaggucuucucagguauaggaaguuuuuguauaucuggauaugggcagcauuuacauugcugucaucacauauaaaaaauaaacuaccugacuucagauuuguacaccuuauuaaagauuuauuauauauuaauuaaaaggaaacauugaacaagagauacaauugaaaucauagaaaaggaacuuuaagaaggcaaccauuucuaaucauagcaaaaacuuuauaaaaagcaucaaggcauaaaucuaacaagauuuaugagaucuuuuauuggagaauaguaaaauuuauuuugaaaggcuaguagaaguccuaaguacauagagaaauacacuguauuuauuaauaagacucuauauccaccuagcacaaacugcuucaaugaaucaaggcagauguuucuuuaaauuuuuuuuaucaugguaaaauacacaacacaaaauuuaccucaacuguuuuuaaguguacaguuuacugguguuaaguacauucauauuguugugcaaccaccaccaccauccgucuccaagacucuuuucaucuuguaaaacugaaacuuauacccauuaaauaauaacuucucauucugucuucccaucugccccaggcagccaccauuuuccuuuuugucucauaugauuuugauuacucugaguacuuccuauaaauggaauaauacaauauuugucuuuuugugacuggcuuauuucacuuagccucaugugguucauccauguuguagcauauguuauaauuuuguaaagugagucuguuguagacaguauauaguuggaucauucugccaaucucuauugauuaaauuuauuuacuuuuaaaguaauuaacaauaaggaggaaccugcuucuguccuuuuucuauuuguuuucuacaucaagguacaaauuuuauguucagauacaauuccaaaccacgaugaggauuuaucuuaacuguccucuaccccacagaaaugcagaggccaacaaaucacauuuguaggcuccuaaaggaaacucucuuagauugcuugucaaaaacuguugagaucauuuuggccccuuccaugcuaugagaacgagauccacacuguacccaaugauuuacugacuucucucggcagaauacugucucuucuccuucucucuucuguuugguaaugaagagaagaaaaguuugaagucaguacuuuauaucauuuaguauauggaccaauaacucaacaaguuuagaaaaaaaaaccaugaaguaaacuuuacuuauacucuaaaauaaaccaaaccaaacuacgaaaguaguaaggaggaaauuauaaaauaaaaucuaucaguuaaugaacuagaaaacagaaaaaugauagaauugagcauuaaaaucuagauuuggaccuuggaaaaauuccaaaucagcagacaaguucugacuagcuagaagaugagaaggaaaaacauacaaugugguaaaugaaaaggagcaugccagauauaccacuuagaaaauuugaaauaauaggagaauauaauguauaacauauaacucucguuagguauaaaauuuucaugaaaugacugauuuucuuagauaauauaauuaaacagaagcguguaacagauuaaacauuaugagagagaaaaacuuuauugaucaaacauuuggcuuccaagaaaaguaccugaccuagcucaauauuagguaacauuaugaaguauuuccugggcaugauaaugacauugugguuauaugauaggugaauuauuuagggucgaagugucaaaucagugucuuuguggagggauaaagcuuuguggagggauaggggaaaauguucgacaauuguugaaucuaaauagaaggaauucacauguuuauuuuaacauucuaucaacuuuuugguauacucuuaacaaaaagaaaaaaacaaugccugacuuagauguuuauaugggugacucaagcuaucaaguaauggauaacuccugugccauauaaacaguuccaauacacuaacaaaaacuuccuaauuuacuugaggacauuaacaaaaaccucagaagacauaccugaaauuaugaaucuuuugcaucagugugaugucuccacuuuuauuucugauuuuauuuauuugagucuucuaguuuuuucuuagucuagcuaaauguuuguuaacauuguuuuuaccuuuucaaaaacuaacaauuuaguugauuucuuccuguuuuucuauuuuuuauuucugcucuaauuuuuauucuuuccuuuuuucugcuaacuuugggcuuaguuuuguucuuuuuuuucuaguuccuugagauguaaaguugaguugcuuauuugagaucuuucuuccuuuaaaaauaggcaauuaucauuagaaacuucccucuuaguccugauuuugcuucauccuguaaguguucauuuguuguguuuuugucuuuuuuaaaauuuuccuugauuucaucuuugauccacugguuguuuuaagaguguguuguuaauucccacauaauugugauuuucccaguuuuccuucuguuacugauuucuaauuuuagucuauugugcuugggaaaaaaagguugguaucauuucagucuucuuaaauuuguucagacuuguuuuaugacuuaauaugugaucuauccuggagaauguucuaugugcaguugagaagacuguguauucugcaacuguuagguggaauauucaguauauguguguucuguucauuauugaaaaugggguacugacaucuucuacuguauugcuaauugcuauuuuucccuucaguucugucaguguuugcuuuauguauuuagguacucuaauguuggguguauauauguuuauacuugugauaucuuccuaaugaauugacucuuuuaucauaugaccuucuuugucucuugggaugguuuuuuauuuaaagucuauaucgucugauaguguggccacaccugugcucuuuugguugcuaucugcauggaauauauuuuccuauuccuucacuuuuagccuguguguccuuaaaucuaaagugagucucuucuagauaguauauaguuagaucuuauuuuuaaaauuaauucagccacuauauguuuuuugauuagggaguuuacuccauuuacauuaaaguaauuauugauagggaaagacuuacuaguuccauuuuguuaauugguuucuuucuuguaguuguuuugucccuuuuguccucucuugcugucuuccuuugugauuuguugauuuugcuuugauccuuccuuuuuuuuuuuucuuucguguaucuucuauagguauuuucuuugugguuaccaaagucuuaacagaaaacaacuuauagcuacagcgaaagcaauuuaaaaaaauagacaaacaggacugcaucuaauuaaaaagcuuuugcacagcaaagaaaacaguuaagagacugaacugguaaucuauggaauaggagaaaauauuugcaaaccauguaucuaaugagggguuaauauccaaaguauauaaggaacaccugcaacucaacagccaaaaaaaaaaaaaaaaauccccaaaacaaaaaacaaauaaccugguuaaaacauggguaaaggacuugaaugaacauuucuuaagacauacaaauguguaaggugcuguauaugaaaagauauucaauaucgcuaaucaucaggaaaaugcaaaucaaaaccacaaugacugaacacuucauaucuguuaggauggcugauaucaaaacaaaacaaaugguaacaaguguuggagaggauguggagaaauuagaacccuguacacuguagauggucauguaaaaugguguagcugcuguggaaaauaguauggagauuccuuaaaaaauaagaauagaauuaccauaugaucccacuucuggguacauauccaaaggaaaugaaaucagaaucuugaggagaucccauguucacaauagcauuaaucacaguagccaagauauauaaacaagauguauaaacaucuauagaugaauggauaaagaaaaugugguauauacauacaauggaauauuauuccaccuuaaggaaguccugcuguaugugacaacauggaugacccugcaagacauuacacuaugugaaagaauccagucacagaaggacaaauacugaaugauuucacuuauaugaaauaucuaaaaauagucaaauucagaaaacagagaguagaauggugauugccaaggacugggaggaaggggaaauugggaauugauguuagguagguaucacaggcaaagcagauaguucaauauugggaaauuuauaaacaaguuuuuacauuaguagaucuaauggagaaaugauuauuucauuaagcuccaaaaaguauuugggaauaaaaauaaaaucuguaauuaaaaauauuucuuuagaguagaauauuucuuuauaguagaauaauaccucaaauaugauaaagaauauguauuugaaauuugcaaucagcauaaucaaagucaaauacuuuuguuaugcauauaaaacauuugugagaaaagucauauaauaugguggaguagggaacucuagggcucuugcaaaaacaccuaauaagcuuccagaaacuaucagaauuaguuuucguagaacucuggaauuuaguuaacauuaaaaaccaggaaaaguagggagcuguagcgcugcagaaacagaacacuauggcaccuuaaauugcucaccuaccauuccuugugccuagaugaacaaugacuuugaagacagcagcuuauacucauggugcaggcuguuagcacgagaaggauuaguacagaucuugcucucaaaaaauugugaucguuuuaaccugucugaaguaucugaaggaccaguauagagcuuccuuuuguuuuacacagcucagagcuuuccugggacugggguggcuugucugucaucacgugucaaaaguauuuaaaagccagaguaucagcuguagaagccugagucuggggauaaaaauuaggacaaugaauagguagacaaaaagccaggaaggaacgguugaaaaggagauacggggugguauaaggacuuuuaaaugcuuuuuuguaugcugagaaauugagaaugcuacguacaugccuaggauuggacaacuccucagagaaggcuugagaagacccuaagcuuucaccacuagcugaccuucaggcucugccuaacuaaguaggaugugaaggcuaagauauaguuguaaacagccuggcuuaguguugauggaaugccccaacacagagcaaaaaagacugggaguguuuuuuuucuuuccuauuaccuuuuuucuuuccuuggcugcagguguuuaaggaaccugucaaaauaguaguugacccugaagcuaagugagcacagacuucaguuccaugcacaacaaagaauguaagcuuuaugaaauagucacuaaacaacacuuacaacaagcaguaacagcaaacuccagggaagggggagaauccaguauccagaguugucacuuuauaauauucaauauguccaguuuucaacaaauuauaaggcaugcaaagaaguaaaaaagugugacucauucaaaggaaaaaagagaaauuaaugaaacuaucccugaggaagcccaccuuaaauguacucaaugagcugaacaauaccaucagcaaagaacuaagggaaaccaagaaaaggauuucccaccaaaaagaaauaucgacaaagagaaauuauaaaaaggaaacaaauagaaauucugcagcugaaaaguacaguaacaaaaauucuuuagaaggauucaauagcugaguagucugaacaaagaaucagugaacuugaagaaaggucagaugauuuauuuauucgaggagaagaaagagaaaagaauaaagaaaaugaacagggcuaugggacauccccaagcauaccaacauaugcauuaugggauucuuagagggaagagagagagagagagagagagagagaaaggggcgguaauaauauuugaagaaauaaugguugaaaacuucccuaauuuguugaaaaaugaauuucaaauggguuaaacucaaagagacccacaccaugucacauuauagucaaauuguuaaauauuuagcauagauguugguucuauuaguagaaauauacuuuccuuaaugaagucagcuuuaacagauuuuuuuuuuaaaucugguuuugaagucauaaaauacaaaacuaugagcuucuuacaaaguuauuccugccguaaauacugugguaauuuauauauuuaaaaaauugagaauuuuuuuaaaacaaguguuuccaaaagcuuauugauuuuuaaguaaguuuuguaucacaugguaauacguuucuuuuauuuguagaaaguagauuuuuacuuuuuagugcuuguugacucugugugugugugugugugugugugugugugugugugugucuauugguuuacaugacggugaagaacuacuuauuucuuuuuugguuuguuacaugaagucuuugacauuguuuguuuguuugugacagggucuugcucagucaccgaggcuggaguguaguggcuggaucuuagcucacugcaauguccaccucccgagcucaagcuauccuuccaccucagucucucaaagugcugguauuacaggcuuaagccacugcaccuggcugaugugucauuaagcuggaugaugagagaauaauauaaccugauaaaacucauguagaucuuuugagaagagauaauuuuaauugugaaauagcaucuggaaaucaguaaaagacauauuuuagcuaaccaguaauuucauaacaucuuuaucucaguauaauuuacuauaauacauaagguuugcccauuuaaaguguauaguuuauuuauagaauuuuacaauagcauaauuuuagaacuuuguugucauuagccccucucccccaauucccuagcccuaggcaaacaccaguccacuuucucucccaauucuuuuuugccaauucuggacauuuuauauaaacagaauuguaauguaugaucuuuugugacugccuucuuuuacuuagcauaguguuuucaagagucauucauguuauguuguaaugugaaucaguacuucaucccuuuuuauugccaaauuacauuucauuguauagauacuuuguuuacucauuaguugguagacauuuggauuuuccacucuggccauugugaauagugcugcuaugaacauaguguuuauguguuaggguagguguuucauuucucuugguuauauaccuaacaguagaauuacugggacauacaguaacuccauguuuaacauguugaggaacuucuaaacuuuuuucugaaguagcugcacuauuuacauucccaugagcaguauaugaggguuucaguuucuccacguccuuuccaacauuugucauuuucugucuuuuugauuauagccugguuggguguuaagggguauuuauuguguuuuuuaccuauuucuaacaacuaaugguguugaacaucuuuucaugugcuuauuggucauuuaucuuuucugaugaaauaccuauucaaauucuuuacccauuuauaaauuuaucacuguacaaauuuguugaguugcaagcauucuuuuuauauucuggauauuagaccuuuagcagauuuauggacuuaccaauauuuucucccauucuguagacuuuuuuacuuucuugauggugaccuuugauacgcaaaaguuuuaaauucugaugaacucuaacuuaucagacuuuuauucuuugcacuuuuggugacauaucuaagaaaucagugcauaacccagggucacaaagauuuaguguuuucuucugagagauuuaguuuuaguuuuuauauuuagaucugugguucuauuugaggcaauuaaaauuuuuauuuuuuuaauugugauaaaauauacauaaaauuuaucaucuuaaccauuguuaaguauaugguucaguggcguuaaguacauucauauuguuguuuaaccaaucucuauagcuuuuuaaaucuuguaauacugaaacucuauauccauuaaacaacaacuccccauuuuccccuuccccuuaggcccuagcaaccaccauucuacuuucugucucuaugaauuuggcuacucuagguaccuuauaguagcagaaucacacaguauaugucuuuuugccacugguuuauuucauucaguaguauauucuuaaaauucacccauguuguacuauaugucagaauuuccuucuuuuuugagauuauauuauuccauuguauguguaugccacaaacaaaaguuuauccauucaucuguugauagacacuugaguugcuucugccauuuggcuauugugaauagugcugcugugaacaugcuuguuauaauuaucucuucaagguccugcuuucacuucuuuuggguacagacccaaaaguggaauuccuggaucauacagucauucuacuuuuaaguuuuugaggaagcuccguacuguuuuccauaagggcuacacuguuuacauucccaccagcaguauucgaggguacugauuucuccacauccuugccaauacuuguuauuuucuguuuuuuuuuguuuuuuuuuuuccuucuuaauaauggcuauucuaacaggucugaauugaugucucauugugguggugauuuucauuucccuuaugauuaguaauauugagcuucuuuucauuuuugguuggccaguuguauaccuucucuggagaaaugucuauuauuuuugccuaucuuugaaucagguuuuguuguuguuguuccugaguuguaaguguccuuuauauguucuggauauuaaccuugcaucagauacagugagucuuugccucacaucuuuguuaaguucuuggaaacugaccuguaagugaagugacguauagcauagcaaaacaaacugauauaaguuaauugauaaaacaagaguuaaguuccuaugguauucaguacauuguuucacuuaaaggugcaauuucuaaguaccuauugaugauguuaagugaagacuuauuguacaugauuugcaaauauuuucucccauuuucuagguuaccuuuucacucuguugaugguguccuuuggugaacagaaguuuuaaauuuugauuuaguccaauuuaucaacuuuuacuuuuguugccuuucuccuuugagucaguuuuuauguauggcaugcaaauucgucuuugcauauagauauugaguuguuucagcacuguugaaaagacucuucuuucccuguugaauuuucaugaccucuuugcugaaaaucaauuuaccauaaauguuaguguuuauuucuggacugucgguucuaugccauugaucuacaugacuguccuuaugccagcacugugcugucuugauuauuguagcuuuggaguaaguuuugacaucggaaagagugaguccuccaacgauguuugucauuuucaagauuauuuuggcuguucuggguuuaugaucugcuugucaauuacugaaaaaaaaaaggcuaggcuuuuaauaagaguugcauugaaucucuagauuacuaugggaaauauuaccacuugaaucucuagauuaguuuaggaaguauuaaucuuucaguccauaaacaugagccaguuuucuaguuauuuugauuuucuuccauuucauucuauguuuuuuaguauacuagacauauauuuauuuugcuaaauauauucucaaguauuuaauucuuuuucuugcuguuguaaauugaauuuuuuuuaaaaauuuauuuuuggauugugaauugcuaguguauuaaaauacaguugauuuuuguauauugcacuggcauccugcagcuuugcugaacuuauuagucuuaauugguuuguccugguuuccuugggauuuccuguaugaaguucaugucaucugcaaauagauauaguuguacuucuuucuuuccaaucuagaugucuuuaauuucuaaccugguugcccuggcaauauguaacauccaauaugauacugaauagaagagguaagaauggccauacuugucuuguucuugauuguagggagaaagcaucuagcuuuucauuauucgguauuauguuagcgcugagucuuucauagguacucuucaucugguuaaagaaaucccuuccauuccuaguuugcugagaaauuuuaucacaaaaacguauuggguuuuguugaacugaacaguagcuuuuaagagccuguuacauaucuaaugacaugugguugguuuguuguaaaauuacuuggaaaugguuaugugaaaauacugaaauuuacuuggcaaauacuaaagcuacaagaauuuuuaaaauggaaagguuauuaugaaagcuugaaagaugcaaugggaggagguagagcaugaaguguuaaaaaauuuguaagauauaauuguuggaaaggaagaagagaaauauauuuugggaugaguauaaaucuacucaugcauacuuuuaagaggcuggaauagguuuauguuucucaaauucggauauuugcuucccacugauaugucaggagguaucaaggcaauaagaagccacagaauaaaaacaacauuuuuuuugcccaaauaaaauuuuuacaucuauuuuuaucagcuaaugacgaauauuuuuauuuauuuaguaauuuauucguuuauuuauuuauuuauuuauuuauuuauuuuacuuuaaguuccaggauacauaugcagaacgugcagguuuguuacacagguauacaugugccauggugguuugcugcaccuaucaacccaucauuuagguuuuaagcccugcauacguuagguauuuguccuaaugcucucccuccccuugccccugaccccaccgacaggccccggugugugauguuccccucccuguguccauguguucucauuguucaacucccauuuaugagugagaacacgugguguuugguuuucuguuccuguguuaguuugcugagaaugauggcuuccggcuucauccaugucccagcaaaggacauggucuuauucuuuuuuauggcugcauaguauuccaugguauauaugugccacauuuucuuuauccagucuaucauugaugggcaaaaaguggcauuuuuaaaguguuaguuuuguccagugguauuuaauuuuuuuuaagucaacauuuuguuuugaaauaauuguaguuucacaugugauaaauaauauagagauaucacauauacccuucacccaauuuccccaagugguaacaucuugcauaacuguggugauauaucacaaccacaacguugauauugauacagccaagauacugaacauuuacaucacuacaaaggugccucaugauaccuuauaauagcuacuuccacuucucuccugccccaccuuuuacugagcuccuggcaaccacuaauuuguuccuuuguuucuauaacuuuguaauuucaagaaugucauauaaaugauaacauauaguaugcaaccuuauuguauuggccuuuuuuucacucagcauacuuaucuggagauucauccagacuguuuuauguaucaguaguuuuucuuuuuuauugauguauaguauuccaaaguaugaaugcaccacaguuuaaauauucacuauugaaggacaucuugguuguuucccaguuuuuggcuuuaccaguacagcugcuguaaacauucauaugcaaguuuuugugugaauaugucuuuguuucugugggguagaugcccaggauugcaauugcugggucaugugguaguugcauguuuaguuuuuugaaagacaggccacaccuuuuuccagggugguuauaucauuuacauucccaccagcagugugugaguaauccgucuacuccauauccucaccagcauuugauacugucacuauuuuuauucuagucauucuaauagguauguagugguaucuuauuaaguuuuuaauguguauuucccuaaugguuuuugauguugcacauuuuuuaauauuucuguuuccagucucuuucuccuguuaagugaaaugucuguaucuuuugcccauuuucuuuuuuuauuuuuauuuuuauuuauuuauuuuuauuauuauacuuuaaguuuuaggguacaugugcacauugugcagguuaguuacauauguauacaugugccaugcuggugugcugcacccacuaacuugucaucuagcauuagguauaucuccuaaugcuauccguccccacuccccccaccccaccacaguccccagagugugauauucuccuuccuguguccaugugaucucauuguucaauucccaccuaugagugagaauaugcgguguuugcuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuauaauucuuggacauuuggauugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucgccacauugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauguccagugaugaugagcauuuuuucauguguuuuuugucugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauuuuguagguuuccuguucacucugaugguaguuucuuuugcugugcagaagcucuuuaguuuaauuagaucccauuugucaauuuugucuuuuguugccauugcuuuugguguuuuagacaugaaguccuugcccacaccuauguccugaaugguaaugccuagguuuucuucuaggguuuuuaugguuuucagucuaacauguaagucuuuaauccaucuugaauuaauuuuuguauacgguguaaggaagggauccaguuucagcuuucuacauauggcuagccaguuuucccagcaccauuuauuaaacagggaauccuuuccccauugcuuguuuuucucagguuugucaaagaucagauaguuguagauaugcugcauuauuucugagggcucuguucuguuccauugaucuauaucucuguuuugguaccaguaccaugcuguuuugguuacuguagccuuguaguauaguuugaagucagguagcgugaugccuccagguuuguucuuuuggcuuaggauugacuuggcgaugcaggcucuuuuuugguuccauaugaacuuuaaaguaguuuuuuccaauucugugaagaaaggcauugguagcuugauggggauggcauugaaucuguaaguuaccuugggccguauggccauuuucacgauauugauucuuccuacccaugagcauggaauguucuuccauuuguuuguauccucuuuuauuuccuugaguagugguuuguaguucuccuugaagagguccuucacaucccuuguaaguuggauuccuagguauuuuauucucuuugaagcaauugugaaugggaguucacucaugauuuggcucucuguuugucuguuguugguguauaaggaugcuugugauuuuuguacauugauuuuguauccugagacuuugcugaaguugcuuaucagcuuaaggagauuuugggcugagacagugggguuuucuagauauacaaucaugucaucugcaaacagggacaauuugacuuccucuuuuccuaauugaauagcuuuuauuuccuucuccugccuaauugcccuggccagaacuuccaacaccauguugaauaggaguggugagagagggcaucccugucuugugccgguuuucaaagggaaugcuuccaguuuuugggcauucaguaugauauuggcuguggguuugucauagauaacucuuauuauuuugaaauacgucccaucaauaccuaaucuauugagaguuuuuagcaugaaguguuguugaauuuugucaaaggcuuuuucugcaucuauugagaaaaucaugugguuuuugucuuuggcucuguuuauaugcuggauuacauuuauugauuugcauauauugaaccagccuugcaucccagggaugaagcccacuugaucaugguggauaagcuuuucggugugcugcuggauucaguuugccaguauuuuauugaggauuuuugcaucaauguucaucaaggauauuggucuaaaauucucuuuuuuuguugugucucugccuggcuuugguaucagaaugaugcuggccucauaaaaagaguuagggaggauucccucuuuuuccauugauuggaauaguuucagaaggaaugguaccaguuccuucuuguaccucugguagaauucggcuguuaauccaucugguccuggacucuuuuugguugguaagcuauugauuauugccacaauuucagauccuguuauuggucuauucagagauucaacuucuuccugguuuagucuugggagaguguaugugucgaggaauuuauccauuucuucuagauuuucuaguuuauuugcauagagguguuuguaguauucucugaugguaguuuguauuucugugggaucgguggugauauccccuuuaucauuuuuaauugugucuauuugauucuucucucuuuuuuucuuuauuagucuugcuagcagucuuuuguugauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugugucccagagauucugguauguugugucuuuguucucguugguuucaaagaacaucuuuauuugugccuucauuucguuauguacccaguagucauucaggagcagguuguucaguuuccauguaguugagcgguuuugagugagauucuuaaucuugaguucuaguuugauugcacuguggucugagagauaguuuguuauaauuucuguucuuuuacauuuguugaggagagcuuuaguuccaaguauguggucaauuuuggaauaggugugguguggugcugaaaaaaauguauauucuguugauuugggguggagaguucuguagaugucuauuagguccacuuggugcagagcugaguucaguuccuggguauccuuguugacuuucugucucguugaucugucuaauguugacagugggguguuaaagucucccaugauuaaugugugggagucuaagucucuuuguaggucacucaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcaugugagauggguuuccugaauacagcacacugaugggucuugacucuuuauccaauuugccagucuuugccuuuuaauuggagcauuuaguccauuuauauuuaaaguuaauauuguuaugugugaauuugauccugucauuaugauguuagcugguuauuuugcucauuaguugaugcaguuucuuccuagucuugauggucuuuacauuuuggcaugauuuugcagcggcugguacugguuguuccuuuccauguuuagugcuuccuucaggagcucuuuuagggcaggccuaguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuauaggguuucugccgagagauccgcuguuagucugaugggcuucccuuuguggguaauccgaccuuucucucuggcuguccuuaacauuuuuuccuucauuucaacuuuggugaaucugacaauuaaugugucuuggaguugcucuucucgaggaguaucuuuguggcguucucuguauuuccugaaucugaauguuggccugccuugcuagauuggggaaguucuccuggauaauauccugcagaguguuuuccaacuugguuccauucuccccaucacuuucagguacaccaaucagacguagauuuguucuuuucacauagucccauauuucuuggaggcuuugcucauuucuuuuuauucuuuuuucucuaaacuucccuucucgcuucauuucauucauuucuucuuccaucgcugauacccuuucuuccaguugauggcaucggcucuugaggcuucugcauucuucacauaguucucgagccuuguuuuucagcuccaucagcuccuuuaagcacuucucuguauugguuauucuaguuacacauucuucuaaauuuuuuucaaaguuuucaacuucuuugccuuugguuugaauguccucccguagcucagaguaauuugaucgucugaagccuucuucucucagcucgucaaagucauucuccauccagcuuuguuccauugcuggugaggaacuguguuccuuuggaggaggagaggugcucugcuuuuuagaguuuccaguuuuucugcucuguuuuuuccccaucuuugugguuuuaucuacuuuuggucuuugaugauggugauguacagauggguuuuugguguggauguccuuucuauuuguuaauuuuccuucuaacagacaggacccuccgcugcaggucuguuggaauacccugccgugugaggugucagugugccccugcugggaggugccucccuguuaggcugcucaggggucaggggucagggacccacuugaggaggcagucugcccguucucagaucuccagcugugugcugggagaaccacugcucucuucaaagcugucagacagggacauuuaagucugcagagguuacugcugcuuuuuguuugucugugcccuuccuccagagauguagccuacagaggcaggcaggccuccuugagcuguggugggcuccacccaguucgagcuuccaggcugcuuuguuuaccuaagcaagccugggcaauggcgggcgccccucccccagccucgcugccaccuugcaguuugaucucagacugcugugcuagcaaucagcgagacuccgugggccuaggacgcucggagccaggugcgggguauaaucucguggugcgccguuuuuuaagccgguuggaaaagcgcaguauucgggugggagugacccgauuuuccaggugcguccgucaccccuuucuuugacuaggaaagggaacucccugaccccuugcgcuucccaagugaggcaaugccuugcccugcuucgucucgcacacggugcgcgcacccacugaccugcgcccacugucuggcacucccuaguuagaugaacccaguaccucagauggaagugcagaaaucaccgucuucugcguggcucacgcugggagcuguagaccggagcuguuccuauucggccaucuuggcuccugucccucuuuugcccauuuuuuaauuggauugucuuuuuuuucccuuuuuacuguugugaauuguauauauauguuaguauauauguuagauguaaggcuagcagauacaagaccuuuguuggauaugagguuugcaaauauuuucuuguaaccuguagcugggagagagaggggcauuuuguuuugcuggauagucuagguaggcuucgcuagacuuucacugacgccgcaaggaagggauagcacuuuaucagccagcagagaugaaaguaaguccuggguuccucacuuggccuuugcugguguuggugugagugggucuaguuuuuucugugaugguuggcuggaguagaaugguuauuauuuaaaaguucucucuuuugcuaggcuucaccucuacuggguuuuuagcuagugagaaaagcucuuguuaggguuuuuugucuguguccauuguuccuggguagcugacuucuucagcuccaagucuguauaugcaagagaaaaagaaaacccagugauugcaccacagcauaauuccucaggucccuagaucucuagcuaaucuacguucuucucuacaucuuucagauucuucuuacauuuguuuuauauauauuuuccagugggcugaauuauacuuagcaggagaaauagggaaaaguacaucuggccaggcgcaguggcucaugccuguaaucccagcacuuuggggaggcugaggcaggaggaucccuugaauccaggaguuggagaccagccugggcaacaaagugagacccagucucuacaaaaauaaaaauaagaaaauuagcccgguguaguggcaugugccuguugucccagcuauccaggaggcugagguggcaggaucgccugagccugggaggucguggcuucagugauagugccacagcauuccagccugggugacacagcaagacccugucuuaaacaaagaagaagagaaaagaaagaaaaaugucacaggauccucagggugucaguuugcaagcuggaaaccacuguggccagcagcaccuucugccugaguauuguucacacugcugggcacauucuccgcacuuggccuggcaggcugugcuuggcucgcacuacuaugcuaugucuuacaccugccaagcaugagccagguguggaguggugaggggugugugggcaagcaaguguggggucuagccacuguacacagccaggcaugcugacggcugugguagggcaggcagcuccagugcuggcacuggugcuggcgccacgcaaggcugcagcuggaccagauguacugugcguggcuucugcugugggcacccacaucugggugagggaaauguggugguggcaacuggaagcuuggaagacaccaggaaccacaaaaccccaaagagggugucauaguccuggcucagggacccccuaggucugggcuucccgaaaggccacagcuugucucuucuucuuguucccugcaacauggcaggcggggagggggcauguuucagcccuguuuguguuacagcucuuuuagucccaccauuugguggauccugagcucuuguccugcauccaugaagaaugagguauguggacaacuggagggugagcaagauggagaggaguuucaucgaguggcagaacaguuuucaggagacccaaaguggguagcuccuuucugcaggcaggucauccugaugacuguccaucugucaguggagaggagaaccuagaguggguagcuccuaccugcaugcaggucaucccauaaucugcaucuuucagcagagaagagacccggaguggcuagcuccuaucugcaggcaggucauuccauugucucuccaagucuggcugaguccaggguuuuuaugggcuucaaaggggaggagaugcaugccaauugguccaugggcaggcccggaaaaagcacuauaaguucuccuuucugcgaaacuggcagcccuucaacccaucccuggcuuaaagguggagcuucacuggugaccugccccuuucugcccaggagccugucugccaucucugccaucuacgguacccauggcacacccaggcuguuuaugucagggggcgccugcaggcccacucugagcugcccucagcccucccugccccugcaaccucccuccugugcuugugggugcccagugucuggaggggcggcagggggcuggugugacagugcugucccaagugugcgcacaccuggcugggucgcaacagugccuggacuuggccucaacuuugcuguguaauuggagcgggaaccaggaguggggagaggccuggcagugggagcaggcacuucugagccugcaggggcagggggaguucccagauccccgaaagugcaguggugccugggucuacagcugugacugggcagcugcagcugugcccaggagggugggguuccugccccuccaacucagaagggaguggggcuucugccuguuccuggcucccaccaccucaguacagcgaguagcccuagcuguuccuuccccacugcagcuggcaucauugcagcagccacuccagaugggaugccgcugccaucaaaaauauaucuacuccaucaccuggggagaugcagcauaauuuaaaauauuuuuaucugaaaucagauguugcuauaucaucaaauagaaugccaaguuauaaugacuguauagguaaaauacagaaaucucaaagaaauguuauauuuaugguagcuuugaguacugauccuaugcgccaggaaacaaggucuugguuuuuuccccccauuguuagggguaaaauauuaggauguaggucaagcuucuguaauagccaaacauagaguggcucaaauaagauagaauuuuauuuuuucacgucauuguucauguuaggaaagugagcucuguuccuugaugucauccagggacccaagcuggcuggacaacuaagcugucuuacacaugacuuccaagguuguuccaugcauuaccauuuucaggaggcaagaaaaauagugaugauagugguggugauauugggggaacaugcaggucaagaacuugauuuuaaggacaggaagcagaaguuguacuugaugccuucauucauaucccauuggugucagucuaguaaugugguuacaacuagcugcagaagaaacaggaaaugucucccacuugguggcuauguggccagcaaaaauuugaguaaggcauuucuauuauuaaaagaaaggugagaauacuuacugguggacaauaguaaucuuugcuguuuacuuuaguggaaauuuuuuagaagaacucucugaguggucuuaaucauugugagccauuuuauucuguaguuaacugucuuuuuugcuugcugugcucuuuguccuguuauauuauaaaagaaugacaugaccuucauggucuaaucuuagcguggguauaaaacugauuuguauaaaacugauuuguuuauaacuacuuggacuacuucaaauaagaaccuguuuguuuguaucuucuaggguuuacagaguccacggggaaugggaugcaagccagaagcuguauguagucacauuauuauugagagccaugaaaagggauguuuccggacucuaacuucugaacauccacaacuagauagacacccuugugcuuucagaucugcuggacccucagaaaugaccagaggacggcagaacccaucaucaugcagagccaagcaugucaaccuuucugcauccuuagaccagaacaacucccauuucaaaguuuggaauuccuugcaguuaaaaagucauuccccauuucagaacuuuauaccugaugaauucaaaaucagcaaaggucuucgaaugccauucgaugaaaagauggacccuuggcugucagaauuaguagaaccugcuuuugugccaccuaaagaaguggauuuucauucuucaucacaaaugccguccccagaacccaugaaaaaguuuacuaccuccaucacuuuuucaucucaccgacauucuaaaugcauuuccaauuccucuguuguuaagguugguguuacugaagguagccaguguacuggagcaucuguggggguauuuaauucucauuucacugaagaacaaaauccucccagagaucuuaaacagaaaaccucuuccccuucaucauuuaaaaugcauaguaauucacaagauaaagaagugacuauuuuagcagaagguagaaggcaaagccaaaaauuaccuguugauuuugagcguucuuuucaagaagaaaaacccuuagaaagaucagauuuuacaggcagucauucugagcccaguaccagggcaaauuguagcaauuucaaggaaauucagauuucugauaaccauacccuuauuagcaugggcagaccaaguuccacccuaggaguaaacagaucgaguuccagacuaggaguaaaagagaagaauguaacuauaacuccagaucuuccuucuugcauuuuucuugaacaacgagagcucuuugaacaaagcaaagccccacgugcagaugaccaugugaggaaacaccauucucccucuccucaacaucaggauuauguagcuccagaccuuccuucuugcauuuuucuugaacaacgagaacucuuugaacagugcaaagccccauauguagaucaucaaaugagagaaaaccauucuccccuuccucaaggucaggauucuauagcuucagaccuuccgucucccauuucucuugaacaaugccaaagcaaagcgccagguguagaugaccaaaugaauaaacaccauuuuccccuuccucaaggucaggauuguguaguggaaaagaauaaucaacauaagccuaaaucacacauuucuaauauaaauguugaagccaaguucaauacuguggucucccagucagccccaaaucacuguacauuagcagcaucugcaucuacuccuccuucaaauagaaaagcacuuucuuguguucauauaacucuuugucccaagacuucuuccaaguuggauaguggaacuuuagaugaaagauuccauucauuggaugcugcuucuaaagcgaggaugaauagugaguuuaacuuugacuuacauacuguaucuucgagaucacuggaaccaaccuccaaauuauugaccaguaaaccuguagcacaggaucaagaaucuuuagguuuucuaggaccuaaaucuucacuggauuuccaagucguacagccuucucuuccagacaguaacacuauuacucaggacuugaaaaccauaccuucucagaauagccagauaguaaccuccaggcaaauacaagugaacauuucagauuucgaaggacauuccaauccagaggggaccccaguauuugcagaucggugagucucauugugauaacaagcaagcuggauggacuuuguaauaaaggguuucaaauacuuaaguagauaucgguucuugggggaaaggccgugugauuucucugaguggagguugugucuggcuaauuacuagaagucuuucaaggaauaaauguguuaaguaagagagaacaugugacaguaaugcauuuauauuucagagggcuuuuggcaagacuugacaucaaguguuuuuaaaaauugaaugaccuugaaaagaaucuuugaucauccaaugauacaauuacgaauuuauuuacuguguuggacauaugcugaagaucuccuuuggagguugcacacacauacaugggugcuuggucacucucucucccgcucucccucucucucucucuucuccagcucucugguuccauuucaugacuucccucaaauauuuaguauuuacaaagaaaguggcuuuacaguggaaaauccuggcagauaccaguuuagucaaaugaugaagauuagcaucgccaguaaaacaucugucaacauaaugugcucccugauaugaugccccaccucauagaguauuguaggaaaggaaacccaauucagggauaaguucguuagauuuauauuauucagcccaauuuuagcacauugccauuaauucaguuuuacuuaaugagccucuuaugauauggugaagcagaacuaccuguauguuuaguauuuuaccuuauaguugaagaggcaucguaccacaguggagagcgcuaggcuuggaaaggaggaagaaagaaauguuuauucauaaucuacaugugguaguagucauggcaauaaggaacuuagauaugcuauccuacuuaguucucaucaugauccuaugaagcaggugaugauaucucuauuuuccuacugggaaaucuuuugugccaaaagauguuguuugugggcaagagaaagagcauucaaaugcauucuguuuaaucagaguaaggauuuguuccucuacacaguacucuguccuagaauuugaacccuaauuccaacacuuccaaccaugaugcuggacaacugauuuaauauccuuggcacucauauguagaaggaaaggguuggaaugcugaaaagucccuuauagcucuaaaaguuagggauugagauaauagauuggggcaaaaaaacaaggucaaucucugauuucaauguuaaaaauaguagagugccauagagaucaguaaugauaccuuuaaaauuuuuuucuuugagacagagucucgcucugucacccaggccagaguacagugaugugaucuugguucacugaaaccuccgcccccuggguucccgucccgccucagccaccugaauagcugggaccacaggcgugcaccaccaugccuggcuaauuuuuguauuuuuaguagagacgagguuuugccauguuggcaaggcuggucaguauugauacuuaaaaaaaaaaaaaaaaguuuagaaauuaaaacauugacaauuucauauacaauuuuuaaacucuucaaagguuaaaugcuaagguauuguacugaauaccuuaaaaaugagauaaagcuaugaaugagaagaaaguaauagaugauuauauauaugaacuaacaauaaugccauuuguucaggguguacguuuguaguggaugcuuauauuauacuuaguguaauaaucagaaauagauauuauuaccucaguuguggauuuaaaaaaccugagacuuagagaaaauauuuugcccaagaucacauggccauugagcauuggagguggcauuugaaccuagguuuaucaaacuccacaguccauaaauaaggcaaacuacacacacacacacacacacacacacacacagaugcauaaaacauauauauauaaguaaauauauauauaauaccuuauaaaauauuuauaaagggcugggugcgguggcucacaccuguaaucccagcacuuugggaggccaaggugggcggaucaccugagguugagaauuugagaccagcaugaucaacauggagaagccccaucucuacuaaaaauacaaaauuagcugggcaugguggcacaugcuuguaaucccagcuacucaggaggcuaaggcaggagaaucgcuugaaccugggaggcggaggcugcagugagccaagauugcaccacugcacuccagccuggcaacaaagcgagacucugccucaaaaaaaaaauuuauaaaguauguauguauaaaauauuuauaaaguauauguguauaaaauauauucaaacuuuuucauuuugagauaauuuuagacuuaggaguugcagaaauagcacagagaguuucuguauuaucuauugcuguguaucauguuacccugaaauauagcaacuuaauaaacgugaaaauuuauguaggucagaaaucuaaauguagcuuauuuggguacuucuggcuuagguugucucagaacguugcaaacaagguauuggcugcaaauguggucucaucacagggcuugccugagaggauaugcuuccagccucacucacauggccauggcuuuggccagagacaugggcuuuuugauucuauaaggcacucauaauaugacaccuaagcuucccuuagugaggcagugagagggcaagagagggugcccaaaacaaaagccacagucuuuuuguaaccuacccuuggaugugucaucucgucaccucugccacauucucuucaguagaaaugagucacugucuaaagcucucacccaaggguugggaauuccacaagguccugaauaccaggagguagaugucauugggggauauguuagagguuguccauguaaccuuuacugaagcuuccauuuauguuaacaucuuaccguaacaucauaaccauaaaauauuuaucaaaauaagaaauuauuauugguguaaaacuauauagucuaacauugauuucaccagguuuuuccacaaaugaaccuuuuuuguuucagauccaacccaggauuccgucuugcauuuuaguugucaugucuuagacuccuccaaucuaugacaguuucccagucuuuuuuugucuuucaugaccuugacgcuuugaagagugcuaaucaguuauuuugaagaagcuucuucaauuuagcauuguuugaugguucaagguuagauuaggguuaugcauucucaacacgucacaacagagagcacauuauguugauauacauuacuggugauguuaaccuugaucacuuggcuaaagugguaucugcuaggauucuccacuguaagguuauuguuuuuccuuuggagauacuaaacauuugagggagauuuuguuagacuauacaaauaaccuguuucugcuuaaacuuugacuacuaauuuuagcauucaugaguggaucuuggcuguagcaguuauuacucugguguuuuaauuuuuuuaugucugucaucucuuuuacauuuguuaauuggaauucuucuguaaggagaauuguucuucccucauuuauuccgcccuagguuauuuauuuacauuacuguagacucauuaguguuuauuucauuauuuggauuauaauccaaugcuaccauuacuguuuuguugcucaaguucucuuuuuagcucuuuagagcacuuuuagguuggcuccuguacccugccccagagcuggaaucaacuguuucauuaaaaaucccucuuuuuauuguuguuguuguuguuguuuucuuucuuuuugagccggagucuugcucugucacccaggcuggagugcaguggcgugaucuuggcucacugcaaccuccaccucccggguucaagcaauucaccugccucagccuccagaguagcugggauuacaggucugcaccaccaaacccagcuaauuuucuguauuuuuaguagagacaggguuucaccauguuggccaggcuggucuugaacuccugaccucaggugaucugcccaccucggccucccaaaaugcugugauuacagacgugagccaccaugcccagccaaaaaacccucuuauuuuugaagggaggaaggaguacaguauuuagaaagcaagauguaaggaccuggcaugcucauugcuggugggauguugcugugucuagccuuucucagugaauaaagcuaagaaauauagguagauuuguaaauuuauguguauacucauaucuguaucuuuuaacguguguguguguuuuaaaucauguguccauauugauaccucugacucuaguacagauccacaagguugauucuagccuuuccccuuucuuuauuuguaacuucugucucuaauagcgauaaaacuggcucucauuaucuguaauauauuuacccuaauauauaaauaguuucagaauucauagccccuacccacaugaaaaacaaauucugcaucuagaguacaguguuuaucugcaguuucgaaguuaucauuaaaauaucuagacaaaaaugcuguuugcuaaaguuucuuaagucagcaucucccuuccccauauucuucaguaugaguacgugauucauuuauaauauagauucauuagucacauucugcauuccaucuuugccucauauccugguucaccuuugaaaauuuccguacuuauaaauuucacuuucugugcuuuacaauucuauccauugcuacaguuucauaugagcaguuccaucaauccccaaauuccccuaugccguuccuuuggagacagucuuuccucugaucccucaccccuggcagucccuggucuguauucuuccuuagaguuuugccuuucuagagugucacacaaauggaaucauaaaauauguaacagccuuuugggucugaauuuuuuacuuugcaaaaugcauuugacacauccaucuuguguggaucaguagugcuuuuuuauugcuuuauuaaaugcaguaauauuuuauuguaauugaguuuguuuauccauucacucacugaaggauauuugaguuguuucuaguuugggaccauuaaaauuagaacugcuguaaacauuuauauacagguuuuuguuucucuacaguaaauacuaagaaagaggauuccugaguuauaugguacagguguauauuuaacuuuguaagaauuauucagagcuaaacuaauacugguuuuucagagugucuguaucauuuugcauuccugcuagcaaugggugagcauucuaguuacuccacauccucaccgauguguaaauugucaauauauuuuagccauuuuuauaguuguacagugguaucucaacauaguuuuaauuugcauguccuuccuuaauggcuaauuauuaugaacaccguuucaagagcuuauuugccauccucuucggugaagugcuuuuuaaauaggguuguuugcuuucuuauuggugaguuuugagaguucuuaauauauucuggauacgagucuuuucuggauauguuauuugcaaauaucucuucacaguaugcgacuugucuucuuauccucuuaaaaaaggcuuucaaaaaacaaagguguuuccuuuugaucaaguccaauuaauugauuuuuaaauggaucgugugauuggguuggcaauacuuuccuuucagcacuuaaaaaauaugcuccuuccuucuggauuccaugguuucuggcaaaaaauucauagucauuugagucauuguuuucuauguaagaacaauguguuauuuuucucugauuauuuuaauuuuuuuccagcacauugauuaugcuucuagauauggguuucuucuuuuuuuuaauuuuuaaauuuucauuucaguaguuuuugggauaaagguuguuuugguuacauggauaaguucuuuaguggugauuucugagauuuuagugcacccaucacccgaguaguaugcacaccauacccaauauguaguuuuuuuaagcccauagguuuacaggcauaccucagauauauugcagguucaguuccagaccacugcaauaaagccggucaccuaaauuuuuuggcuucccagugcauguacaaguuauguuaacacuauacuguacucuaugaaguguauaauagcguuaugucuaaaaaaauguaccuaccuuaauuuaaaaauugucguugguugaugggcacuuagguuuuuaugaguuacuucacuuagaauaauggccuccagcuccaucaaaguuacugcaaaagacauuauuucauuccuuuuuauggcugaguaguauuccgugguguauauauaccacauuuucuuuaucuacucauugguugaugggcauuuagguuuuuaugucuuugcaguugcaaauugugcugcuguacaagugugugcacgugucuuuuuaaugucuucuuuuucuagguauagauuucuuugguacaucuuguuugggguuugcugaguuuuuuuaagccuauagguuuacaggcauaccucagauauauugcagguucaguuccagaccacugcaauaaagccgaucacaugaauuuuuugguuucccagugauaauacaagugauguuuacacuauacuguacucuauuaaguguauaauagugucaugucuaaaaaaaguacauaccuuaauuuaaaaauucuuuauuguuuaaaaaugcuaacaauuauuugaaccuucagugaguuacuuuuugcugguggcagucuuaccuugauguugguggcugcuaacugcucuggguggugauugcuaaagauugagguggcuguagaaauuucuuuuuuuuuuucuuuuuaauuuucauugguacauaguagguguauauguuuauggguacaugagauguuugauacaagcaugcagugugaaauaaggacauugugaagaaugggguacaucccuucaagcauuuuuauccauugaguugcaaacaaugcaauuacacuaaguuauuuuaaaauguacagucauuauuuacuauagucacccuuuuguguuacauaguaggucuuauucauucuuucuauuuugugugugugugugugugugcccauuaaccauccccaucucuccccaaaccccucacuaccuuucucagccucugguaaccauccuucuacucucuauguccaugaguucaauuguuuggauuuuuagauuccacaaauaagugacaacaugcaguguuugucuuuuuaugccugguuuauuucauuuaacguaaugaucucuaguuccauccauauuguuguaaaugacuggaucucaucauuuucuaugucugaauaguacuccacuguguauauguaccacauuuucuuacccaucuauugauggacacauaggcugcuuccgaaucuuagcuuaccacaaacacugcugcaacaaacaugggauugcauugaaacuguagauugcuuuugaguaacaaaaucagucuuccauauacugauuuccuuucuuuuggguauauacucagcagugggauugcuggaucauauuguagcucaguuuuuaguuuuuuuaaggaaccuccaaacuauucuccuuagcaauugcacuaauuuacauuccaagcaauaguauacaaggguucccuuuucuccacgucuucaccagcauuuguuauugccugucuuuuccauauaagccauuuuaacuggggugagaugauaucucauuguaguuuuuaguuuuaguguuuugauuggauuauuagauuuuuuccuauggaauuguuugagcucuuuauguauucugguuauuaaucccuugugagauggguaguuugcagauauucucuuccauucuguagguugucuucuucacuuuauugauuguacccuuugcuguaaagaagcuuuuuaauuugaugugaucccauuuguccauuuucgcuuugguuaccugugcuugugggguauugcucaagaaauuuuugcccagaccaauauccuaaagauuuucccucauguuuuucuguaguaguuucaugauuugaggucuuagguuuaaguuuuuaauccauuuugauuugauuuuuguauauggcgaaagauauagaguucuagcuucauucuucugcauguaaguauccaguuuucauuuauuucugcuguuuuauaguuuuugucagggaauucugauaucucuuuuauccuagccuuggugucuguucccaugugauuuaguuuuuauauuugucucuucaaaaucucauauugaaauuugauccccagcauuagaggugggaccuaaagagagauguuuggguuaugggggcagaucccucaugaauggcucagugaccucccugugguaaugagugaguucuggcucguaguucacccaagagcugguuguuuaaaaaagaaugacuccccuccuccccaccuuccacuucuuuucucuucccgugugaugugggcucuccccuuacacuucugcugugauuggaagcuuccugaguuccucaccagaagcagaugcuggucccaugcuucuuacacagccugcagaacugugagccaaacaaaccuuuuuacuugguaaauuacccagccucaaguauuccuuaauagcagugcaaacagacuaagacaccauuugagcugagauuuuucugguucuaaauaugaugaauaauuuuggauuguauuucauaaugacguguuaugaaaugacaagucuuguuuaaaugccauagagaauguugauguuuuuguuuuagcagacaaugacccaacuaguuucagguuaaaaauuccagccagccuucuguagguuguuguuccaaguccauucaguuuucaaagauuuugcagugcuguucacaucuguugucugugugugugccuaguggcccuuuucuagguacuuuuaucccuuuucuauguacuuucugugacuacauugugucagggcugaguggcacaggacagaaggagaaaaagccaaccaggaguggucacucuugagaccacauuuccuuugguguaaguugaagguuucccuucuucagaacuuuaggcuccugccagccucuguuacugcuuguaccauugccaccaugagauuacugggaugcuaugacuaauauacagagauaaggaaaaaggggauuccacacucuauauagaguguugggagacccuucuuucauuccugaagccugaacuagaaggcuucgcugugaagucuuucucucuaugcuaauauccacuuuuagguuucaggcuauauugaguucaggccaaggaaugacagaggaaacaaaaaugauggcaaacucauuaccauuuugaugauauuucagauuuuaugaucuucaaucugccugcuucuguuauuuuccacagucuuccaauagcugcuccauguagucuaucuagguuuuauagcucaucucaucuaggauuagauacgcuaaccuggaacuggaaccacuucuacuguuuuuuguucccauuaacugcauaugugaguuucaguuauuccacauccuugccaacacuggguauuaacaguuauuuuuaauuucacucauucuaaaugugaguaugaaacaguaugguauuguaauuuuaauuuguauuuccaugaugacuaaugaugcugagcaucuuuucugugucucuugcccauuugcaugauuuuauuuaugaaguaucuguucacuuuuauccauuggauuauuugucucaguauuauaggaauuuuuauaauauauuccagauacaaauccucuguguauugugaauauuuucucauagucuguggugugauuuuuguuuucuuaauggugucucuggggaacagaaagcuuuaauuuugaugaauuccacuuugguaauuuuuuuuuaaugauuaguacuuuuuuguguccugauuaagaaauguugccuaaucaaguguuguaaaaguuuucuccuguauuuucauguagaaauguuauggucuuaacuuugugaucaagucugugaucuguuuccaaauucuccuuugugguguaaguuaugcaguugaggaucauuuucuuuccuaggaauauucuagcaccacuuuucaaaaaugauuauuuccuuauugaaguuaguuggaaccuuggucaaaauuaguuggccuuauauguguaaguuuuagaguuucuacucuguuucuuuguucuuuuuauuuaucuuuacaccaguaccacaaugucuugauuacuguagcuuuauaguaagucuugaaaucagguuauguccuccaaccuuguuuuuguuuucaaaauuauuuuugcuauuucaaguccuuugcauuuucauacaaauuuuagaauaagcauacugggauuuuuuuggggauuguauggaaucuguagaucaauuuuguagauugacauuugaauuuucagucuuccuaugcaugaacauggugagauuuuucuuccccacuuauuuaagucaucuuuaaugucccccggugacauauuguaauuuucguuguguagauuuuacacaucuacuaaauauauuccuaaguaguuaauauacuaugguauauggcauuuuaaaauuuaaguuuucucauuguucauugcuuauauauagaaauacuguugucaugccaauuuguaggucccaacaaguuaauuuuaauuuuaauuuauuauucuuugggucagagcuuucaugccuacugugggauguuuuagggcaaugagugcuguagagaauuuauacaaggcaaaaguuccagugguugacauauaucuauuuguucucuguuuuauguucaguaacuccucuaagauuucaagaguuucuucuuuaaauuuacugggauccucagguauaaagucuauucuucauacauaaucauuucaccagagaacagagcaguuuuacuccuuccuuugcaguucucaugccuuuuauuucuuuuucuugcuuaaugcacuggcuagaacauugaauaugauaccaaaacaaguaguaaaagcagacaucuugcccuguucccuauuccuggagggcaggagaguagaguaguguuuugucauuaaguuuaauauuaccuguagauuuuuaaugggugccuuuuaucagcuugaggauguuuucuaagugaguuuuaucaugaauggguguuuaauuuuucagauguuuuuccugaucuauggauaugaucauacauguuuucuccuuuuuucuacugauguagugaauuacauugguccaguugaucaacuguauuguugaaauugucaucuuuacugaauuuuuaucugcuuguuuaaucagcauuugaaaacagcauacaucuccaguuauguuuguguguuuucuguuucuccuuuagaucuucuuuggaguauuuuguggggaggggaacaauaacaaaguuauagaaaagguaaauauggcacaaggaacuucucuuucuccuuaguuauuugggaauacguuguugaccugcugcacaaucacuuucguguaauauagucucauuuccuauaaaaggacauucuccuauaggaccacaauaaaaccaugagaauuaggaaauucauacuagugcauuacagacauuauuuagauuucuccaguucucccaguaaugucuuuuuuuuuauuuuuauuuuuuuauaacacuuuaaguuuuaggguacaugugcacaaugugcagguuaguuacauguguauacaugugccaugcuggugugcugcacccauuaacucgucauuuagcauuagguauaucuccuaaugcuaucccuccccccuuccccgaccccacaacaguccccagagugugauguuccccuuccuguguccauguguucucauuguucaauucccaccuaugagugagaauaugcaguguuugguuuuuuguucuugcuauaguuuacugagaaugaugauuuccaauuuuauccaugucccuacaaaggacaugaacucaucauuuuuuauggcugcauaguauuccaugguguauauguggcacauuuucuuaauccagucuaucguuguuggacauuuggguugguuccaagucuuugcuguugugaauagugccgcaauaaacauacgugugcaugugucuuuauaguagaaugauuuauaauccuuuggguauauagccaguaaugggauggcugggucaaaugguauuucuaguucuagaucccugaggaaucgccacacugacuuccacaaugguugaacuaguuuacagucccaccaacaguguaaaaguguuccuauuuuuccauguccucuuuaucacuuuaaaacucaauaaaguuguggcuguuaggugccuuuaucauuuuaaaacucaauaagguuguggcuguuagguaccuuuucaucccacaguaggcaugaaagcucuuaggcaccuuaauaccccaaacaagauacucuuuucccuuuuguaauuaaguguuuuauggaagguauguuuaaauuauguaaacaucuuauucaucagcaaacuuacuuauuaauuuguaucuguacagaaucuuccuuauuuuauucagugaguuaugaucaauuucuaccuuuuuucuuuuuaacuuguuauuugaaaauacauauagacucacaagaaaaauaugugacucacaagagguuacaaaaauagccaagggagguccccacucagcuuccccauugauaauguccuuacauaacuauaaugcauuaucaaaaccaguaaauugauauuggcacaauacagucaaguggacuacagacgcuaaucagauuucacaaguuuuugcaugcacucaguuauucuaaugcauauauguguaauucuguaaaauuuaaacacauguauagcuuuauguaaccgccaucauaaucaagauacagaagugcucugucacugugaaggaauucccuugugccuucccuuuucuagucacacccuguucccucaagccagccuucuuuaaccccugaaagccagugaucuguuuuucuacuguauaauuuugucauuuugagaaguuauauagauggaauccaacauguuacauagauggaacauaacauguaaacuuugagauguguucuucuuacucagcauacucaccuggagauccauucaacuuguguguaucaguaguuaauuucuuuguauuggucagcauuccauuauuuggaauuuauacaguauguuuauccauucaccuguugaaggacauuguuuccaaugcuuauuacuaauaaagcuguuaugaacauucauguacuuuuuuuuuuauacuuuaaguuuuggaauacaugugcugaauguucagguuuguuacauagguauacaugugccauggugguuugcugcacccaucaacucgucaucuacauuacguauuucuccuaauguuaucucuccccuugcuuccuaccccacaacaggccccagugugugauguuccccucccugugcccauauauucucaacucccacuuaugagugagaacauggaguguuugguuuucuauuccuguguuaguuugcugagaaugaugguuuccagcuucauccaugucccuccaaaggacaugaacucauucuuuuuuauggcugcauaguauuccaugguauauaugugccacauuuucuuuauccagucuaauauugauagggauuuggguugguucuaagucuuuguuauugugaauaaugcugcaguaaacauacaugugcaugugucuuuauaguagaaugauuuauaaucguugggguauauacccaguaaugggauugcuggucaaaugguauucuaguucuaaauccuugaggaaucaccacacugucuuccacaaugguugaacuaauuuacacuuccaccaacagcauaaaagcauucuuguuucuccacauccucuccagcaucuguuguuucccaacuuuuuaaugauugccauucuaacuggugugagaugguaucucagugugguuuugauuugcauuucucuaaugaccagugaugaugagcuuuuuuucauguuuguuggcugcauaaaugucuucuuuugaaaagugucuguuuauauccuucgcccacuuuuugaugggguuguuuguuuuuuucuuguacauuuguuuaaguuccuuguuuucauucuuaaguaaauuaaguuuccuugauuuuuguucuuuugcauuugcugaggaguguuuuacuuccaguuauguggaucucagcccuuuuucagauggauagacugcaaaauuuucuaccauucuggagguugccuguuuacucuaaugauaguuucuuuugcugugcagaagcucuuuaguuuaauuagaucuaauuugucaaguuuggcuuuuguugccauugcuuuugguguuuuagucaugaaaccuuugcccaugccuauguccugaaugguauugccuagguuuuuuuguaggguuuuuaugguuuuaggucuuacauuuaagucuuuaauccaucuugaguuaauuuuuguauaagguguaaggaagggauccaguuucacuuuucugcauauggcuagucaguuuucccagcacuauuuauuaaauagggaauccuuucuccauugcuuuugucagguuugucaaagaucagaugguuguagaugugugguguuauuucugaagccccugcucuguuccauuggucuauguaucuguuuugguaccaguaccaugcuguuuugguucccguagccuuguaguauaguuugaagucagguagcaugaugccuccagcuuuguucuuuuugcuuaggauuguuguggcuauacgggcucuuuuuugguuccauaugaacuuuaaaguaguuuuuucuaauucugugaagaaagucaaugguagcuugaugaggauagcauugaaucuauaaauuacuuuggacaguauggccauuucacaauauugauucuuccuauccaugagcauggaauguuuuuccauuuguuuguguccucucuuauuuccuugagcagugguuuguaggucuccuugaagacauccuucacauccauugaauguuguauuccuagguauuuuauucucuuuguagcaauugugaaugggaguuugcucgugauuuggcucucuauuauugguguauaagaaugcuugugauuuuugcacauugauuuuguauccugagacuuugcugaaguugccuaucagcuuaaggaguuuuugggcugagaugaugggguucucuaaauauacaaucgugucaucugcaaacagagauaauuugacuuccucucuuccuauuugaauacccuuuauuucuuucccuugcccgauugcccuggccagaacuuccaauacuguguugaauagcaguggugagaggccauccuugcauugugucgguuuucaaagggaauguuuccagcuuuugcccauucaguaugauauuggcuguggguuugucacaaauagcucuuauuuuuuugagacauguuccaucaauaccuaguuuauugaguguuuuuagcaugaagggguguugaauuuuaucgaaggccuuuucugcaucuauugagauaaucaugugguuuuuuguuauugguucuguuuaugugauggauuacauuuauugauuuguguauguugaaccagccuuacaucccagggaugaagcugacuugaucuugguggauaagcuuuugaaugugcugcuggauuagguuugccaguauuuuauugaggauuuuugcaucgauguuuaucagguauauuggccugaaauuuucuuuuuuguugugucucugccagguuuugguaucaugaugaugcuggccucauaaaaugaguuagggaggagucccucuuuuucuauuguuuggaauaguuucagaaggaaugguaccagcuccucuuuguaccucugguagaauucggcugugaauccaucugguccugggcuuuucuugguugguaggcuauuauugccucaauuucagaacuugucauuggacuguucagggauuugacuucuuccugguuuagucuugggaggguguaugugucgaggaauuuauccauuucuucuagauuuucuaguuuauuugcguagagguguuugcaguauucucugaugguaguuuguauuucugugggaucaguggugaucugcccuuuaucauuuuuuauugugucuauuugauucuucucucuuuucuucuuuauuagucuggcuaguggucuaucuauuuuguuaaucuuuucgaaaaaccagcuccugaauucguugauuuuuuuggaaggguuuuucgugucucuauuuccuucaguucugcucugaucuuagcuauuucuugucuucugcuagcuuuugaauuuguuugcccucgcuucucuaguucuuuuaauugugauguuagggugucgauuuuagaucuuuccugcuuucuccugugggcauuuagugcuauaaauuucccucuacacacugcuuuaaaugugucccagagauucugguauguugugccuuuguucucauugguuucacagaauuuauuucuugcugccuugauuucguuauuuagccaguagucauucaggagcagguuauuuaguuuccauguaguugugcgguuuugaguuuucuuuucucuuuucuuuucucuuuucuuuuccuuuccuuucccuuucccuuuccuuuccuuuccuuuccuuucuuuucuuuucuuuccacccugcccuccuuucuucuucuucuuuuuuuuuuuuuuuuuccgagucucacucuguugcccaggcuggagugcaguggcgcgaucucggcuuacugcaagcucugccuccuggguucacgccauucuccugccucugccucccaaguagcugggacuacaggugccugccaccacgccuggcuaauuucuuuuuguauuuuuaguagagacaggguuucacuguguuagucaggauggucucgaucuccugaccuugugauccacccgccucggccucccaaaaugcugggguuacagaugugagccaccgcacccggcugagugaguuucuuaauccugaguucuaauuugauugcacuguagucugagggacuguuuguuaugauuuucauucuucugcauuuucugaggaguguuuuacuuccaauuauguggucaauuuuagaauaagugcuauguaguacugaggagaauguauauucuguugauuugggguguagaguucuguagaugucuauuaggucugcuugguccagaccugaguucaauuccugaauauccuugagcugaguucaaguccugaauauccuuguuaauuuucugucucguugauuugucuaauauugacaauggggcuuuaaagucucccacuauuaccgugugggagucuaagucucuuuguaggucgcuaagaacuugcuuuaugaaucugggugcucuuguauugggugcauauauauuuaggauaguuagcucuucuuguugcauugauccguuuaccauuauguaaugcucuucuuugucuuuuuugaucuuuguugguuuaaagucuguuuuaucagagacuaggauuucaaccccuguuuuuuuuuguuguuuuguuguuguuguuauuuuuugcuuuccauuugcuugguagaucucccuccaucccuuuauuuugagccuaugugugucuuugcacaugagaugcgucuccugaauacagcacaccaaugggucuugacucuuuauccaguuugccagucugugcauuuuaauuggggcauuuagcucauuuacauuuaagguuacuauuguuaggugugaauuugauccugucauuaugaugcuagcugguuauuuugcccauuaguugauguaguuucuucauaguguugauggucuuuacauuuuauuauuauuauuauuauuuuugcagugacugguacugguuuuuccuugccauauuuagugcuuccuucaggaggucuuguaaggcaggccugguggugacaaaaucccucagcauuuaccugucuguaaaggauuuuauuucuccuucacuuaugaugcuuaguuuggcgggauaugaaauucuggguugaaaauucuuuucuuuaagaauguugaauguuggcccccacucucuucuggcuuguaggguuucugccaagagaucugcuguuagucugaugggcuucccuuuauggguaaccugaccuuugucucuggcugcccuuaauauuuuuuccuucauuucaaccuuggugaaucugacgauuauguguuuugggguugcucuucuugaggaguaucuuugugguguucucuguauuucuugaauuugaauguuggucagucuugcuagguuggggaaguucuccuggauaauauccugcagaguguuuuccaacuugguuccauucucccugucacuuucagguacaccaaucaaacguacguuuagucuuuucacauagucccauauuucuugucuucacacuuuauuucaugaaguugaucuucagucucugauauccuuucuuccacuuggucgauucagcuauugauacuuauguaugcuucucgaauuucucaugcuguguuuuucagcuccagcaggucauuuauguucaucucuaaacugguuauucuaguuagcaauuccucuaaccuuuuaucaauguucuuagcuuccuugcauuggguuagaacauguuccuuuagcucggagaaguuuguuauuacccaccuucugaagccuacuucugucaauuugucaaacuuauucuccauccaguuuuguugcuggugagaguugugauccuuuggaggagaagaggcauucugguuuuggaauuuucagccuuuuugcacugguuuuuccucaucuuuguggauuuaucuaccuuuggucuuugcuguuggugaacuucagauggaguuuuugcguggucguucuuuuuguugauguugaugcuuuugcuuucuguuuguuaguuuuccuucuaacagucaggccccucugcugcaggucugcuggaguuuacuggggguccacuccagacccuguuugccuggguaucaccaaugaaggcugcagaacagcaaaguuugcugccuucuccuaccucugaaguuuugucccagaggggcacccgccagaugccagccagggcucuccugugugaggugucugucgaccccugcugguaggugucuccccaccaggaggcacgggggucagggacccacuuguggaggcauucugucccuuagcagggcucgagggcuguccugggagaucugcugcucuauucagagcuggcaggcaggaacguuuaagucugcugaagcugugcccacagcugccccuucccccaggugcucugucccagggagaugggaguuuuaucuauaagccccugacuggggcugcugccuuucuuucagagaugcccugcccagagaggaggaaucuagagaggcagucugggcuucacccaguuggaaauucccagcggcuuuguuuacacugugaggggaaaacugccuacucaagccucaguaaugguggaugccccuccucucacaaagcuugaauauccuaggucgacuucaggcugcucugcuggcagucagaauuucaggccagucgaucuuagcuugcuggacuccuugggggugggauccacugagcuagaccacuugccuuccuggcuucagcccccuuuccagaggagugaacgguucugucuugcuggcauuccaggcgccacuggaguaugaaaagaaaacuccugcaacuaucucggugucugcccaaauggccgcucaguuuugugcuugaaaccagggcccuggugguauaggcacccaagggaaucuccuggucuguggguuucgaagacugugggaaaagccuaguaucugggcuggaacaguccucauggcuucccuugguuaggggagggaguuccccaacccguugugcuucccgaaugaggcgacacccccacccugcugcugcucacccucugugggcugcacccacugucuaaccagucucaaugagaugaacuggguaccuuagucggaaaugcagaaaucaccugccuucugcguuggucuugcugggagcugcagacuggagcuguucuauuuggccaucuugcccgggaaucccucauguacuuguuauuacaugaccauaaguuuuuuauuucucuaugacagugggucucaacuaggagugauuuuaccucucagggaacaugggaaaugucugaagacauuuuugauuguaaugacuaggaaagaaaugcuacuggugucuaguaaauaaaacauagaggugcuguggaauauccuagaaugcacaagacaguccuccacaacaaagaauuguuucaaaaugucagugcugagguugagaaacugcacuaggauuaagacccaggagugugauuauugaguuguacguaaguauauguuuaauuuuauaggaaacugccagaguguuuuccagagugguuauaacauuuugcauuuccaauaacaaugugugagagaucaaguuccuccacauccucaucagcauuuauacugucaguauuuuuuauauuuuuauuuuuuugagauggagucucacucugucacccaggcuggagugcaguagcaugaucucagcucaguagcaggaucucagcucacugcaaccucugccucccggguucaagcgauucuccugccucagccucccgaguagcugggacuacaggugcguaccaccacgccuagcuaauuuuuauauuuuuaguagagaugggguuucaccauauuggugaggcuggucuugaacuccugaccuugugaucugcccaccuuggccucccaaagugcugggauuacaggcguaagcuaccacgccuguccacugucagauuuuuuuuuuuuuuaauuuagccuuccugauugguauauagggguuaucucauuauugcuuuaauuugcauuucucuacuacugacaaugaacauuuuuaauaugcccauuuacuaucuauauguuuucuauuaaaauuguuuugcucauuuucuaauugcauuuuuuuuacuguugaauuuagagaaucuuuauauauucuggauacaaauucuuuauuagauuucagacuugcaaauuuuuacauuguacaaaaccaaguuuucuuauucuauuuauuguuacuauuguaauuuguuuugaugcucaaaauacagauuugguggccgguggcagccccuucaagcuggcucuauauccuuuuuguauguccccgucaucuuuugaucaugucuuugcuuucuggcacaagauauuucaggcucaucuuauacuuuucuuucuccagcucuggaaucaacuacuucuccaagaagccuguucuuccaguggaaugugcuauuuagagguuaggauuuaaacacuaggcauauguguugcucccagcccuacacuuauuuacauuaauauuuauuucucuaucuguauauauuaaaaaccauauguucaucucauuuuuuacuuuuuucuuuguuuuuguaacuuucauaucuaauagugaguaaccucacuuccagugugcuuuauauaacgaauucucucauuucuugccaaccucuccccagcaaggaugacccuaacgcuccacuuggauucaaacacuuuauugucugucuccuuggguggaugcucuuuucacccugcuugggcuuuggcauuccaugcuagaccacuccucaacauguauagcaccccucccuacuuggucucugacuucccugugucagaaugcucaucacccucaacguauggacacucuccccaccccacguagguucugacuccccaugcugaacuacccccucacauggauuucuuccucaugcugcauaggcucaugacaccucacauuggucucccucuacuuggaugcccucaucuuguuuaggauuugacucaagaugucaggcuacgccauuuagacagccuccucacucagguucugacauucaaggucagacugacuccugucacccugcuugaguagugacucaccacacugcccuuacccuguaugacacccuucucauccugcaggaaaucugacuucccagccuaggcuaucucucuguguagguauuuuccuucucuacugcagcucugccacuccauguaaggccaccccaguguggagacaccuaccucauucugcuugggcucuaacuccacaugucugguggaccucccucuucauggaagcccuccauauccugauuuggugcuuuuauugcacacuaagccacacgucugcagagacugucuucuugcccugcuugaauucuaauacucugugcuaggacacuucuuuacaugggcaccuuccuuacccuaaugagauucugauaccuugcucuggcccguugucacuccauuugcuacagauucccgccuuguucugccuaccuaaugguuuuaagauuguauuguuugggaugggaaagauaaaagaaagggagaauagaaacacaggagaggggaaagagaauaggaagcuuauuuuuuguuacuuugugauuaauauaucuuuucucuccuuuuacuuucaaccuaucugugaccucacaguaaagugcaucacuugucaaugucauaugguugaauguuauucauuuuuaaucuugucuguuaaucuuuaucuuauaacugagauauuuaguucauuuacauuuaauauaauuauugagcuaguugauuuugcuauccucuauuauuuuagauuaauuaauuauuuuuauuccaugcuauuuucucuauuggcuucuuuuacuuuuuuuucuuuuagugguuauucuagagauuauaauauacuuccuugacuguauaguuuaccuuaaauuaguacuuuuuucgcuuuaugagcagcaaaguaucuuaggacaguugaacucuauuuacucacuccuccuauuugugcuuuuguugucauauauuucuguucuacauguucugaaucccacaggacauuauuauuguugcuuugaacaaacaacauucuuuuccauauauauguauauaagaaauauaaagcaacguaaaauauguauauauacacaagaguguauguauguauauguacauguauauauuuacauacacacauccuuuaaguguucugcauucuuucuagcaguucuguacuauguuggaucauuuuccuucagccuaaaaaauuuccuuuaguauuuccugaagucuucuggggauuaucuuaguuuuuauuuguuugguuuaagaaauguauuucaguugguuauagaauuguagguuuuuauuucagcacuuuaaagagcuacuaucuuuguugaaaggccaagugucguucuuauuuuugcaccuuugauuuucagcaguuuggcuuugaugccccaagaguugguuuuucuuaguauuacuuuguguucacugagcuucuuaacucaguagauuaagucuucuaccuguuuuggaaaauucuuacccauuaacucauaaauauuguuucugcacucuucccucuucuccuaggaguaagauuacacauguauuggauuauaugacugugccccgugagucucuuaugcugucauccguucguucuuuuuauguuuggcaguuuucuguagacuuuuugaauuuacaaauuauuuuuacacagugucuauuugcuucuacuacaguugaaucagauuuuagauaauguauuuuuauucugaaauauucauuucuuuuuuuaauagauuguaguuuucuguugagauuuuccauauuuuaucuauuucccuuuaucuuuugcucucaauauauuaauaaccauuuugaagucuuuuugugcuaacuaguagcuaaauccccuguaaaucaguuuuucuugucuauuuuuuccucucaauuuuugaucauuuuuuccugcuucauauguuacauaauguuuuguguguuggauauuguaaauaagaggauaauagagauugaggguauuugcaucuagagggacuagaaaaacaagagcaagccaaccccaaagcuaacagaagaaaauaaauaacgaaaauuagagcugaacuguaugaaauugagaugcgaaaauccauacaaaagauuaacuaaaccaaaaguugauucuuccaaagaauaaacaagauugacagaccacuaacuaaauuguuaaagaaaaaagaagacaaaauaaguacaaucagaaaugacaaaggugacauuaucacugacuccacagaaauacacacacacacacacacacacacacacacacacacaaacucagagacuauuaugaacaccuauucacacacaaacuaggaaaccuagaagaaauggauaaauuccuggaaauauacaaucucccaagauugagccaggaagaaauggaaaucaugaacagaccaauaaugaguucugaaauugagucaguaauaaaaaacuucuucacgacaaaagaaaccgucagcauaguaaaugaacaacguacagaaugggacaaaauauuugcaaacugugcauccaacaaaggucuaauauccagaaucuguaaggaacuuaagcaguucaacaagcaaagaacaacccuauuuaaaaaaugggcaaaggacaugaacagacgcuucucaaaagaagacauacuugcagccaacaaauauaugaaaaaauguuccacauuacuaaucauucaagaagugcaaaugaaaaccacaaugagauaccaucucauguuagucagaaugucuauuaauaaaaaguaaaaaaaauaacagguguuggugagguugcagaagaaagggaaggcuuguacacuguuggugggaacauaacauaguucagccacuggggaaaacuguggagauuccuuaaagagcuuaaaacagaacuaccauucaacucagcagucccauuacuggguauauacccaaaacaaaauaaaucauucuacugaaaaaacacauauaaucaauaucauauuauugcuauucacaauagcaaagacauggaauacaaaaaacaauuuuugcuuuaagccugacagaucuuugguuuuucaacaacuaaauauuguaagaacucaguugaggcuuucagguguuugaacucagcucuuuagacucuuugcccucacaacuuuagaauaugguaaauguuguaaggggaacaacagucaugcauuucuugcaguuaaacuuucucaagggaaauucauuucauuaguacucuugcaaauaauuuuacuguuuuucugacucagccccuuuauugggguuggcccuucugacuuuugacugagagucuagugagucuuuaauuccuuaccuuuaaaaguucucucccucaagcauuaguuauuaagcccccugccuuaagcagguacaacauuuggcaaauguuuuaaggaggagagcugauguguguuugucccaggccucuccaucuagugggacuugguuucuuauagugccaugaguaugaaugagauuucagucuauuacucugacucagcccccagccucccauaccaccaaaaaaagggaaauugaccuuuuuuuucuuuucucauaauuguccuuuucaauuagugaaugguagacauacgguagagacucaaaaguucuacuuuugugauauauucuagauauuacucuaauacaauaugacauuauucucuuuucuugaaacuuuauuuucaagugauuuuuugaaaguuuuagucuuuuuuuuuuuuuuuuucuuauagagacaagguguugcucuguuacccaggcucuggaguacaguggugcagucacggcucacugcugccucgaacucuuggucucaagcaguccuccugccucagccuccucaguugcugggacuauaggcgcaugccacugugccuauuuuuuuuauguuuuguagagacgaucuugcugcauugcccagggugaccucuaacuccuuggcucaagugauccuccugccucagccucccaaagaacugggaucacagaugugaggcacugugccaggccuuauuuucaaguaauuuuagaguuacaaaaaagaaacacguauaguagaguuccuuauaccacucuucuagcuucuccuguuguuaacaucuuuuuuuuucauuuuauuuuuauuuuuauuuuuuugaagacagaguuuugcucuuguugcccaaguuggagugcaauggcgcaaucucgguucauugcaaccccugcccgcuggguucaagugauucuccugccucagccuccugaguagcugggauuacaggcaugcaccaccacgccuggcuaauuuuuguauuauuaguagagaugggguuucaccauguuggccaggcuggucucgaacuuuugaccucaggugauccacccaccucagccucccaaaauacugggauuacaggcgugagccaccacgccugaccuauuuuuuauuuuuaaacuuuuagguucaggggguacauguuccaauuuguucuauagguaaacuugugucauggggguuuguuuuacagauuaugucaucacccagguacuaagcgugguacccaguaguuuuuuuuuuuuuucuguuugucuccccugucccuccacccucaaguaggccccagugucuguuguuccccucuuuguguccaugaguucucaucauuuagcucccacuuauaaaugugaggaugcaguauuugguuuucuguuccugcauuaguuugcuaaggauaaugaccuccagcuccauccauguucugcaaaagacaugaucuuguucuuuuauauggcugcauaguauucuaugguguaaguguaccacauuuucuuuauccagucugucauuuauggggcauuuagguugauucaugucuuuguuauugugaauaguacuauaaugaacauuugugugcacgugucuuuaugguagaaugacauauauuucuuuggguauguacacagcaauggauugcugagucaaauggugcaucugguuuuagcucuaugaggaauugccacacugcuuucuacaaugguugaacuaauuuacacucccacaaacaguguauaaccacucccuuuucucugcaaccuugacagcaucuguuauauuuugacuuuuuuauaacagccauucugauugaugugaaaugguaucucauugugguuuugauuugcauuuauguaaucagugauauugagcuuuuuucauaugcgugguggcugcauauauaucuucuuuuaaaaagugucugucauguccuuugcccacuaaguuccuuguaaaugcuggauacuagaccuuuaucagaugcauaguuugcaaauauuuucuuccauucuauagguugucuguuugcucuguugauaauuuuucuuuugcugugcagaagcucuuauguuuaauuagaucccacuugucaguuuuugcuuucguugcaauugcuuuuggugucuucgucgugaaauugccuguuucugugucuggaaugguauugucuagguugcauaugugguauccacaucaucacuggugauguuaacugaucacuuggauaaggcagugcuugcuaggugucuccaagauggaaauaaguuacuauuucuuccuucuuauacucuguuuuuugaaauccagucacuuaguucagugcauacacaaaggaggaggggaagguuaagcuuaaccuucuuuggugggagguauucacaucuguuaucuggacuucuucuuaaagcaaaauuugcuucuucuuuccaauuauuuauguguucaauuauuuacuugcuccacucuguuuuaauauuaauucccuaugaucucaagauauaacugcaaccuugaaaacuccuaguucucccagaacuccuugacagaaugcucuguuucuuguuuaucuuuguacacuguguguauuuagcacaguccccuaauuuaugguggacaucuaguaauuuaaaaaaauguauuuucaauucagcugaaaaauagcauuuccucaacuaaauuauauaauuuaacauucuaaauuaaaaguagguuuuaagauaaaaguaaacaugugugauaacauuguaucaaacaaaauaaaggguacugcugaaauuuuaccuuaauaacguuugacauugauguguccacaauauauuccuauagcuacuuaaauauuccuugaaaccacuuuuggaaagagauuucagucucuaauggccaaggauauaaucugcuguauucuuucucuuuuuuggucagauuaccagagaagaugaagaccccacuuucugcuuucucugaaaaauugucaucugaugcagucacucagauaacaacagaaaguccagaaaagacccuauuuucaucugagauuuuuauuaaugcugaagaucguggacaugaaauuauagagccugguaaccagaagcuacgcaaagcuccugucaaguuugccucaucaucuucaguccaacagguuacuuuuucucgcggcacagaugguaagagaaugugauugcauuuuagauuguuagaccagcucuuuuguguaguuaucuuagaaauuugugguugugucuuucuagucagaaaaccuaauuuuaauuuaagaauuaggguccauaugauuauaucugucuuuuauuugcauagcugucaacagaauaugauuuauuauauuuuaucuuaauuucaagcacaguuaacauguagaacucaugcuguuuguguuaaaacuuaguuuugucucaucauauuugcaauaaaaaugcaaguaguucauaacaacuugaaaguaauugaggucugcuuuuaaaauggcggauaaauuaucuuguauuacaguaacaguaauguuauuacuauauagugcguauauagggagaguauguauauacuaaauacuauaacaaauagaugcauaaacaugugauagugcaaacacaauagcaguuuaucucuuacuuauaaagcaaucaccagagacccagguugucuucuugcucuguuuucuuuaaaauauauaacccaagguuauguuggauuuaccuucauggucaacaggaaggaacaaaaagcauugaggagcacauauaggagauguuuacaggucaggucuggaaguaacccaaaucacuuuccacuggccaggaauguaguuuagcuguguuuuccaaaaugaagaagaaauggauuuuggugaauagguagcagucucuaccauaaggugaacauuuagaguguuuuauaugcuauaguuucagugauauuuugauaguacuuuuaccauguaacauuuagaauuagaccaaauuguaaauuauuuucuuuuuuugaguaaguagcaggaaaauuaacaauuaaguuuccauucuuccccaaaugaagauggagacuuuacuaauuuuuaaaauauuuacuauuuuggacaagucuacucaaaguacaucuuaaguuucucuacuuauacaaaaaacuuguccaccuacacacguagauggaauauaccuaaauguaaagaaaauuguuuaguucagcauuuaaauugcauugaauuuaaguaagugcauuuauauacuaagaugguuauaauucuugaacauuuuucuugugaaauuaaagcauaccaaaaauauauauauaguuuaauaaauuaucacgaagaacaccuuuauguguugguuaccuguuguuacagugguacaguauaacaaacaaccuaaaaaaucucuaugguuuauaacagcagacauuuguuuuucuuacucacaggcuuaugggucaauuggacuuuggcugggcuggcuguaagcugcagaaaugguuugggucuguuccagauacuucuuucugagacucaggcuaaugggucaauagcuauccuagagugugguguucucauggugguggcagaaacacaagagaggaaacagcuauaaaagcagugcgcgguggcucacgccuguaaucccagcacuuugggaggccaaggugggcagaucacgaggucaggagaucgagaccguccuggcuaacacaaugaaaccccgucucuacuaaaaauacaaaaaaaaaaaaaaaaaaaaauagccggacacuguggcgggugccuguagucccagcuacuugggaggcugaggcaggaggauggcaugaacccaggaggcggagcuugcagugagccgagaucgugccacugcacuccagccugggcgacacagcgagacuccguuuccaaaaacaaaaaaaaagcauauuuuaaacuucuacugucaucaaacggaucaauuuauagaggccaugauuuaugguucauauaaacuuuuuaucaaagaaucgauauuauuugguuuaguaauaaguguuauuuucaacacugugggucaaaaguaaaauuuuaugagguguuuuuuuuuguuuguuuguuuuuuguacaaaacauuuuaagguacaaaaaaucguauguuaacuacaugacugcuuacccauuagucugaauuaacaaguuccucuaccccucuccagugcuuuuuuccuuucccggaagcagccauuauuugcuauguauucacuucuuccccuagacaggcaguccaguguaaccuuaagacuacugcauccaaacaaaguucuugagaacuucaaaaaauucuuuauuugucucagguccaucgccaugugauagucauuucugcucuggguccauuguaauuuuguccaaucguugcuguuaauuuucuccaaccugugaacugcauggcauauucagccauugcuaucaagcuuaauauauaccgauggagaaagaaaauuaauaaaucaguauucuaacaauaacuacgggaacgaccaaauagaauuggaggcuacagcuuuuuucuuuuucuuuuuccuuuuuuccugauagagugguacaaauauuccuaaguugucucagacuaagguugagguccuuuuuuuuuuuuuuuuuuuuugagauggagucucacucuaucuccagguuggagugcaguggugcaaucuuggcucacugcaaccugcaucuuccggguucaaggauucuccugccucagccucccaaguagcugggacuacaggcgcgcaccaccacgcccaacuaauuuuuguauuuuuaguagagauggaguuucaccauguuggccaggaugaucucgaucucuugaccuugugauccgcccaccuuggccucccaaaguguugggauuacaggcgugagccacugcgccuggccaaggucauuuuuuauuaauuucuugacuggacuuucuuuagaggucacuuugccaugcccagugauagaaauuaaugccucuagguguuaaucauacuccuuuuaaaaaguaaccuuauuucuuguggauaauucaggucuaucauagauuuagucagcacucuguaagcugcucuauguuuugcuuuagugauauaaaaaauguuaaguagcuagguggcuccugucccugguagaauugucccuuucuuauuucuaagaucuuccaucuaacaacacucauagucacaaagguugaaagcaaaaacuucuuaaaaagcuuguuuguucccaaaugcaugcauucuaucugguacucgguauaggcaaguaccaucuaugguucagagcauaucccaaaucccauaagaaagcauuguagacucagaaagugguguuccccagcuuaugccauaacacuuuucaguaaauagcuugcucacuuuauuuauuuauuuauuuuuuagguuuagcauaguuaugguccauaaggcauggauaaggacaguaaaucccuuuaggcaucaaccuuuugucucauuuccuucauuuggaagugaguuucuuccuuagaagcaggcuacuaacaauguggaauucauugccaaaaugucaucagaaugauagaguugccaaagauggugacacaguucuaaguaauauaaagauuauuguuucuggccaggcgugguggcucacaccuauaaucccagcacuuugggaggccgaggaggguggaucaccugaggucaggaguuugagaccagccuggccaacauagugaaaccucaucuguacuaaaaauacaaaaauuagccgggcaugauggcacaugccuguaaucccagcuacucgggaggcugaggcaggagaauugcuugaacccggaagguggagguugcaguaagcagagaucgugccagugcacuccagccugggcgacagagugagacuccuucccccuuccccaccaaaaaaaaaaaaagauuauuguuuccagaggagagcucauucuacuccaggacuaucagaaucagucuagaggauuuuggguuuuauuaacuagagaugagcaacuaggaguccaucuagaaaugguuacaggauauaagagaaaaccguggucuauaagaauaaagauaaacggaaggagcuggaggcauucggccaugagaaaugguagcuacauugaaaauucauaaucauaugagcaauacaacccuaugaaaugcucagaaauaaccuaaacaaaaauuuuaaaugaccuaaugcaggaaacacuaauccuuuuuguaaagauagaaaauaauaauuuacuaaauuaaaagguaugauucuagaauggaaggcugaauauuguaaagguaucauuuauucccacauaaauuuauacucuaaaguaauucugcacaaaguucuaauggaacuguucuuuugaacuguguaauuuaucuuuaugaauuuauuuuuauuuuuaauuugucuggguauauaguagacauagauauuuaugagguacaugagcuauuuugauauaggcauacaguguauaauaaucccaucaagguaaaugggauauccaucaccucaagcauuuauccauucuuuguguuaacaauccaguuacauuauuuugguuauuuuauuuuuuaaguauuuauuuuuuuugagauggagucuugcucugucacccaggcuggaguacaguggcaugaucucagcucacugcaaccucugccuccuugguucaagcaauucugccucagccuccugaguagcugggauuacaggcacccgccaccacgccuggcuaauuuuuguauuuuuaguagagaaaggguuucaccauguuggccaggcuggucucgaacuccugaucucaagugaucugccugcauuggccucccaaagugcuggauuacagaugugagccaccaugccuagcugucuuuugguuauuuuaaaauguacagugaauuauugacuguagacccuguugugcuaucaaauacuauaucuuacugauuauaucugacuauauuuuuauacccauuaacaauccucacuucccccacacugcucacuacccuucccagucucugguagccaucuuucucucucauguguguccaugaauucaguuguuuuaauuuuuagaucccacaaauaagugagaacaugugaaguuucuguuccuaugccuggcuuauuucacuuuauauaauaaccuccaguuucauccauguugcugcaaaugacaggaucucauuauuuuuuuuggcuaaauaguauuccauugugcauguacugccuuuguguauauguacuacauuguguauauguaauagauuaauuuauccauuaaucuauugauggacacuuagguugcuucuaaauuuuggcuauggcgaacaguguugcaauaaacauggggugcagauuuaucgcugacauacugacuuacuuuauuuugguuauauaccuagcagugggauugcuggaucauauguuagcucuaauuguaguuuuuugaggaaucuacaaacuaacuguucucuauaguguuguacuaauuuacauucccagcaacaguguacaagaguucccuuuucuccacauucuugccaacauuuguuguuguauaucuuuugaauaaaaccauuuuaacuggggugagaugguaucucauuguaguuuugcuuugcauuucucugaugaucacugauguugagcaccuuuucauaagccuguuugccauuuauaugucuucuuuugagaaauguuuguucagaucuuuugcccguuuuuaaauuggauuauuagauuuuuuuuuuccuauagaguuguuucaguucuuuauacauuauggcuacuaaucccuugucagauggauaguuugcaaauguuuccuccuauucggugguuugucucuucaguguuguuuccuuugcugugugaaaucuuuuuaacuugaugugaucacauuuguccauuuuugcuuugguugccuguauaugugggauauuacucaagaaaucuuugccaauauuuaauguccuagagaguuuucucaguguuuucuuccuguaguuucauagcuugaggucuuagauuuaagucuuuaauccauuuugauuugauuucuguauaugaugaaagauagagguuuagcuuuauucuucugcauguagauaaccagcuuucccagcaccauuuguugaagagaccgucuuuuucccaguguauguucuuggcaccuuuguugaaaaugaguucacuguagguguguggauuuguuucuggguucucugguucuguuucauugguuuaugugccuguuuuuaagccaguaccaugauguuuugguuauuauaguauuguaguauaauuugaaguuagguauugugauuccuccaguuucguucuuuaugcuuaagauagcuuugucuauucugggucuuuugugguuccauauaaauuuuaggauuuuuucuauuucugugaagaaugucauuaguauuuugauagggauugccuugaauacagauucaguggaauaccccacugcuuuagguaguauggacauuuuaacaauauugauucuucuaauucaugaacauggaauauuuuuccauuuuuuuguuguccucuucaauuaucuucaucaguguuuuauaguuuccuuuauagagaucuuucacuucuuugguuaauugcuagguauuugauuuuauguguggcuauuguaaaugggauuauuuuuaaauuuccuuuucacauuguucacuguugacauauagaaaugugaacugauuuuuguauguucauuuuuguauucugcaacuuuacugaauuuauugauuguggaggcucuagguuuuuacaaauauaagauuguaucauuugcaaacaaggauaauuugacuucuuccuuuccaaucuggaucuccuuucuaucuuucucuugucugauugcucgagcuaggacuuccagugcuauguugaauaacgguuuugaaaguaggcauucuugucauguuccacaucuuagaggaaaggcuuucaguuucuuccccauucaguaugauacuagcugugggucugucauauauggcuuuuauuauguugagguauguguucucuauaccuaguuuuuucaggguuuuuaucacgaagagauguugaauuuuaagaaauguuuuuucaucgucaauugaaaugaucaugugguuuuuguccuccauuuuguugaugaggcaucacauugauugauuagcauauguuaaaccauccuugcaucccugggaugaauacuucuuggucaugaugaaugaucuuuuuaauguguuguugaauuugguuugcuaguauuuuguugaggauuuuugcaucaauauucaugagggagauuggccuguaguuuucuuuucuuuuuucucuuuuuuuuuuuuggaugugucuuugguuuacuggucuuguagaaggaguuuggauguauucucuccucuuccauuucuuggaauaguuugaguaggauuaguauuaguucuucuuuaacuauuugguacaauucggcaguuaagccauugaguccucagcuuuucuuugcugggagacuuuuuauuacaacuuuuaccuuguugcuuguuauuggucucuuucaauuuuggauuucuuccugguugauagguuguauguuucuaggaauuuguccauuuuuuucuagcuuuuucaauuuauugguguaaaguugcucauaguagugucucaucauccuuuaaauuucugugcuauagguuguaaugucucccuucuuaaucucugauuuuauuuacaugagucuucuauuuuucuuagucuggcuaaagguuugucgauuuuguuuaucuuuucaacaaacaaacuuuuuguuucauuuugcgauguuuuucucauaucaauuuuauguauuuuugcucugaucuuuauuucuuuuuuucugcuaauuauggauuucauuugcucuuuucuaguucauuagcauacguuguuagguuguuuauuugaaguuuuucuauguuuuuuuaauguaggugcuuauaccuauaaacuuuccucuuaguacugguuuugcuguaucccguagguuuugguauguuguguuuccauuaucauuugucucaagaaauuuguaaauuucuuucuugauuucuuccuugacccacuggucauucagaaacauuauuucauuuccaugcauuuguauaguuuccaaaguuccuuucauuauugauuucuaguuuuauuucauugugaucagagaaaugacuugauauaauuacaauuauuuuugaauuuuugaacacuuguuuuguggccuaaaauaugaccuguccuugagaaugauccaugugcugagaacaauguguauucugcagccguuggaugaaauguucuguaaauaucuauuagguccauucaauguaucuucguugauuuuucugucuggaugaucuguccaauacugaaagcgggguguugaaguuuacagcuguuauuguauuagguucuaucucucucuuuagcuguaagaauacuugcuuuauauaucuggguacuccaccguuggguccauauauauuuacaguuguuauauccucuugcugaauugaccucuuuaucauuauauaaugaccuuugucuguuuuuauaauuuuugucuuaaagucuauuuugucugauaugaguauagcuguucuuccucucuuuugguuucuauuugcgugggauaucuuuuuccauccuguuauuuuuagucuauucauggucuuuauagguuaauuguguuucuuguaggaaauagaugguugggucuuguuuuuuuuugcauucauucaaccacuguaugucuuuggauaggaggauuuagucuacugcuuuuuauuuuuuauuuuagauuugcccuuuugaggcuauuuucuagauccuguaggcaugcuuuauucuuuuuuauuccuuuuuuucuuuugucuucucugacuguauuuucaaauagccugucuucaaacucacuguguuuaaucaauuuugcuguuaagagagucugaugcauucuuuagugugucagguguauuuuucuacuccaguauuucugcuucuuuuuaauuauuucagucuuuuuguuaaauuugucuuauaggauucugaguucuuucucugugucaucuugaauuucuuugaguuuccucaaagcaguuuuuuuuuuuuuuuuuuuuuugagauggacucuugcucugucgcugaggauggaguacaguggugcagucucagcucacugcagccucugccgccuggguucaagcaauucuccugccucacccucccgaguagcuggaacuacaggggugcgccaccacacccagcuaauuuuuguauuuuuaguagagacgggguuucaccauguuggccaagcuggucuugaacucccgaccucaggugaucugcccaccucggccucccaaaguguuggaauuacaggcgugagccacugcacccagccaaaacagauauuuuugaauucuuugucugaaagguuccacaucucuguuucuccaggauugguuuuuagugucauauuuaguucauuuggugaggucauguuuucauagauggucuagaagcuuguggauauuuguuggugucugagcauugaagaauuagguauuuauuguagucuucacagucugacuuuguuuauacccauccuucuugggagugcuuucaaggaauucaaagggaguuggguguuaugaucugaguuuuuggucacuguagccauaucuccauuagggggcacuucaagccuaguaacacuguggcucuugcagacuuguagagguaccaccguggagguuguauuaguccauuuucaaacuccuagaaguaugcuaccugagacugguuaauuuauaaagaaagggaguucaauugacucaguucugcauggcuggggaggccucaggaaacuuacaaucauggcagaaggugaagggaaagcaaggcacgucuuacaugggggcaggagagagugagaucucagggauaacugccacguuaaaaccaucaagaucucaugagaacucccucacuaucacaacaacagcaugagagaaacugcccccaugauccaaucaccucccaccaggucccucccucaacauguggggauuacaauuugagaugagauuuggcuagggacacagagccaaaccauauuauuccacuccuggccccucccaaauuucauguccuuuucacauuuaaaaaccaaucaugccuucccaauagucccccagaaucaacucauucuagcauuaacccaaaaguccaaguccaaagucucaugugagacaaggcagguaggucccuucugccugugagccuguaaaauaaaaaacaaguuaguuaguuccaagauacaguggggguacaggcauuggauaaauguucccauuccaaacgggagaagcuggcuaaaacaaagggauuacaggccccaugcaaguugaaaaccuggcugggcagucauuaaaucuuaaagcuccaaaauuuccuuugacuccaugucauacauccagggcaugcugaugcaagggguuggcucccacagccuugggcagcuccaccccugagguuuugcagggcacagcucccacagcuacugucaugagcugguguuuaguaccuguggcuuuuccaggugcacagugcaagcuguugguggaucuaccauucugaggucuagaggaugguggcccucuucucacagcuccacuaggcagugcccaaguagggacuauuagugggggcuccaacucacauuaccagucugcauuucccuaguagaaguucuccaugagugcucugccccugcagcagacuucuuccuggacaucuaggcauucauauauccucugaaaucuagguggaggcucccaaaguucaacucuugucuucugugcaucuguaggcccaacaccacgugaaacugucaaagcuuggggcuugcacccucugaagcaauguccugagcuguccuuuuagccacagguggagcuggagcagcugggacacagggcaccaagucccaaggcuguacagagcagcugggcccuaggcggggcccacaaaaccauuuuucccuccuaggccuccaggccugugauggaagggacucccguuaagaucucugacaugcccuggagacauuuuccccauugucuuggcuauuaacauuuggcuccucguuacuuaugcaaauuucugcagccagcuugaauuccuugaauggguuuuucuuuucuacugcauagucaggcugcaaauuuuucaaauuuuuaugcccugcuucccuuuuaaacauaaguuccaauuucaaacccucucuuugugaauguacauaacugaaugcuuucagaauaagccagguaaccucuugaaugcuuugcuguuuagaaauuucuccugccagauacccuaaaucaucucuuucaaguucagaucuccagggcaggggaaaauugcugccagucucuuugcuaaugcauagcaaaagugaccuuuaugccaguucccaacaaguuucucaucuccaucugagacuaccucaaccuggacuucauuguccauaucacugucagcauuuuuggucaaaaccuuucaguaagccucuagaauguuccagacuuucccacaucuuccugucuuccucuaagcccuccagccuguuccaaucucugccuguuacccaguucccaaguugcuuccacauguucagguuaucuuuauagcagugccccacuucuggcaccaauucuuuguauucauuuucacacugcuuuaaagauacuaccugagacugguaauuuauaaguaaaagagguuuaauugacuaacaguuccacaugguuggggaggccucaggaaacuuacaaucauggcggaaggugaaggggaagcaagacacaucuuacguggcagcaggagaaagagagcucaggggaaacugccacuucuaaaccaucaagaucuccugagaacucccucacuaucgugagaacaaggugggaaccacacucauaaucuaaucaccucccaccaggucucugccucaacauauggggauuacaauuugagaugacauuugguuggguacucagagccaaaccauaucagaaguuucugauaagauccagaagaauucucuggauuaccagguagagacucuuguucuuuuccuuuacuuucucccaaagaaauggagucugucucugugcugagcugcuuggagcugcugugacacaagcaccccuguggccaccaccagugggacuguucuagguuagaccugaagccagcacacacugguucucgccugaggucuacaggaaccacuugcuggauacugccuauguuuguucaaggcccuggggcucuacaaucagcagguggcaaagccagggagucuugugugcuuuccuucaggguggcgauuucccccuggcccuaggcagguccagaauugcugucugggagccaugaccugaagucagaaaccuuagugcuuuauucugcuguggcugaacuggcauccaugccacaagacaaaaaguucuuauucuuuccucuuuuccacaaacagaggagucacuccccauggccaccacugccccaggcuuguggugacugcuggcugccuaccacugauauucauucaaggcccaagggcucuuucgucaccuugggugaaugcuucuaggccuggaacucucacuucagggcaauggccucccuucuggcccagggcagguccagaaaugccauccauaagccaacaccuggaaucaggaacuccuggagcuuacuuuguacucuaccccucuguggcugagcuggcacuuaagcugcaaaacaaaguccuauuuaaucuucccucuccuuuucucaagcaaagggagucucuccucauagccaccauagcugggaaaugugcugggucacaccugaagccagcacaucucugagucucacccaggugaguacugccuggcuaccacugcucacuauucaggacccaaguacucuuuagucagcaggugaugaauccugccaggacuggguccuucccugcaaggcagcaaguuccuuucuggcccaggguaugucuagaaauguccaggaacuaggucauggaauggaggccucaggacucugccuggcaucucuaucauucuguggcugagcuaguauccagguugcaagagaaaggucuguuuaaucuuccgucuuccgaagugaaaggaaggacccucuccuggagcaagcugugcugucuagguuuggguauggaguggugcaagugcuucccuuggccauuuuggcuggugucuuacuagguugcauacgcccaagucagcuggcucugauuccagcacaucaccaagacuuuccugggaauuguguuucuuauugcuuuaggcuaugguauaugcuauuuuaucacagaaacccuaaauuacagguaaguagucuagagcagauagcugaguugcauaucugguggcuguggcauccuuccaucucuggaagugugacuuccauuucugggucuagaguaacugcuacagcuaucaugaucugcaguaucuaggaaguggggggcuuuaaugggauaccuuuacuggaaugccuggaaguuucacacauucuugcacucuucccaugggcugaacaaaguuacccauauguucacacauggcuguaagggagauuggaaguguauauagauguauagguguaaggagguagggaaguuggacacgaggucauauuugacaguuucuaccaaucaugaaagaaaaacuaguauauagaaaaaaaauguccauaauaguaagaugagggcauauuuuuaaaaugagauuccauuuaccucuauuagcaauuaaucauuucuuaaugacuauacacgugcuguuggaggaagaguaaauugucgcagacauauuaauaagcaauuuagcagucaguacuuuuuugaaaacuucaugaaugguguaauuuuucacuuuguaaaaagaauuuaccuuggaugggugaugggggagaauaaguauaaacaggaaaaucuuuauucacagaauucuuuauaauugaacauuuuaacacaaccugcauuuucaacauuaggcuaagaguugacuauauuuaaucugguauaaccauaaaaaugugaagaauaggaaguaaaaugaauauuuuuauuauaaauaauagaaaagcugaauuucaaauuaugcauacuauaugcagacaacuuuguaaacaaauaaaaaacaggaaaagauggguaaguuauacauuaaaauguuaacaauaauuauccuugagugguaggaccuuguaauuuuuacguuuauauauuuucuuaauauugaaaauucauacucuugcaguggaaacuauguuuugaagcccugucacauagaugagaauuagacuuauuuucuaugacucuggaagcagaauaagaccaguauaagggcuuaauuaugaccagguuaggguucgauguaagauaacauguuuuuuaguuagagucaucuauauauggaauggauugcuaaaaagucaucucaaugaaacauaucccuaccauccuacuuaaacuguuuccccugcauuuaaaccccaauuucuccuguauucuuaauuaccuucagcauuucuauauuuucccuguaucacuuauaauguauuaaaaugcuagauaauuuacucauuuaguauguuaauuauuuacuguauauuuuccuccucuagaauucucauucuucuugaaggcagagauacauuucucuuuguuuacucauaaauuccaaaagucaugaacacugccugaaacauagaaggcauuccauauuuguucaaugaauuaacaaauguuuuucauauuaauuguucugauuuuuaccuccuuaggccagccuuuauuauugccauauaagccuucugguaguaccaagauguauuauguuccacaauuaagacaaauuccuccaucuccggauuccaaaucagauaccaccguugaaagcucccauucagguauuaugcagaaauuauucgaaguuuuauuguuugauauuuuauuuguguauuggcuaguugauucuggagugacaaaaguccagugcucuuuaauuuuucagugaaauauggaacuuuucauaccuugaucucugguucagauaggugaguuauuugaucagauauauacacauaagcauuuauaaauauuugaugaaggaaauuguauggaucauuauuuggguuagugggcuccaucuagggcaaaguuucuaagcuuucuugguucacaguacccuuaguuguuucacugauuuauuuucuccgcuuuauauauaauaagcaauuauuuuuuucaaauagcaacuaaggaauuagaacauaaauacuaauuguuuuccucugacaacuaauuuaacaaauuuguuauuuauuuuugguuuugguuuuugaaaaaaaaauuuguucauaaauaacaaugaugacuuacuaaugacauauguguagcuguuggacacugugcaacuucccaaaccaugagaugagauuggacccucuuauuuucugccuuuuauuacagcagcugccaaaaauccagcuuuugccaaggcacaacagcauugaaaagaacauagcacuaucugauguugacacuuugaccuugagcuaguaguuuaucacuguccuuucccuagaauuuuaaacuauccugcagcaucccugugaauccacuacagaggaggugcagaguuaggaaaugaauaauaccccauggaggcacuagauaaauauuuccuauggagauuuuaaguuaagggugcagaguuagugugguguaggguuuugauuggugggacaguauuuugaguugucgacgggauaugacuugauucacuuuagacaaauuguuuuuuccaugauugucuauaaaugucauuauauauauagaaauuacaaagaaaggagaaguugccccuggucuuaggcagacauuuuuguuacuuugauaugaaagagaaccaaacuagcuucugauaguaacugcacuaaagccucugauacaaccucgccugauuucccacaaugauggcauugaaaaaaaagaaccacaaaaauacucaccacaaguuaagauuguuaaguuuauagccauaaaugaagaaauguuuacuccuugcaaggcuaugguuuuaaaaacacuguuaauggcuaccagaaagaaaacaagcucacuuaauugauuguagguaggaaaaucuucugucccacuuacucauaguucagaagacagaaugucuguaaacaguagaaaccuggucagaugugccaguacuuucugaggccuccaguguccugcuaucgauauacgucacuaacacuuccaucugguuggagagauuaacuuagagaaagacugaacaguguaggugaugggagaagaaaaugacucaggacuggcacacuguauccugauaaauauaguuucuguaauaaaguacuguaugcaucaguacgacaaaaagagaucuaguugccauacacacuugagauuguuuuuucauguuuucaucuauucugagagugaggaaguugggaauagaaaauaauccuuucuuagaccaguagaccuacacuggaugaaagccuagaaauuguucuaauuccuagccguuaucuaugaauauguuguacaucuauagcuaugagaggagccaauuagaguuuggggccaagagcaagacauacaucauuguuagcaaauauuugggccaaauaacuguucuucaguugagaaucaguaaauaauagaacugaugcaaacaacgacggcaaaaaacuggggcaaaggaaacagccauccaaagaaagagauaaaugucugcaaauaaaccagucuuaauagcaacccagggaguauuuauucaagaaaaauggccaaaucccacuaagcacaguaagcguuagcauuuuaacuugcccuagucccauucccaguaccucagcucagugauagccuucagaaauauagcuuucuuuuccaagaccagaggaugcaaaauggagcugggccucuuuuaaaaguuccuucccaaagaauuguuaauauuugaccuaucuagugguuccgugaagauuccacacaaaaggcuuaucuuuacuugaccugacugggagccauccagugcuaaaggccucuggugaaggggagggaaagauguuuaucaaaaacauuuacagacaaguauuuuaauaucauaauggcugagguguggacuagcaguugagguaaacaguaaacuaacuggaaagcuuaaaaguaacacccgaggauaagauguugauagauucuuugaaaggcgcugacauauuccuaagacucugggagaccccauguaugcguaggccuguguaugcucaggaaagacccaaggcgcuaggucuuaucucuggcugaccuugaggaucuguacaagaagaaaagggaaggcuaagguaaaguugacagcugccuaggucaguguugaagguacaucccaacauauguguggagccauuugaugaaggccgggagauuuauugguucuaggcauuuaaggaaaucccuguucaggcauuagcugaccauuaagcuaauugaguaguaacuucaguggccauauauaaaaagaauauagacuuuacagaauuaauucagagaaguuauuaaaacaacauaaagcaacaacaccaaacccugagauggaaguagaaucugguuuccagaguuggcgcauuguauuacuuaaauguccaggccgggugcgguggcucaugccuguaaugccagcacuuugggaggccaagaugggaggauugccugagcccuggaguuugagaucagccugggcaauguaguaagacccugucucuacaaaaaauuaaaaaucagccaagcaugauggccuacgcuuguagucccagcuacucggaaggcugaggcaugaguaucacuugaacccucgaguuuaaggcugcagugaacuaugauugcgccacugcaguccacucugggcaacagagugagaccaugucucaaagaacaaaaaaacaaaaaaacaaaggcaacaaaagaaaaauauauaugggagacuuuaucaaaauucaaaacuuuuguacacaaaacccagucaaaagaaugaaaaggugacucacagcauaggagaaaauauuugcaaaucauuuaucuguugagagauuaauaccuaaaauauguaaggaacccuuacaacucaacaacaauaacccaaacaaucugauucauaaaugggcacagaaucugauggacauuucuccaaggaagacgugcaaauagccaauaaacaccugaaaaucuucucuauaucauuaaucaugagggaaauaccaaacaaaaccauaguaagauaccacuucacacccauuacaaucacuguuauuuuaaaaaauaagcggagagagccaagauggccgaauaggaagagcuccagucugcagcucccagugugagcgaugcagaaaacgaaugauuucugcauuuccaacugagguacuggguucaucucacuagggauuguaggacagugggugcaggacagugggugcagcacaccgagcgugagccgaagcagggcaaggcaucgccucacccgggaagcgcaaggggucauggaauucccuuugcuagccaaggaaaggagugacagaaggcaccuggaaaaucgggucacucccacccuaauacugcgcuuuuccaacgggcuuaaaaaauggcacaccaggagauuauaucccgcaccuggcucggaggauccuacgcccacggagccucgcucauugcuagcacagcagucugagaucaaacugcaaggcggcagcgaggcugggggaugggcgcccuccauugccgaggcuugaguagguaaacaaagcggccgggaagcucgaacuggguggagcccaccauaccucaaggaugccugccugccucuguagacuccaccucugggggcagggcauagccaaacaaaaggcagcagaaaccucugcagacuuaaaugucccugucugacagcuuugaagagaguagugguucucccagcacacagcuggagaucugagaacggacagauuaccuccucaagugggacccugaccccugaguagccuaacugggaggcaccccccaggaggggcagacugacacuucacacggccggguacuucucugagacaaaacuuucagaggaacgaucaggcggcaacauuugcuguucaccaauauucgcuguucugcagccucugcugcugauacccaggcaaauagggucuggaguggaccuccagcaaacuccaacagaccugcagcugaggguccugacuguuacuaacaaacagaaaggacauccacaccaaaaccccaucuguacgucaccaucaucaaagaccaaagguagauaaaaccacagagauggggaaaaaacagagcagaaaaacugaaaauucuaaaaaucggagcgccucuccuccuccaaaggaacguagcuccucaccagcaauggaacaaagcuggauggagaaugacuuugacgaguugagagaagaaggcuucagaugaucaaacuacuccgagcuaaaggaggaaguucgaacccauggcaaagaaguuaaaaaccuugaaaaaagauuagacgaauggcuaacuagaauaaccaaugcagagaaguccuuaaaggaccugauaaagcugaaaaccauggcaagagaacuacguggcgaauguacaagccucaguagccgauuugaucaacuggcagaaaggguaucagugauggaagaucagaugaaugaaaucaagcgagaagagaaguuuagagaaaaaagaauaaaaagaaacaaagccuccaagaaauaugagacuauaugaaacaaccaaaucuacgucugauugguguacuugaaagugacggggagaauggaaccaaguuggaaaauacucugcaggauauuauccaggagaacuuccccaaucuagcaaggcaggccaacauucacauucaggaaauacagagaaugccacaaagaugcuccucgagaagagcaacuccaagacacauaauugucagauucaccaaaguugaaaugaaggagaaaauguuaagggcagccagagagaaaggucggguuacccacaaagggaagcccaucagacuaacaacugaucucucagcagaaacuccaauccagaagagagugggggccaguauucaacauucuuaaagaaaagaauuuucaacccagaauuucauauccagccaaacuaagcuucauaagugaaggagaaauaaaauccuuuacagacaagcaaaugcugagagauuuugucaccacuaggccugcccuaaaagagcuccugaaggaagcacgaaacauggaaaggaacaacugguaccagccacugcaaaaacaugccaaauuguaaagaccauugaggcuaggaagaaacuucaucaaucaacuaacgagcaaaauaaccagcuaacaucacgaugacaggaucaaauucacacauaacaauauuaaucuuaaauguaaauggacuaaaugccccaauuaaaagacacagacuggcaaauuggauaaagagucaagacccauccgugugcuguauucaggaaacccaucucaugugcagagucacacauaggcucaaaauaaagggauagaggaagaucuaccaagcaaauggaaaacaaaaaaaggcagggguugcaauccuaguuucugauaaaacagacuuuaaaccaacaaagaucaaaagaggcagagaaggccauuacauaaugguaaagggaucaauucaacaagaagagcuaacuauccuaaauaugugugcacccaauacaggagcacccagauugauaaagcaaguccuuagagaccuacaaagagacuuagacucccacacaauaaugugaggacuuuaacuccccacugucaacauuagacagaucaaugagacagaaaguuaacaaggcuauccaggaauugaacucagcucugcaugaagcagaccuaacagacaucuacagaacucuccaccccaaaucaacagaauauacagucuucucaguaccauaccacaccuauuccaaaagugaccacauaguuggaaguaaagcacuccucagcaaauguaaaagaacagaaauuauaacaaacugucucucagaccacagugcaaucaaacuagaacucaggauuaagaaacucacucagaaccgcucgacuacauggaaacugaacaaccugccccugaaugacuacuggguacauaacgaaaugaaggcagaaauaaagauguucuuugaaaccagugagaacaaagauacaacauaccacaaucucuggaacacauucaaagcaguguguagagggaaauuuauagcacuaaaugcccacaagagaaagcaggaaagaucgaaaauugacagccuaacaucacaauuaaaagaacuagagaagcaagagcaaacacauucaaaagcuagcagaaggcaagaaauaacuaagagcagaacugaaggaaauagagucacaaaauacccuucaaaaaaucauugaauccaggagcugguuuuuugaaaagaucaacaaaauugauagacugcuggccagacuaauaaagaagaaaagagagaagaaucaaauagacgcaauaaaaaaugauaaaggggauaucaccaccgaucccacagaaauacaaacuaccaucagagaauacuacaaacaccucuaugcgaauaaacuagaaaaucuagaagaaauggauaaauuccucaacacauauaccuucccaagacuaaaccaggaagaaguugaaucucugaauagaccaguaacaggcucugaaauugaggcaauaaucgauagcuuaccaaccaaaaaaaguccaggaccagauggauucacagccgaauuguaccagagguacaaggaggagcugguaccauuccuucugaaacuauuccaaucaauagaaaaagagggaauccucccuaacucauuuuaugaggccagcaucauccugauaccaaagccuggcagagacacaaccaaaaaacagaauuuuagaccaauaucccugauaaacauugaugcaaaaauccucaauaaaauacuggaaaaccgaauccagcagcacaucaaaaagcuuacucaccaugaugaagugggcuucaucccugggaugcaaggcugguucaacauucguaaaucacuaaauguaauccagcauauaaacggaaccaaagacaaaaaccacaugauuaucucaauagaugcagaaaaggccuuugacaaaauucaacaacccuucaugcuaaaaacucucaauaaaugagguauugaugggacauaucucaaaauaauaagagcuaucuaugacaaacccacagccaauaucauuacugaaugggaaaaaacuggaagcauugaaaacuggcacaagacagggaugcccucucucaccacuccuauucaacacaguguuggaaguucuggccagggcaaucaggcaggggaaggaaauaaaggguauucaauuaggaaaagaggaacucaaauugucccuguuugcagaugacaugauuguauaucuagaaaaccccauugucucagcccaaaaucuccuuaagcugauaagcaacuucagcaaagucacaggauacaaaaucaguguagaaaaaucacaagcauuccuauacaccaauagcagacaaaccgagagccaaaucaugagugaacucccauucacaauugcuucaaagagaauaaaauaccuaggaauccaacuuacaagggaugugaaggaccucuucaaggagaacuacaaaccacuacucaaugaaauaaaagaggauacaaacaaauggaagaacauuccaugcucauggguaggaagaaucaauauugugaaaauggccauacugcccaagguaauuuauagauucagugccauccccaucaagcuaccaaugacuuucuucacagaauuggaaaaaacgacuuuuaaaguucauauggaacaaaaaaagagccugcaucgccacgucaauccuaagacaaaaggacaaagcuggaggcaugacgcuaccugacuucaaacuauacuacaaggcuacaguaaccaaaacagcaugguacugguaccaaaacagagauauagaccaacggaacagaacagagcccucagaaauaaugccgcauaucuacagcuaucugaucuuugacaaaccugagaaaaacaagcaauggggaaaggauucccuauuuaauaaauggugcugggaaagcugccuagccauauguagaaagcugaaaguggaucccuuccuuauaccuuauacaaaaauuaauucaagauggauuaaagacuuacauguuagaccuaaaaccauaaaaacccuagaagaaaaccuaggcaauaccauucaggacacaggcauggucaaggacuucaugucuaaaacaccaaaagcaauggcaacaaaagccaaaauugacaaaugggaucuaauuaaacuaaagagcuucugcacaguaaaagaaacuaccaucagaaugaacaggcaaccuacagaaugggagaaaaauuuugcuaucuacccaucugauaaagggcuaauauccagaaucuacaaugaacuccaacaaauauacaagaaagaaacaaacaaccccaucaacaagugggcgaaggauaugaacagacacuucucaaaagaagacauuuaugcagccaacagacaugaaaaaaugcucaucaucacuggccgucagagaaaugcaaaucaaaaccacaaugagauaccaucuuacaccaguuagaauggcgaucauuaaaaagucaggaaacaauaggugcuggagaggagguggagaaauaagaacacuuuuacacuguuggugggacuguaaacuaguucaaccauuguugaagucaguguggcgauuccucagggaucuagaacuagaaauaccauuugacccagccauuccauuaacuggguauauacccaaaggauuauaaaucaugcugcuauaaagacacaugcacagguauguuuauugcggcacuauucacaauaacaaagauuuggaaccaacccaaauguccaagaaugauagacuggauuaauuaaauguggcacauauacaccauggaauacuaugcagccauaaaaaaugaugaguucauguccuuuguagggacauggaugaagcuggaaaccaucauucucagcaaacuauugcaaagacaaaaaaccaaacacugcauguugucacucauaggugggaauugaacaaugagaacacauggacacaggaagggaacaucacacacuggggccuguuguggggugggggaagcggggagggauagcauuaggagauauaccuaauguuaaaugacgaguuaaugggugcagcacaccaacauggcacauguauacauauguaacaaaccugcacguugucacauguacccuaaaacuuaaaguauaguaaaaaaauaaauaaauaaaaaagcaaagaauggaaaauuaucaguguugucagggacauggagaaauuggaaccauugcuuauugcuggugggaauguaaaaugguauagccauuacggaaaacauuguggcuauuccucaaaaaauuaaacauagaauuauaguaugauccaguaauuccacuuuuaaauauauaccccaacaaagugaaaguaggaucuucaagagcuauuuguacacccauguucauaacagcauuauucacaguggccaagagguggaaacaacccaaugucuauugaucuaugaauggauaacaaaaugugacauauauguguaauggaguauuauucagccuuaaagaggaaugaaauucugguacaugcuacaacauggaugaacucugaagacauuaggccaacugaaauaagccagucugcuuauaugagguaccuagaaaagucagauucauggagacacaaaguagaauuguguuuacuaggggcuggggcuagggggagugggaaguuacuauuuaauggguacagaguuuaagucugggaagaugaguagguucuggagauagaugguagugaugguuacauaacagugugaauauacuuaaugccacugaaguguacacuuaaaaaugauuaauuuuuugugguuuuuuuuuuuuuuuuugaaacagagucuugcuuuguuacccaggcuggaguacaguggcacaaucucagcucacugcagccuccgccucccagauucaagcaguucuccugccuuagccuccugaguagcugggauuauaggcacccaccaccacgcccagcuaauuuuuguauuuuuagcagagaugggguuucaccauguuggccaggcuggucucaaacuccugaccucaagugaucuuccugccucagccucccaaagugcugggacuauaggcgugagccaccgcacguggucaugguuacauuuuauguauauuuuaccacaguuaaaaaaacuuaagaaguuaccaaaaaucuuaauugaauuuuaaaaguagaugucuauguuccaaaucaggguugaguauacgaaauuagcaaaguaacagaacgagaaauacaggaaacuuuaagauagcauaaacaguuaaaucagaugaguggaauucggugagaugucuuuagcugugauaaauaauuuuagcauauguugauauugucucaugcauguauuuaacuuaagcaaguucaaauaaauauacuuaacaaaagaggagagaaagaauuuuaaaagugcagguguuuugugcaugcacucuacccuuuaugaacauaugacuacggaagaauauguaaugaaagaugggaaacuucauucucaaaauuaauuguaguccucguuugccuuuuguaguguaggcaucuuaucuugcuuauuuggguaugauucuagaguuugaagaaaugucuuuuugguacaauaucagauacuucaucaggugcucagauucaggugcagugcuauguuacaagcuuggaggaaaaaguggacccucauggguuucuugagcagacacgaugucaauuucaacauaugccuuccuaagguaccuucaagggugauuuugacccucuauagcaagguuuucaccucacaugcugacuuuaaacccugaauuccauuuaaaauguaucucuacuuuagugaaaaaauaguaaugagacuguauaugguaugaucccuguaaauguucacuuaguaggauauauaaccaagguuuaguuggguuuucuuuuauuguuuccuucauacuuuccugaauuuucuacaaugaucagguuguuuuguuuguuuguuuguuuuuaaugaugggaagcugucagcucacguucauuuguuuauucaaacaauagguauuaaagauguuacuguguuccacgcagauacacugugguagguguuacaauuucaguauugcucaaaauaaacuauaauggaguuuauguucacguugguugacagauauuaaacaaauaaaccauaaauaaguacguaauuacaagugauaaaugcuaagaaaauaagaagaguuccaagauaaacaaguagacccaguuuuguuuuacgaacuuaugaagaucuuuuccaggaagaaacuuuugagcugaacucuagaggaugggaaugaauuagguaggcagagaguggagugugagaauguuccggcgagagggaagaagauggggaaagccccugaagcagaaaagagcuugaugcauuugacaaauggaaagaaggcagcguggguugaaauuccaacaaauuuaaagaucugauugguuuuuguagugauucaugaaucaggcaacaucccauucuauaauauggaaagggugcacugggcaugggagagaguugguucugguaagguagccagaccaggaacaaggaaacacaauacagacaguccccaauuuacagugguuccguugaacuauuuuuugacuuuaugaugguauggaaaugauacacauuuaguagaaaccguacuucaguacaguauuuaauaaacuauaugaacuauuugauacuguauuauaaaauagacuucauguuagaugauucugcccaccuguaggcuauuguaaauguucugauuauguuuaaaguaggcugggcuagguuaugaugcuugguagguuaggggcauuaaauacauuuuugacuaacaguauuuucaaccuaugauggacuuaccaggacauaacuacauuguaagugguggaucaucuguaauaccaaaaaaagcauauugauuaacaucagguuacuuaccugguaaagauuaaagcagagauaaguuccuuuuuacgccagcucagggugacuggccccuuuuucaguuaguugcugugaaucucuuguuuuuagaaaaaacugguccauuuuggaacuuuccuucuuucuuaaaguuucaguuggauuguauggcauuuaguacaagugacuacauuuugguuuggucucuuggggcuuagugcaggagcucagucuaaaacaauggacucccauaaauuuuauuuaacaggguagagcauagugauggguagauaugguuaaagauagguggguucaagaucaugcaggaucuuaucaacuguauuaaaguguucggauuuuauucuaguacuacugcaauuaugguuugauuuauacuuguaaaguuuauucuugccacuauauggagaaaugguuuauagaugggaaggcggagagccauggcggggcggguuagagugcaaguagagacaccaguuaguuagaaggcuguugcuuuagacaguaccagagaugguagcaugaguaucacaguguuaucuauagagauagggagaaauggacagucagcauccuuuuagaaauaguuucuccuagauuuggugauaggaguauggagagugagggagaagagcgugaaaaaaaugucuggcgugagcaacuaggugaauagaggugccauuuacugagguggagauugaggaaaaagcagauuuggggaagaugaucaaaaugucugcuuuggacauguuaaaaaugagauuccuauuauacauccacauagagauguugggucuacaauugaauguaggcagaguuaauuuacacauguuaagguaauagugccacauauaagguggcauuauucacauuauaaauauauacuuuuaugaaaacauacagaugggcaugaauauuccagaucuuuaguuagaguucuggagcaauaauguuaacucuugugcugccccaaacauaaaucuauacucgcacauacuauagcuaugcacagguacaggaaaauaaguauauguacauucacugacacgcacacauguguggcugcacucucucagcugccucucaccuccucugagguugauucucuugcuuauucacccacugcucucagggauguaauuguuccucaccugacucugaacuugaaagggucaucucucuuggagaacgaggggugguggugcagacugugcgugcacaugcugcugcugguguguacucccugggagaauuugugaaaagaaugaccaccauuuacaguuguuuguguuguacuacaauauauaguaacuuaaacauuuugauuugaagaagacacaucuuuucuaauuuccauaaaagugcuguaagagcuagccgugucccugaaugcuggagucggaugcucagaagaaagguacucuugggcaaugguacauuauuuguuggucaucagcauauaccuugguggucgauaaguuuaccuaggaagagaagagaggccaguuccgacuccuuaaggaacuccaccauugagagauuugguagaagaaaauauaaaaaauaaguuuccggagagguaagaggcaaauaagagaaagugauguuacagaaguugagaagaacccaauauaaucuauuuggcccagaaggcuugguguuuuccuugcagucuguccugcaaaacucuucagggcuuacugugcacuguacuaaugauacagguacuuacccagcucuuauugccauauacauacuaggagcucaggaaauagaggaucuuagaaaaaucaucucauaggagauuaguauaagccuuuauauguccagaaauguucuuuugccuguuagauguggcauggauuauagauuaauuuauuuuaucaaggaaugugggaauauugaaauauauuuuaaaagaaaauuaaauacuuucaaaucuuuuacuuaucaucugucauuuuccauucaguguuuugucuuuuguauugucagauuaaucuucuggaaacauagcuaaauauauuauuauuuuguugaaaaaucuuccguuauguugcauuuuauauacaauaaaguuuauacucuucagcuugggaucccaugcacuggugaauuuugucccaaacaacuauuuuuuaauaucuucuaccacuguccuuaauguauucugcaauccaaccugaccauaaaguguccacuauuuuuaaauacuucuuuucuuugcuuaugcuauaacuucugccuaaaaugccuuucuuccuuccucucuauaucaaaaaacuacuuuuuuuccaagauacaauccauuuucuccuuccuccaaaaccaucaugagcuggaaauauucucucuccugaacugauucuccauuuuacaucuucuuuuauaucauuugcaucucugccuuguauuauuagaauuuauuuuacauggcuuacaacuucaguuugacugacguuuccuucugauuauccuacccauuguaguguaguguuuuuuuguuuguucguuuguuuguuuguuuguuuuuuaagaccaagucucacucugccacucaagcugcagugcgguggcaacaucucugcucacugcaaccucugccucccagguucaagcgauucuccugccucagccucccaaguagcugggauuacacgcaccugccaccacgccuggcuaauuuuuguauuuuuaguagaaaugggguuucaccaucuuggccaggcuggucuugaacuccugaccucaggcaauccgccugccuccaccuuccaaagugcugggauuacaggcaugagccaucgugccuggccuguagugcuuuuuucauagaauuggucuaagaggcaaauuuuuaaaaagucuuucucaaucucaugucgcuauuuguguuuuguauuacuuccccguuuuucuguaggauccaaugaugccauugcuccagacuucccagcucaggugcuaggcacaagagaugaugaccucucagccacuguuaacauuaaacauaaagaaggaaucuacaguaagaggguagugacuaaggcauccuugccagugggagaaaaacccuugcagaaugaaaaugcagguaacuggauuggcuuuguauacuuuguagcuuuuucuccccuuuucauccuaaaugagauuacuauccaaucuuuauccuuuuuuucuguuuuguuauacaagcuuuucuccuugcuguuauauugagcauauacaagaaggcaaaauuucauaaaauccuuuaauaauaaaggaagcauaagcuucagagauuuuugaaaauuauaaacuucauuuucacaacggauaauaaaauaugauacaacuuuugaaaugaaauaauacccaaucaaguauguuuuagauacuaagauccacagaaaaucuugauuaaaugccacauuaguuuaucucugucagauauuacaaaguaaugucuuauaggcuggauucuguagggagauauguagcugacaugauuuuuuuuuuuuaauuuuuuuaaagacagggucucacucugucacccaggcuggagugcagugaugcaauuauagcucacugcaguguugaacuccuggacuccagugauccucccaccucagccuucugacuagcuggggccagaggcacacaccacuaugccuggcuaauaauuuuuuuauagugaugggggguuuuuuguagugaugggggucucgcuauguugccugggcuggucuugaauuccuggccucaagcugucuaccagccucagacucucaaagugcugagauuacaggcaugaaccaccgcauccagcccccauguuguuuuaaaauuuuuaaaauuuuccaccaacauucaaaacuaagauuuuugauuuuccuugaaaaaucagaaaaucugacugcccuuuggcucgcauucauucauggugguaaucagcugcagcugagccauggcugucccccugcaggcaggacauccauucucuuguuugcuuccaucuccacagcucugagacccagucugcuucauucauccaccuuaucugucugcugaucacuguggguauuugaguuucaaucuuuuuuuuuuuuuuuuuuuuuuuuuuuugaguuggaguugcgaucuuguugcccaggguggagugcgauggcgcgaucuuggcacacugcaaccuucaccucccggguucaagcgauucuccugccucagccucgaguagcuggguuuacaggcacccgccuccacacccagcuaauuuuuuguauuuuuaguagaggugggguuucaccauguuggccaggcuggucuugaacuccagaccucagaugaucugccugccucggccucccaaagugcugggauuacaggcaugagccaccgugucuggcccccacuguuuuauaaaagcuuuuuuucuucugcaccccugccauuauacuuuuguagcugauagaugauaauauuuauuaaaugaaaacuccaguagccacugaaaauucuguguguauaauugccuguguuuguuacauuuauacuuuuuuauuccuguguauaacuauuagcuaaauaggugcuacugaucccagggcaguuuuuaaauguaggguggcucuauguucuaguuuuggcauaguguuaaugacuuugugugauagcaucagugccuuugugagaaaaauaaaugagaucugcaugguuuuuuuuauuuuauuuuauuauuguuauacuuuaaguuuuaggguacaugugcacaaugugcagguuaguuacauauguauacaugugccaugcuggugugcugcacccauuaacucgucauuuagcauuagguauaucuccuaaagcuaucccuccauuuuuuuagauaauuucguucuacuucaaaacacagugaagucuuuuuauaaaucccuuuugaaauaagagaagcauaucuaccagcuaacauugagacugccaaguaaauaaaaagaaauaauuuuacaaaauauaguucauaaaugaaaacucuucugcaccagggaauccguuacguguuuuccacuauccauaugcuaguggcaguuugguugaaacagauaagccuaagaucccagugucagauacuucaggugaguguagauguggaaaaauuggcaggaaagaagugaacucugucagaagucugcacaaagaacucaccagcuuuaccucacucccaggcuucauuugguaaggaugauacauuugaaauaaagucaggcucaguuaucugaggaccucuacaaucucccaucuguuggucuacuuacagacuuugcauccuaaggaaaagcccuccuccuggcuuaguccuuaguagccauuucaccuugagagaagccuagccucagaaccucuugccuuagagaauuaaagaagaauagaggagagaaugccugccugggaaacugaacaaugaccuauguaauagcuaaaugagcucauaaaauaucauaucauaaguaaaauucucaguggaagggguggaauauaaaagugagaaaaucucuucaaaaauagaacauaaagagaagggaaaagauuuuuuaaaauucaagauuguccccaaaguuucaacauucaaagcagguauucuguaaagacaauagagaaggcaaaaaagaaagaaccaaaggacuaguauaggaauaaauuucagaacugaaagaugugaguuuucauacuaaaagggacuaccauguacauaaaaauacacaccgaggcacaugaccuugacauuuuaaaacugauuugaaaagagauucuaacagcuuccaaaaagaaaacauacauuccauauaaagaaauggaaaugagacuggcaucagacuucucaaaagugauaaacagaguuagaaaccaaaggaguaauaccuuagaauucugagagaaaauuauuucacuaaaacaagggaguuuauuuaaguuacaaaagaaggaaagaaagaaaacauggugggauugaggaaauggagggggccaacacaggaaaugggaaacgaauucucacuguggcggugguacacaaggccuagaacccauucaguuugaagccugcaaggaaaaagucgaauuuguaggauaccuuaugugauugacuauacuuagaggagguuuucaguucuauuugcagcuaugaggaugaaguagggauuggcacauagaaacucagaaaaugcaaaaacaaagcgguuauuaacucuucaggaaagcagaaguuuguaauagaaaauaaauguaauuacaguauacuagcuggcuuagcugugaauaauaauuauauaaacaaucauauguaaauacuaaauauaaacuuaauugaauauugauuuaaucacucagaccauuauuuaugugacauauaaacacugaauguuaauauagggcuaaaacuuuucagaagauaggaugaaaggauauauauggguaggaggguuuuauaaugagauaaauccauagaucuuaguauauaguauaagaauaaaucccagaacugaaagaugugagauuguaauugaucuuagaaggaaaucaauagauaauuucuggaacauaaaaugauaugguaguauaaagcauguuauuaggaaauaaggauauugauccuagaauaaauggcuaaagaaguugaaaaugguagccuuuagaaauuggggaucuguaguggauaggagagggaacugcugacuuuucuuguaagccucgugaaacuauuugacuuuuaaaacauauacauuguuauuuuuauuaaaucagaauuuauauuguccuucaccucaaaaaaguaagaagaaaaaaauacauuuggcaaauacugacuaaagaaaagcuaguguugauauggacaaaauauaauuccaggacaaaaaaaaaaaaauuaaagguagauacaagaguuuaucucauaguaauaaaagggucaaauauaccaggaaagauaaaauugugagcuuauauguauauucucaaauauauucaggaaaaauuacaggaauguguagguaaauucaacaguacauuucagaaaugugaaagaccaggaaauagagaaaguagggcugagcgugguggcucauaccugaaaucccagcaguuuggggggccaaggcggguggaucacgaggucaggagaucgagaccauccuggcuaacacggugaaaccccgucucuacuaaaaauacaaaaaaaaaaaaaauuagccgggcgugguggcgggcgccuguagucccagcuacucaggaggcugauguaggagaauggcaugaaccugggaggcggagcuugcagugagccaagaucacgccacugcacuccagccugucguauuuaaaaucagguguuacccucagcaugggggagauggaaggaagaaugaggggagcguguaaguuucuagccagauuuuauuuccuaaccuggguaagguuauauacacuugcuuuuuguaauucacugaacucuuuaugugcacguuuucccccauauuuuccacuguacaauuaaaaagauauuuuaaaaagcaauaugguacuuagaaaugaaucuaaaagggucuguaagauaaacaauacgguacuuaggaaugaaucuuaaagggcauguaaaacuauuuuaagagaaaauuauaaaacuacauugaaauauauuaagaccuaaauaguuggaaaauuacacaauuguaauaauaaagaugucacuaaauuaauuucuaaauuaaaugcauugcuacucagaauuccaguaggauuuuucguggaacuugacaggcugauucuaaaauauuuauggaaaaucaaaaaacguauauuuaaagaauaagauaagggaucuugccauaccagacaucaagacuuauuacauguguagcuuauuuaagacaucauuuacaaaggaauaaacagaaagaaaaaugaaacagaauggugacccagaaacauauccaugaauguggaaaccuaacauacacagagauggcauaacaaucuguggagaaaggaugaagaggaacuauucaauagaguuugaaccaaugaauauauaucuggaaaaaauaaaaucagauaaaucacugccacacacuaaacagaaauguauaguauaccaggcauauuaaaaguaaaugggauaacuaaguuuuuagaauuuagauggucuguccuuaugaccaugugauaauaaaagauuucuuaaucaggacacgcaaagcaccuacccuaaagggaaaauauaauaaauaugccauuauuaaacugaaaaacuuuuugccuaaacgauaucaaacaauuaaaagacaugaaacagccugggagaagauauuuauaaugcacaccaccugcaaagacauuucacaggaauguucauugcagugcuuuucaaaauaggaaauagccuuaaguugaucaacagagguguauucguauauauuaauacaguagaauaauacauaacguucagaaucaaagacauauauuaauugacuaacucucaaaaucauaauauugagugaaaaagucauggugcguaaagguacagacaguauuguacccuucguauaagguuuaaagaaacuugcaaaacaaugcuguacacuguugguuaauauaugcaaugugguaaagaauuacaaaacauccuugauauugauaaacuguaaauuugguguaaaggcugcuacugagaagugagaauggcaucauugggaacacuuuacacaagaaacauuauauuuguaauauuuuauuucuuaagcucuaugguaaauacuuggguguucauuuuguugccuauauuuuugguaugccugaaauauuuuauuaacauuaaaacauuuuuuaaugaucuaaaaauuucagaagacauuuagagaaaagagauuaggaggauugaaguaauaagaaguaagaaaaaugugugaauuuaaaagagguagcaagaguuaacugguucuuugcauuuuuagcaaucucuauugccuuucugauuucuuuguugaaaaauauacuuacagauaaaaaaaucaaaaaugaucaaaaaaguagaaaagagaaauaguauuagacaaguuuaaaaggcuauaacugcaugaaauuuuuaaaaaauuguaugagaaugcuguauuuaaaaucuagaugauaaaagugcuuuucuuggauuauaugaaauauaaaaauugacuccauaagugguaaaaacuuugaauaggccaaagaacuugaaagcauuguucacaucuuuuuuccuuugaaaaaacauaccugaucuuuccuuuuuuuuuuuguuuuuuuuuuuacuguugcaucaaaccaucaaggaacagauuuuuuuuagaauguuuuuauuuuauuuuauuuuuuugagacagagucucacugucgccccggcuggagugcaguggcacagucucagcucacugcagccuccaccuccuggguucaagugauucuccugcaucagccuccugaguagcugggacuacaggcgugcaccacgacgccugcuaguuuuuguauuuauaguagaguugggguuucaccguguuggccaggcuggucucgaacuccugaccccaagugauccacccgccucagccucccaaagugcugggauuacaggugugagccaccccgcccggcuuuagaauguuauuuuauuuaaacuguuguuguacacaguaaaguaugaaaaauuuuucaauucaugucacaguuuuuacacagguggagccuaagagguacuuuuuuccuaauauguaaauggguuugggguuuuguuuguaauugugggggaggauuacuugucuguuguguuuauuaucuuuccuuuucugaaaucaaaugaugucguuauuccagaugccucaguucaagugcuaaucacuggggaugagaaccucucagacaaaaaacagcaagagauucacaguacaagggcagugacugaggcugcccaggcuaaagaaaaagaaucuuugcagaaagauacugcagguagcuaaacuggauugucugcguauuauuuucuucuggucuucuaaaaugagacuauucccuuaagaacagaaacagaaauauauucucuauuuucuucuugcugucuucagcucucuucuaucucauguauauaugaaauaguuaagguauguuuagcuauauuuuuuauauacuuuggcagguaaaauuaacauauuuaaaguucuuugugauauuucuggaggguuuugaauauaguaaacaaauuaaucuaauuuccagaaauucauuuaauggacuuuuuaccuccgcugauaaaaucucucaauucugugagacacggacccucuaauaccauuuuuguacauaauccuuuauuuaggaauucagcuuguuuacuuccuaccuaucaguuacuuuacuucaaagggauuaugcugauuuaaauaacccuaauaguguauuuacguuaggauuaguuuugacucagagaggaaaacaaaagcaaaauaacauaggcuugaagaagacagaaaacucuuucucuuuuuuguaaaacuccagagguaagcauccagaguugaccugguacuccagaguaucggaacaaagcuguugcucucuuguuacucuaacauuuuuggccuucauucuuaagcuguagccaucagcccauauugcaaccagcaggaagaaaggaaaggaaaaagcacauuccuuccuuuaaggauacuucugagaagcuauauauaccauuccuuuugcauucuauuggccagacuuagacacauggucacauguaccagggaagcugggaaauugaguuguuauucuaauaacaaugugcccagcuaaaguuaggguucuguuuagaggaaaaggaaaguggauauuagaggacagauaguauugauaguuucugccacaauuguaaacuaaaacauuuuagaacaugauuagcugcuucucuucuuuagguauugcuuguuuaaaaagguuagauuguauucugggcaacacuucugaauuuuaccccauuuuacuauuacuaaaugaauguuccaaaaacaguuuugaucauguuaaucuccuaaucaaaaacuuuaguguuucauugccuguaaggauaaaaucuaaacucuuuuagcacugucuucuagaacuguagaguccacucucaaacaacuuucuaacacuaguucucaccucuuuuccuuauaaauucuauaaucaaaugcuauauacuugcucuguuucuuagaugcuaaguuacuuuccugacaccauucuuguguuauguagucaccuuuuuuuuccaucuuaauguguaucccaucuuagcucucuucuaaugccaaaaucaguugucuagaguucuaugguacucccaccugcaauuaguuuuucuuucuuugaauaccgcuaccucuuuuucugacuguuucuuacaguauaucuguuuacguaugugauuuuuugccccaauuuucaauuauuuucuaaacgcauuucugagucaucuuuuuucuucaauaucaguaacaaagccuuucacauaauacguacuugagagacauuuaaaaaucuuuuaugucaaguuccugucuguauaguguguuaauuucccuuucguagauuccagugcugcugcugcugcagagcacucagcucaaguaggagacccagaaaugaagaacuugccagacacuaaagccauuacacagaaagaggagauccauaggaagaagacaguucccgaggaagccuggccaaacaauaaagaaucccuacagaucaauauugaagguaaugggauuggguuguguaugagugugugugucuuuguguguaugugagggucaguguuaguguuuccauuucauucugaugagaauauagccucaugauuaaacaaaaauuccuuuucuuuuuuuaaaacuuucuuguguaaaguacuuugaugcuacuauuagguuacuauauauauauauagauuuccaaaaaguaauuguuacuuuuuggaaaagauauuagcaacuuagaaacaggauuauaaauaaauaccuaaggcugauaguuuuagaagugaaguaucuugucucaguccccagagacaaccuuaaaggccuuccagaagacuauagcaaagauagugagaccaucaauacaaacuuuuaaaaaauuacaauaaaaucacauuuauuuuuguuuguccaugggucucuuuuucugacauaaaagcguauagaacacaagacauuacuaccuagccaucaagcuuuaccucuuagaggaagauggaacagccuacauaaggagagaaaagagucaaggagcuaaacuacccauacuggauuuuggaaauagucuggguucaacugcuuacaucaagaauauacaaaauaaaugauuuuuugacaauagccaagacuacacaauggggaaaggauagucucuucaacaaaugguguugggaaaacuagauauccacauuuaaaagaauaaagguggaccuuuucuuuacaccacauacaaaaguuaacucaaaaaggguuagugacauacauguaagaccuuaaaaccauaaaacucccagaagaaaacauaaggggaacacuucaggacauugaacuuggcagugauuucucagaugugacaccaaaaacacagacaacaaaagcaaaaauagaccaaugaaacuacaucaaacuugaaaacuucugcaugacaaaguagacaagagugugaauaggcauucuacagaaugagagaagauauuugcaaaucauggaucugauaagggauuaguauucagaauauauaaagaacuuaugcaacucaauagcaagaaaaacccaaacaacuuauuuuuaaaaacacguaacuuauuuuaaaaugagcaaaggacuugaauagacaauagaagauauacaaaugccauaucaagcauauaaaaagaugcccaaucucucuaaucauaagagagaugcaaaucaaaaccacaaugagauaucacucacaccuguuaggaugaccacuaucaaaagaaaaaauagcaaauguucgugaggaugcaaggaaauugaaacccuuguucaccauuggugggaauguaaaaugauguagcuauuauggaaaauauuauggagguuccucagaauaauaaaaaagaauuaguauaugaucccgcaaucccacugccacugcugggcauauaaccuaaagaauucaaaacaggacuucaaaaagcuaccuguauacucauguuuauugcagcguuauuuauaaucaagagguggaagcaacccacauguccaucaacagaugaauguauuaagaaaaugggaauuauuugucaauaaagaaagcauguuacauacauauuuguauugugcagccuuaagaaagaaggaaauccuaucacauacuacaagguaggugaaccucaagaacauuauacuaaguaaaauaaaucagucacaaaaagauaaauaccauaugguuucucgcaaauguugagggauuuaggaggaugagagagaccuuggguuuaaacaggagagucuuuuauugagugcacucaggcccagcagacucacguccaaaggcugggcccagaacaaagacagcacuugacuuuuauacacacuucacaaaaggggaugggcuagcuugaagcaagcuuacaguggcgugaaagcgggaauacagaagcaggacaaagacaguuaaucaaauuguaacagguucauaacucaggauugcacauaaccguugcuaugcaacccagauguccauuaucuagguuugucuaggcacgggcuuaucccauaaccuucacuauggugcccaggcagcuguaguucaggccuacucaggcuucucaugaccuucauuguacuucuuagauaaaacagaauacuugaagucacuaguuacagagaacaggaaucuauaaacucauuccauaaaacaaaggaaaauuuguuuuuucuucucccuguguugaaggagugcugggagagucuccagagcacauuacauaauauuaucaagacuuuuccugggucugggcugugccuguugcugccucugggacaagucagccuaaugcaggaaaacuuauuucucuuucuuuuuaauuuuauuuuucuuuaauuucccaccucaguaugaaauaucuaaaguagcugaaaucauagaaacagaaaguagaauagugauugcccaggcuugugagaggguggacagagaauuaguguuuaguagguguaggguuucaguguuacaagaugaaagaguuagagauuguugcacaacaaugugaauauacuuaacacuacugaacuguacacuuaaaaauggcuaaggugguuaauuuaaugucauacuauuugucacacacaaaaauaauacauaagaugaagaaauauaacauugcaacuuugcagggguuagugugggagacauagcuugcaaaagaaagauggaaauauaaucuguaaaagcauacucuagaagauaagaaaaauuuuucuaaauguuuuacacucugaauaauuuuagaagacaugaaguauaugaaauaaaaauugauagaauaaugaaaugaaaagggagauuuaggggauagaacaaaaugaaaugaaaaaaaaguaccaauuagaagaaagagaugaaagcaauuaaaaaaaaaugauggaauuugaaggcugacagugaaaauccaacacaaugauaucuguuguugccucuaaagaagauaauagaaaaauaaagauauaaggaagaauggaacuuacaauuguauguauguauguauguauguauguauguauguauuuuuagacauggagucucauucuguugcccaggcuggagugcaguggugugaucauagcuaacuguagccucaaacuccugggcucaagugaucuucccaccucagccuguagaguagcugggacuguaggcacaugcuaccacaccuggcuugaaccuguaauuuaaaaggacguaccaaguccuaggaaaauuuuguauauaguguucaauacugagauguauguuugcgauaguacugaacuuuaaagaaaaagaaugaaucaugcaggccuccauacagaaaaaaacaaguagaaaaugcuaaaagacagggggacaggcagaggacagggagguuaaaggagguauaaaugagcaaacuucaccuuuaaaguuguaaaaucaaaaaauacauguguaaguaauuauaggguugaaaauuauaggccagacgcgguggcucaugccuguaauuccagcacuuugggaggcugagguggguggaucaccugaggucaggaguuugagaccagccugaccaacauggaggauccccauaucuauuaaaaauacaaaauuagccgggcaugguggugcaugccuguaaucccagcuacucagaaggcugaggcaggagaagcgcuugauuccgggagacagagguugcagugagcugagaucaugccauugcacuccaaccugggcaacaagagugaaacuccaucucaaaaaaaaagaaaauuauaaaauuuaccccuaaaagaguuaaaauuaaacuauaaaacauccaaaauauuuagaaaaacagguuagcuuggagguaaagggagggaaaaagaaaacaguaaauuuguaacaaaaacaaaaaauugccauaaaaugaaagacagcaaagcaugcaagucuauauauaaguaaacuaaauucaccuauauuaaaaaaaaaaaaacuucuuggauuauauuaaaaaacaaacccaguuccaugcuauauaacaaacauaucaaaaguaaaauuacugagaaagguggaaagcaaaaagaaaacuuagagauguaucaaaaagaaauuuggggacauuaauauagaugagguuaaauucaccaaaaguuuugcaggaauugaagagguauauuuuuauacugauuugcaauccacaaugaggauauuuugcauaaaucuuuaaacaucaaauaacuuagcauaaaaaauucauaaaacgaaaaccaggagcucaaucaauaaggaaauuuauguugccuuaaaaaagaaugaaggagggcagggugcgguggcucacgccuguaauuccaacacuuugggaggcugaggcgggcggauuaagaggucaggagaucaagaccauucuggcuaacaugguggaaccccgucucuacuaaaaauacaaaaaaauuagccgggcgugguggcaggcgccuguagucccagcuacucaggaggcugaggcaggagaauggcaugaaccugggcggcagagcuugcagugagccgagaucacgccacugcacuccagccugggugacagagcgagacuccaucucaaaaaaaaaaaaaaaaaauaaaaauaaaaaaugaagguauggaauuauaugaaaacaacucuuaggauggauugugaggcaaaaggugcuuaacagggggauuggacgguggaauuugcuuguagggagaaaaaaaauaaaacagacaacccuaggaaaucuucaaagagaaauggacaaauacaaaauaauacuggggagcuugaacacacauaauuagcuuaugacagaucguggagaugaaaauuuuuuuuguaagugaaguuuaaaaacaccugggaauaauacaaguaaugagguugaugugggguguguguggcugugugugugugucugugugugugcaugcaugcauaagccuauauggguuaaacuuaaaaaaaaaacccuuuccaaaagaccauagaaaauuuuuucauacagcuuuauucagauauaauuuacccauuuaaaauauguaaggcugggcacaguggcucaugucuauaaucccagcacuuugggaagcuaggguggguggaucacuugagaucaggaguucaagaccagcauggucaacauggcgaaaccccgucucuacugaaaauacaaaauauagccgggcauggcggugcaugccgauaaucccagcuauucaggaggcugaggcaggagaaucacuugaaccugggaggcagaggcgacagugagccaagaucgcgccacugcacuucaguccaaacgacagagcaagacuccgucucaaaaaaaaaaaaaaaaaaaaaaucaaacauguaauucaaugauuuuuacuguauucacagauaagugcaaucaaccaucaccauaaucaauuuuagaauauuuucuucacuucaaaaaagaaacccugagacuuaagcaaauacugauccacuuuuugucucaguagauuucccuauucuggacuuucauacaaaugggaccauuaaguuggggacauaacaugaaacuuagggcccgcccauaaugaaaaauguuaaaggaaauucccauguaaaguaggccuccagugggcuacacucuuacuauaagaauaaaagauaaacacguccauguagaaggggacaguaagaaaacugccuguuuuaaccuugauaaugaguuuggggaaagaagacaaaauuuauccucagaauuuauaaccacaaacuaguguucacacagauuuacagucauuaauuuuguacugguauaauuuauuagugcaguaaacuacagguguguucugaaaaaucucaagccgagaauuuaacaauggcaguagguugguauugcagacucacaugccuuucggaugcaaaugcacaucucucugaagaaacuucaacccagaccuaaaauacccuaaauucccuaaaauaccaagcucauagucaaggcacuauuaguagaaacaguaucaacaacaagaaacagaaaugagacccacaauuacaaauguccaggauuccuuggcaaaaugccugauucucagacugggacaggagauauauuagaugagccugaacccuuuuguggugccagaaaguaaagaaaaaaaaaugcacagggauggggaauaugucaauggaacacagggaccaaguaaaaaacuucccaguggcuaaagcugggacaguuucuguaguauagcaauaguauuagaucauaaccaaaguauaaaauaaauaccuaugagucuguacugauaaaaguaaaugauuuaauaaauaaauggggggaaaugacaaaucugugcagaauucuaaauaauguauguagauauuccaccaucagggagguggaacauaacucccacucuuaacuaauggguugcacauaguaacuuaacuuccuuccaaagaguguauuuuuauaggaagggggaaaaagaauaacuauauagugaagaauucuggcaaacacuggcucagccgggucaucaagaucaucaucaauagugguaagucauguugauaguauguacccuuaauauguaaugagaaauauauuuuaacuuugaaaucuucuucccaaaaacccauaaccccagucuaaugagaaaaacaugagacaaacucaaaugaaggacauuuauacuugaccaguacuucucaaaacugucagagucaugaaaaacaagggaugccuaagaaauucucacagaccuaagagaagccuaaggagacaugauaauuaaauguaauguggugucuuggauagaauccuggaacagaaaaagaacaguauguacaaaacaaggcaacacaaaguauggccuuugguuaauaauaauguaacuuuauugauugauucaugguaauauauuguauuaauguaagguguuaauaggggaaacuggguaugggguauagguaaucaucuguacuguugucaccguuuuucuguaaauccaaauuauucuaaaauuaaaaguuuauuuuaaaaaauuaaugcauucugacauuaaaacagguggauagauaaaugauaaauaagaaauuucaucuucuuaaagaaaacacuuuacagcuucucuuuggcauaaccaauuugcuggcguuacugcucuugcacuuuggggccauuacuaacuacaguuaggguuacuugaacacaggcacugcaguaucaugacagucacccugauaacccagacagcuaugaagugccuaaggggcagguaguguaaauguacggacaugcuggauaaagggaggauucacauccuagggugggauggagcaggaugacaagagauuucaucauacuacucacaacgacgugcaauuuaaaaaucaugaauuguuucuggaauuuuccauuaaauauuuuuggaccaugguugacuauggguaaaugaaaccuuagaaagcaaaaccacagauaagggggacuacuguauucacaccuaaugugugggguuuccccucacguuaagcaguucugacacugacaaccuguacuuagcacaguccccacagguuauggguucagucccacaagacugcccaccacuucagauaccaauugcauggcuuggccuccuauacuucugaccaacuagcuccaaauuggggugguggggagaaucccaugacccccuccucagguuugguaauuugcucgaauggcucagaaaacuuagggaacauuuucuuacauuuccugauuuuuuaugaaggauauuucaaaggauacgcacgaacaaccaaaugaagagauacaugggcaagguauagggaaggugcacagagcuuccauguccucucugggccugccauccucccagcuucuccuguguucaccagaugugaagcucuucaaacucugucuguuaggguuuuuauggaggugccauuacauaggcaauauugauuaaaucauuggccauuggugauuggcucaaccugcagucccuguccccuccccagagaucagggguuggggcuggaaguuccagcccucuaaacauaugguuguucccuugguaaacaggccccccauccuaaggggcuuuccaaaauucaccucauuaauguaaacucaagugcaaucagaagugacuuguuuugaauaacagacccuccuugaaccuuuaucacucgcucuugaacuguuucaagaaccaaguacaaaaaccaaaugucauaauaaaagaugccccuauugcuguuaucccguuuuccuaaauggaaauuacaagaguuuuaguaguucuggccaggagcuaggguuaaggcaaaauauguauuuauuauaucacaguauuacaauuuacaggguauuuaaaugaauuauacagugauaauaguaaaaggaugcuacugggacaagagacugauacaucagugaaaauacuuaaauacagugggcacuuacucuaugauaaaggugccauuucagauccauuuguaaaaagauggauuacucaacaaauaaugccaagaugcuuugcuagccauuuagaguaucgugagaauuuuaaguuguagcccuacuuuacuccugucaccaaaaugcaaguauaaaagauccaaguauaaaaaagagaucauaaaaguucugguuuucugacuuuucuaauaaauuugagcagaagaaggcuuucaaggucugacaaaaucuuggagucauaaagccaaagauuugauaaauguauauauuaaaauuaaagugucuucaugguagaaaauaucauaaugcaaaaucaauuuauaaaugaauaaugggaaaacaauuuuaaaaaauugagaaacugagaaaaggggcuaauuuucuuacuaugcaaagagcuuuuuacaaaucaaugacagccuaaaaggaaaacaaaggaccugaacaaaaagcuuauaguaaaagaaaugcaaauggccauuaaagauaugaagaaauacuuaacugucuuaauaaagaauguacuaagccacaaauuuuguuuuaccugucacaauagcacagaugaaaagauuugauuauccuuaguauuguugaguacauggggaaacauucauguacucuuauaagacuauuauuagaagugcaaauuuguugcaacauuuuugaaaguguggaacaauuggaugauaucuaacuaauguugaaauaaauauucccuuuucacccagacuuccauuuaagggaauaacagauacacagauaaaguuguaccuagaaaaauaaaaugaagcuacacauaaacgcacaaacaaauguucacugcagcaugcuuuggaagaauaaacuauuggaaacaaccuaaauauuuaguuaaauuuugguaaaguaaaucaguuuaauauaaaauguuuguagaugcacaaaaucuugcuuugaacaaguaguuuuacucuacuuggcaggaauuuuucuauaagaaaacuuguuuaauauugguuaucaccagaaaguggaacuaggagguucagagauaaccgggagaacuuuacuguucauauuaaauuugucugcauuauuugaauauuuugcauguuuaauuuuuaaaagucugcaguucuagguaugaaagaaauauuuaaaaauaaaugaaaagcaguaaaugauauuuucauguacuuuuauauauucggggagaauuuugcaaauguuaugaguaaaauuaauuccauuaucagaaguaaauaacuacuucaacuuauuugaccuuuacucuuaacaaagugccaugagaugauggugauuaucaaauccuguuguuuuauaaagcccuuuauacuuaaggaauucagcuugcuugcugcugcuucugcuucuuuuuuuuuuuuuuuuuuuuuuuuuuuuuuuuuuuuugagaugaagucucgcucugucgcccaggcuggagugcaguggcacggucuugacucacugcaaccuccaccuuuuggauuuaagcaguucuccuuccucagccaccacaguagcugggauugcacgugugcaccaccgcaccuggcuaauuuuuguauuuuuaguagagaugggguuucaccauguuggccaggcuggucuugaacuccugaccucaaguaagccacccccauuggccuuccaaagugcugggauuacaggccugagccaccgugcccagccuucagcuugcuuauuuucuacuauccuuucuguauuuuacuucauucccaggcugggaggacuauguucauugaaaauacugauauuagggaauaaacauuuuagagcaauguuaucuauuuccuuauuguuuuacuuacugcuuuaaugaauucuagauaggccuucaaauuuuugcuuuauucuguugccaagguauccuuccugaaauacagccauaauuauguuacucgccuguucaaaaugguauacuggcucuucauuucuuuuaagaauaaaauuuaaaguccuuggccuaguguuccaggcccuguagaauuuggccccaaauaaccuuugcuaccuuacuuuccucugcuuuauaaaugaaauaagccauacauacugaauauuugcacucucccuuauugccucaguucuuuccuacuuuuaugcuuuugcucaugcuauuugaugaagcaggggaaaggccagcacaacuauaguauaguuaucaggaagagugguacaaaaugaggaagaaaaguuauguauacuuguacuucuuguuaaggaguuugggcuuuguucuuaguguaagagaaggucauugaaaauugcuaaauagaaaaugacaaguccagcuuacauuuuaaaaagacuacuuugaccacuauuugacaaauagauuggaaagguacaagaagggacaggagaccuauuagagacuugcaguauugugacaggaaauagaaauagaugugugauuguuuggugaaggauuaaugacaggaacaggaagaggagggaguuggaacuaucaagaauaacucccagauuuuggcuugggcaguaggaugaugugccauucacagagauguggaagacuagggaagguacaguugucaaggaggcuagaauagagcucaguuagauggcugugacauccaaguggauauaucauguauauaguuggaacucaagaaaaaucguagcuugaaaugcaaauuugaaaauaaguaacagcauggaaaugguacuaaaagccacagggagagaugagauuaccuagaaagagaauauagacugagaacauuuccuggaaauuggccauacauugaggucauugaucauauuagcaagagcacuuuuaguccagaaguauggcuguacucugcaguaauuugaagagggaauugggguagggagagagguaaaggagaggaaaauagguuccucuuuagaagcuuggcuaugaagaggagcagagaagugggccaguaccuggaggaagaugugaggauuuucuaaacauacauacuaaaugauguuuucaagccaauggaaaugacccugaaagauagaagagagauaugauagggaaaggaagcaaggucuggaagggaagaugaguuggguuccagagcagcauuggaggaacuugccuuuaaaagaaugggagaggugguguugucucuguauccagaaagguuaugggagcagguggauuggcauagguggcagcugccucaggacauccacagaaagugaucccucagcccagaauguucuucuuccuguuuguuuguuuagcucucauuuuuacuucacaucucauccuccucagagaauucuucucuagcuaccauuucccaguaaaauuucucuuauaucagcuuguuuuuguucuuuguagccccuaauuuagaauuauauauuuguuugcauuuguucagugcagaagcugcaaucucaagaaccuguagaaucuaaaugaaaucucccaauuuuuaaauguugcuagauaauucuaaaauuguauagucuacauacuuuagguauaaaugcaggcccugugugucccacucuacucuggggaaguccguagggauuccuagaguauuucaugaaaacucugcuugccaguaaucuauagugugggugaaaaggaucccaucauugcauguguguaucuuuguuucugcccaugauguagaacucuaaaacaguguuuugaugucauaucagagauuagaauuaggguuuaugauugugucuuagcucauuccugcugcuguaacaaaauucugcagaucuaagaucaaggcaccagcagauugggugucuggugagagcccagucucugcuuccaaaauggugucuuguugcuuuguccucacgugguggaaggcagggaaaggccaaacaggagccuucaggccaaagggcacuaaucccauucaugaagguggagccuucaugaccuaaucaccuccuaccuaauacuauuauauuggggauuauguuucaacaugaaucuuagagggacgcaaacauucaaaccauagaaaauuguaagauauuacaucuaaaaaugucaaaaaaugaagauagaaagugguaaauuuuauguguuuuuuaccacaauaaaaaaaaauuuggaaaaaaagucaagaugguccacagaaaaggaauuucaaagggcucuaaaacauguaaaaaggguuuuuuaaaaaauuuauccauuuaauuacugacuaugagaaugaagugucagguuucuuagcugaauaugggguuaccaauaucugucagguuuaauagcaggauuaauuaaaaaaaaaacagaugcagagcauaugucauaacacccuacacagaacaggugguaaauacauauagcaguugcuuuuaugaucuggagaacugaagugccuuccuccaggucacguagccggucaguggcagagcccaggccaaaauucaugucucuuaaacuuuuacuguaccagcgaggcuacuaagaacaaggcaucagucuuuugugcaggcagugaauuuucugauaccuuauauaaacuauucuuuccuuuagucuuuguucuguaucuaaagaauugugaauaguauuucuaaacagaaugcuaauuuuuuaaguucuuucaaaaucuuuuuuucuccuuuucagaguccgaaugucauucagaauuugaaaauacuacccguucugucuucaggucagcaaaguuuuacauucaucaucccguacaccuaccaagugaucaagauauuugccaugaaucuuugggaaagaguguuuucaugagacauucuuggaaagauuucuuucagcaucauccagacaaacauagagaacacaugugucuuccucuuccuuaucaaaacauggacaagacuaagacagauuauaccagaauaaagagccucagcaucaaugugaauuugggaaacaaagaagugauggauacuacuaaaagucaaguuagagauuauccaaaacauaauggacaaauuagugauccacaaagggaucagaaggucaccccagagcaaacaacucagcacacugugaguuugaaugaacuguggaacaaguaucgggagcgacagaggcaacagagacagccugaguugggugacaggaaagaacuguccuugguggaccgacuugaucguuuggcuaaaauucuucagaauccaaucacacauucucuccaggucucagaaaguacacaugaugauagcagaggggaacgaagugugaaggaauggagugguagacaacagcagagaaauaagcuucagaaaaagaagcgguuuaaaagccuagagaaaagccauaaaaauacaggcgagcuuaaaaaaagcaaggugcuuucucaucaucgagcugggaggucuaaucaaauuaaaauugaacagauuaaauuugauaaauauauucugaguaaacagccagguuuuaauuauauaagcaacacuucuucggauugucggcccucagaggagagugagcugcucacagauacuaccaccaacauccuuuccggcaccacuucuacugucgaaucagauauauugacccaaacagauagagagguggcucugcacgaaaggaguagcucuguuuccacuauugacacugcccggcugauucaagcuuuuggccaugaaagaguaugcuugucacccagacgaauuaaauuauauagcagcaucaccaaccaacagaggagauaccuugagaagcggagcaaacacagcaagaaagugcugaauacaggucauccccuagugacuucugagcacaccagaaggagacacauccagguacauggcuacagauuccaucuggcaaugugacugcccucuucauggacuuuuuaguuaagcuuugcacacaggugaaaaaaacaagccauuugcccuuuccucucuauaccauuucuuaccaacuggaaaagagugagaaaguguaguacagugcuauugugaguugucauuauuuucaucaacauucauuuacgaauuaccuuuugaaugaagggcuuugcugcuagauccuucacagucugcaaaguuuaccccugaaaugggggagcuuugagguuagaaugaucucuauccugaacaauauugcuggguuuauguuuauuuggguuuuuuuuuuuuaauucauuccucucugucuuucaggaaauauauuugagguucuuuuaaacacacacacacagacaaacacauaaauaauacaggguuuuuuuuuuuguaauugaagaauggaguugauuugaaaaauugaagcuggggugagcuacaauaugauuuuuuaaaaaugaguaaauaaggaauugugaauaauggaaagacaagucaaagccaggaggaagauaaauaagccuuguggauguggucgcuagaaaagagcuacaaauuuggcuuuauguuuucuagcacuuaguguugcuagaauuuugugaucaauaacauucacuuuuuaauauaaaaagagaacaaaauuuuuagaaacauuacagauuucugauaagagaccuaaaauaaauuucucucaucugucuucuuaaagaaggcaccacagugcaacaaagaguauccuccuauaaggccauuaucacauuccuuaguuuaggguguuaauaagggagaucucaaggggucaauaaauguaggccauugcuuuaacccaagaggaaaauuucaaguaucacuagacaugcucuccaaagaaggaugcuugcaaaaugguucaguggaguauggaacgaaaaauauuugaauuuauauucauuuuccccaacuuuuuaaaauuuauauuuuuguguauauuuuaugaguacaguagugacauaacauauaaauaaauaucuauuuugacaacuugugcuaaaaaaauuuuugucagauuacaugaucaaaagaaauuggagaccacuggucuagagaaagggaggcaugagauguucagacaauuuauuauaaauauuauuucuccucauugagcuuuuggcaguguuuacauauauaaauaauagaguaugcuuuuuuucuaaaguaagugaagaauugggaaugguacagaguaaggcuuuuguuccauaggggagauagauaaauggauccaggagaggguuuguguguguguaguaaaauacacaugacauaaaguuuacaguuuugaucauuuucaaguauacaauucuguggcauugaguauauucacaguguuuuacaaccaucaccacuaucuauuuccagaaauuuuuaauuaacccaguggaaacccuguacccauuaagcagugacucucuguucccucuucucaccagcccccggcaaccaguaaucuauuuucugucucugaggauuuuccuauucugguuguuucauauaaauggaaucauuuaauauaugaccuugguaucaggcuucucucucuuagacacaguguuuugaauauucauccaugacauaacauguaucaauacuucguugcuuuuuauagcugaguauuauuccguugcauguauauaccacauuuuguuuauccauucauuuauugauuuggguuguuuccacuuuuugguuauugugaauagaauugauauagaacguuuguguacaccugucugcaauucuuuuggguauauaucuaggaauggaaaugcugggccauaugguaauucuguggauuagcuuauugaggaacugccagacuauuccauaguaccugcacuauuuugcauucccaucagcaguguauaaggguuccuccaacccuccuccuuuuuuccacagcgacugcuuuaguuuauauucgcaccagcaguucacaaggguuucaauuuuauugcauccuugccaacacuuauuuuccauuuuuuaauauauaaacuaaccauccuguugggugugaguuaguaucauugugguuuugauuugcauuucccuagugauuauucauguugcacaucuuuuuaugugcuuauuuaaccauuuguauaucuucuuuugaaaaaugucuuuucaagucauuuggccauuuuaaaucuggcuguuugauuuuuugguuuuugaguuguugggauuuucuauauauucuggauauugaucucuuguuagauacaugaucugcaaauauuuucucccauuuuguagguugccucuuucacagucacucugcugaccgugucuucugacauauagaaguuuuaaauuuugauguaguccaauuuagcuauuuuuuuuuuguuuuuugugcuuuuggugucauaucuuagaaauauuugccaaauccagugucgugaaaguuuucuucuuaagaguuuaauaauuuuagcuuuuacuuuuaggucuuugauccauuuugaguuaauuuuuguguaugguguaagauaaggguccaccuucauucuucugcaugugaauaucccguuuucucaacaucguuuguugaaaagacuuuuuuuccccauugaauguucuuggcacucuugccaaaaaucguuuagccauauacgugaggguuuuuaucugggcucucuauucuguuagucuauauaucucucuuuaugccacuacugcacuguuuugauuuacuguguauuuaaaaugaguuuugaaagcagguagugugaaaccuguaacuuaguucuuuuuucaaaauuauuuuggcuguuugguuucccuugagauuucaugaauuuuaguaaauauuuuauuguuuuuaauacuaccauaugugcaauuucuuucuuaauuucauuuuuggauuauucauugcuaauguauagguacauaaauaauuuuuacauacugaucuuguaucuugcagcuuugcugaauuuauuaacucuuuuuuuguguggauuuuuaaggaucucuaggauuucauguugaggaaguucccuucuuuuucuauuuugaugaguguuuuugucaucaaagcauuuugguguuugccaaauucuucagcaucuauugagauuacuaguuuuuucuuuuucuuuuucuuuuuuuuuuuuugagacagaguuucacucuuguugcccaggcuggagugcaaugacgugaucucagcucacugcaaccucugccuccuggguucaaccaauucuccugcuucagccucccgaguagcugggauuacaggugccugacaccaugcccagcuauuuuuuuggauuuuuaguagagacaggguuucaccauguuggccaggcuggucuugaaccccugaccucaggugauccaccccccucagucuccccaaagugcugggauuacaggcaugagccauugugccuggccuguuuuuuucuuuuauucuguuaauaugguguauauuuauugauaaucauauuuugaaccaacuuuacauuccugagauaaauaccacuugaucauaaaauucuguucauaugcugcuggauucaguuuauuagaauuugaagaggacuuuuuacaucuauauucacaaggaauauuugucuauaguuucuuugugauaucuuuacugccuuuauaucaggguacuacuggccuuauagaaugagaaaguuuucccaccucuugguuuuugauaaugaguuugagaaggauuaauguuaaugauugacguuaauucuuuaaauguugguagaauucaccaguaaagccaucuggcccuguguuuuucuuuggggaaauuuuuuuucauuacugauucaaugucuuuuaagucuauuuagauuuuguuucuucuugagucaguuucuguaguuuguguuucuagaaauuuguuuaucuuuuuuuuuaaagucuguuucauuuaucuccauugaaucuacauuauucugcuugcuuuggauuuaguauguuuuuuuuucuucucauuucuuaugauucaaaguuagguuauucauuugggauuauucuuuaauguaggcauuuguagcuauaaaugucucuuuaagccuugcuuuuguagauaaguucugccuucauugcuugccauaaguuuugguauguuugucuucuuuuucauucaaaauguuugcugauuucuucuuugaccauugacuguuuaggacaguguuguuuaauuucuacuugugaauuccccaccuuucuuuguuauugauuucugguuuuacuccauugugaucagagaauauauuuuguauuauuucaauccuucauuuaugaccuugcauaugaucuguccuugagaauuuuaugugcauuuaagacgaauguguauucuguugcuguuuggaguguucucuauuguguuaggucuagcugguuuauaauguuguucaaguccucuauuuccuuaucagucuuuuguccaguuuuucuauggcuaucagaaguggauuauugaagucuccagcuauuacuguggaacuaucuauuucuccauugaaaucugucaguuuuuugcuucauauauuuuagggcucuguugucaguuguguguauguucauaauuguuauauccucuucauggauugauccuuuuaucaguacaaaauccucuuuuugucucuuguaacaauuuuuaauguaaagucuguuuugucugauauuaggguaacuaccccagcucucuuuuggguaacuauuugcauggaauaccuuuuuuauccuuuuaauuucuaacucuuugugucuuuggauguaaaguaagucucuuuuagacauaacauagauggucauuuuuuauaagcuauucugcccucucugccuuuuaauuggcgaguauaauccauuuacauuuaauuucauaagaaaggacuuacuuuccccgugcuguuugcuuucuuuaugucauaucuuuuuuguuuuucauuucuacugccuucuuuguaucuaauugauuuuuuguaguguaccaguuuuauucccuuuucauuuuuuuuuuaacauuucauaguuauuuucuuacggguuacauugaggauuacaauuaauaucuuaaacauguaacagccugauaugaaauaaaaccaacuuagcuucaauaauauacaaacacuguuguuaauacaucucuauucuuccccuuaacuuuaauaauacacaaaaacuguggguagacaucuccaucccuuccucuuuaauuguuauagucacagauuacaucuucauuuuguccccacuaaaauagauuuauaauuauuuuaugcauucguuuuuuaaaucagauaagggaaaagggaagaguuacaaaccagaaguauaauagggacuuuauuuuuaccuauguaauugucuuacccuuauuucuuaugccuuauuucuauguauaugccuuaagccuuauuucuauguauacuucaagguauugucaaauguccuuucauuucaccuuggaguacucucuuuaucauuccuuauagggaaggucuacuuguaacaaauuuacuuuuguuuaucugggaaugucuuuaauuucuccuuuauucuuuuuuuauuuauuuuuuuuuuugagacggagucguccugggcuguagugcaauggcacaaucuaagcucacugcaaccuccaccucccggguuccagcaguucuccugccucgaccucccaaguagcugagauuacaggugccugccaccaugccuggguaauuuuuguguuuuuaguagagaugggguuucaccauguuggccaggcuggucuuaaacucacgaccucaggugauccaccugccuugaccucccaaagugcugggauuacaggcaugagccacuguaccuggccuucuuuuuuuuuucuuuuuaagauggagucucacucugucgcccaggcuggaguacaguggcgugaucuuggcucacugcaaccuccaccucccggguucaagugauucuucugccucagccuccugaguagcugggauuacaggugcacaccaccacacccagcuaauuuuuguauuuuaguagagacgugguuucaccguguuggccaggcuggucuugaacuccugaccucaggugagccacccaccucggccucccaaagucuccuuuauucuuaaaguuuugcuggagguagauuucuugucuuacacuuuuuaucuuucaucauuucaaauaugucauuucacugccuauugucuuccaugguuucuggugagaaauuagcaauuaauuuuaccgaggaucccuucugugcucgcccuuauucuuacugcuuucaagauucucugucuuuggcuuugacauuuucauuauaacaugucucaguguggcucucuuucaguuuauccuacuaagaguucauugagcuacuucgauguuuagauuaauguuuuccccuuaucaaguuggaggaguuuccaaccauuauuucuccaaauauuccuucugccccuuucuuucucucuucuuuugggauuccuaauaugcaucuguugguaaguuugaugguauccuacaagucucuuaagcucuguucauuuuucuucauucuguuuucuuucauuuucuauuuuuuuagaguaggguuucacacuaucccagacuggaguacagugauguaaucauagcucacugcggcgucgaacucugggcucaagaaaucuuucugccucagcuuuccgaguagcugggacuacaaggcaugcaccaccacacucaucucauucuguuuucuuucugucccucagaguacguaauuucauuucaccuaucuucaccuaucuucaaguucacugaucuuucaucugugugaucaaaucugguauuggacugcucuagugaauuuuucauuuuagcucuuguacuuuucagcuucauauuuucuauuugauuccucuuugucuucauugauauucucuuuguugagacauuguucucauuuccuuuaguucuuuauccaugguuuccuuuagcucuuugagcacauuuaaaacaguugauuuaaagcuuuugccuaguaagucuacuguguguucuuccuaagggacaauuucuauuuauuucucuccucuaacccaugaaugggccauacuuucuuguuucuuuucaugccucauaauguuauguuaaaauuuugacauuuugaauauuaugaugugauaacucuggacaucagauuuuccuccccuucucuaggguuuguaguuacugcuuguuguaaguuaaaguuguugguuuauuuagugacuuuucuaaauuauguuuguaacgacuguacucuuuguuguugugugauauuucuguuccuuuagcuuaguagcuggcuacuuguuugauagagauuuucuuaaaugccuggggccgaaaaaagcaaaagaaaaaagaaaauuccccaagucuuugcagauuuucugcauucggacacuccuucaaugcuuagccaggccauucacaacucucugccuuagccuugcuuccuacuuguacugagccuaaaggucaaccaguggugaaagugucuggucuucucaggucuuuucugaacaugcaucuugcucugugcaugcacuuucuaguuucccugguauacaugggaaauuuuccaagcccuuaugccccaaagauucucaguuuuucuuuccugcuuuuaguaugucuauuguuucccuugaacuguuaauuuuugcuccaggcaguagugccuuguucauuugguuuucaguauuuucaaggaacauucuuccccuauaaaacuacuuuuucacucuaagagaguuauguuaggugaaacuaaggcaggucccuugugucaguccacggcuaauacucagacaugucaaaacaaacacaauuccuugggaacaagguacuacuccgugcugucuuugggagcagguaccuacaucaggaccaagggcugccgucuuuaagaccaccaugcuggguaaggggauagcagaaggcuaaguuaaaaugcuacaaaguucuucuaccuugugcugauggccuuucuccugguuuagcaaacacuugguuacuauaaaccuuugacuaucuuccaaaguucagauaagguuggcuuugacaguuuuccguauuuuuugguguuucuagagaaggcacuuucucccuuggaggucucuacucuaccauuuuugcuugucguucccagguggaguugugugucccucugaccaucaaaauaacuagagugacaucaauuauuuuuucuuuuuuuuuuuuuugagacguagucucuauugcccagccuggagugcaguggcacaaucucagcucacugcaaccucugccuccuggguucaagcgauucuucugccucagccuaccgaguagcugggacuacaggugugcaccaccaugcuuggcuaauuuuuguauuuuaguagagacaggguuucaccacguuggucaggauggucuugaucuccugaccucgugaucuguccgccuuggccucccaaaaugcugggauuacaggcgugagccacugugcccagccuguguuacauuuuuaauaucuuugccuuugauuuuacuucauccaguacaguuuuuuuuaaauuugcauuugcacuauugcucuuugcccauccuuuuagccuuuugagucacuuuacucaaguguuaguaacaucugaauuuaacuuuuuucccacccaaucugaaggucucucuuuugaaacaaauuuauuccauuuaaguuuacuguuguaaauguuugguuuaaauuuuauuauuuuggcuuuuuuucauucugauguauuuauuaaauaaagguguguucaacuaaauuucauuucaaaguaaggagaggggugaauuucuugugcgugguaaaaaacacauaccaaaaaauucccuucuuaacuguucuuaaguguacaagucaauaauguuaaauguauucacacuauguugaaaccaaucuccagaacuuuuucauauugcaaaccugaaacucuauacccauugaacaacaacugcccuuguccccgucccccagcuccugguaaccacuauucugcuuccuguuuaugaaugauuaccuuagauaccucauaugaguguaaucaugcagauuugucuuuuugugacugacuuguuucacuuagcauaagaucuuaaagauucauccauauaauccauguagcauguuauaggauuuccucccuuuuuaauucuguaugauauucuacuguuuacauauaccacauuuuguuuuucuguuauucauugauggacauuuggguuguuuccaccuuuuagcuaugguaaauagugcugcugugaacauggguauguaacugucuuuuugagaccuugcuuucaauucuuugggauacauacccagaagaaggauugccagaucauauauaguaguucuauuuuuaacuuuuugaggagccucaacacuguuuucccuagugguugugccauuuugcaaugccaccaacaauguacaaggguucuaauuucuuuacauccuuaccaacacuuguuuuuuuuuuuuauaguagccauccucaugggugugagguaauacuguuuugauuugcauugcucuuaugcuuagugauacugagcauuuuuuuauaugcuuuuuggccauuuguaugucaucuuuagagaaaugucuauucaaguccacuuuuacuuuuuuuuuuuuuuagagguggggucucacuguuuuguccauccuggucucgagcuccugggcucaagcagucuuuccccauugaccuccgaaagugcugggauuauaggcaugagccaccauaccuggccugcccaucuuuuaguuagguauuugauuuuuguuguuguuguugcgacugcuuuauauuuucuguauguuaaccccuucucagauacaugauuuguaaauauuuucucccauucaauagguugucuuucacucuguugauuguguccccugauguacaaguuuuuaaguuuagugugguccuguuugucuauuuuugcuuucguugccugugauuuugguguaauauucaaaaaauuauugccacauugaaugucaugaagcuuuuucuguaagaguuauauggguuuaggucuuacauuuaggucuuuaacccauuuugaguuaauuuuuguacaugguauaagauaaggguccaauuucauucuuuugcauguggauauccaguuauccaagcaucauuugaaagcuauccuuuucccacugaguggucuuggcacccucgucaaaaaucauuugaacauauaugcgagaguuuauuucugggcauguuuucuuauuucauuggucugcuuguuugucuuuauacuaauaucacacuauuuugauuacuguuccucugguaauauguuuucaaaucaggaagugugaauacuccaacauuguucuugucuuucaaaguuguuuuggcuauucaggauuucuuaucauuuuuaaugauuucuugcuauuuccaaucuuuuuuguugauugcuauguaaugcauguuucuucgaguugguuuuuugauaacuuagcaacuauguaaucuaauuaacuaauaugcuucaaccacuuucucaaucugucagugucagauaugaaacuaucuauuggcucuauuauaugaaaaauuaagaaacugauuuuacuucuucccaccuaucccccacauaauuuuccccaacuaaccaauagugguuauauuuugugaauuuugucucagcucauuuauaguaguaguauuacuauauugacuagcuucuguuucaagaauuagaacauuuuacuuacauuuuauaagaucaugaguuauuuuacauuaguuguauuuaaauauagggucaguauuuaccaggagucuuuucacauaccuauuuaugaguuuguuaauuucaaucuguuguuugacuagacuguuaaauguucaggagugaucaucuuuuauguucuugcaaauuugagacuauuaccuuuauguaccagaacaacaacugaguuggauauaaaaguuuugauuaacaguucuuaauucaaaacuguuaauuuugcuccucuuuucuggauuaccaguauuuaauguuucauaugcuugcuugcuuuguuucuuucuuuauuauuuccauaguuuggagggaacaggugguuuuugguuacauggauaaguuguuuacuggugauuucugagauuuuggugcacccaucaccugagcaguauacacugcaccuaauguguagucuuuuauuccucaccccgcucccacccuuccccccuaaguucccaaauccauuauaucauccuuauuccuuuguauccucauaacuuagcuccccguuauaaaugagaacauacaauauuugauuuuccauuccugaguuaccucacuuagaagaauggucuccaacuccacauugcugcaaaugccauuauuuuauuccuuuuuauggcugaguaguauuccaugguguauauguaccacauuuucuuuaucuacacauugguugauaggcauuuaggcugcuuccauguuuuugcaauugcgaaucaugcugcuauaaacaugcaugugcaaguaucuuuuucauauaaugacauauuuuccucugggaagauacccaguagugggacugcuggaucaaaugguaguucuacuuuuaguucuuuaagggaucuccauacuguuuugcauaaugguuauacuaguuuacauucccaccagcaguguaaaaauauucccuuuucaccacguccacaccaacaucuauuuuuauuuuuuauuuuuuuauuuauggccauucuugcaggaguaaugugguaucucauugugguuuuaauuugcauuucccuuacaauuaaugaugaugagcuuuuuuuuuuuuuuuuuuugagacagagucucacucuguugcccaggcuagagugcaguggcauggucuuggcucacugcaaccucugcuucccagguucaagagauucuucugccucagccucccaaguagcugggauuacaggcaggugccaccacgucuggcuaauuuuuuuguauuuuuaguagagaugggguuucacugucugagccaggauggucuugaucuccugaccucgugaucugccuaccucagccucccaaagugcugggauuacaggcauaagccaccacgccuggccgaugaugaucauuuuugcauacacuucuuggccuuuuuuuuuuuuuuuccccgagacggagucucgcucuuguugcccuggcuggaguacaauggcacaaucuccacucacugcaaccacugcaucccggguucaagcaguucuucugccucagccucuggaguagccgggauuacaggugccuaccaccacgccuggccaauuuuuuguauuuuuaguauuuaauuuuuuguauuuguauuuuguauuuuaguagugguuucaccauguuggccaggcugaucuugaacuccugaccucaagugauccaccugccucggccucccaagaugcugggauuacagacaugaaccaucgcaccuagcccauuuguauaucuucuuuugagaauugucuauucuuguccuuugcccacuuuuuguugggauuauuuguucuuuucuugauuuguuugaguuccuuguagauucugcauauuaguccguugucggaugcaugguuugcaaauaguuucucccauuuuguggguuguuugcugauuauuucuuuugaugugcagggcccaucuauuuauuuuuguuuuuuguugcauuuacuuuuggguucuuggucgugagcucuuugccuaagucaaugucuacaagaguuuuuccaguguuaucuuacagaauuguuaugguuucaggucuuagauuuaagucuuuaauccaucuugaguuaauuuuuuuguaagggugagagaugaggauccaguuucauucuccuauauguggcuugcuaauuaucccaggaccauuuguugaauaggguguccuuuccuuacuuuauauuuuuguuugcuuugucaaagaucaguuggcuguaaguauuuggcuuuauuucuggguucuguguucuguuccauuggucuuggugccuauuuuuauaccaguaccaugcuguuuuguuaacuauacccuuguaguauaguuugaagucagguaauaaggaggccuccagguuuguucuuuuugcuuagucaugcuucggcugugugugcuguuuuuugguuccauaugaauuuuaggauuguuuuuucuaguucugcaaagaaugaugaugguauuuugauggaaauugcauugaauauguagauugcuuuuggcaauauggucauuuucacaauauuaauucuagccauccaugagcaugggauagguuuccauuuguuugugucaucaaugauuucuuucagcaguguguuucucauuuuccuuguagagaucuuucaccuccuugguuagguauauuccuaagguuuuguguuuuuuuuuguuuguuuguuuauuuguuuguuuugcaguuguuguaaaagggauugaguucuugauuuguuucucagcuuggucuuuguuggugcauagcagugcuacugauuuguguacauugauuuuguauccuguaacuuuacugaauucaugugucagaucuaggaacuuuuugaaugagucuuuaggauuuucuagguauacagucauaucaucggugaacagugacaguuugacuuccuauuuaccugcuugggugcucuuuauuuuuuucucuugucugauugcuuuagcuaggacuucgaguacaguguugaauagcagggaugaaagugggcauucuugucuuguuccaguucucaggggaaauccuuuuaaccuuuuccccauucaguauaauuuugguguggguuugccauagauggcuuuuauuaccuuaagguauguccuuucuaugccgauuuugcugaggguuuuaauuauaaagugaugcugaauuuugccagaugcuuuuucugcaucuuuugagaugaucaugugauuuuuauuuuaaauucuguuuaugugguguaucacauuuauugacuugugcauguuaagccaucccugcaucccugguaugaaacccacuugaccaugguggauuaucuuuuugauaugcuguuggauuugguuagcugguauuuuguugaggacuuuugcaucuguguucaucagggauauuggucuuuugguucuuugaaaagauaaacaaaauugguagaccauuagugagauuaaccaagaaaagaagagagaagauccaaguaaacucaauuagaaacaaaaugggagauauuacaaccaauaccacagaaauacaaaagaucauucaaagcuauuaugaaaaccuuuacauguacaaacuagaaaaucuagaggagaugauuaaauuccuggaaauauacaacccuucuauauuaaaucaggaagaaauaggaacuccgaacagaccaauaacaaguagugagauugaaacaguaauuuaaaaaacugcuaacaaaaaaaaguccaggaccagauggauucacagcugaauucuaucagacauucaaagaagaauugguacaaauccuacugaaacaauuccaaaagauaaagagggaauccuccuuaaaucauuaugugaaaccaguaucacccuaauaccaaaaccaggaagggacauaacaaagaaacuguugacucgcucuuucuguguuucucucugccccgugcugucuccccugcagucucugcaguccaggcccucuucucucucuaugaucucuuugcacucugucuguuucucuguucugucugccucugcucacccacacgugcacuugugccccacaugccccacccucguucucucugguucccacugugucuguugugugucucuauucuucuucugauuacucuuuccucccccacccuuaucucuuuaauguuauugcuauguuugucucugugcuuucucuguguguuuucacucuuuuucuuuccugucucccuucugcaguucuguuucuuggugucugguugucuucuggugggggagaagggauaguuuacuauugucaguacaaaaagugaagaaaaaaggucauucaguaguuuuccuuuaugaagaaaaagcugaagauggugaaugauuucucuguauuuuagaucucuccuuauuuauauuagcucauguuuccagcaggugggcaaauaaacaacacaagcaaacuaccaaacagagagaccuccaugagaaaagaaaaugagagcuuuauguccaacuaaauguuuauuaauguuucauauauuuuuguaaaauggaguucauaucagacuuuacaugccuauauacgaagagaaauuacacucaaaagcagcauccugaaauccaaagcguaaauuuuuuuauacguuuacagagaaagaguuaagauauaaaacuauguauacauauuauaauccaaauauacauaccuauguguauauauauauacguauacauaucaguaucaccggaacaaaauauaugucauacauagaacaaaaaacugaaauuauuauaaaaauaugaauuaugauuuuuucuuuuauauuuuugucuauuuuuuacaagaauuauguucuaauaagaaaccauaaaaguuguuuuuguuuaacaauaauagaauaagguaagccagauugauaaacacaaaaaguuauaagcuuagaaggugaauucccaaauuucucauugacuucuauuuuggguguaaaagaccauuuugagcuucccaaacuagucauaaugaacccuucuagaaguauagugaaauaauaggauuagagaacuaguauacaugguuucugugucaugauaaaguacaguuuucuuuuaacuuccagugccaaggguugaguuaaauguacuccucaguucaugaccccucuuuuuaaaauuuuaucaccauaugccauccucauuucugucuccccauaggaaaccagucuuauguaaauaucuuucagguuacaugaguucuuacaaaauacauauuuuuuaaguaugcaugaacuuucaucauauauaaaagguguaccauuauuuuuguuauguuggcuaaguuuuguauuuucaaagucugccuacauugcuguaaguauauaucuacauugcuguaaguauaucuaaucacauaaugcuccauggagugcaucuacccacuuacgcaugaacacccaggagcacccagguuccugucaguuccccagcaccacagaacauggcagugcugucuuuguccauguccccuuaugcgucugucugaaacugucuuuagcauauauacccagaaguggaauucuuggcuuacaggcucguauacuuaauuuccuacauuaguaccaaauugcuuuccaguucauauuccuaccugcagugcaugaaaauuuccauuucuacuucucugccaauuauuucuaauuuuuaucagaacacuaguaaaacaaguuucuauaccaugggaagauagguguuuuuuuuuuuucuuuuuaaugagaugauacuugucuugaacaucuagaguaucucuuuaauuuccgugggaagagaguuuuucauauaauuuacagugcuuucaaccagaauacauucguuuguucauucauccaaacauaauuauagaauugacaaaagcacagagugacauacuuuaauaagcuuuucucagauuuauauauaugagugagaaaauauauggaaaauuuuuauaacaauauuuaaaaacuugauuuaaauaucugguaaaacuucauugucaaaacacagcauccacauuuguuccaaauacccauggaauauuuacaaaauuaauuguacguuagacaaaauauugaugaauucucaaagcagaaguuuuauaaguaagcccauauucuguaacuguaaugcaguaaaauugaacuuaacaacuauaauuuuuaauuuugcuaaugcuuuaaauugcauuucuauuagguuucagauuugccauuuacauuucuuacuuugagaauuaccuuuguguauccuuugccuguuuuucucugaagguuuuuuuccuauucauuuuuguaaacauauuuggagaccacuguaguugcuguuuuuuuaaauucuguuuuauuacuuuuuuuuuuuuuuuuuuuuuugagaugucucgcucugucacccaggcuggagugcaguggaaagaucucggcucacugcaaccuccaccuugcggguucaagcgauuuuccugccucagccuccugaguaguugggauuacaggugcgcaccaccacgccugacuaauuuuuuuguauuuuuaguagagacgggguuucaccauguuggucaggcuggucugaaacuccugaccuugugaucugcccacagccucccaaagugcuggaauuacaggcgugagccaccgcgcccggccccuuuuuuuucuuuuuuagagauguggucuugcuauguugcccaggcugaucucaaacuccuggccucaaccaaucuucccaccuaagccuucugaguagcugggacuacaggcaugugccacugugccuggcuuccuauugauuuuuaagcuuaauuacauuguguuaauauuggaauaaauaauauuguuauguauuucuuuauuucuguguucaugcuaaaaaagaucuuccaaccucaagauuuguuuuuaaaaaauuauccugcuuuacuuuugauacuuuuugagggauauggaagcuuuaagcuuuaauuuaagcuuaagcuuuuaaucuacauggaauuuauuuuuguguguauagguauaaauuuauuuccaaaugguagcuaguugccaauaaagauuuuuaaauaaaguaaugucaauaaauuaauuuauuagaaaaaucuaauguucuuuuguuaagcuagacuccaaucaguuagaauugguaaauaauuggcaugguucuuuugaaauuuccguucaaaacaacugaaauaacauauggacaccuuauaaaaauugacagaccugaagaggaaauuaauucugacugaaacaugaaggaguuuuauuuauuaaacuugaaguuggaucagaucauccaagugaaaauaucuaacaagcuagauggaucugaccccaugaggauaucaugagugagaugaagauuuuagagucauccauguaaagguggugguaauucuuauaguuauuaaagccaagaggaaacauauuugggagaaugcaaagaauaaauaaauguauagggcuacuuccaggcuguaguuuuucaaagcugauagaaaaaccuuugggaaacaugcugucucgcucuaucacccucuacaaaauuguaugaucauuugucaaccuucugguuuuccugugaguuaauugaguguuuuagcucuugauucauuuucuuucuguccaacccaaagcccuaccauuaucugggaaauuuuauuaucccauuagaguuuuuuuuaccuuaguuguaaugaucauugacuguaauaauuuccacugcauuuuagccauacauucucuuaacuauuguuugaauuuuggauucacucaaaauuauuuguucucugcaaucuuuacuucuucacauaccaaaauaaauuuuucaagaaccuguuaugcaggcacaguacauuguuaauuuucugaggaagauuuuccauaguuuucugaucaaccacacuggcagaaauagauaacuaguucuaauuuccaaaagguaaguaauagauaguuaccaccugaguuucugcuucugcaaccuuuuuucacuaggaauuaaauguaugucacagcauuauuuuuuggacagacacuuggucauugugucaccccuuggugaugaguaaauuuuauugaaaauauacuugcuguuugauugacacaguucuauaaacuuuucacaagaaaagacagucuuuuggugccauagacuauauuucucauuuugacucugacuguuuuaucaaugugugucucugguccuaagccugagugauuauaaaugaauuagcguaaacccaugccucuaaaggaaaagcaucucccagcaggcaccuggcuagcugaaggccagcaguaccaauccuccugccugaagaauagcaguguagggucauaucagaaaacauggcccuuuuccuauguuggauauguuuuucuaagaucaguuuccaccuaacaaguaauuuuuuaauugaaaagcuuuuauuucuaggucugucucaugucuuuaauaaauacgggaaugagucucauuuaguucuuaagcuaaagaguacuacaaaaacccugaaacaucucugagaugguacauuuacuuuccauuguuacucuuguauaagacagcaacaggugaguuugcucucauaguggaaauuaaaacagaagcagccagccagcauauauuuccuuccaagauuguguacaagagaaagccuaacccaugguggcugauaaugccauuuaauauauagucaccuaaaucuuuaugugucagcuccauugcagaggacucagugggcuacuccacacccaagccugagggaugaggagaucauuagagaugcgugggacucucccacggacuaaggaaagugaacuguuuugguuuacugaccgcauauauaaauggauucaggaaaaaaaaaaaaaaaaaguuccaucccaugauggguccucagcacaaauugugggacaugagugcagaugugugcauugugauuauugugaauccguggauggauucaacaucacauggcacgguucugacaguuugugcuuggcccagcuuuagaguagugcuccaucacuccuauagcauccagugcccaccuuuuuuuaggauuguuuguuguuuauuacaugaaggcaacacuguuuaucacuuuccaagguugaucuuuuucugauuucgguaacauaggagaugcagaacuauagaguauaaccuuuuuucuccaaacaagacuucauaguccacauuuuuuucaguuggcauacaauaaauaagugcauuuuaugccuuucuugacauauuuuccaugccguaaacuuuaccuguuuaaaguguacaguuuaaugggucuugauuuagucacagaauugugcaaccaucaccguauucugauuuuagaauauuuuaaacacccuccaaaaaaauccuguaaacauuaacaaucaaucuucauuuccccagccucccaccucugccacagccugcaggcaaccacuaaugacuuucuguuucuauggauuugccuauucuggaccuuucauauaaauggaaucacagucuuucgugacugacuucauucacuuaacauaguauuuucaagguucguacaccucauagcaugugcucauuccuuuuaauggccaaaggacauuccauucuaugaauauaccacauuguaucuauucaucaguucauggacauuuguguuguuucuguuuuuugucuauuaugaacaaaacugcuaugaauauucauguagaaguuuuuuugagggcauauguuuucauuucucuuggguauauaccuaggaguggaauuaaucauaugacaacucuauguuuaaccauuugaggaacugccagacuuuuccaaaaugacugcaccauuuuacauucccaccagcaguaugugaggguuccaauuuuuccacauccuagugaacaguuguuuuugucucugucuuugauugucaucuuccuacugggcuggauaauuauauuggguugagagagaauuuauucuuagacuuuucuauuuuuaaauguuuaccuuuuuauaggcaagcauuacuaaaugaaaaagaauuugaaaugaaaacggaaacauuccaaggcuccucauauaauccaguguaauuguguguuuuuucacacccuguggugcacaccaugacuacuuguguccuuuggaagugcaggauguucacagaaccucagacuuggaagggaccacuggaguccugugaauccuacccacucccaucaacacuucugcugcaucugcaccaaaugacaggccacccucuaauagcuccaccucucacgugcuacuuauggggcagccaguuccauuugccuaaggcuucaguuaucaaaggcuuuaacuuaaauccaauaucuccuugcauuggaauaccuggcucugcucccagagcugcucucugaaggcacaggaaacagaccuagcccucugccucucggacccccaccuccuuuccugauguguuuuuucucaggucuucacuccaugaaccguuccacaugggcugugguaucuacucuccuuucugaguuuggcagcuuuccuggguauaaguuuguugguaucuuguuuuuaaauaugucccucucagcuaagcuuguugugcuucagguagugagagcguauugaccaacacaacuuaccaccuuccauucagugacuggaccaugucuguggccuaacguauguuauuccuuuugaacuccuuaaaucuuuucugccacacccuuccccacaaguuuuuguuuauucucauuucuugaacugguaauacaguacaaccacaugauacaaaauauuugaucaagaguguccuuccuacuccuguuccccagcacccagcccuccuucgcagagguauacaauaaaauuucauccauuuuaaguguacaguuaacuuuuaguaaauuuacagaguuuugcaaucaucaccaaaauccaguuuuagaacauuucugucguuaccaaaaggugcccuuguaccucuuugcagucaauccuuguucccagccccaggcaaccucucaucugccuucugucucuucuggagauuuuauguauauagcaucagauguggucuuuugcaucugccuuuuuuuguuaacaucaugauuucaagguucauccgugcuguaguaugcaucagugguuccuuuuuguugcugaauaguguuccauuuuauggauauaccacauuuugcuuaucuuucaguugauggacauuuggauuguuugauuuuuuuggaugugaaugcugcuauuaauacuucuguaaaaguuuugugugggcauacauuuucauuucuucuggguuuuuacucaggagugaaauugguaggucauaugauagguuuauguuuaacuuuaucagaaauugccuaaguguuuuccagaguggcuguaucauuuuacauucucgccugcaaugugugaggguuucgguuucuccacuuccuugucaacacuugcuauuguccaccuuuuuauuuauagccauucuagugggugugaagugguaucuuauugugaguuuaauuugaauuucccuaaugacugaugauguugaacauuuugugugcuuauuggccacucuuacaucuucuuugaugaagugucuuuuuaaaucuuuuugcccauuuuaaaauuagguuaucuuccuacugaguugaaagagcucucuauauacucugguuacaaguccuuuaucagauguauuuuuuguaaguaacuucucccaggcuguggcuuuugaauugcaaaugguuuuaauacaguaaugaugaagucccauuuaaacuguuugucuuuuauggauuguggauuguacuugggguguuauauucaagaacuguuugccuaaccaaagucauagagauauucuccuauguuuuucauuaaaaguuuauuguuuuaauuauuauguuuaggucugaaauccauuuuuagugcauuuuuuguguacgguguguugucuaacuucaucucuuugcauagggauauuuaauugucccagcaucauuuguucaaaagaguauuauuuucuccaauuaguugcuuuggcccuuuuguugaacacuaauugaucacauauguaaggcuucauuuggaauuuucauucuguuccauugauaugucuguaucuuuuuuuuuuuuuuuuucuuaagacggagucucacucugucaucaaggcgggagugcaguggcacaaucucggcacacugcaaccuuugccuccuggguucaagcgauucuucugcuucagccuuccgaguagcuggaacuacaggugcgugccaccacacccagcuaauuuuuguauuuuuaguagagaccggguuucaccauauuggccaggcuggucucgaacuccugaguuugucaucugccugccuuggccucccaaagugcugggauuacaugcaugagucacugugccuggccaaucuagaucuguccuuauaucaaugccacaaugccuugauugcuguaacuuuauaagauuugaaaucaggaaauauaagcccucuaccucuuuuuuuuuuuuuuuuuucuuuuuuuuuuuucaguaacuuuggcccuugugguccuugccauuucuauauaaaguugagaucauuuuguagauuucuugaaaaaugcuugcuggaauuuugauagagauuguguagaaucaacagauuaauuuggggauuauugccauccuaacaauuuugagacuuccaauccauguauggugagugucucaccauuuauauugacuucugaugucucccagcaauguuuucuaguuuuuaaugugcaaaccuugcacuucuuuuguuaacuuuauuccuaaauauuuuauucuuuuugaugcuauugugagugagauaguuuucuuaauuuuauuuucagguugucacuugcuagaauguagauauacaauugauuuuuuuaucuuauugaucuuauauucugcaaccuggguaaccuugguuauuaguucuaguucuuugaggauuccuuaguauuuucuacaaagaaaaucaugucauuuguaaauaaaaccaguuuuaccucuuccuuucaaucuggauucuuuucuuucagagacauuuuauaaauaaaaaagcaaacaccuacauauacuuuuuuaguaccuaacaugcuuucuuccccuuuuuuauagcugcagagaagguauaauguauuucauaucagucacuucuuuuuuauguucccuuuuuuaaggagaaaauaaaaauauauuuuuuaacaucauuuuagucucuaguuuuauaucaguguuuuauauuuuaccaucuaaaucaucuguuauuucuaaaaugcagauuucguuuccuuuucuagauggggaaacugacacaaagagguuauggcuugccuaaauagagaccgcuaauaaagggaagaccugaaacuggccuagcuguuuggaauccugacacagagcuuuuuuuuuuuuuucccugcaucaaaguugcugccauuccuccugccuaaugagcaggacuuuacaauugccccuacuaaacaugcucugauuuagcccaucauuccuguuauuauuugggauccugacagaggcccucucucugaugaguauuguauguaaauucuccugcuuuccauaucuaagacauuuaugucuaaaaucuuaagaaggaauagccagcaccaaacccagugauugcacacaguaauugcuuaguaaauauuuguugucaaaugcaagauguaccacucaguaaagacaucuguuuugaaauuauauuuggauaagguugguucaaucaguuaugauucuaucaacuuguauuaucauccaacccauauaacuccaucuugcccucaaagaugcuauuaaauguuuuggcauuuuguucaaaucuagguaugguaugcuauguauucuuuugguuagccaguaaagugaccuuauguacuagagaaaacaaggcuaaccuggcagggcaugcucugccugccugacugagccuggcuuaaaucugcucaucuuuuuuuucaccaguuccuugcaaauuaucugauucgugaugcauccuaaauuuuacaugucaucaguguucagcccacuaguuugcaaugccuaccuuuccgaaaaucaaaguauuuccuuucuucaagugucuaacauagaucuuccuccccaaaauucuguuacaaguuucuuugugacucuggaauaugguuuaucuaguucaagggaucagauaugcucaguuuccuauccuuacccuggcuuuaauuuaccuccaccagaccugccuaaguagaaaauucccuaacauuuauucaaaauauagauuaccagaccccuccccuagagauuccaauucauuauucuggguuagccucccucuguccuuauuaacgauggagauauuaacaaugaacaaguuuaagaagcacuauuuuacacuauaguauuuguucagcuauaucuuguuaaucauuuugucauccaccgacauuccaccaucagcugcaaucccugaaauugccuucauugcucuacuugcucugaacguaauuuaaaaggccuuugggacucucuaauacuuuuugcaaugcucuacucaucaggacgucucacgagccuuguaggucuuugguguuugucuuaguauacguguuugagucagcucuuaauuggagagcgcucucuucaguucaucacucuuuuuagcuaucuccaggccucuuuaucucacaugaaaauuaugugcaggugucacuucagaauuucauucugaagaugcaucagacuaauguuuggcuagcauucucuucagaguuuuuccaagcccagugaaaauagccaggcuuuuuuuugucuuaccaccuuauaacagcuuaaguccuauccaccuacaacauucucccuaucacagauacaaggcagcaaguucacaguaucucaagcuuccuccaaaugcaucucaacaguuugaauuggauuagaaagaggacuuguuggcuugcuuauccuguggauaacugugacauugacugcagguaauaauaacaagaucucuuuuauuuuucuagguagcaaaccaugugauuucuucugacucuauuuccucuucugccaguaguuuccugagcucaaacucuacuuuuugcaacaagcagaauguacacauguuaaacaagggcauacaagcagguaauuacuugaaucuaaacuuuuucauugaaauacauugaaauggcucuuaaacauguaagauacucaaccucaaucauaauaaaggacaugaagauaaaacuauauccaacugccaauuuucaucuugucagauuggcauaaauucaaguuugauggcaaguuugugggcaagaguguagggaagcggguucccuuguauauuucagugggaguagaaguugauucacugugaaaggcaauuugaaaguuccuaucaaaauuacuuucacucagcauuuuuacuuuugaaaugucugcuauagauauacuaugaauauguggaauuuaaccuauagauauacuugcauaugugcaaaauaguguacaaaauuaaccacuaaaacauuguuuauagcaggagauuaaagugaauuuagguguuccucaguagcugaaugauuacauaaauuauuguaugucuagauaaugaaugaaauucuacauagaaugaggaagcucucucuguacuaacauggaaagauuuccaaggcauguaauugauuuuaagaaaagguacagaacaguguauagcauacuacaauaugaauuuuuuuuaauaaaagaaagaaaggagggaagagaauugcuuaaaugugcaaaacgaauucucuggaaccauaugggguugugaacagaauaaauggagaccagaagugggaaggaggauuuuuagcuauugccuuucuauaccuuuugguuucauaaaauaaaaauaaauaaacuuucaucuugauuuguuucuuccccucaaauccugucuucugucagccucuuccuuaccugcgugacuaccaaaaggacucuuaaguauuuauugucuuucuaacuugggaucagaguugaaauccuuuacccuuugaacccauauucauucuucuuucccucucauaccuaaaaugaguuacaaauaaaacccuuucuuuuuucuuugcccucuuuuucccuccuacucuccccuguccuucuuucucuuccucucucuucgcaucccuccaucccacacaaagggauuguauuuuugaaacauuaaaaaggguucacguacucacuugaauaaaucugucaacucagccucaagguuacucccagagacaccuaugauccuuccccucagguaacuuggagauugugaacggugccaaaaaacacacucgagauguugggauaacuuucccaacuccaaguuccagcgaggcuaaauuggaagagaacagugaugugacuucuuggucagaagaaaaacgugaagagaaaaugcucuuuaccgguuauccugaggacagaaaguuaaaaaagaacaagaagaauucccaugaaggucaguuucucauuccagaucuuguaguagagaaacuagugaauuucaaguccccugcgaugcugacucuguguuuccaagugacucuaugugguccccaccuacccccagccacaaccuugucagguuuucagaguccagcauggcaguuacacagucaucccugcagcaaaaccagacucaagggcacccuguggccucugacagcugagaccccugagaaccuguauuauaugcauauccuggauaagagcuggguggggcuguaaaaaagugaaaaaucuguguuccuucuaaaaacuguuuccuguaggaguuuccugguuuguuccuguggaaaauguggagucuagaucaaagaaggaaaacgugccuaacacuuguggcccuggcaucuccugguuugaaccaauaaccaagaccagacccuggagggagccacugcgggagcagaacugucaggggcagcaccuggacggucggggcuaccuggcaggcccaggcagagaggcuggcagagaccuacugaggccauuugugagagcaacccuucaggugcagugacguugacuuaacuuuaaugcuacguguagggagaagaagggcaaggcgcagagaagcuggcucugugacuuggugagcugagguguaggccugagacgcucuuuuccagcaccuccgcaguucaccuguuuucacgcacgaggguuggguuucucaucaucugucaaaggcugccuuacuccuaaccauagauggugcaucaccgucgggaucuggggacaaggccgcaggagggaggauuugcaucucugcuuauugggccugugggucccuguguguggagggcccggaggccugacgcuugugcggccucauguguguuccuccauguccguagcuccuguuucugcuccaugucggauuuaaaggaaaccaggucucuucugaugugucccuugggggauaaaggaaauguuauuaaugauguauuugucugaauagaucuuuaaaauagcacugugggaagagcuguauugcacugacauuucaaagaguuguaaucgccauagucuuaguuccuggccuaugcugaaggcaugucuuugaucccugcgguuuccaagcugcagcucucccccauagagagaugucagaggauucuucaacgcuagauacuuucucggcauuugaaucagacuuccccaaaccucuugggcagguggugugucuccaggcauauggagaguagauugcaucauuaaucugaggcugggcauuuucucuuuuuuuuuucuuuuaggaaucgcuucaguuucacagaccugacuucaucucccgcucuggggagcggauaaagcgccugaaguuaauaguccaggagaggaagcugcagagcauguuacagaccgagcgggaugcacuauucaacauugacagggaacggcagggccaccagaaucgcaugugcccgcugcccaagagagguacgcccugcccguucacuuuccugugaguggaauagagaaggcaaggucugcugcucugcugcagagcccugcuaaaggccagcccaggccaguuaccugggcagacagugaccuuuugcuugccaagacucaaaccuucuuagcuagcagaaucuccccaacuuagccgucagcacauucaugauccaaguaagcccaguuacucuaagcccugucacugcaucguaaaccagcucugugucugugagcaaguuaguuccaaaaguauauugauuuuuccugaaaagauggggcugauuccaggcuugccuaccucuuaggaugguaauaauaauaauaauaaacacauaguccuuacaucuugcccaggcacuguucacauuagcgcuuacagcacucucaguagguacuauuaauauaucuacuuuauagugagaaaacugaaucaaagggagauuaaguaccucucccaagaugacauaccuaguaaguaaaagcuaagauuugaacccaggugugcuccucuggagucugcauucuuaacaauuaugauaagcagaucuugauaaaauaaugaaagcugugaaaacuacaaagcacuaccuaauucuuuuauccaacuuuagaaaccggccagauuuuuaauucaaagccuagucuuugcuacagaguguuagguccuuagggccuuaggcugcugucccuguuacccuagucuuacacuggcuugccuuggucauugcuccccacucagucuugccagcucaggguaggggcaccaaguccuagcagcucccucucccagcucuugcaccacacccucuggguuaagucacuguccacugaaaacccuuucuucucuugccuagucuuccuggcuauccagaagaacaagccuaucagcaagaaggaaaugauucagagguccaaacgguaagaccaagaaaacaagaguacguauacaaguguaaaccaggccaccaaguggucgggagcucuggcuugcacccagaauaaauguauuauacucaaguuuaaacauuaugagaaaguugugagagucauuucucacuuauggcacugaaaaaaaaaaaagcacaucaugguaugaaugacucauaugcaaaagaugaaaaacuucucacuaauuugcaugucuuaggcuccucuuuauuagaaaccuaaauguaaauaaagaauauuuuaggccagguacgguggcucaugccuguaaucccagcacuuagggaggccgaggugugcagaucacaugagguuaggaguucgagaccagccuggccaacauggugaaacuccaucucuacucaaaauacaaaaauuagcuggguguggaggcacacgccuguaaucccagcuacucaguaggcugagccgggaggaucucuugaaccugggaggcagagguugcagugagcuuagauggugccacuguacuccagucugggcgacagaacgagacuccaucucaaaaaaauuaaaaaaaaagauuauuuugaaauaaaauuaaauauguauuuagaccacaucuuuuauucuagcaaucccauuucuaggaauugaucccauagggugagaaagaacaguguucuccagaacacaguaaguuaaacuuuuuuaaaagauuaaaauuucgaagcaugugaacacuguuuccauuuguggucuuuaaaaauaaguauuugugccuauguagauguguguacuuuuauaugcauagaauauuucuggaagacagaaaaaacugguaauacugauugccuuuggaaaggauaacaguagauuuuuugacuuuuuauaauuuuugaauuuugugccaugaugaacgaacauuagcuacucguuaauuaauucauuugaguguugaauguggugguacauuucuguaauccuaccuacucaggagucuuaggugagagaaucucuuaagcccaggaauuugagacugcagugagcugugaucacaccauuacgcuccggccuggguaacagacugaaacucuguauucaaaaaauaauaaauacaauuuuuaaaaauuaauucauuucagauauucauauauugaucaugagaaugccagagaauaagguugacuuuuuuaggcauucauuggacacuugcuuuaauaagaauaguuucuuaguuggcauaaugcuucugaaguaaugguacuuuaaaauaauuuaucucaugaacuuuaagcauuccucuugaaaucuuguuuuuacucuaucuagucagcccuuauaggcaauccaaagggaugcuuuggaugcuuuaguccagugguucucagagaguggucuguggaguccuggaaguugcugagacccuuucaggcaauuugcaagcucaaaacuaauuucagaaugacaccaggauguucugugccuuuuuugcuguguuggcuauuugcacugaugaugcaagagaaauggggaggaguaaaaucacuggugucuuaccacuauucaagacaguggcaccaaacuguaguagucuaguaggcauuguauccugcacagccucccgccaggagugugauggaagaacaaggaagcaguguaaauggagguacacgggaagcacuuccuuugcaccgugaaggaugaugacuguuuuaaggaaaagcacuuaugccaugguuugugucgugagcugaaccagcugccuuuuucauggaacaugacuuuuacuugaaagaguaacugacagaaaaccaauuauucugacuuguguuuguagcagacauuuucuugaaaaugaagaagugggucugugacuucaggaaaaugucugacaguaucuguugccaaagaaaaugugaguuuucaagccaacaauagaaaucuagaaaacuuguauucaccuccaugggcuugaugaccucuuaguacuuagaccuuucugacgagauaagcgguggcauuaacaaaugugauguuuuucauguuaucuaaauacauuugucaacauuuggaagaucugcacaacucccuggaccaggauuuuccaaaugauuguugcuuuuuguuacaaaaucagggaauagauagaagauucauucaaauaaugaaagauagacugauggauuuuuauguaacagaauaggaaaaguuuaugacauguuuucagauuccaccuugcaacuaauuuuuaagaagcuaccacuugucagccaggcacaguggcucacgccuauaaucccaacacuuugggaguccaaggugggcagaucacuugaggucaggaguucaagccuggccaacauggugaaagacuucucuacuaaaacuacaaaaauuagcugggcauggugguggguaccuguaaucccagcuacucuggaggcugaggcaggagaauugccugagccugggaggcagagguugcagugagccaagaucgcgccacugcacaccagccugggcaacaagugcgaaacucugucucaaaaaaaaaaaaagaaagaaaagaaacuaucacuuaucaaguuuggguguaguaucaaagaagaucaagaguuaccugaaaagaguauugcaguaacuucucucguuuccaaguacguggaaaaucuauauguaagcuggauuuuuuaauguauacuuuaaccagagcagguugggacagcagacuuaauacagaagcagauacaaguccagcugucuuccauuaaaccagacauuaaagaguuuucuaaaaaauguaaacagugccacucuucucacuaacauuuuuuuguuuucaaaaagucuuuauuucccauuaaaaauacagguuucuuauguuagccugucacaggcuuauuguuauuucaagugaauaaaaaaauaaaguuuugcuuaauuuuuaauuuuaauuuuugauacaguaucaauagauaaaaccuacauugggaucuucagcauuugggagugugaagggggcccuaagucuaaaauauuuuugaaccacugcuucauucuaacucagucacaaaauggaauuaggggaaaucauacaggguuuguuguggggcagcuacuaauacucucaccucagcaagagcagucccugcuguaagggacuaggaagcuugccuacaggaagacagccaggacaucuccuaaaauguaucaaugcuuucgacgagaaauauaugaguggauuuagugcccaucuucuggagagacuuuuuaaacuguuuuuaaacugguacauuuucauuagguugcuucuguucauguuuauuucuuguguggccucuuuucaagggagugaucuguuuccaucugagaaucuucaauaucaucuaguaacucuuaauauuuaggaaacuacaacccagagaggggaaguaacccagcaaguuagggucacagcuggaguuagagccugguguuuggccuucaauuguguccuauuaaggauuugugucucuggagccuguguuacucaucuuuuguuaucaccuaucucuaccaaagauauuuaaagguucccgugagaaggaaagauuucaagaggaaagaacauagcucuuuuauuuggaagcacuuguuccagaguggccuucaggagacaccuucaccuucucuaauguguuucccgcagagcccuccaugaaucuagugauuuuuuuuccagauuauagaaaacuuuaggaaauauagagaaaaguagaaaaaagaaaaugaauaucacuuaucauccuuccaucuaauggaggaugggaauuuuuggugggaggcgugggaauuuugcagagaccugcauaacacacacuuuuuucccucaaauuguuaaucauacugcauauacagguuugugucuugcuuuauuuuauucaacauuauguugugaaccuuuccuaugacacuaaaaauucugaaacuuuuguuugguauacaugaaacauacuuguaacauauacauuccauuauacuucauaaucuauuuaacuguuguuuuguuggaaacguauuuacaaugagagugcauuuaucaaaugcacauuuguguuucucccaacuuaaaaucauugccacccaaccccugcuagaacagaucccauguuuuucacauggccacaagauccucucugcagcccaccucacccucacccccaucuguuucccaccuauuccuuuacgcuccuuuuugggaagccucgaguccauuuuuaccaacacucauuuuccccaccuugagugucuucuguccuucuccccauucccuuucugcucuuauccaucauuauuauuuuuuuauuauuauuauuauuuuugagauggagucucacuuuaucacccagcuguagugcagcaguggcuugaucuuggcucagugcaaccucugccacccagguucaagcgauucuccugccucagccuccugaguagcugagauuacaggcaucugccaccaugcccaccuaauuuuuuuuuuuuuuuuuuggugugugugguuuuaguagagacgggcuuucaccaucuuggccaggcugcucuugaacuccugaccucgugauccacccaccucagccucccaaagugcuggguuuacaggcuucagccacugcacccagcgcuccuaucuauucuuaagacccaacuuaccuauaauuuccucucuggagccuuuccgaaccuccuuccaccagaccaaguuucuucuccucuagaacauuuuauaggugugaccauuuuaguacuuuuccauaauuucacuuguguuuccaaacacaauaguaacgcuguucauuaucuuauauugaaacaguccauuuuugcauguagagcagaaaguagaaguucagcucuccuucauuuaucucacuccuuuccccccuuuaucccacuucuuuccacauguaagcacuauuaggauuuuauuguguuuguauuuaucuccccuuccagauugugagccccgggcuaggguuuucugugcuggaguaucuaacggggcccagggccuuucugagagggaugagcuccuggagagugggagguauagggagggaugaugagaggagaucucaugacucugcacccugguaaccuccccgauuucuguccuuucacuggugccauuucuaaggauuuaugagcagcuuccagaaguacagaaaaagagagaagaagagaagagaaaaucagaauauaagucauaccggcugcgagcccagcuauauaaaaaggucaguggguccucugucuagagugggauggaucagguuuauuggcggaaagagaaauggagaaaacacguugccuguugagugugaagucagaaugaaccgcauuugaggaaugaacuuagaaugcacuggaccaguguugaaauuuggaagaaggcaucuguaauuagacuucaaaucagguuuaacuccccauccauaaugguguaaggcccuuuccaugcauucguuugcagugaaaccaaauuucacacacaggaguucauugacauaucaugguagaaauaccagaauuaucagguuuccauuccagagucccagguggugauuucaugccccucauuggugagucagauaccuuuagaacuguuaaacuggaaaauguguaacugcggcauaagaguuguccacuuggauggucagaggccuccaacuugucaccaugcccugcccauugucccaguagagucagcguugcugcaaguccaagaaccucacggggcaggguugguguuaccaguuaauucucugagaaaccagaccggcuccuaugccugaagggccauauacuucacuguaguuguuuccuucucacccugucagucaccagacugaugugggaugggagcugcuucuggagcaggccccagaacccaggcgggugccucagguggaggccccaggcaccacaccaccugucuggugugucagcaucgcagggccaggccucuccuuaugcuacuguaugugggaacugauggauuaucugugucucuauagaaauaauagauauugauuacagauccucuuuccugaaccuuucgugaaguauuuuuuauaugacgaccauaguuucugaagcagaguaaaaugaacaagauuugaauaggaccacacugauucuccuuggugacauggaugcagggaggagaggcaucugccucugauggcaguaauaucuaacuucuuuccugccuuucuuuucuucuacagagagugaccaaucaacuucuggggagaaaaguucccugggacugacacaaguuuauuuuccucagagccuuggaauucuauuuuaugaaccuagagaagcagaauccuuacuuuugugagucugguugaauaaagcuuauucuuuguccauguguauuuuagaaauaguaacuucuaaagagucuggaacaaaguggugauuaaaauuccuaaugguuugggagcaauacuuucugcauaguggccuuguccaauggccuguguguuacaaugauaugaucauuucucaagaauaagucccuuuuuguauguguuuuuauacuuuuagaaaauaaaaacuuuagauuaacuc

SEQ ID NO: 61543 - RNA, 5901 nt, Homo sapiens
gagcugcccugaagagucagccgaaagagcuggaggcuucuucccugugguugcggguuccugcauucucugcucuaaaucccagccugcccuuggggcugcccacgcccccuucagauccuuugcuccggagagagaccuguccgagcagaggccuggacuacaucucccggcgugccuggcagugugguggccucugugcgccgucugcacucguugcaggcgacgaugcagagggcuguaagugugguggcccgucugggcuuucgccugcaggcauuccccccggccuugugucguccacuuaguugcgcacaggugggauagagggugcugaucuuggagggugggggagggaagcggcugggggcuagggcccugguggcacuaagcccagccgcccacaggaggugcuccgcaggacaccgcucuaugacuuccaccuggcccacggcgggaaaaugguggcguuugcggguuggagucugccagugcaguaccgggacagucacacugacucgcaccugcacacacgccagcacugcucgcucuuugacgugucucauaugcugcaggugagccaggggagcacacuggccaucugaucaggccuuccucccuguuuacagugguccacuccuuggcuuuguuugcugugaacuggauuccaaggacagccuucucagaagagcuagaggucaugggggugucauggauaggucaauggccccaaggaaaugagcucagagggucucaucaucucauccuucuagcuugcccccauuaaauggugugccuuaaugucccggguuuuccagggcugacacccacucucauguauugggcuggauguugguuugaaaagggguuauuucaggaaggugcuagguccuguccaguucccuggcaguccccccacacagagugacugggggaggucaggaaaucagaaggugguccuuugccacguguagaaccaaaagacugguuagucacuuugggugggcuggacugcacuguggauggcagggaggaugcauccuugcuuaguagccuuuuggauuguagcuguugcaauggccugaggcuuucaaucucuuccccagaccaagauacuugguagugaccgggugaagcugauggagagucuagugguuggagacauugcagagcuaagaccaaaccaggugggcccuuuuauuucugcucuaugaguuuucuuagucaugagccagcaaaugggcugagucccuaccucaggcuuaggggcacagagaugagucaaacacagcuucucagggcuugcagucuuggacagaaucccugagucauuuccagagacacagacauuuguagggaggggaauaucccagucuuacuacaucaggcuaggaggccagaaaccaagguuaauaugcugcucucuggccaucccuucugcuuaaccccucucuauucaacauguggucccuggccaggcgacgugacucaaacaccuguaauccuggcacuuggggaggccaaggcggguggaucaccugaggucaggaguucgagaccagccuggccaacauggcaaaaccucguuucuacuaaaaacacaaaaauuagccgggcgugguggcgcgugcuuguagucccagcuacucgggaggcugagguugcagcaagcugagguugcaccacugcacucuggccugggcaacagagugagacucagucuaaaaagaaaaauaacaacaacaaaguguggucucuaaaccagcaucuuuggagcuuguuaggaauauagucucaggcacugcugcagaccugcugaaucagaaccuucauuuuaacaagauccccaggugauucaugugacccccucaaccucaggcuuuuuguccauccaguggggaggcuaaggaaguuuuuugggggcauugcuauggaguacuuaggagagccugcgaucaucaagaugaccuuugaagcuuuuguccuguggguugccacaugggcuaagucgucccagguuuggguaggugaagcagcagguccuaggugucauagauuaagugucagaugggacucucaguacagaguggggaggggugcagagguugcaccagaucagggaagcaccccaagguagggaggggaugaaaacuuacuugaugcaugaggaucaaagaccuuggacuugggcccagacuuguaccuugcacacccugaguccuucacauuaggguucauaaccuuuugguaacuaaguggguccaggguugugucuggcucacccuuggccuugcccuccuggaccuggaagccaaaacgcuccacuuugguccuaggggacacugucgcuguuuaccaacgaggcuggaggcaucuuagaugacuugauuguaaccaauacuucugagggccaccuguaugugguguccaacgcuggcugcugggagaaagauuuggcccucaugcagguauacccccucuguguucuagacaccuugucuuccuuguucauagagcaguauccuuguuguccaagacaggguuggcacagacaagggaccuggaaaauggcucuuucagugaaugaacagcuaugagacucaagagcaggcccucucuggagcacgccaggguuugguggugggggauuaccaggcauggggagggggucuuggccccucuggugugagguggcagaacugggcuugggucaucucuaucacuuaguagcuaugugaccuuguaagaugggaaccagccuacuaccuuuuuuuuuccucccuccuccuccuccucuccacuguccuacuacuguccagcucugcagcguccagcccaugguagcugcucaguaaguggccccagaugcucuuguguuucugucuuuuaggacaaggucagggagcuucagaaccagggcagagaugugggccuggagguguuggauaaugcccugcuagcucugcaaggugagagggcugggcugggguuggagccaaccuuugccuuccuggcuucauugacugcuuagcacagaggccauaccaagaagaauguguggaaggugugauauuugugugccauaauuuuaaguuuuguaucuugcccuccuccuaccuaccacaaggcuccaugggcuagggacaagggcaucuucucccacuugcagaguaagacaugcucagggcuuguucuggucccugaauaaggcuuuaguccagcuuugagggaugcugggaccuggauacuuggucacuggcucccugggcccaggccccacugcagcccagguacuacaggccggcguggcagaugaccugaggaaacugcccuucaugaccagugcugugauggagguguuuggcgugucuggcugccgcgugacccgcuguggcuacacaggagaggaugguguggaggugugucaagaaguggugugggggcaguacagggcacaggaugcaugugagggguuggggguaugugguacagggagcuucccaucugcccucugguguuucauacagaucucggugccgguagcgggggcaguucaccuggcaacagcuauucugaaaaacccagaggugaagcuggcagggcuggcagccagggacagccugcgccuggaggcaggccucugccuguaugggaaugacauugaugaacacacuacaccuguggagggcagccucaguuggacacugggugagcugggccagcacuaaaggauaggguccuggaggucagggugacccuugauaagacuagccagcccaugacucauccaaagguuauguagccugaagccuuccugagccucccuucccugaaggugccacugugccuuugcccauuagaaacugcagauguuggccggaugcgguggcucacaucuguaaucccagcacuuugggaggccgaggcggguggaucacgaggucaggagaucaagaccauccuggcuaacauggugaaaccccgucucuacuaaaaauacaaaaaaaaaauuagcugggcauuguggcgggcgccuguagucccagcuacucgggaggcugaggcaggagaauggcaugaaccugggcggcggaguuugcagugagccgagauugcgccacugcaccuccagccagggcgauagagcgagaccccgucucaaaaaaaaaaaaaaaaaaaaaaaagaaacugaagaugcugccgggcaugguggcucacaccuguaaucccagcacuuugggaggccaagguggguggaucaugaggucaggaauucgagaauagccuggccaacauggugagaccccgucucuacugaaaauauaaaaauuagccaggcgugguggcgggugccuguuaucccagcuacucgggagacugaggcagguaaauugcuugaaccugggaggcagaguuugcagugagcugagaucgugccacugcauucuaggccugggcgacagagugacuccaucucaaaaaaaaaaaaaagaaacugaagacgcucggcaggugggcagcauggccuccaggggauaggaggugguugguuggcugacggcagugaagggaggaauagagccuggaguagcccaagcaaaggggccuugaugcuagauaguguguuacuugaggaccucauaaggaccuccuguggccagggcuucuaugggcuguggcuuaugucucaugugucauucuccagggaagcgccgccgagcugcuauggacuucccuggagccaaggucauuguuccccagcugaagggcagggugcagcggaggcgugugggguugaugugugagggggcccccaugcgggcacacagucccauccugaacauggaggguaccaagauugguagguggaccagggaagcugggaaacccuugucucuucccaggagggugggggcacuggcaggguggugcugaugcguggcuuaugcuugcuugacagguacugugacuaguggcugccccucccccucucugaagaagaauguggcgauggguuaugugcccugcgaguacagucguccagggacaaugcugcugguagaggugcggcggaagcagcagauggcuguagucagcaagaugcccuuugugcccacaaacuacuauacccucaagugaagcuggcucaggguggggcugucccuuccaggaguuuugccccuacaagggguuagucaagaagcugaggcagaacucacugggggugggcaguuaagguggaggcugauucuaauugucugguugaggggccacaccaccuauuccccccaccuaacucaugccauuccagcuuccuucaggacccugcuucugagugacggaccagcucacacaaugucuuguuucaguccaugaucccacugaccuacucuugccugcuggaggguaaugagaagcuuugguucugccaucucucccacucugccaggugcuggcuguggagcaaaggcucaccuuuguggagaggauaaaaccugcccaaccuaccucaccaugguuuuucacauugcaaaggguaauaacaugggcagugcggacuuaggcuacccccuccaguuugcuuuccguaaaugcaaauuguccuuacugcaagucaggaaugauugcugacucacaguagggcugcuaugccuguguguaaacuuggggauggcugagggaacauagacucacucuuccacauucccaaguuggucuagugugcugcccaguagcaaaccauggcagacucaccaccuauucugaguuccagggcugcuguagggcagggugggcuuccucccagacuugccuuacccugggcugaucuuugccccugguaugcauuaauggacuccacugaauccugaaaaaaaaauuaaacuuccuucuuacuugcca

SEQ ID NO: 61544 - RNA, 5901 nt, Homo sapiens; identical to SEQ ID NO: 61543

SEQ ID NO: 61545 - RNA, 5901 nt, Homo sapiens; identical to SEQ ID NO: 61543

SEQ ID NO: 61546 - RNA, 5901 nt, Homo sapiens; identical to SEQ ID NO: 61543

SEQ ID NO: 61547 - RNA, 5901 nt, Homo sapiens; identical to SEQ ID NO: 61543

SEQ ID NO: 61548 - RNA, 25770 nt, Homo sapiens
gugcugcggcucccgggccaucuuugugcggggccgcgcuuccgccagcgccgcagcggggaaucugcaguaggucugccggcgauggaguggugggcuagcucgccgcuucggcucuggcugcuguuguuccuccugcccucagcgcagggccgccagaaggagucaggugggcuccgggcagugccgagccugccccuugggcucggggucuggccggagucccgaggcgcucccccgcgcggccggcucccgggaagaugccguggccgcuguagcucggagcugggcagaaggcaccggggcgccuugcggcggagagugaggugccggggucucugcuccugcucuggacccuggagaguaacccauuccccggaauucagaaugacagggaggagagggaauuccccguucacccgcaggaggcguggcccgugcuuggcuacucuggaccugccugaaacacugaggggucggggaugggggcaaaugucgugcgcgcgagcguguguguauaugcguugccagaagagaagagggguuuaaugucuguagcuuuuaacugauccucuuuguggaguucaauuugauuaguagaaagugagaguccgcgucacuauccauagcauucugaggguugagcauuaagcuugggaauuuuccaguuucuuggacaccugacagccggauagaggaacagacuugacgugagcgugggaguugcacacacaaaaauuccucccuagcguuucguuuccaucagugggaugggaaggggauuucugaaaguuuuggucuucuguuucuucuguugguguggugucagcaaauaacauucaggaaaauuuuuuuaacucucauuuacuucacuuuuuaaagguucaaaauggaaaguauuuauugaccaaauuaacaggucuuuggagaauuacgaaccauguucaagucaaaacugcagcugcuaccaugggugaguucuuuucuuugaugugucuuugagaguuuaguugcugucacaggaaguauucuaacauccuugagagauuuugguugcaguggucagaaaggcaaggauguuuuucuauuucuggggaauaaaaaugcucucgcaugggaaaggcucagguggugucaaccuaaccacugacucacugcgggauucagugcaugugcaucuguuuuucccacugggcugcaagcuuccugaggucagggucugugucuuauuugcuguugucucccuggugcuagcugucagugcgugcucgauaaauauuguugaggaaauaaacccaucuaucgcugaaucuaguccuaaauuuccugaugguuaucuuuagaaaaugcacaucaggcugggcauggugguucaugccuguaaucccagcacuuugagaggccaaggcagguggaucaccugaggucagaauuucgagaccagccuggccaacauggugaaacccugucucuacuaaaaauacaaaaauuagcugggcaugauggcacgugccuguaaucccagcuacucgggaggcugaggcaggagaaucgcuugaacccgggaagcagagguugcauugaauccagaucaugccacugcaccccagccugggugacagagugagacuccgucucaaaaaagagagagaaugcacaucagggccgggaugagguaugguagaaagauaacucugaaaacagacuuggguguuggugccgguacucccacugguuaccccugugccgagccacuucaacuccucugggucucagauucuucaucagcuaaauaacagggucuuuuaagcuccuuuuuauguuauuuuugacuccucaaaaaauuccuuggaugcuuaugauacuuauugaaaacuuacuaugcacucacuuuaaaaggaauacaaaauaguguaauuuugguuacugcugucacgcuaccagaguaagggcuugugggggagaguguggaccagacagaccagaacaagagagucagugcuagacuguaaggcguaaacuucaccuccugugggauugggaggagaugccaggaggacugaagugacuagaaggacacagguguggcaugaguagcgaaagagaaauacagaacugccaagggaggggcaauccagauggaaggaggaagaagagacauugacccgcuuuuuacuuuuuauugcuuuauugcauuugauguuucagauuaccuacagggcuucuagggaagagcugcucauucucacucucgauucuuuccuuccacuuacuguguucucuaauacgaaaccuaaaugcacuuaggaaguagguggaauggcaccacucucuuggccugcuuuccuugaugacucccauucuuucccagugucauagaagaggaucuaacuccuuuccgaggaggcaucuccaggaagaugauggcagagguagucagacggaagcuagggacccacuaucagaucacuaagaacagacuguaccgggaaaaugacugcauguuccccucaagguaagaguuaacgagguagauauaucuucugacuuuauuacauaugggcuugauacccuuuuauagaggagccaauucaugggacuaacaagcagaucccuccucacauuucaggcggacuaugaaauagugacgagcucuucuccuugccugggaauuuuucuugcgagcuccucucaaagccugucuccucugugaggcuugguucaucacugguuguacuggugguggcucugccucuucugcuccuucccugggauauaguagcggcaggacacaggcugaugaggccuagcaggccuagcaggagggagcuaggcugaaggaggaagaggaauugguugaaugucugucaucggccaguguaguucuagauacugaauauucaaggggaggugguagagucaagaggaguaacuagaugggguggugguggcucacaccugugaucccagcacuuugugguggauuacuugagcccaggaguuggauuauggcaaauaauccggcaguggcaaauaauacaacagagugagacccugucuauuaaaaaauaaauaaauaaagaggaguaacuagugcugcaaauuacacuagccaggacuucagaacuucaggugugagaccugagguaccaugucagugggcugaaggcagggugguaagcagggagggucaugggcugaggguggagguuggguuuaggcagcauugcacacaccaaaagauaaacuuuauuuuuggaguuuguuuuuuuuuuuuaacucagaucuuuauaaaauuagaagguacaaaacucagagggcauaauauucccuuauguaagagcaucuuucuaaacaaucccuauucugucauuaaaagugaaauaaaugugcagaguugcaaaaaauuaucgauucguucauaaagauuuguauuauuuguauuuaauaacaacuuuguaagaauuuaauauuuauucuuauaaguauauaaacaaggccgggugcgguggcucaagccuguaaucccagcacuuugggaggcugagaugagcggaucacuugaagucgggaguuugagaccaaacugaccaacauggagaaacccugucuuuacuaaaaauacaaaauuagccagcugugguggcgcaugccuguaaucccagcuacucaggaggcugaggcaggagaauugcuugaacccaggaggcagagguugcggugagcugagauugugccauugcacuccaggcugggaaacaagagcgaaacugucuaaauaaauaaauaaauaaauguaaacaagaaaacaggcugggcaugguggcuugugccuauaaucccagcacuucgggaagucaaugcacgcagaucgcuugagcucaggaguucaagacgagccuaggccacauggcaaaaccucaucucuacaaaaaauacaaacauuagcugagugugguggcauguguuuguaguccuagcuacuugggaggcugaagugaguggaucaccugagcccaggaggucaaggcugcaguaagccugagccgugauuaugccacugcacuccagccagggugauagagcaagaccugucucaaauaaauaauaauaaagaacaauaaaaaagaaagauuauuuaauaucucacuacccugaggaaaucaguuacccuuuggcuaucagauaucggaggaaauaagguuguagaggaaaaaaucguuaagguauuuuaaacagacauuuguuucauuauuuggaacucaauaauagagacuuuaaguacaaauugugagucuaggagaauuuuugauuuccacagaugagaaauaaaauaagaauauagacauuguuggacuuugaaagcuuacccaauguuuaauaguuugcugaacaauugccaaaugaaaugaaaugcuuucaaaguuucugaaaggcacaauucucuucuuccugagcucagaacauuuuggucauaaucaugagcuuagaaauguucugaagggaguacaggaccuucauuagcaauaaaauaauauauauuuccaaugacacugaaaguucccuauccuagcuacauauacaacuaaggaaaacagagagggacaaaauacgaauagaaugcaguauuccaaaacacaauccugaaugaaaugcacacagucguaugauaucucaaagauucccauauaguuagaaauaauaucuuucuacgucuagauacuuuuuuuuuuuuuuuugagagagagaaucucacucugucacccagucuggagugcaguggugugaucucggcucacugcaaccucugccucccggguucaagccauucucuugccucagccugcugaguagcugggacuacaggcgcccgccaccacaccuggcuaauuuuuguguuuuuaguagagacgggguuucaccucguucgucaggcuggucucaaacuccugaccucaugaucugccugccucggccucccaaagugcugggauuacaggcaggucuagauacuuuuaacucauccaguuucagaaaucuaugugacauuuuaaaaacucaguuuugaauaaaauaaaauauaaacuccacauuucaaggaugagcagaggaaccagagguuuaucuaauuaaugcuagagacaagucauuucaaagaugaggaguaaugguauuuuuuaauaacagcuuuauugaggugugguuaacauaaauuacauauaaaguauacaauguaaauguucccacaacaaaaaaauaguaugugaggauauguuaauuagcuugauauacucauuccacaauguaaacauauaucaaaacauuacauuguauccuguaaauauguacaauuauuauuuaucaauuaaaaauaaaaccuacaguguacacugauaagucuucauguauguuuauaccaagauaaugaaccuuccaucacaaccaaaacguuccuucugccucuuugcauucccucucuccugcgucucccugucucccucuccuccccaugccccaccuucaggcagccgcugacuacuuucucgaauuauagauuauuuucuaguuuucuauaaauggaaucauauaagagaguauauuugaaaagccaaauguggccgggcaugguggaucacaccuguaaucccagcaguuugggaggcugaggugaguggaucacuugaggucaggaguucgagaucacccuggccaauauggugaaaccccgacucuacuaaaaauacaaaaaaauuuagccaggcaugguggcaggcgccuguaaucccagcuacuugggaggcugaggcaggaaaaucgcuugaacccgggaggcggagguuacagugagcuaagaccacgccauuacacuccagccuggucaacaagaaagaaacuccaucucaaaaaauaaaaauuaaauuaaacuaaauuaaaagccaaaugugaaagaaauacgagcauuuuagcuguaauguauaaauuguacugcaauauuuuuuuacauuuuuuaacuaguuuuuuuuuucuuuuagugucaaagaguauuacauacacuuuggauauguaaaauauccaaauauuuuaccaugcuaaaauauuuggauaccuccaaaagacauucagugaaaaggaaguuucucuuccaccucagacccucagacugcuagucccugagaccucuuuucaaaagacaauuagaauucugugucuuguauauccuucuagaaauagucuguacauuuacaagcaucuagacucaucaacaaaauaaaacaugcugucuucuguucugcacuuagauuucuuuuccauauaacaguagauuuugagauuguuccauaagaguccauagagaaugccucacuuuuucauggcugcauaauaacuuauuauauggauuucuuuauucagcccucuaucaguggacauuuagauuaucccuuaccacaucacuuugcuuuuuggauaacgcaagcaaugcugcagugaacauccuuguuacugugaacacucauguaaauauauauguaggcuaaauuccuaaaaguauaauaacuagggcaauuaaugucauuuuaaaaucuugauaaauaggcugggugagguggcucacgccuguuaucccagcacuuuggauggcugagacaggcagaucaucugaggucaggaguucaagaccagccuggccaacauggugagaaccuaucucuacuaaaaauaaaaaaauuagcugggcaugguggccugugccuguaauccuagcuacucgggaggcugaggcaggagaaucacuugaaacccgagguggagguugcagucagcugagauugcgccauugcacuccagccugggccacagagcaaggcuccaucucaaaaaaaaaaaaaaaucuugauaaacaggcugggcacaguggcucucaccuguaaucccagcacuuugggaggcugaggugggaggaucacuugagcccaagaguucaagaucagucuggacaacauaccaagacugucucuccacacacacacacacacacacacacacacacacacacacaaacacauacagaguugccagguguguuggcacacaccuguagucccagcuacucaggaggcugaggugagaagauugcuugagccuaggauuuuugaggccacagugagccaugaucaugccacugcacucuucagccugaguggcagagcgagagacccugccucaaauaaaaaaaaccuuaaaaaaagagaaaucuugguaaauagaaucuaauuguccuacaaagaggcuaaacacuuccacaaccgauauaucauaugcugugaauagaucucacacccuuaccaacacugcacuauuggacuuuuugaucuuugccaaucugauugguaaaauugguaucuaguuucauugacauuucuuuauuauuaauacaguugagcaucuuuuccuauguuugugaacuguugauauuuuuugcaguuaucucccuauauaaaaaacacuuuuuuuuuuuuuggcuagaggagcucacuacauugccuacugugucacuauguugcuggucuagaacucuugggcucaaauaacccuucugccuaagucucccaaguaguaaaacaauauuuuaaaucaguuauuuccaugcugccagaaaauuuugaucaagccuuugaauauugccccuagcauagugcuggucaggaccucagaggaugaggcagaaacaagcuaaacugucaguguaucuucuuuuucuuucaagaaaucccugauuucccagggaaucuagucagaaagcuguguuacacuauuuaugauuauguauauaacacuuuuucuggcuugcagaacugauuuugauaauguucuuuauucagguugaagguaaugaaagguuuucuaucuguucucauaaacuaggagacuuaauuauaauggaaauaaaaauggugucuuugugaggagcaaagccaaaggaacacagguggaaaauuagcuauuucagcuauuacgagaguuuguaucuugucuacuaauuaaacuauuccauauaagggaaauaaagaaaagaacuggaaugaauaaagugguagaaguagcaauaauacucccuucaaagcuaugacgauuuauuuggaaaauuuuauuaaguauuguaagcuggagcagcuuagcuaugagugaacuugcacaauacaaaaaagcagaauagccccuuuagaagcauuguuuucaggagacuuugcaguagacugaugauauggaacacuggaacacuggcuugucuuacuuuaaaaugugaaugggaccucgccuuguccuagagccugcaggcacuacucugcugaauuuaugguaugucugguugacagguguagugguguugagcacuuuauuuuggaagugaucgggcgucucccugacauggagauggugaucaauguacgagauuauccucagguuccuaaauggauggagccugccaucccagucuucuccuucaguaagguaaguacagggagagccacauggguggauggagagugguccucuaggauaugagcaugagaucuuuguccggugacauagucugauggauaaugguaaggaugaggacugagguccagaaaugggucugugucucuauuagcaucacagugauugagcaaaaagacagaggagaugaaguugagagcugguaaguaguguaagauugcuugagugucuauagggcuagagauggaggcuagggcgugagaggccugagaaaccuacaggaauuagaggugggucuugaagaucuuacagagcaugggaggaagggguccaagaaagcuuggaguuagggaacaccuucauuccaaaaguuuguugagcuccuacuauguauauauucagccauagugcuggguaucagcugucccaucugucaccauauuccgggggcccaggguggcuaaaagugaaccugaaggugccagauaacuccacacgguguguguacaagccgugcauugaagggauaggcuggagauagccuagagggcuaugcaagggggugaucuuuuagacucaucauggaagauuggaguagcuaggauacaccugugggcuuggggaauugggggcaaggaaugucuugucagugcucagguucauguaaauguuguaucggcagggaugggccuugguucccuagagacaaggaaagcauuugggggugaaggcaggaaggcuagaagagaguggauggaagauucuaugggguaagagugaauugaggaaaaccccaugaaauuugggaaaaggaacacuauuucugauuugguuugucuaaagcagagggaccuuuuauccccacuuuuucuuuaucauaguuuacuuucucccuagacuuguuuuauuuccuguguugcaagugggcagaggccacauuuguguugcauuucccauggucuagccucauuucucgaaaguguuugguuccauuguuugucaugaaacucacucagaagaacagauagaggcucccauguaagucaguagggacuucguguuuguuaucuaucuguuguuucuauggauaauaaaguaugaccgucgguauacuaacuuuccguucaucuuuacuucccuucuguuuuuuaaaucagugacuucuaguuuccaagggagaguuuuacucugucaacuuuauaguuaauugugcagcuucuauugaauagcuguuauguuuaaggugcuugaugaaucacauuuuuuacauauuugagagacagcaaacagcauauugcacauguauuuccaguggaagaaauaguagaguuagagguuuaucaguggccagauuuuuaacagaaguaaccauaaaaagggaacaaauggaggccagguguaguggcucacaccuguaaucccagcacuuugggaggccgaggcagguggaucaaaaaaaaaaaaaaaaggggggaacauauggcuuuaaacuuuuuucuuuuuuuugaggcagagucucacucuguugcccaggcuggagugcaguggcgcgaucucagcucacugcaaccuccaccucccagguucaagugauucuccaccucagccuccugaguaucugggacuauaggcaccugccaccaugcccggcuauuauuuuguguguauuuuuuaguagagacaggguuucaccauguugaccaggcugauuucaaacuccugaccucaggugaucuacccgucucggccucccaaagugcugggauuacaggugugagccaccgugcccaaccucaaacuucuuucaaaagauaugugauaacaccccuucucauuuugcucauccauacuucugaccccgaucagugaauaaccaagaauuuauugaccaaucaaugugagcccaacagugccauaguaugagauaacacuagccaauauuuaucaaguauguacaaugugccagcuacuguucuaagaauuuuacguguaucaacucauuuaauauucaaaauaaaccuuuuaguuagaucauauuauugauauuauuguuucccccauuacagugauaaggaagcugaggcauagaaccauuaaguaacuugccuagagcuguaaagagguggagucagaauccaaacccaugugauccacaucaggagcccacacucuuaaccauugcauguauuucuuggcucuuacucucaaaaaaacccauugggaaauaaccaaaaacugguaagacaguguaaacucuuaaauguaauaguuaaacaaugagagagcucugugauuauucagaauugggcauauuguuuccuuaaauuggaaaucuuaacaguauauauccucuagaaaaacagaauuugggggaacugaaaaagcugaccuuuaaugugauucugaauucuggaauucagugagcccaugacuuuuaauccauagucacuuuugccuuuuaaugucuacaggcuagacuuuggaaaauagggaaaauauaucuuugacaaugugacacuaaaccaaggcuguccagauccuguggcaugauugcaguugccucuuuucacuguuccaagacugauuuaggacgaccugucuguuuuuguugaagacaucagaguaccaugauaucauguauccugcuuggacauuuugggaagggggaccugcuguuuggccaauuuauccuacaggucuuggacggugggaccucuucagagaagaucugguaagguagguccuuuaaagagguuuuauuuuuucucuuucuggguuuucuugaaauaagccauagaauauaaccaauuauuuacuuuuuuuuuuuuugagacggaguuucgcccuuuuugcccaggcuagagugcaauggcgugaucucagcucaccgcaaccuccgccucccagguucaagugauucucuugccucagccucccgaguagcugggauuacaggcaugugccaccacacccggcuaauuucguauuuuuaguagagacggggugucuccauguuggucaggcuggucuugaacuccugaccucaggugaucugcccaccucagccucccaaagugcugggauuacaggcgugagccaccgcgcccagccuauuuauuuuuaagugacuaauuuuuaaguuaaaaauuaaagacagaaaacuguaguguaaacaauuuuguacgugucuaauaauauuuacauauccauagaaaggggcagaauagucuauccuaaacuaucagcaaugccucuuugcaagggauuaucagagacuuuuguuuuguauuuuaaauuuuucuuucuuuuuuuuuuuuuuugcgacacagucauguucugucucccaggcuggagugcaguggugcuaucgcggcucacugcaaccucugccucccagguucaagcaauucucuugccucagccucccgaguagcugggauuacaggcaugugccaccacaccuggcuaauuuuuuguauuuuuaguagagaugugguuuugccauguugcccaggcuggucuggaacuccuggccucaagugauccacccaccucggccucccaaagugcugggauuacaggcacgagccccugugcucagucaguauuuucaauuuuucuauacuuaagauucuuuaaauaagagugcauucuuucauaguaagaaaaaaugaaugaccucgucauaggggggauagaaaauuauuuggaagaauauaaacauacuuggcaauugagagcuaaguaguuuaggcagggcugagggagcauaaaugucccauaagcaucucaaguacaagcuuauuccagauccucucugauucaugacugagacaugccuuggccuguugacuccauccugcuaucauuucagaauuuagauuguguagcucauccaagcuguagguauuucuuaccuagcuacauuuuacaucaugauucaaacaacuuuggugcuuaauuagagaacuuccggaaacacagucauuauaggccuucucucagguauaaggaaagcaaacaauucaaccuuguuuccauaaauaccuaucaccucucccaaguguggcugaagauucaaagaggauuaagguaauauucccuuccugaagaaacguacagggcugcaguccucagugguggguagagcccuuuguuaaaaaacaaacuucucuaguggguauaauuuggaaauuuuaaaaaauaauaacuuagucucauauuuuacagaacuggaacuagaaauugucuuuguccagcccuuuauuucagggauaagggaaugaagguacagaaagguuuagugaucuggucaaggucagaagcaaaucuaggccuaaagaccagguuuccaagugcauuauccaaccuacuuuacugguuaauauuccuuguguuuuccugacauugagacugucauuucuuguuuauuuuuggguuuugaacauaauuuugagagggggggaaaaaggugugguuuuuuuguuucuugguuguuuuuuaaaauuuuuuguagagacaggucuugcuauguuucccagccugaucucaaacuccugggcucaagugauccucccaccuuggccuccaaagugcugggauuacaggcaugagccaccacacuaagcuggaaaaaagguuuuaaacuuuuuuuucccuaaguuauucuuggccuuggccuuaauuuucuaauccuuucccccccuccucagguacuugcaaauacccuuuucacauucuucuuuuuguagcucuuuucccaccugccaugcagcugcuuuguuuucaaaaucuuuaaaaacauuuuuacugauuaugaaaccuauauaugcucauaaaauuuuacaaauauguauaacucaggcaacuuucccccuaacuuauugguguaucuaaguaaucuuuccaugucuuuguuucaugucaguacauaugaaagagucacuuuauuuauuuguuuguuuguuuauuuuuaaaaggcaggaucucacuauguugcccaggcuggacucaaacuccuggggucaagguguuauccaguuacuccaccguguaguuauuaauaccauuuucccccagguaaacuaguaagcaauuuuuaggcagauagaauguuuuaaagucuaaucuuauaugaauacuuuuuucuuuugauaccuucccauuuuauucaauugaauuuauucaugguuauagaaauacaauuuuguuuuuuagaacccucuguuuagaaucucuaaugauguucauuuguuaccuugaaaauuuaauaaucugcuuguuuauccaucugcacugaugucugccugccacuguucauucuauuuuucugauauuuugggaguuugugcccacugauuuauauuucacucuguagaagaauucauuguucuuuacagaucgaagauuucauuuguuacugucagagaggguuuaaaaaagagggcugggguagcaccaggcugugguggccaccguuagcacuugccuggagaaacaaguccuaaccuaggucuuuugagggaggauggguagguuaggagaaugaaagagagagaacagugauacacaguuuggguuuguguauaugaaacacagcuuccccaggagccaaggaaauaaagagaaguaacuuugaguauaaauugauacauguuuuguuagauaguuugacaauauguaucaaaauuggaaauguauacuguguauccuuugaccuagcuguuucaugucuagaauguauccuaaggaauuaaucagaugaaugugcaaagauuuguguacaaggauguuuacuaccauguuguuucuuagagcagaaaguuggaaacuaccuaaaaguccaucaauaaaggaugaagugaaucauaacaugacuauaaaauggaauuuuugcagugagucuuugccagagauuauaaaauggaauaucgugcaugaauggaaaggcaguguagguuuuaaaaacucuggguucaaauccuggcucuuauuagcugcaugacucugugcaaguugcuuaaccucuaaaggaccucauuuguaaaauaggggugauaaaaccuaccucuuaagauugugagaaugauuuuuuauuuacaaagcacuuaaaacaaugucuguaacauagugaagugcuauauagauguuggcuguuauuauuauuuauauuuccuauuaagauuguuaccuaacaguauguauggugugaccucuguuacauagagcaaaguuucucaguacuaguguugcugacauuuggggcuggauaauucuuuguccugggagcuguccuaaccacuguaggauuguucagcagcauuucugaucuuuacccacuaaaugccaguagcaguccccuaguaguaacaaucaaaaaugucuacagacauggccaaauguccccugggugggagggacgggcaaaauuacccccaguugaaagcuacuaauaugaauaaaugauugcaaggaaauucucggcuaaaauguuacauuguuaccucuggacagggagauuccagacgacuucuuacuuuuaucuuuaugcuuuuucaugagaacuuugcaugaggagcaugaaacauuuuccacuaaaaacaaaacaacaaaaauccagugcuauagugucucugcuugggcaggaagaaguauggggaaaacaagauaguucuggccuuagacuggagaaucagguaaaggugauccauccagaaaaggccagaggaugagccacguuggcugaggguggaggucugagggccuggaaaauacugagcagcguucucagcugagugaaaaugagcagcaugacauuauauguaucugaaaaggaccugugccuagaaaguuuauauccuaaguuucuccguuacuguaauccagcccaucaaucccucauuaacuucaguucagccuucccuuccuuuuucagagaagaugcugugcagacuucugugcagggaggguuccuacgaagcaaguuaagaaugaugcaucugugagcuagcaguuucaguaaggaaggcuggucaugguaauguguacugagaucugacuuucaaggacuucaucuuuauagagcacuuagucuggcuuuaagaauacaaaggugcuuuucaaauaucaaacuaaaucugaugacacuucccaccuauggaaaacauaaaaucagagagugauuucccuuucauuccauuucugaugcuuuuuuauuuuuuugcaguucuguacacauaauuaauuucaucaguagcacccuacuuaaaguacagaggaaauccacauuugccaaauuauaaacagaccuaaucaugaccuucaggguuugggggcuuuucuuucaauguuguuaacuuguuaauggggaguagauuuguagauacaacuggguagcaccuccagagcaaugaaaugguagcaaaaggaaacaaaguguccuuuagggcuuuuucuuuugagugacuuugauuagacuuacuuagaaauaugaagcucuggccaggcacaguggcucacgccuguaaucccagcacuuugggaggccgaggcaggcggaucacgaagucaggagauagagaccauccuggcuaacacggugaaacccugucucuacuaaaaaauacacaaaauuagccgggcgugguggcgggcgccuguggucccagcuacucaggaggcugaggcaggagaauggcaugaacccaggaaggggagcuugcagucagccaagaucgcgccacugcacuccagccuggacgacagugcgagacuccgucucaaaaaaaaaaaagaaauaugaagcucugaacuaaucuucagaaaugguuaaagcacauucuuauauaguugaaaaagauauauugaaacuaauuaaauucuauauucuuaggucagcagcacaguggccauggaaaaagaaaaacucuacagcauauuuccgaggaucaaggugaguuauuuucugacauuuuacaaagauauucuuccaaguaauguaaaauguaaguaacuuugaggguaugacaagcucuguaguucaaagggaaagcuaagauaacaaagaaagaaauguggaaucacaauuuuagauucgagaauaauucacauuauuugccgaaaucgccauugauugaguugauauucaaagaaguaaaguucauccauuucagucauuuaacagauauuuuacauagugucacaaaugugucggucauugauuaugugaugccaaacacaacagaugggugucuucuuacagucccuaggaguagcuuaugaucaugccacgguacucugcugguuaaugcagagcaggacucaucaccauaucucuugacugccuuuuuuaucacacccuguggcugccaaauagugguuaagagcacagacugagacugcugaaaaugaagaagggagcagggaggaaagagaagagaaaaauggcaaagguaguaggaggacccuguguuguucagcuccauagucccaaggccaagaacaguuccuagcaugucaauauaugauaaauaucuguggagcagaugaauagaaaagaccaugaagggagcaggguuuuguaguuuuagcaagugaguccuugccagagauuauacucccucuucacccuccucuucacuucggagcuagacuuuaggagguaaauggauuauccagcuacuauguccuguuucuuaccaacuucucugauucuuaaaucuugaagucacaaauuaacuuggggaccaugucuggacuucaagaguuuuaggacucccuugaaauuaugugaggauaugugcauuuuucugggaaggagagaggguugguucauaguucuuaacagauuaucaaggaauccaugaugccucacaugucaagacccucugcuacuuggaacaucacuagaaauucuuccacauacagucgucagguuuuuaagcccuuugguuuuugugcauuuuuuuuaaauuaaauauuauacugggcuguacagagcauacauaacaaaggucauguagcuguuuuagugagucgugacuaccuagccucacaguuaugagcaccagugauuauagaagccacaugaacuuuccuaaaagggaaaucauucccugggauuugacuauagugaccugaacaacauacccuucaagaccaaaugcaagcaaagaagggccaaguaccccccaacccuaaagguacagaggggaccagcccuggaugaccuagaugcugcaguacccaguauaccccuccuccgcugucacgucaccagugaauuguccacuugugcagagucauugcauuggguccuaguccugcucaccuuucagggauugggaacaguuuucuaauacaggccacacaguuuuaugucacguguuucuuuuauaggacaaguccagaacgagauccucucauucuucugucucggaaaaacccaaaacuuguugaugcagaauacaccaaaaaccaggccuggaaaucuaugaaaguaaucaccagucaucugacuagaacuacagcagugaacauucucacucaaagaacauugccaccuggguagaauuugagauuagguuuccugucaguggugaggugaauguaaagaaaguuccaugaaccagcauuagcauauauguaaauucuccuuuuucaaacuuacauugcuuuucuggccauauuaugacuaguauauugcacuacuuugaagguuuaaaccaggggucacaaacuuuuuccaggaagggccaaauaguaaauguuguagguuuugcaggucguauggucucuauugcaguugccaacagacaugggcaguuuguaaaugaaugagccuggcaguguuuuuauuaaaacuuuauuacggccaggcaugguggcucaugccuguaauccuagcacuuugggaggcgaggcggguggaucacuugaggucaggaguucaagaccagccuggccaacauggugaaaccccgucucuacuaaaaacacaaaaauuagccgggcauggugguaugugccgguagucccagcuacuggggaggcugaggcaggagaaucgcuugaaccugggaggcagagauugcagugagccgagaucacgccauugcacuccagccuggcgacagagcaagacuccgucucaaaaauaaguaaauaaaaauaaaaauaauaaaaaauaaaaacuuuaugggcacugaaauuugaauuucauguaauuuuaaguugucauaaaauauuauucuuuugccuuuuuuuuuaaccauuugaaauguaaaaauuucuuaguccaugacaaaaacaagcagugggucaaauuuggccugugggucguaguuugccaaccccugguuuaaaucaauggucucaacccuggcugugcaauacaaccagagagcuuaagaaaaugaaucaaaugagucagaaucucugggaaugguguccaggaaucuucauuuguuuaaaacuuuucaagugauucuaaggugaagccagaaaugggaccguugguuuacaguccacucucuccucuuaacucuauggcuuuuugccuuaaucaaagaaauuaaagcccuaaacuuccuuuauaugaaauuuccauauaccauaugaggaugcuaugaggaaaagcuuuagacuucuugggagaaaacuaaguaaaucugaggugcauguauuauuucauacaguuuuaaucaggagcaagugagcuuaagaaacuuuguugaauaauaaaaauaugaaaaaauguguucauuuagaacaaaaguuguuagcaucuacugugggaggcugcagaagcaaacaaaacuuguccccucaucaaggaguuuaccaucugcuaagguggauggaauguaccuggggaugucaaacucagauguccccaggggccagcaggugaugucaagaggugagcaagagagaauacuaacaguuccaaauguuaauaagagcccaguuugccagaucuuccuuuuuauucuccaagaaagacuggaaaucuggauuuuugcaagaaauauccuaccaccuguaaauguuggcaaugauuugauuuaaaaaaaaaaauacuuugcaugcccaacaaaauuugagcaugggcuauauacaccccuaaggccaucagccagcacuugggaccuucucugcauacauuauuuacacagagugaagugugcugcaggcugugacaucugaauucaaaggagggcaacauggcuuuaggugugcuuaaacuuuaaaaucagacgggcccugguuaaaacucugucuucuauuuagagccacacugaccuugagcaaaucucaacuuccaaagccuuggcuucugcauuuauauaaugggaauaauaaugucuccugaguauauugauuaugaagcuuaaaugagguaauguugaugaaauguuuaacaaugcuugcugcacagugaucacaauaaaugcuguugcuguuaauacuaauaacuuccuuuccacuuaaaggauaccuuaggaaagccagcugcuaaggauguccaucuuguggaucacugcaaauacaaguaagauuugcaggacuccucacuuucuugguuuccauacugcuuuugaaauagcuucacuuugggugagaacuuuaauauaaaggcccagcuggaguaaaugaaaguugcauuaauucauuucacuggcuuuuccucagggccuaaaugcacugaccugaguucuguggcgacuguagagaagaauggaacaugguuccugcuuccaaacagcugcaugcuagcuaguaaucacaguaauggaauuaccucuccauaugccccacccacccaaucauugaaguuagaauaaauauuucucaguuaauaaauauuagaauuauuauccuggugugcuggcaugcuccuguagucuuagcuacucgggaggcugagguaggaggauccuuugagcccaagaguucaagaccagccugggcuacauagugagacccugucucuaagagaaauaaaauaaaauucugggacuaagaauuagaugaacagguaaaaccaggucuagaggagggcaguggugguggggguggcucagaguuaggagugcuaaugacacgcagaguaggagcuauauggugaaagcaacucugguuggcgacaggugcgugcauaagaaaugcugagaagaagacagcuuuuuuuguuuuuuuuuuuuccccugugggcaaucucugaaaauugauuagguuuuccucauucuccucucuacaccagggguccccaacccccugccaugguacuggucuauuaggaaccaggcugcauggcaggaggugagcaguggggaagcgagcauuaccgccugagcucugccuucugucagaucagccuuggcauuagauucucauaggagcacaaacuguauugugaacuguguaugcaagggaucaagguugcgugcuccuuaugagaaucuaacuaaugccugaugaucugagguggaacaguuucauccaaaaccaucucccccacacuacccauccauggaaaaauugucucccaugaaacuggucccuggugccaaagagguuggggaccgcugcucuauacuuuaagagaagagggugauguccaggaagcaguggagaccuucgaccagaugggguacacuagaggaaaaacaaggcuuugggaggccaugacuaguuagagacauuaggccuagaaaagcuugugaaauuuuuuucacucguuuuauuuuauguuuaccauugaacauuuauuuucucagauauguuccaaaucuacaagcugucauuuccuucugagcccuguauacacucuacccggcacccagcuccugacccuaucuagugcugucuggagaaaauauccccuauuuuuccucacccugccauucccagaacaaccuguaguccuagcccugguaaaguggcugauagaaaccacuuaggaacauauuaauguguccuugaaaacucaaaguggaaagagaauggagaggaaucauaaaaggaaagaaggggaggggagaauaagcauaaaaggucauauuuguggcagcaggcauauaguaucaaauguauuuuguucuuuuuuccccagguaucuguuuaauuuucgaggcguagcugcaaguuuccgguuuaaacaccucuuccuguguggcucacuuguuuuccauguuggugaugaguggcuagaauucuucuauccacagcugaagccauggguucacuauaucccagucaaaacagaucucuccaauguccaguaagcaguuaucccccaaugcagaguuucuaaagacccuuccaaucugcuuuuaaaaaugccuuaaugccuuaaaaccagucauguaagacauuuaguccuacgauuuuuuuccauugaaagcuuuuuuuccucuugguuugcauauauaguauugcauuauuauccaaguaggcuauaaguggaauuuaauuugaaaaagcgcuuuaauacugguuucaaaugaaacguucagacaaaaugaaguuaaaaagcucuaaucucuccaagacuaaagauagggauauucaaucuuauuauauugucaaaaggauuuucagauacagcaugagaauugacucaagugaagcuucagcaaauuuccuuucaugacaggaggagcuaggaagaaguauagagaagggccagaguuaucugaauauuguuaucauggugauaucuguguauauauauuuuuuuucuauauauaaauauauuuauauauaaauauguaaaauaauauaaauaucuaauauaauauauaauauaaauauacaaaauauauguaaauauauaagguaacuucuguauuuucucaaauaugucccaaaucuacaauaggguaucuuuaaucaguguguggggguuuuuuuuuguuauuauuuuguucuugagagaacccugauaucuuugcuugaaggaaauaauccaccauccacauaccuaaaauuauccauagaccucaaucuauaucgucuuucugacuuagugccaaugaaguuggucuauauuucacagucuaaaauucuuuucauuuuagagagcuguuacaauuuguaaaagcaaaugaugauguagcucaagagauugcugaaaggugaguucuguucauuuucccuuuuccacuuuacuuuuugucauccccauuaugcccuagccaaaguuaucugaauauuguuaucauggugacaucuguauuuuauccucauuauauggagauaauucagaacuaaaccuguccugggggaaaacauacacacaugucuacauaugcuuguuuuaaaggaaaaagaugggccgggcgugguggcuaacgccuguaaucccagcacucuggaaggccgaggugggcggaucaccugaggucagaaguucaagaccagccuagccauggugaaaccccaucucuacuagaaauacaaaaaaauuagccgggugugguggugcgugccuguaaucccagcuacucgggaggcugaggcaggagaaucacuugaacccgggaggcggagguugcagugagccaagaucgcaccauugcgcuccagcaugagcaacaagagcgaaacuccgucucaaaaaauaaauaaauaaauaaauaaauaaaggaaaaagauuguuaaguuguauugcuacaugcauguauguggauaugauugccauaggguugguucuugaggcucaaaugaauuaauuuauauaaaaugcugaauaaugcuuggcacaaggugagcacucaaaugcagacugcuauuaucauuaaauucugugcuuuaacauuuucuuguuaaaucuugucucuaggggaagccaguuuauuaggaaccauuugcagauggaugacaucaccuguuacugggagaaccucuugagugaauacucuaaauuccugucuuauaauguaacgagaaggaaagguuaugaucaaauuauucccaaaauguugaaaacugaacuauaguagucaucauaggaccauaguccucuuuguggcaacagaucucagauauccuacggugagaagcuuaccauaagcuuggcaccuauaccuugaauaucugcuaucaagccaaauaccugguuuuccuuaucaugcugcacccagagcaacucuugagaaagauuuaaaaugugucuaauacacugauaugaagcaguucaacuuuuuggaugaauaaggaccagaaaucgugagauguggauuuugaacccaacucuaccuuucauuuucuuaagaccaaucacagcuugugccucagaucauccaccugugugaguccaucacugugaaauugacuguguccaugugaugaugcccuuugucccauuauuuggagcagaaaauucgucauuuggaaguaguacaacucauugcuggaauugugaaauuauucaaggcgugaucucugucacuuuauuuuaauguaggaaacccuaugggguuuaugaaaaauacuuggggaucauucucugaauggucuaaggaagcgguagccaugccaugcaaugauguaggaguucucuuuuguaaaaccauaaacuguguuacucaggagguuucuauaaugccacauagaaagaggccaauugcaugaguaauuauugcaauuggauuucagguucccuuuuugugccuucaugcccuacuucuuaaugccucucuaaagccaaaaaaaaaaaaaaagacaaagccucuuaauaaauuuaauggaacuauacauagaacagcagcucuuccucacccuuugcauaccuuuaauauuuuuccuucuuaaauuggccacagcaggggucauucacacucucacugucuugcaggaaucacaagaagucuucauaugugaacgugccauucaguugguaguuaagagcauucaacuucaaauauauagaagauauuuguuuuagugcaaauccaugauggagugccucccuuuuccuuuuuucacuuuuugaaaaagauguuuuggguaguaguuuaauaucucagggugcucuuucuaacauaguaaaaaaugaagaaaaauguuuagauuaaaacucuguagucugaugacuuagaaccauccuugacccuuaggcccaaccuuuccacagagaaaucaccucucuuccuuugucuuuuaagaacuauuugguauuaacuaguuucagaauuaguaaaugugagauucagucacauaauuaucagacauuccauuugucagaaauguauuuggcuuuuuaaacuccuuuccacaaaaguuuaagucuaaugaccuucuuagagaaguugagcaugccuggcaagaucauuucauggaauaagcagauguuuaaaguuggauuuuuuuuuuuuuuuuuuuuugaguacuagcaaugcacagggaccguguucuuagguucuuagucugugaaucuagcaauaggcaguccagauuucugagucguacuaugguuuugccuugucacugugaggcccuacuagguguaagcauucucucugaauuuuaauuuccucucauuaaaauaggaacaaaauuugcuauccuuuagauuaggagcugaagauucauuucccugggaauguuucccauuuagcuucaaguuucagcucaaacaucaccuucuuucugacuccuuucauucauuccuccaggcaguaaggggcuaccauaguacuuuguuuaugccuguauuauaugacaucacuguaguugcuugacuguuucuccuacuguucuguaaacuuauuaaugggugagaaucuaauuuuacucaucuugauggcuucaugauccagcacagugccucacacaaagaacuauuggguggguggauggauggauggaggaauggagacaguuggcuuaaccagauccuauauacagauuauuacuggcuccaaaggaugaguagauaagaccauaagaauuggaucaauguaaauccucaccugcccuuugaagagccaauaagggcaucuuugucuuuaaauacagcaaauguuauucagauuuuguacuugucuaucuguuuaccucaguguagaugauaugaggaugguauaacuauguaaauuguuuuugaaaauaauuuguuuccccacaacuuuugaagguuuuauuuguuguuguuauuacuaguucagucccaaacuuacccuuuccuuuucagagagcuaauggccaugcuuuucuucaaggaaagaauaauuuauuugaaugaagugggauacuugcauaacacaa

SEQ ID NO: 61549 - RNA, 25770 nt, Homo sapiens; identical to SEQ ID NO: 61548

SEQ ID NO: 61550 - RNA, 7754 nt, Homo sapiens
agaggcuaggccugaggccuggaccgcucugugagcgaggacccgguuccgcccgaaggaugaagacuugucuuuaaagaugacaacguacaggaaagguccaucagccgaucucccccugccugggcccacagcgccccccaaacccucaccacccucucucacugccuagccugccucccuaccuucucucugaggucgcuccucauucuuguguuacccaggacagggaccuagccagaaaccggcagcauucccccuucuguggagugacaguaucucccucucauuguaacuuauccucaggcgcauucgacaguccccucuugcuuucucacccccuuccuucacccaagggacccucugccucuccagcccacucccagccuccuuucucuugguucccuggucaugccugccucccugucuccugucucucccucccacacacacccacuauccucccagcuaucccagcacccuccuuccuaaucuugggagacaucucgucuggcuggacgggaaaauuccaggaucuaggccacacuucucagcagacaugcccauccuuggggaggaggaacaggagagagccugaggaaguucugggggacagggggaugaugggaucaaggucaggccaggaagccccugaggacagagacuguggggagacugggacugggaagaaagcaaaggagcuagagccagggccaaaggaaaaggggggccagcagggagguauuugcgggggagguccagcagcugucuuuccuaagacagggacacaugggccugguuauuccucuugucacauguggaacgguaggagauggaagacggagacagaacaagcaaaggagggcccugggcacagaggucuguguguguagccaucuaagccacuggaccccagcagacgagcaccuaagcucaggcuuaacccagugcacgugugcgcacauacaugugccccgcaccugacaguccacucaacccguccaaacccuuuccccauaacaccaacccauaacaggagauuucucucaugugggcaauauccguguucccacuucgaaagggggaaugacaagauaggacucccuaggggauuacagaaagaaaagcaggaaagcaagcauccuguuggauuucagcagcagguaugauguccagggaaaagaaauuuggauagccagggagugaaaaccccaccaaucuuaaacaagaccucugugcuucuuccccagcaacacaaauguccugccagauuccuccuggaaaaaaacuucugcuccugucccccuccaggucccagguugcccauguccaggaaaagauggaucccccuauccaaaucuucuccgugguguguguggguggaggaguggacccugguccaggcaggggcuccagggaagagaaggcgucacuuccgggggccuucaccagugucugguggcucccuucucugauugggcagaaguggcccaggcaggcguaugaccugcugcuguggaggggcugugccccaccgccacaugucuuccuacccaucugcuccccagagggcugccugcugugcacuuggguccuggagcccuucuccacccggugaguggccagcagggugugggguuaugugaggguagaaaggacagcaaagagaaaugggcucccagcugggggaggggcaggcaaacuggaaccuacaggcacugaccuuugucgagaagaguguagccuucccagaaugggaggagcagggcagagcagggguaggggguggggugcugguuucugagggacugaucacuuacuugguggaauacagcacagcccuggcuggcccuaaggaaaggggacaugagcccagggagaaaauaagagagggagcugcacuuagggcuuagcaaacacaguaguaagauggacacagccccaauccccauucuuagcuggucauuccucguuagcuuaagguucugaaucuggugcuggggaagcugggccaggcaagccagggcgcaaggagaggguaaugggaggagggcccacucauguugacagaccuacaggaaaucccaauauugaaucaggugcaagccucuuugcacaacuugugaaaggaggaggaagccaugugggggguccugugaaggaaccggaagggguucugccaagggggcagggaggcaggugugagcuaugagacagauauguuagugggcgccuaagacaagguaagccccuaaggugggcaucacccagcaggugcccguuccugggcagcuggucucaggaaggaagucccagaacuguuagcccaucucuuggccucagauaauggaguauuucaggacuuggaguccagagaaaagcuccaguggcuuuauguguggggguagauagggaaagaauagagguuaauuucucccauaccgccuuuuaauccugaccucuaguggucccaguuacagcuuugugcaguuccccuccccagccccacuccccaccgcagaaguuaccccucaacauauugcgcccguuugccaguuccucacccaggcccugcaucccauuuuccacucucuucuccaggcugaagccacaauacuuuccuucucuauccccaucccagauuuucucugaccuaacaaccaagguugcucagaauuuaaggcuaauuaagauauguguguauacauaucauguccugcugcucucagcagggguagguggcaccaaauccauguccgauucacugaggaguccugacaaaaaggagacaccauaugcuuucuugcuuucuuucuuucuuucuuucuuucuuuuuuuuuuuugagacggaguuucacucuuauugcccaggcuggagugcaauggugcgaucucggcucaccacaaccuccgccucccagguacaagcgauucuccugucucagccucccaaguagcuuggauuacaggcaugaaccaccacacccugcuaguuuuuuuguauuucguagagccgggguuucaccauguuagugaggcugguggcgaacuccugaccucaggugauccacccgccuuggacucccaaagugcugggauuacaggcaugagccacugcacccggcacaccauaugcuuucaucacaagaaaaugugagagaauucagggcuuuggcaguuccaggcuggucagcaucucaagcccuccccagcaucuguucacccugccaggcagucucuuccuagaaacuugguuaaauguucacucuucuugcuacuuucaggauagauucuucacccuuggcccgccuuugccccacccuacucugcccagaagugcaagagccuaagccgccuccauggccccaggaaggauucaggggagaggccccaaacagggagccacgccagccagacaccccggccagaauggagcugacuggugagaacacaccugaggggcuagggccauauggaaacaugacagaaggggagagagaaaggagacacgcugcagggggcaggaagcugggggaacccauucucccaaaaauaaggggucugagggguggauucccuggguuucaggucuggguccugaaugggaauuccuggaauaccagcugacaaugauuuccuccucaucuuucaaccucaccucuccucaucuaagaauugcuccucguggucaugcuucuccuaacugcaaggcuaacgcuguccagcccggcuccuccugcuugugaccuccgaguccucaguaaacugcuucgugacucccauguccuucacagcagacuggugagaacucccaacauuauccccuuuauccgcguaacugguaagacacccauacucccaggaagacaccaucacuuccucuaacuccuugacccaaugacuauucuucccauauuguccccaccuacugaucacacucucugacaaggauuauucuucacaauacagcccgcauuuaaaagcucucgucuagagauaguacucauggaggacuagccugcuuauuaggcuaccauagcucucucuauuucagcucccuucuccccccaccaaucuuuuucaacagagccagugcccagagguucacccuuugccuacaccuguccugcugccugcuguggacuuuagcuugggagaauggaaaacccagaugguaagaaagccaucccuaaccuuggcuucccuaaguccugucuucaguuucccacugcuucccauggauucuccaacauucuugagcuuuuuaaaaauaucucaccuucagcuuggccacccuaacccaaucuacauucaccuaugaugauagccuguggauaagaugauggcuugcagguccaauaugugaauagauuugaagcugaacaccaugaaaagcuggagagaaaucgcucauggccaugccuuugaccuauucccguucagucuucuuaaauuggcaugaagaagcaagacucauaugucauccacagaugacacaaagcugggaaguaccacuaaaauaacaaaagacugaaucaagauucaaaucacugaaagacuaggucaaaaacaaggugaaacaacagagauauaaacuucuacaugugggccgggggcucacgccuguaaucccagcacuuugggaggccgaggcaggcagaucaccugagggcaggaguuugagagcagccuggccaacauggcgaaaccccgucucuacuaagaauacagaauuagccgggcaugguagugcaugccuguaaucccagcuacuuggaaggcugaagcaggagaaucccuugaacccaggagguggagguuguagugagcugagaucaugccaaugcacuccagccugggugacaagagcaaaacuccgucucaaaaagaaaaaaaaauucuacauguguaaauuaaugaguaaaguccuauuccagcuuucaggccacaaugcccugcuuccaucauuuaagccucuggcccuagcacuuccuacgaaaaggaucugagagaauuaaauugcccccaaacuuaccauguaacauuacugaagcugcuauucuuaaagcuaguaauucuugucuguuugauguuuagcauccccauuguggaaaugcucguacagaacucuauuccgaguggacuacacuuaaauauacuggccugaacaccggacaucccccugaagacauaugcuaauuuauuaagagggaccauauuaaacuaacaugugucuagaaagcagcagccugaacagaaagagacuagaagcauguuuuaugggcaauaguuuaaaaaacuaaaaucuauccucaagaacccuagcgucccuucuuccuucaggacugagucagggaagaagggcaguuccuaugggucccuucuaguccuuucuuuucauccuuaugaucauuaugguagagucucauaccuacauuuaguuuauuuauuauuauuauuugagacggagucucacucuaucccccaggcuggagugcaguggcaugaucucaacucacugcaaccucagccucccggauucaagcgauucuccugccucagucucccaaguagcugggauuacaggugcccaccaccaugcccagcuaauuuuuguauuuuugguagagaugggguuucaccauguuggccaggcugaucuugaacuccugaccucaggugauccaccugccucagccucccaaagugcugggauuacaggcgugagccacugcacccagccuucauucaguuuaaaaaucaaaugauccuaagguuuugcagcagaaagaguaaauuugcagcacuagaaccaagagguaaaagcuguaacagggcagauuucagcaacguaagaaaaaaggagcucuucucacugaaaccaaguguaagaccaggcuggacuagaggacacgggaguuuuugaagcagaggcugaugaccagcugucgggagacugugaaggaauuccugcccugggugggaccuugguccuguccaguucucagccuguaugauucacucugcuggcuacuccuaaggcuccccacccgcuuuuagugugcccuuugaggcagugcgcuucucucuuccaucucuuucucaggaggagaccaaggcacaggacauucugggagcagugacccuucugcuggagggagugauggcagcacggggacaacugggacccacuugccucucaucccuccuggggcagcuuucuggacagguccgucuccuccuuggggcccugcagagccuccuuggaacccagguaaguccccagucaagggaucuguagaaacuguucuuuucugacucagucccccuagaagaccugagggaagaagggcucuuccagggagcucaagggcagaagagcugaucuacuaagagugcucccugccagccacaaugccuggguacuggcauccugucuuuccuacuuagacaagggaggccugagaucuggcccugguguuuggccucaggaccauccucugcccucagcuuccuccacagggcaggaccacagcucacaaggaucccaaugccaucuuccugagcuuccaacaccugcuccgaggaaaggugcguuuccugaugcuuguaggaggguccacccucugcgucaggcgggccccacccaccacagcuguccccagcagaaccucucuaguccucacacugaacgagcucccaaacaggacuucuggauuguuggagacaaacuucacugccucagccagaacuacuggcucugggcuucugaaguggcagcagggauucagagccaagauuccuggucugcugaaccaaaccuccaggucccuggaccaaauccccggauaccugaacaggauacacgaacucuugaauggaacucguggacucuuuccuggacccucacgcaggacccuaggagccccggacauuuccucaggaacaucagacacaggcucccugccacccaaccuccagccuggauauucuccuuccccaacccauccuccuacuggacaguauacgcucuucccucuuccacccaccuugcccaccccugugguccagcuccacccccugcuuccugacccuucugcuccaacgcccaccccuaccagcccucuucuaaacacauccuacacccacucccagaaucugucucaggaaggguaagguucucagacacugccgacaucagcauugucucguguacagcucccuucccugcagggcgccccugggagacaacuggacaagauuuccuacuuucuccugaaacccaaagcccugguaaaagggauacacaggacugaaaagggaaucauuuuucacuguacauuauaaaccuucagaagcuauuuuuuuaagcuaucagcaauacucaucagagcagcuagcucuuuggucuauuuucugcagaaauuugcaacucacugauucucuacaugcucuuuuucugugauaacucugcaaaggccugggcuggccuggcaguugaacagagggagagacuaaccuugagucagaaaacagagaaaggguaauuuccuuugcuucaaauucaaggccuuccaacgcccccauccccuuuacuaucauucucagugggacucugaucccauauucuuaacagaucuuuacucuugagaaaugaauaagcuuucucucagaaaugcugucccuauacacuagacaaaacugagccuguauaaggaauaaaugggagcgccgaaaagcucccuaaaaagcaa

SEQ ID NO: 61551 - RNA, 6274 nt, Homo sapiens
cagaaguggcccaggcaggcguaugaccugcugcuguggaggggcugugccccaccgccacaugucuuccuacccaucugcuccccagagggcugccugcugugcacuuggguccuggagcccuucuccacccggugaguggccagcagggugugggguuaugugaggguagaaaggacagcaaagagaaaugggcucccagcugggggaggggcaggcaaacuggaaccuacaggcacugaccuuugucgagaagaguguagccuucccagaaugggaggagcagggcagagcagggguaggggguggggugcugguuucugagggacugaucacuuacuugguggaauacagcacagcccuggcuggcccuaaggaaaggggacaugagcccagggagaaaauaagagagggagcugcacuuagggcuuagcaaacacaguaguaagauggacacagccccaauccccauucuuagcuggucauuccucguuagcuuaagguucugaaucuggugcuggggaagcugggccaggcaagccagggcgcaaggagaggguaaugggaggagggcccacucauguugacagaccuacaggaaaucccaauauugaaucaggugcaagccucuuugcacaacuugugaaaggaggaggaagccaugugggggguccugugaaggaaccggaagggguucugccaagggggcagggaggcaggugugagcuaugagacagauauguuagugggcgccuaagacaagguaagccccuaaggugggcaucacccagcaggugcccguuccugggcagcuggucucaggaaggaagucccagaacuguuagcccaucucuuggccucagauaauggaguauuucaggacuuggaguccagagaaaagcuccaguggcuuuauguguggggguagauagggaaagaauagagguuaauuucucccauaccgccuuuuaauccugaccucuaguggucccaguuacagcuuugugcaguuccccuccccagccccacuccccaccgcagaaguuaccccucaacauauugcgcccguuugccaguuccucacccaggcccugcaucccauuuuccacucucuucuccaggcugaagccacaauacuuuccuucucuauccccaucccagauuuucucugaccuaacaaccaagguugcucagaauuuaaggcuaauuaagauauguguguauacauaucauguccugcugcucucagcagggguagguggcaccaaauccauguccgauucacugaggaguccugacaaaaaggagacaccauaugcuuucuugcuuucuuucuuucuuucuuucuuucuuuuuuuuuuuugagacggaguuucacucuuauugcccaggcuggagugcaauggugcgaucucggcucaccacaaccuccgccucccagguacaagcgauucuccugucucagccucccaaguagcuuggauuacaggcaugaaccaccacacccugcuaguuuuuuuguauuucguagagccgggguuucaccauguuagugaggcugguggcgaacuccugaccucaggugauccacccgccuuggacucccaaagugcugggauuacaggcaugagccacugcacccggcacaccauaugcuuucaucacaagaaaaugugagagaauucagggcuuuggcaguuccaggcuggucagcaucucaagcccuccccagcaucuguucacccugccaggcagucucuuccuagaaacuugguuaaauguucacucuucuugcuacuuucaggauagauucuucacccuuggcccgccuuugccccacccuacucugcccagaagugcaagagccuaagccgccuccauggccccaggaaggauucaggggagaggccccaaacagggagccacgccagccagacaccccggccagaauggagcugacuggugagaacacaccugaggggcuagggccauauggaaacaugacagaaggggagagagaaaggagacacgcugcagggggcaggaagcugggggaacccauucucccaaaaauaaggggucugagggguggauucccuggguuucaggucuggguccugaaugggaauuccuggaauaccagcugacaaugauuuccuccucaucuuucaaccucaccucuccucaucuaagaauugcuccucguggucaugcuucuccuaacugcaaggcuaacgcuguccagcccggcuccuccugcuugugaccuccgaguccucaguaaacugcuucgugacucccauguccuucacagcagacuggugagaacucccaacauuauccccuuuauccgcguaacugguaagacacccauacucccaggaagacaccaucacuuccucuaacuccuugacccaaugacuauucuucccauauuguccccaccuacugaucacacucucugacaaggauuauucuucacaauacagcccgcauuuaaaagcucucgucuagagauaguacucauggaggacuagccugcuuauuaggcuaccauagcucucucuauuucagcucccuucuccccccaccaaucuuuuucaacagagccagugcccagagguucacccuuugccuacaccuguccugcugccugcuguggacuuuagcuugggagaauggaaaacccagaugguaagaaagccaucccuaaccuuggcuucccuaaguccugucuucaguuucccacugcuucccauggauucuccaacauucuugagcuuuuuaaaaauaucucaccuucagcuuggccacccuaacccaaucuacauucaccuaugaugauagccuguggauaagaugauggcuugcagguccaauaugugaauagauuugaagcugaacaccaugaaaagcuggagagaaaucgcucauggccaugccuuugaccuauucccguucagucuucuuaaauuggcaugaagaagcaagacucauaugucauccacagaugacacaaagcugggaaguaccacuaaaauaacaaaagacugaaucaagauucaaaucacugaaagacuaggucaaaaacaaggugaaacaacagagauauaaacuucuacaugugggccgggggcucacgccuguaaucccagcacuuugggaggccgaggcaggcagaucaccugagggcaggaguuugagagcagccuggccaacauggcgaaaccccgucucuacuaagaauacagaauuagccgggcaugguagugcaugccuguaaucccagcuacuuggaaggcugaagcaggagaaucccuugaacccaggagguggagguuguagugagcugagaucaugccaaugcacuccagccugggugacaagagcaaaacuccgucucaaaaagaaaaaaaaauucuacauguguaaauuaaugaguaaaguccuauuccagcuuucaggccacaaugcccugcuuccaucauuuaagccucuggcccuagcacuuccuacgaaaaggaucugagagaauuaaauugcccccaaacuuaccauguaacauuacugaagcugcuauucuuaaagcuaguaauucuugucuguuugauguuuagcauccccauuguggaaaugcucguacagaacucuauuccgaguggacuacacuuaaauauacuggccugaacaccggacaucccccugaagacauaugcuaauuuauuaagagggaccauauuaaacuaacaugugucuagaaagcagcagccugaacagaaagagacuagaagcauguuuuaugggcaauaguuuaaaaaacuaaaaucuauccucaagaacccuagcgucccuucuuccuucaggacugagucagggaagaagggcaguuccuaugggucccuucuaguccuuucuuuucauccuuaugaucauuaugguagagucucauaccuacauuuaguuuauuuauuauuauuauuugagacggagucucacucuaucccccaggcuggagugcaguggcaugaucucaacucacugcaaccucagccucccggauucaagcgauucuccugccucagucucccaaguagcugggauuacaggugcccaccaccaugcccagcuaauuuuuguauuuuugguagagaugggguuucaccauguuggccaggcugaucuugaacuccugaccucaggugauccaccugccucagccucccaaagugcugggauuacaggcgugagccacugcacccagccuucauucaguuuaaaaaucaaaugauccuaagguuuugcagcagaaagaguaaauuugcagcacuagaaccaagagguaaaagcuguaacagggcagauuucagcaacguaagaaaaaaggagcucuucucacugaaaccaaguguaagaccaggcuggacuagaggacacgggaguuuuugaagcagaggcugaugaccagcugucgggagacugugaaggaauuccugcccugggugggaccuugguccuguccaguucucagccuguaugauucacucugcuggcuacuccuaaggcuccccacccgcuuuuagugugcccuuugaggcagugcgcuucucucuuccaucucuuucucaggaggagaccaaggcacaggacauucugggagcagugacccuucugcuggagggagugauggcagcacggggacaacugggacccacuugccucucaucccuccuggggcagcuuucuggacagguccgucuccuccuuggggcccugcagagccuccuuggaacccagguaaguccccagucaagggaucuguagaaacuguucuuuucugacucagucccccuagaagaccugagggaagaagggcucuuccagggagcucaagggcagaagagcugaucuacuaagagugcucccugccagccacaaugccuggguacuggcauccugucuuuccuacuuagacaagggaggccugagaucuggcccugguguuuggccucaggaccauccucugcccucagcuuccuccacagggcaggaccacagcucacaaggaucccaaugccaucuuccugagcuuccaacaccugcuccgaggaaaggugcguuuccugaugcuuguaggaggguccacccucugcgucaggcgggccccacccaccacagcuguccccagcagaaccucucuaguccucacacugaacgagcucccaaacaggacuucuggauuguuggagacaaacuucacugccucagccagaacuacuggcucugggcuucugaaguggcagcagggauucagagccaagauuccuggucugcugaaccaaaccuccaggucccuggaccaaauccccggauaccugaacaggauacacgaacucuugaauggaacucguggacucuuuccuggacccucacgcaggacccuaggagccccggacauuuccucaggaacaucagacacaggcucccugccacccaaccuccagccuggauauucuccuuccccaacccauccuccuacuggacaguauacgcucuucccucuuccacccaccuugcccaccccugugguccagcuccacccccugcuuccugacccuucugcuccaacgcccaccccuaccagcccucuucuaaacacauccuacacccacucccagaaucugucucaggaaggguaagguucucagacacugccgacaucagcauugucucguguacagcucccuucccugcagggcgccccugggagacaacuggacaagauuuccuacuuucuccugaaacccaaagcccugguaaaagggauacacaggacugaaaagggaaucauuuuucacuguacauuauaaaccuucagaagcuauuuuuuuaagcuaucagcaauacucaucagagcagcuagcucuuuggucuauuuucugcagaaauuugcaacucacugauucucuacaugcucuuuuucugugauaacucugcaaaggccugggcuggccuggcaguugaacagagggagagacuaaccuugagucagaaaacagagaaaggguaauuuccuuugcuucaaauucaaggccuuccaacgcccccauccccuuuacuaucauucucagugggacucugaucccauauucuuaacagaucuuuacucuugagaaaugaauaagcuuucucucagaaaugcugucccuauacacuagacaaaacugagccuguauaaggaauaaaugggagcgccgaaaagcucccuaaaaagcaa

SEQ ID NO: 61552 - RNA, 7754 nt, Homo sapiens; identical to SEQ ID NO: 61550

SEQ ID NO: 61553 - RNA, 7754 nt, Homo sapiens; identical to SEQ ID NO: 61550

SEQ ID NO: 61554 - RNA, 6274 nt, Homo sapiens; identical to SEQ ID NO: 61551

SEQ ID NO: 61555 - RNA, 6274 nt, Homo sapiens; identical to SEQ ID NO: 61551

SEQ ID NO: 61556 - RNA, 6274 nt, Homo sapiens; identical to SEQ ID NO: 61551

SEQ ID NO: 61557 - RNA, 7754 nt, Homo sapiens; identical to SEQ ID NO: 61550

SEQ ID NO: 61558 - RNA, 7754 nt, Homo sapiens; identical to SEQ ID NO: 61550

SEQ ID NO: 61559 - RNA, 7754 nt, Homo sapiens; identical to SEQ ID NO: 61550

SEQ ID NO: 61560 - RNA, 86066 nt, Homo sapiens
gucgccagcagcuggagcggaguuggaggaagcagcggcagcggcgagggcggcaggcuagcugucggagacggcaagcacggaucgggcacggccggcgggucgcagccgggcuggaggccggucggaaccgagcgggcaggaggccaccgcugcagcgcgggccccgcagaggaaggaagccggcgggcgggguagguaggcagcagcagccccgggugugugugcucgggcgggggaggcggugcaugugugcacggcugccgcgacucucuuccugucacuggcagcggcuucuccuucugcagagccccgccggggggaagcgggcuggccaccggcccuccccgccuccggcaucuccuggccgccgggcagcacuacccccgcgcgcggccggcguccugugagauccccgccauccugacucccguuucccccguccuccugcgagcugguccugcacgccgccggucgcauuugcccccggaguugccgacgagcucgggcuuccucccacccuccgucaccgcacacuucggaggguccccgcugucgccuugcugcaguuuuccggggccccucaccggaggagagcgcccuggccgcugccuucguguugcgggaaggagcgcucccuucccccguggcccuccagcugcagccagggucgcugcccgggcccuucccggggcgggcgaggcggcggugguccccggagcucguccccuaacccccgccuuccgaaguuugccgcccuccucuuccggggugggggaagugcgccucggggcgguuggucgcuggggcccuaacucagcguuuauugccagccaagcuugggcagguuguuggaggcauauuuaguggggucuuggaaccgcccggaaauccagcuuuuggaacguggggcgaggcgggagggaccugcccagcaauauggagccggcuggggagagccagggagccugcaacccggagcuaaaauaucgugggcaauucucuggaaaccacagcucuaaccuaagcucagaaacugccccucagaucacaagacaaagagaacagaaaaccucuggccaggcacuccuguacagaaauacacuuugauaaccagaauuggagccugaaaugcaaggauauaugcagaauggcuguuacguguugaaugcagaaugugugucaacuggguuugggggaauucuucuguuucccggggcgcuauuaauaucggaaaggucucacuuccaccguuaaucccuugagcugcagcgcuguugguguccgagugugagucugcucuuuauuugggggcuucaugauuuuagguuuuuuuucuuuuuucucuucuuuuccucuuugucagccagugcgaaguaccaauggauaaagcaguuccggguuuugaaugcaacauaagauugucauuuuggugugaugaggcucaaguuuuaguaaucaggagggauauucacagagcuuauuggucaaggcuugauguggaguuauauuuuaaugcuucauuaguucuguuacguuuuggcaaccuuaaagaugguuagauauuagcuaggaaggguuggagugggcagacagguucauuucuuaagcagguuauuagaauauuagauugucacaguuugaauuacuaggaauuuggugacuucugcacagaaggccacaaguaucuuuuaacauugaaaaaggaagaaaaagcaacucacuagcuauacaacuuuuugacagauuacacuguucuugaaaaaccguuuagaagaaagcagauaagaguuuucuuaggugcaaaaguugauuaaacuuuaggaagcaaguguuuuugaccaguauaaagaaaauaagaguaaugugugggggugugugugugugugugugugugugcgcgcgcgugccugcggcuaaaguuugggaagaaauguugguucagaguuaagguuuaaguuggaaaggccaguggaggaggcucccugccuugcagaacugcuggguauugucacugcuugccucuucagcuuuuauaugcagguagguacuagauaaucauauuacuuuuuccagagaaguggauagauuuuuaugauugggagaaaguuuaauguaucugauacuggcuugcaaaguguaaugugcauuuacuuuuaacuuucaucuugacuugggaccuguucuuaguugcauaacagaacucugcaguguacacacugcuauuugauguuuuaucugcuuuuuaaaaauaaugauaucagugagucucuuccuauccaugaugcuguauagucaguguaaaaagcauuuuguuucccauuuauugaauguuuuuucuuuagcgauuucuugaguuuaaauauacuaagcgcaggaaauccucacagaauaaaguugguucugggaaacagaaguggaacaauaaguuauaggaauacauauuuugauuauagacagugaugauggugguaugcguuuaucuuuugguaaugucaguuucaccuaacgugauuuuugaaggacuuugaauuguaaaugcaaaccuacucaaacuaacccaaauuuuguacuguuaaaaguuuuggccauuucuuuacauuuuuccaugacugucauauaauuuuuagguugauauguugauugaacauaucaaccuaaauugauauguucaaucaacauauuggucguucaggggaguauuguaaaaaggcaucuacucugaaagauuguucacaugaucauuaaaauaggaacaauucuaguucagcuuuuauuguguuugcauuuugugauuugcaaaauacauguuuuauugaauaaagagauggugaaugagcaggcugaaaaaaaauugauuuuuaugcucaaguagaauauagccaguugagauaauguuuguguuggguuuuggaauucucucacgucaaggcauacacaaugcaaaagauauuguauguuucauaugagcuccuccagcucucccucuugcagggcacaggguuugcaagugaaggcaagagaaugaagcauuuuaaugaagcccuggaagacuagaaaguuaguuaucaauggaaggaauuaucaaguuaguuuuuacuuuagaaagcagaauauaaauuauaucacagcuuuuuaucaaaaccuagguuuuaauuaauuuucaaaguauucauaucauuuacugcauuuucccaugccuccuuuacguacacccuaaugcccuaaugugauuacuugccaugauucugccaauacuuguauggaguuacuugcuuaaaagaguggcaauuaacgaccauuucauguacauuaagccacaugagcugaaaaaauagacuauauaguuacuuauaaacuugucuguauggccuuuauuuauccccuagguguuagguguuuauuuauuugaaaggcuagagugauuguaguauaguguuauuggaaaaaaugucuacuguagaaacaucuuuggagauuuuauucugcuagcauuguuuuccuuaaaguaaaucaaauacauauccacaggcaccuguagucaaaauaguugucagguuaaugaucauccaagagaguauugaagucacaggagucuggccacagugugaggaggcuccaccagugaguguagugaguuaauaaagccaaggcaucuggaccagccauuccuugccuguugucuuccuccccggaugucccagugucccagccugggguucugccccaggaucaagggcuguaccaugaggacacagcuacucaucucuaaauccuggggaugcacacacacauguacacaucccuuggccucucccaggccuccuuuguccugaccucuguagagccguccucuaccucagguaaggagagaacuacaugggcaaaguccacacucagccuuuaucuauuuacuccaaaagggguuuaagacagcgggaguuuuauuuuagcuagauucaggauucacuuagaacuguuugcagaguuaagaggcaaugcagaagaaaaucccucauaaauguuuguuccucuguuaaaucugaauuguauaaauggcaguaggugacauucaauacuaauagaaauaauaguaauauaauaguugcaauuuacuagcuauguaacuuuaggcaaaauauuuaacuuuuaucugcuuguuuucucaucuguaaaauagagauaauuguuguacuuagagugauuguaaugguuaaaugaguugauauauguacaacucugagaacuaugugccuggcacauaguaaguacuauguuggcauuaauuauccuaagcuccuauuaucaaguauggagcgaagugcuuuauguaugucauuuuguuaauccucauaaugacucugugggcuguagguuugcuuauagcugucucacagaugauaaaacugugccacagagagguuuaaguaacuuuccugagguuacauauuuaggcacaaucugacuggggcagcugccugaaucugaagcucaguguucauacuaaccuugccaagaaguuuacagaauagcaucuuuuuuucaaaagaagagagacuugaagucauccccuucaguccucucauuccugcccccucagguccucuucauugugaugaugcagagaaccggaauggucagccucauggccuuuucugggugauaggaucugucugucccucaggucccagaagcuacgucacccuuucucccagccuccgcguaauggcuacugcgugccuaagcguugcugucaccugggccagggucauuccucuguguuuccugcaguaccuuccccucauguuggcugcuuucugaagagcccuagcuccuuguuguguuaccugggcuugugcuaccuguucuccucucccucgccccacaaacacaacaccaaaagggcuuguaggcgagaauuacagccuauacagccuguuuacccacaccacacacccagcccugagcauggcagcaugcaacacauucuauuuaguugguugguuuggaaaugaauuugaugucuauuauuugggguuaaucucagcccauuauuuucauuuuauuuuaauugauauaaaguccacauaccauaaaauucacccuaaauucaucauuucaaauugaaggcaauuuauuauguuuacuaggugcucuggguugaaugugucccccagaguuuacaugucagaaauguaaucccuaaugcaacuguguugggagguagggccuaauaggaggcugugcucucuugaauggauuaaugucauuauggcaagaguagauuaguuaucuugggaaugggcuuguuauaaacucgaguuuggcccugucuugcugucuugcccuugcaagaggacauaagaugaaggccuucaccagaugcuagugccaugcucuuggacuuuccagccuccagaaccaaauauacuucuguuguuuauaaauuacccagucucaggaauuccauuauaacaacacaaaauggacuaagacacuaggauauuuuaauuuuguucgucuugauuuucaugauuucugggacaccaugauuuggaagguaaaccauuuuuaaauaaugauuuuuuuaaagacuguaugaauuuaggugaggagcuugaccuagacucugaacuagcacacugaaguuaaaaagauggacuguagagagauaugggcugugggcccaggaacccuuccauacccuccugccuugguugaagacccauuucgugcugccauccaaugccuaacugcuaauuucauugggagauagaaucacaugacuuggauauauucuugauuaauuuaaugugauuuaaaaauauccuguauuccugccuguccaucaaguucuccaaauucuugucauuucuaaauggagaauggaguaacucaacaaagucagagagggcuuuuuuguuuggcucuuugccaaaaugccuauagguuagaggguuacacagaaaaucuacuuuacagcaguuguacguuaaguagcuguggauugcuauuugucaaacaucagaaacaauuuuauuuuggggaauagaaagagaauuucucuguauguuagcagggacagaaaauaugcuucugauuaaugggauugcaggcagucauuagaaggauugaaagacuggagaaaaauuccuuaaaauuuugaacuguugcauaugauauuauauaagaguaaguuaguuuacuuguucguaggauuccuuuauacccuuuguuacaauaacuuaugcaugcacuagcuuggagccuauaucacaaaacugccuugguuauuugaaaauauuacauuguagauaauguuaucuacauauaaaaagccuuugcuaugugaauaaucaugucagaacuggguaaaaauaguuuagugggcagguauauguagcaaaagagaauagaggcaugauagagugaaucugaggaaaaauccuguugauuuggauaguuuaggcuccaggucgaucucgguagggguggugguuacacagguauuaccaaauaccucaggcugcugggucuucugcaguacugugaagaauuugaggaugagagaaaagagaacuucccaguccucuagaugugacaguccuuguggcagugccauaucccccuaaggaggagcuggguuauuggaaauuguucaguggaggggccugggauaguggcaggaggcagaggugcuaaggauacagguggcagaagcgaagcucauagagcagaaauaggcaggauuccagaagugggcagccuuccagaaguggugugcccaguauucuuuuauucacuaguuuauggacuucuuucgcagggacacauuuuaaugaagucucuuuggaagaaaauuugcauggcugagaugcuggguuuuggaguugauggaacugccgaguuaaaauagcuuuuuugugugugcagguagugugaaagagccacauacacuaucaguaaagccgcugucugagagaguuaaagaggcagacagacaguuaagguuaauuggagugaucagcuugugcaggccacgaaccugcaucauccacaccaaagcaaguugaguucaggcaguagaugcuggagguguuaaaaaugggacuuacagagcuagacugccuggaucugaauucuaguuccucuucgcaauugcuaaguauuaucgugacagagauauuuucuguccuauguuaagugagacuacugauaguaccuguuuuuauauaguuaucuacacacacacacacauacauauaugacuauauauaugacuauauauauaugacuguauauaacuauauauagucagcaucaucauaucaucuaauacuaauugggagcuauauguguacaaacucaaucaucaucaucaucaucaucaucaucaucaucaucaucaucaucacccaauacuuaaccggaguuuuauguggauuaacccauucaguccucaagaaugacagacgucaaaauggacauggcagucaggagaaaguguacaaugugcaaaagaguagggguggcugccuucucugucuagcuaagggcucucuacaucuuaucaccaugcuguccaguccccaccccaaugacuugacugcucuccuuuuuuuuuuuuuuccacaacauugcccucagaccacuuaauugacacugacuaauggcuggccuugaauuaacgucugcaucaauggauggaugcccuguuuguauccaucuuccuggccuuacuuuggggucucagaagacagaaaugguguguucuauuuaccauccuagagucauagaagauuugugguucuuuuuaucagaugaggacccagaguucugcacaggguucuucuuacccacaaaguaagguucuucuuacagguggcaagggagagagaauuuguagagaccuuuaguucucugucacuucagacagggauugccucucuggugucuagccucuaaaagucaucauguuccuuagguuucuauuucccuuugcacaaauuuagccucaggcagacucaagcacagcuuuuagguuuguaaaaccuugacaaguccuggagccuuuucuuaauacagagcccccuggcaaggaacagcuucagagguaagcugugagcaggggcuugcuugaugguuccuggaggauugaagauggggaagaguuuguucauuauacuucccauucuauuaagaaucccaccaaacuggcccacuggguggcuggaauaaaggaaguguuaggaagcagcuggcauaaagaucuacccagccuacugguugaggauuuuuuuuuccccccuaaaagacauacauugccaggaaaagcuaacaaaaauuucaaggcagauuuggaggaauuaaauuauucuuaggcacauugccugguuucuaagcauuuagggauauguaaauguucauguucuuuagaggucucugucucuuuuguacagaguacauuaguacuaaaaaugagauuugcuaguucuacauuuucaugugaauuuaugcagugaauauucaauuugauucuggaucuuucaaaaggaaaggcuuucuuuaaacaaauaauauagcuuauuuuucugauaugcucuauugguugcuuugauuuuuuucuccgacaacugaaaugcgaaguagaguacuauccccaauuaauauucuugcuccacaaagacuuccaguguuuguuuuugcuucuuuuaauauguaacucuccuaaguguguuauuguauuacagcuaagaggcuuuacccauguaaaguugaauacuuuacacuucugaaugccaacauaacaauuaaucuaugauuagauuuugcuucuuaagaugccuccacugacgagugccuguaauauuaaacuucuaaaguguuccacucuuuaaaacuuauaaaagcucucuuugauauagcccacugaaauuguguggcuauuguuuuuauugcuuuauugugcagccagcuuaacugaaaccuuuggguggcuuuuacucuuuauaauaaagauaacauugagaaaugccuggaguacaaaguguauauguguacaugccguucucagccaucuacucugacuuaguaacucucuaauucccuugccuccacuauguuuaagaacaaaaaagaaaaacacuuacauuucacauuuccuccaucaagcugucuuuauagaguggucuguagcaaccauugcuacuuccucucuaauauuuuuuaacuccuuaagauguuguugcuguccucacugcuggacuggaaucugcgugaugauuccaucaugggcgaagccccaaauuauuuagccuugacucagucucuccugucuggaugccuuugcaggauuuagucuuagggaucacauuuuccuacuugaacucuucuuccuuguuuuugggauguugucucuaaaccuugacuuuccuuccucaguuacauacauugaacuucacuauuuggcccuuggaucauuuuuuuuuuuuuuuaacuuuugauuuguccuugugagcucuuccauuccauugaauucagccuugccuaauuguggccgauugccaaaucccuagcauguuuccucuucugaaucacagaccaggguuucaucagccacuagcacacuugcacaggggugcccagaaucaccgucagcccaucaggucaccuggcuucucuuugccugauagugcuccaaacucucauuaaugcaggaucaggcacccuuugcuccucucguucucgccgcacauuuaagcauuugccacaucccacauguucuuucucugcaguguuuauuucacuccuccccuuuccacaccugcugcugccacccugguuuguguccucacuaccucuuggccagaccucugcaacacaccuuucucgcacacugugguuagauugauauuccuggagugcagcucugaucccguugcucacuuuucaccaagcccuuuccguguuccacacugugggcugaauuacucacaaacucagcaugggcaugcgugauguccuacagccccuaccuaaaucucuaaccccaaucccacugcucccucuuuggcuccagacggauuggacugccuguucuagcucuucucagaauaugacauuuucuuggucacuucuguaacuagcguccgaccacacaugccauucugucuucagauuccugcaguuagugugcuuucucccucguuugaacccugcaguguuuaguuucugccucucuuaugacauguacuaguguuguggcucuguguacucugagccacauuaucagcgauaaugucacauuaucgcuaagacauugccucaugccgacacuccuccccucugcccccgcccgguguucuuagaaggcagggacugccuuacuaaucucuguugugucaagcaauagcacacuggccugugucugucugccaaaucgauuaaguacuuguugaauggaaguagaaauuccaauuaacacagauggcaaagugugcuguucauucuuaagucucguuuuuuucauuccuaggugaagcucguguguggagugccacgguacaaucagacgacagauggacagugugacaaaagugucagaaaggauugggccucgcugugagagucagccuggauucaaaguguugacaaguugcugaaaaggaagccagugagaggacuguggcacgcagaggaaguggagcccugucuucggucacaccauugauggaggacagauggacagccguauggccagucaccucuccucuuaaaccuuuggagagugguccuuuguccucugcuggacacauaauaggaauucuaacacauucucugaauucacuuuucauaaaaacguaaaaucagacugcucuguacaaccaggcucaacuguugcaugguagcagauuugcaaacaugagugcugagggguaccaguacagagcgcuguaugauuauaaaaaggaaagagaagaagauauugacuugcacuugggugacauauugacugugaauaaaggguccuuaguagcucuuggauucagugauggacaggaagccaggccugaagaaauuggcugguuaaauggcuauaaugaaaccacaggggaaaggggggacuuuccgggaacuuacguagaauauauuggaaggaaaaaaaucucgccucccacaccaaagccccggccaccucggccucuuccuguugcaccagguucuucgaaaacugaagcagauguugaacaacaaggucaguauugauaagugguugcuuaaugacucccuuucuuuuucuuuuuaaggaaaagucuuaaguuuggguugagucguuauguucugggcagaaguuaccuuggcaacugcaccugaauugauguguggugcauaaaagcuuggucaaucauuacacaacuagaaauuuguguuugugggguuggaaguuguuauaaaaauagggacacaguauccgagaaccuguuuagugagugucguugaacacuauuauuauaguugucauugaauuaaacaucuacuauauuucuuauuuuuguaauuggcauuauaggcggaguauuccuagucugaaaauaugaaaucuaaaaugcugaaaaacccaaaauuuuuugacacccaaaggaaauucucauuagagcauuccagaauucagauucaguggucaagggguauaaugcaaauauuccaaaauccagaacaacaugaaaucuacaacacuucugguuccaagcauuucagauaaggaauacucaaccuguguauaucuaauaauaauuuugggaaaguggaggguaagucuaauauaaguauauuuaacaugauuuguauggaaaaauguagagaguaauaaaaugaccacagaacucggcugagaagaaaccauuguuuuuauaaccugguaucuaccucuugguuuccucuccaggaucgcuguggccaaagcugaaacccaauccuauaguuaguauaaaaguaaagggauuucacuuccuuuguggguagugucauuuguagcauuaaugccuauagucugguucgccuucaugagggggaagaaaaauucacugaauacuuugcuuaaauggaaaccaccuucauucaaaaaccacuuauugcuuauuggagaugguccauacuugcgcuucaggcacagcugugucuuuaagguuuaucuucuguucgguuucacacagagacaagccuuaugcucagcuuugcuguuaucagcuuugucaaauaccgguuuccucacuaguaaaucacacgcauuuuucuuuuuucucuuguguagucuucuuucuuagggucuaagaagggaaugggaaggaaugguuuaagaugggugggccuaacugcaguaguuauauauugaggagaccugacuggcaucacaggauauuucuggaagagauucugauaccacuaguaagcuauuauaccuucuuuaauguugccuuauucuaacacaagugaauaagacaaugagaacagagaaacagaaugcaaggguaagagcugccuuucaguauugaguaguaauagauugggaauauuguguuaaaaucaaggaauuuauuaaugauaccugaagggaagcccuuuucuuucccauacccagcccaaagggauacuuauuucauaaauguuauacuuuauaauguucaaauaauaucuuuuauuauauuguucaaaagccaaaguuaauuuuucuuugcagaucaaucaaaaaaccaugacucuccgcacauacauaagugauuuuaucaaccauugcagcacuuagcagauugaagauacauacguaaucguuuuucuccaccaaguuauauauuuucaccuuuuauuuuuuuuaaguuaaaaacgcuuucuucaguagccuaauuccaaaggaaaagugauuuaauuuuuccgagaauacagagcuuuacagaaucauaaaaauaguugaauuagagaagauuauuuaaaagguggaauaagggcaccuugucaagauuaguuacaaaacaauuuuauaaaagcaguuucuaaacaaaauuugcauuugauaauugcuaucaggugcaaguuucuuuggcucugguguacagaaaagcaagucuuuccuuauaggaaaagucauuuucucuuuuuauauccuaaacuauuuuauaaugcuugcuuucucauguaaugugaugacaauugagauuuuuagcagcuuuuucauuuuucuuuaauacauggaaagauggagugaaaugaaaauuuuuagcagaauucaagaaagagacccaugauaaugugcauaaaaguauuagagccugaauauaaaugagaaauuaguaauaacugaaagauugaaaggagaguguugggggggggucauguggggaguauaauacuaaacauucaauuuucuagaaguguuggucuuguauucucauuuaaauauuccuaugaagcgagaauucaauagcuccuaugaguugcauguugaauucauauggaaaguaguuauaaggacaaauuuuauauguuagaaccugugagacuaguuucuuuugccuccguuuguauuucuuugaaaagcuuuugcagugacaaauugugugaaggcaagaaaugauaguucuguucuauucuuaccauaauugaauucuuuaguucuuuucuuuuuuuuuccuuuuaacacccuccaccuccaccugacuuagccaguuuuucauguuaugcuguguuuauugcauuuagaagguuauuccucaccaacccccaccccaggucuaggaaccacaugcaguuuuguuuuguggacuuggcacaccucguuaaugggcagcaggguagacagagggugcgaggacagccugcaugccaauugugugucuguguccugcugagccuugcugcccucucuguuuuuaaaaggaaauuguccuuagacucuggccaagaguacguucugugagagauuccucccuguacgauagugucuuacuuuuccacuuugcuuguauguucuuggaaauaaagcugugauauuuaacuuuuugagagaaagagucaaaaacccauuaggaaaucuuauauacggcacuguacuuucuuccaauacauuuugcaugcaguuuuuaggaagcccuggcauauagauugaaugaauuguuuuaauuggauaauuuuggauguuuuuggacuuaaauacauucaguaagcauggucugaguccuuauuuugugcuggaaagcaaagauaaaagaugaaaucaaggcucaagagccagcaugcccugagaugcucucucaugccucucuuccaccuuuggagcugugcuuuuucuccucugcuaguacagcucuuccccuagacaucugccugacugacccacucucacuucucugcucaaaucuuucgucucauggagucuggcucuacucacgcuauucuaugcugggaccuaccucucugcuuuugcaaaucauugauuacuuaacccacgauaucguuuacuuauuacguuuauuguucauugacuguucccucuguuagauuuuaagcuccauaaggggagagaucuuuguggucccccauuauccuaaguaccuaggacagugugguaguuucccaacaugcugguaaacaggugcugcugcagcucauccuacagcuauuucacuuucugcauugcuuuugaaauugaccacgugcucugaaugucaugugcagucauacaaagcuuaauggcccaucuuguuuuagaaaauaacagcuuauuuguuauccacauccuucaucugaggcauccugccuuggccuuaaccauugccugguaugucuccagaacucuuuauuuucuucccagggccugggacagguaguucugcuggugggaaagugcauuaagcugauaguaccuucagucacuuaagccaagugaguagaggggcugucauggucagcgaauauccucagggcaaauucugugcccuuucucccauccuuuuaucuccuucccuuugcaugggggcuaaaauugccaauaugaggaugacguuuuauuuuauuuuucuacaagccaguagagcccuauguuauguucuucggagagaaccucuuccauguuuuguuuggauaaagagugugcugggugugcaagguggguguuacauguccucgggugaggcagcuauugaaaggcaaucuuauggcucuuucugcuuuagcuugcucagauccuggcaucccaucccgcuacaccaaccccauucagccaggguccuguauuuucucuuguacacaacgaaaugaguugauugaaaauggggauauagggauaugggaauaaaaauauauuccucugucauauguaagccauccaguggggcuauuucucaagacagugguuuuaacucauacuuugagauccuuuaauuaaagucaugcuaaugcagaauauuuagacgggugagagucugugcccauguuaguuugugcagugcagugaaaccugcuaacacaagagauuacuuacugcauacccaccuccauccugaccugcacaacccucccuggcuccuccugcagccucugacaguggauuucagcugguuucaaaccuaagacauaaagcaugcauuugacauggcuuacgcuaaauuuugaucaaaaucccuuuuaaacagaaagaaaaaggccaccauugguguugguuuucaugguuucccaaggcauguuauuguuaaauuuuucacauucagcauuugagugucccuucaugguuguuguucccuguccagaaagcagggcugcaauaaaucacaaacauugacuacacuguacagaggucacagaaaauagugaccugaucccaaauuacacaccucugcugagcccguuggucauaaccuacgcugucuccuugaggcaaauagugcuugugcaaguaauuugcuuugcuucacaaauuccugccuuuacgaauucuguuuucuuucagaauauacuuucucauaacauucuucacucuuccuuccuacuuaagucuuugcugugaacuuggagguuugucuuguuaagcccaagugauggggaaaaccacccaauuuauggugcugacugcucauucugcaucuaucgaccacucuguuuuugcgagaaaguugggucaguuacaggaucuuagaagauaagggccuuugagcucugucucuaacuucugaccacaagaaaaguucaucaggacauuauggagauuuuuacccaggcaugaaaauuuaaguguuugcccucuguguuucaguaggaaaugaaauauauuucuacugaaauauaauugauuaaagagugugucuggaaaaaacaaaugugcuaauuauuuugaauaaaaucagauuagccuaaccacuuagggucacagaauaugucauuugcauauuaaauuacuuauugcaacacaguucacccucucaugagcauuuauauucucaauacauucuugauuuuuuaaaaacauuuuuucuguuaacuuuguuucccuaaaaauguguaagagaaaggaaaguagcccuaauuagcgauuuguguauccgugguuuuuugaaaaugaaauugacaaaaagagacaggaugcucacuuuuauugcuuuuugcaggaggguucuuacccugagcuggccuggccacuuuaggaauucacaggcacgcucugaggggccugugaguagggaggcucucuuacccagaggggagaggaaggcauuucucccuccuucccucagucuguuauuugaagggaaucacuugaacugcucuccuagagcugcggugacaguuaaguccaggguugcagaauaagacaguauuugaggagaagaagcuuucugccaggugucuguuucugccucuguccuuuagaaucacaggguuaugguaggcaaguuauauuuucuuauuuaagugaaauguuuguucagaugcuuuuguuaaggcuucuguucuauacacuucuuucuguguucuuuuuucaaaaaugggaaaaggguccaguguccuuauauguauauccuaaguaaagcccucacacaccucugauucaaauaggaguuauuuaauuagagggagcauauuuuguuuucuggcaacuaaguuaauguugauauucuaauacaauuuucuuuguuauaaauauggaacucucuauuuaacuugucaauagauucuuugauaaauuugaugucagucuucucugguuucuaggugaugcaucuuugucuacaacaagagacauucugauuaguaagaauuucuucucugaguuagaaaaaaaauuagaaauucugaaauucaacaacaaaugcugacuuacaucugcuaaguagcacccaaaaaggggagaauuuuuuaccuauggcaaauaagagugccaaaugugacaucauuuacauauccauguuuugauuaguaaaaaccaaacagauguuagcaguacagcuggcucuugcauauauguguaucuuuguugcuaacagauuuccauggggaaggauguagcacuggucugaagucucagauaggagaagauaacauggugugauagcuugaaaugaggagcauaauugcaugauggauuauaucugaauguuuugaggucuugaguuuauagcauucgauaucaaagcaguccuuaggcuuucaauagaggaggacacauggagggggacaaagugaacuagaaaugggcuuuauuucaauugcuuggguauaguguaccuaaaaugucaaguuguuuaacagaauaucagacuacuuuauaaauguguuauuccuucuuaccaauuuauguaauauuuuauuuuuacuaugaaaauuccaugcaguauacaaacaguacguggaauuguaguagaaacauuguuaaaauauaacuuugaauuaaaaacaaaacaugguauacauuguuauauaauggauaacauaguguauacauuguuaaaauauauccuugcaauuaaaaacaaaacaaaucagcugcaaaccuuuguuuaauuauguaugcagaacuuucucccaauggcuuuauaccaccuaaggcauggcugugauuuucaggaauacccucucuggacuguuucuugcuuggagguguuugcgauguauuuguauuugucugucuaucuauucucaguugguagauuauguaaugccuauagauuauucuguccugucacaguuugauucauuuugaaguuauaacugugaauuuauuacagcguauugcaggagacguaauuugaugaucaaaucugauauccaagaucguaaagaauauaggcauaaaugaaauauaaaucugugauauauuauuugaaucagaaauuccacauugcuuugcuuucuauaaauuccuuaacguucuaguuccaguguucucuaauuguaagaugagaagcuaaaugcugucucuuuugaguuucagcaguuuuuguuuuaauccuucucuucccaaucagaagaacugucggagaaauaagacccagaaaaauugguucucacuaguaguguuuccccaauaaugcaacccagaagcccuguauaugagaauaagggaauguagugagaggauuuaugcagagaaacaaccuaggaugguuggaaagauguacuuacaugaccucauugcacgaucugauuggagacugguccauggauuguaugggauuauugcuuaugaaagugcccaccugguaucaaguuuuugcagaugcaugcgguguaugguuuuaagacauguuucaccagugugaauauuuaggcucuacuucuguuggugggcaguuagcaauugcugguaucuaaacugguuugagacuuacugccucauuugaacaguaucugugcaguagcgcuaaacucguugacaugaucuguacugagaguuccuacagauuuguuucauauauauuuguuaaauuuuccaagguaaguagagagugaugguuauaacauuuguuuauucagaccccucuaaaucuaccuaagagguaacauguuagcauaggcauuagacaaggcugcauugugaagucagagugacugucugggguugucacugucaucuuccaagcuuucuccuaaagaagaaaauugacauaaugcucucagacuuggcacaugggaccagugccacagcaagcacugguucuagccugcuacugguuuuugguaaaaugcaguuuucagaacuacucaaggguguaauaagauuaauuuuuaugauauuagauauaauauguuaacuuuuuagcuauuguuaaucuuaaacacugauggcuuuauuuuuauucuauuuaaaaaaauaauuuuugaggccaggugcaguggcucacaccuguaaucccagcauuuugggaggccaaggugggcagaucacuugaggucaggagaucaaaaccagcauggccaauauggugaaaccccaucucuacuaaaaauacaaaaauuagcugggugugauggugcaugccuguaaucccagcuacuagggaggcugaggcaggagaaucgcuugaaacugggaggcagagguugcagugagccgagauugugccacugcacuuuagccugggugacagagugaaagugucucaaaauaaauaaauaaauaaauaaauaaauaaauaaauaaauaaauaauuuucaaugcuuaagaauuuuuuaucaguaaacaguucauuugaauuuuuuuuugcauucuuguuucccaacuauagaaacauagcugaauauuuguggcaucauuaaugcauaauuucaaagcauuuuacacauuguuaauuaaaucucaccauguucuuucagguagcaaaaaguaaguuuauuuuugauucagaaguauuugaagaaguuagaacaagaugauuuuauugcuaaauaauaaggaauaucuguggaguaccaaggaaugagauauaaugaauuugguuagaguauaucaaaguacauauuauaguuuuugucuuacacuucccugugggucuguuuaacuauugaaaaugucuucuucaaaaugaaccuuaaacauuugcaaacuuacucuuugcuaauuauucugccaggcauuuuuuuuuuucuuuuuuuuuugaaucuugcucuguugcccaggcuggagugcaguggcucaaucucagcugacugcaaccucugccuccuggguucaagcaguucuccagccacagccucccaaguagcugggacuacaggcacaugcugccacgccuggcuaauuuuuguauuuuuaguagagacaggguuucaccauauuggucaggcuggucucgaacuccuaaccucaggugauccacccaccucggccuccuaaacuggugggauuaccagcgcgagccaccacgcuggcccugccaggcauuuuauagacauuuuucauuugacgcucacaaccacccugcaaagauggcauauuauaaccuuuuuuuguuuguuuguuuguuuuuuugagauggagucucgcucugucgcccgggcuggagagcaguggcacgaucucggcucacugcaagcuccgccuccuggguucacgccauucuccugucucagccucccgaguagcugggacuacaggcaccugccaccacgcccgucuaauuuuuuguauuuuuuguagagacgggguuucacuguguuagccaggauggucucgaucucuugaccuugugauccgcccaccucggccucccaaagugcugggauugcaggcaugagccaccacgccuggcccuauaaccguuuuugagauuuaaaaacugaaggucaugugauuguguaaauauuuaaaaagugaucauauuaaaaaauaucauagugauggcacauugauaagauucaagaacauuuugggcaaggcaggcagucaugaggaucuccuuaagcagucucuugugaagugaucgguaacugaauuuugcuuuuuggguggucuucaauuaugucugcuuuaucuguuagguuucacuagcuauuacauucaugcaacuccagaaauuuaccuccaauuuauaugugacuuacaacauuuucuuaugucugguaaauauuugaaaggauugaauuacaaagagacggauaaggccaugaagcuaagacaaaguuuuggguaugugcauguaaaugcaauuuuucucaggaagaaauacaccaugaucagauaacucaaaaguuuuauaaccuugauaaauagauuuaccuucguuucuguuguuuuugaagaaguuaaaugucugcuuuaaauguuucccugaguuucaaguuuucuuauuucagacucauaauuauaucauuuugauuaaaauggagcacagacuggaguuauuacuugcuuaaaagccaaaaacuugaggguauccagcauaagaauuguguguuuuggucuguggauagcagcugcuugaaguccauaaaaacaagaaaccugaaguugauucagaugaaucugaagucuuguaccugaauuaugucaagguuagcaguaaaugccauuuaaaaagacugaguacaaauugccaaauuccuuugaaugccaaaccauauuucucaggaaaguuggccacugccaaauuuauaacauuuguguuucuguuaccugaauuccaagggcagaggggugauugaggggguaagggaaaggcacaggugaauuuuauuuucagaugucuaauaggacagugugacauugcccagagauagucucucaaagguagugagugccagcagaacuucucgaaugcgaaguugagaaauuuuacuuauuuacuuauuuucccauugaaaaaaaaaaaaaaaacuuuaaauguuuucugaguuaaaaaggccucugacugguaguccugacacagcuucuugagagucuccgagagagccucuucucaguacaauuccuaagaagauaggaagaaaaaaaaaaauauucuuaacacauaaaacuagaauuagugggaagaaaugccuacuguaaacucaacagaaccgggguuaaaaaauauaggauaaguuuugacuaccuaaaaguagcagggcagacccaucucuucccuaacucuguccauaauucagaaagggcccagggaacuguccucaggaaugcucuuccccccucuuccuuguccucuccgacagagccuuucuaaucaguaggaggucacaacuuagaaaauaaccagagagagcuggaaugguaaguuaggggcuauuacuguuauauucugagaauccugauccaugaaaauaaagugcugaaggugggguagaguuagaaagaccuguguucacugaggguuuugaguauuacaggcucuccaucacucagagcaucagaaagucaggcggugaacgcaggagauuuuucucucaggcuaaccaaaaccauguugaaaugaaaaccaccuuggaacuggccuuuucaucucagacugccaaauaacuagcacccaaguggaucccuuagcucagagcagucaccaggcauggguaggucuuuccuuguuuagugauaaacaggaaaaaccuaaccgagccuacugaaccauguccaucuauaaaagaaaaagggagaucauacuggagauuugaaagaagaguagaccuccagaacugauugauuauaauuuauuucuguuauaguauuuccacuuaguauuaugauuuauuucugucccucaugaaagggacagaaaguagucaggcgguuaugagaugaaaagacaguaagaugggaugaaaucggagugaaacaauaaaaaaaagacuaaguuaaaaauguaauagcauauuaaaauucauguguaaggggguaaugagcugaaaauaaagucuguguuuugaaggagaaacaagauaaagcucuuuggaauccaaaggauaaaaacauaaaaugagggagaagauauauagagagaauaucuaacaggagaauuacaaguguugauaaacagggaaccaagugaaauagaacaacaucauuauaagaaguuuucaugcacgugugcagauuugaaaguguugccguauuuuucaugugaaaucaaugaaaaauauguuugggcauuucuauuuaagaauaauguuaaaguaccuugccaaaauaucuggcaagauauuagcuaccagggaacaaaguuguuuuucuucuccuuucuagcaauaaaugccaaaaaaaaaaaaaaauagugcauugauuuuaguagaguuuugaggagaaaagauggugacuuaagaacuuacugagcuuccuccuuauauguuauguggaaaggcaauugagaggcauucguugauaagcaggagcucaggaaagauacacuaaaccucuuguucacgugggaguaccuaaagguugccuuuuuauuguuaagcuuuauaauuuaaaaagguguaaauuuaaacuuaauucauuuugguuaacuucaguaauuaucaaaauaauaaaacuauaaaguauguaucuucuaaacaccuagaaauauauauuccaaaagauaggcaacaaagaaagaauaaaaauaauacagggaaaauguuuacuauauaugacuacuuuaaagaaauacagacauuaacauauguauguacguauauacacauacauauauacauauaaaauugaccauauacauauauuuguguguucaacacacgcauuauuuuucagguacugcacuaaccuuuuauuccauugacuuguuacuuuuccuaagaacucugugacacuggccuuauuauaccuguuuuaaagauaaacaaguuuaguuagagauggcccaaggucacacagcuaguggaggagcugggauuugaccccaaacagucugacuguugacccaaugcucuuaagcaacugugcaauacagcgaaaggggcgccggggguuaauguucacacugcuugaugcugcugacuuccgaccagccacaaggcaccccggagccaaaggcagaugacucccuggcuugccagugacgugugaugcggucugauaugacaaagugaguuaaacaagcagauuuuuccucucaggaaacagacacaagaacaacugaaaagaauaaagcagaugugugaguuacuauuccuuacagcaaaagaaccucaucagaaccgcaggcuggaaagaggugauuacuuuuaaagggcaguucauuccuccugcauguuggaaacuguggcucuuaacuggcuaaaauuuuaacuuucaguguagcccucacuuggcuugugcuucuuaauguuguagauaacauuauagauuuauauaauauucaacuuuuauauauauauuacuuauauauaaauguuuauguauaaauauauauuuguauauaauauguauucguauaugauauguaguaaauguuauauuuaaaccaucauauagaaaagccauuauuggguacacuguacaaaucugccuuuauaauugaguguacuguucuacuaaaagcagcuuuagagaaaggauugaaagccagcucuuucuacuucacuagccuucauuguuuggauuggcauuauguguacaguuauauuguaacugucacuuguggucuaaucuuccccuuaggggaaacuugagaaaccuggucagcuuuaacauuuagaggaaguuuaaacauauuggagcauaaaauucacaguuguuuaacugaaacuccaguucuugucagaccacaucucuccagcccuucugugauuggaaucaucuaacuuuggcccucaauaaggaaaacuuugacaagaugcaaaaaauguuuacucuuguuuucuuugccaggaaccugagucugcagcagacucugagaccucuuugccuaccccaaauaagugaauugucacuguaacuguuuuuuauccccauaacugcuuucggugaaugccaaucuaguuguuacaugccuuuaauauuuuggguaauuauguucuuuaagaaugaaaauauuuuuuccuuccuuccuuucuucuuuccuuccugguuuuguuauagucuagcugugagaccaguugccuuucauauauucuagaagagaaggaugaggugaguuucacagugaucuuuuuccaaaauacaaaaccacugucacucuccacuucccaggcaaccccacucauucuauuuucuagugaggguuuugcuuagaugaugacgagucucuugauucaguggacuccuaagggaccaucuuucaccagcaccaaaugcuguuuaguucacauauugaaauguuuuaaauuauaacuuagcaauuguaguuaguaaucuucacauuauauugucucacauuuaauguauaauuuccuaagagaaggaaaugguccuggugggggucaauaguuauaguaacuauuaauaauacugaugacuacuaguuaauaguaauuaaggccuccuaaaaugagaggaaaaaaaaucuuuuguuuauaagguuuaaaaagaagaguugauacuuaauaguuuuaguaaaaccccagugcauguucgauuaauuuuguuacuuuauucugggcauguaguugaauaauuaccugcauuuuugauuugcugaaaagguggugguuacaauuuuuuuuguuuuuuuuuuuuuuacaguacuguuuuuaguucauuacauugagaugcuacauuuuccuuuucuuaaauacaugcaagaugaaauguuuuaccucugagaugaaaaauuugaaauuucuuuaaugugacuccuuacuaacacaauugcaggcaagcauugaacauuugcuuuguuccaggcaccaugugcugugugcucuaccuaccuaaucucacuuaguccacuuagugcuauuugcagguugaggcuuagaaagaaaaagaaacuugcccagaguccaacacuaguagcugguaaagagcuggucuuugcaugcagccucucucacuucaggaugggugcuucccagcaccacacuguaccacccucaagacgaguugcaggaggaaaggaaccucuagugguauuaacuaaaucuuagcaaguaguugccuguaaauuguagacuuuuaaauacaaucucacauuucugugaucuuuacccauacaccaguuaccuucaaacuaauuuaagaaucuuauagauauuaaaaaugcuugauuggccaauaucucauuucugucaaaaucauguacuagaagcauguaucaaaucagagacuuauuuaugacaauuugcacacacauuuggauaaaaugcaucaacuucuuucaaaguuuacuugaaauaaaaagggaagaauacgaaguaucacagguuaaagcaaugcccucauuccauuuaggcaaaaguguugugcuauuugaauaguguuaguuugagaauauggaguuguacuccuuauagcaauuccaaccuagaaaaauguuuguguuuuaauugauggguuaggcaaaaaguuaaucuuugcauagaggaaagaaacagcucugacuuagagguuuuggggcuagaacauggaucaagugucugaaguuuuucauguggccucaaguugaaucuuggucagagaauacacgguggucaaacuucacaccauagucauaauguaugaagccaaaagaaaaguccuaguugcugggugcuuccauuauaucaucaaccuggguuuaaugauuuuauuggaagcacgacuuccagugaggcaaggcaguaagccccagaagagaggccuuccauggguagauaggaacucaaaugcuuucccaggcuggacccaggagacugugucagcuacugugauauggcuugccaccaggacagaucauucuacccgucuaaggaguuaggguauccccaagagcugugaugggagguggaaauucacaccugugaaaugggagguaugcugaguugaacgggauagcccaaggccuguccaugaacugagccauggccaaggauuucuuaauucuagaggccuccuucuugagcuugccuucuuuugaacuuggcccucagugucuggguaaguuggagcgugacuauccagggaaagccccugguuuguauuuagucaaguuggccagagaagacuggaucuaagcgggaauaaaauuugcugacccccaucucagagguuaacauuuucauuuguguuuugcaugacucauuuuaaauuacagugcucuacaaguauagaaagaagccuuccucuucccaccguccccagacaccacauaauggaaaaagcaagaauuuucugcauaagcaaggccuuaaaaaaaaaaaagccagccucugaugggacuucuuuccugccagaaaucccacugguccacugucgcaauuuuuacaaaaggccacgaugaaagaguaaggcccauuuugagcccuuugcuucuguauuaugugaaacauaacuuguauguuucacauauguucuugguaucagaagaauuguuaguuuuugaacauguaaaaucuacuagggucucugacuguuaaaguauaauuuugauuaagaaaagauuuguuccacugcuuugauuagacacauaaaacuuugaaaaguuuugauguucuguuuccuguuuuaaaaaaauauguccucuccuaugaacucuaacuagaugagaggauuuuccucagagaaaauucagcccugggaagaaccaucuauggaggucauaaccuagaaaauucuucaagggaaguugcagugaauuaaaagagggcggaguuagaaaguccuguucuaccaaauuugugcuaauaguugcaccuuucuuucuuucccagaauggucacuggagaaaauguguaaaccaacugcaaacaaguuuauccguugccaccuuucuuuuccuuuagugacaguucaauucguuaaccugaaggagcuacuguaccaucaagacuagcucccagcccagggcuucagcauaaagcagcugcucaguuaauuuugguggaucacgggcagaaacaaguuaccuuugggaugcagauucugaauagucugccaugaaaugauuaaaugaaugagagugaugaggggcuacuuaauuggacuauguaaaauggcuccuuaagcuucguggacaauugaguaauuucaguuuccucucuucacucuuguuuacuuccugcucuucuagcaucaaguguuagguauucuguucucuuacaaugagaagauuaaacagcuguaguuuaaauuaaagcauuaauuuggaguguucuguggcuacauuaauuauauuuucuacuaagauuaaauugcagauggauauaagcagcaauauauguuuauccagggcaaaccagaauucuguuaaccagccauccuuggugacuuuuuauuuauauauaaaaaccuuuuuaaacugaaauaauguaacuugauuuuuccccccaguuagguagaagaaaaaauaauuggaugcagaaaacaguuguauggagcguauuugcauagguacaggacuugagugacagaaaauuccuuuuauuuuuuuccccagugggauuuagcaaaaagcauguguugaaagucucuugacuaaauggaucauaauuaaagacuuugggauuuauuuauggguauuuuaauuagaaacauuaaguucacucagugguccuugugaaaacuuuuuucuaacugcuuauuuuauaucaaguaauaaauaaaauuucuguggguaugaagaugaguuuuagggccgccuauuucucuaggaccgcccccccgccccccgccgccgcuucagagagcuuuucucuuucuuucaccuauuaaacuucugcucuggaccucaaaaaaaaaaaaagaguuuuagcuguaaccacauuguaauucgugcugaauauaugaaugcugcuguucacugaauaguuaacugguuauaucccuuguuaauuugaaguuuucuuccuucguuuuggaaugauaguuauaaggcaacaugcauuuuagaaaaaugcacuuguuugaacuucucagaucuaaugugacucugugggacuagauguuaagaaaccauaucuuuaacugaacaucaucuaugauauuccaucucauaacauguuccaugaguuuuauggacaauuucuaagaaauccaaaguagcaugcaguuuuaucaaccucucugcauccccuuggcacaaggaauaauuuuucuguuauugaggggcaaaacagagggguaaaggcacucauacaguuaaaugccagauuaagucaggcauccaagucacucugcuuuggguugauucucugagacucagcuggcugacuucaaaaggacgaaauagauuucaacauuggaaaagaauacaguauagaauauaugaugggucuuguuagcuaucucuuauuuucuaauccaaagagccuccuaguuggaggaaaaacuugaacuacauaaguauaucagcaaauuuucauuauauuuuauaauucuuuauugcauuauacgugaauauauuuagcagugguaguacgucuuggaaaguuuaagaauuuagacaaauaugcuuuuuuuuuaaaaaaaaauaguugaguuuuaaauaugcuguuuggguccuuaugagcaugugggagauauauaggagaaagaguuuguugcugauguuauagaaucaccaaugcagcauugcacuuuuguucuuuuccauucauuguucuugcuuacauggagcacuugcaaauaggcuggacgucucagaguucugaacaaugcccuuggcuaaccguuaguccuaauugcugugacuaaugugcugugugaccuaaagacgguaacauacuuaaccuugguuuucucaucuguaaaauagaauugaugaccucuaccaagccaaggauuucagugaggcacucaaaaauaaaaauuaaaaaauacauuugggacaaacaugaaaaaaauuacuuuuuagacuuaagcaaugcauuuaaaccugacgaaaaugaaaggaauugaaauuguuuagccacagaaaauaaagaccaaggaccaauuuaaacaguugaaaauuauaugaagcaguguuuuauggagaguaguaaugaacucuucuucaccuuuuuugaggcuguccaaagaagaaaugaaguuagauuauugcagaauuacauaaguuaguaagcauggacugaccaguucuuucuaagacacauacuugaguauuuauucucuucaguugcaaugaaggugacagugaauuugcugaauagcuguguacauguuuccccaaagagaccacuggaauaaaguuuuguuucuugagacaguuuccauugcauuuauaagucuugucccuugaaggauguuuucugguaaacaccuguauucuuuuuacauuauauaucuucauuaccguacaaguuugguugugagccauuccaaagucuuuaguaugcuguauggguguauucuauacuuuauaccuuauuuggaagucauaauaaugucaaaacuaugccuagccauccccuucccugcagagucucuuuugcuuuguccacuugguguguauauuuuuuuuuuuuuuuuuugagacagaguuuuacucgucgcccaagccgcagugcaguggcgcgaucucggcucgcugcaacuucugccucccgggcccaagcgauucuccugccuuagccccccagguagcugagauuaccggugcccgccaccacgcccagcuaauuuuuguauuuuuaguagagacaggguuucaccauguuagccaggcuggucuggaacgccugaccucaaacgguccauccgcuucagccucccaaagugcugggauuacaggcgugagccaccgcgcccguccaugugugucuuuuuuauuuuuuguuuuuugagacggagucucgcucugucgcccaggcuggagugcaguggugcgaucuuggcucacugcaagcuccgccuccuggguucacgccauucuccugccucagccucccgaguagcugggacugcaggcgccugccaccacguugugugucuuuuuaaaagauuuccaggacuucuuuuuccuuuacaaauccaaaauugcaguagcuuaauaaauaacaaauauuuugguuuuaugauuacugucaaauagcucauuaguaagagaaaaaaaaaaaugcugagccuuaagaggggagaggaaaggcagucuuucugaagcugaauccuuugccuaaauugucuuagcaauaaaucuugccaccuauugguaaaaaggaagaacuaaaacuaaaagguguuugccguucucacagguaguuaguagugugaucgaaauagaauucuuucagcggugcuuuuggauaaggggcuuggaaauaugugauuugauauggaacuuuucccugugcuuugaauuuaucauggcucaucucuaagucauaauaguuuuuugaguagaggagguaugcugcucucauggucucucuuaaaauuauauuuuuugagauagaauuccauuuuaauagaucaguggauuuuaauuggacacauuuuagaggcuugauugauuuugaaaacauuuuucuuuuuucuuucuuucugucuuucugccuuucuuuccaccacggcuaacugcagucugaaccuccugugcucaguugauccucccgccucagccuccugaguagcugggacuacaggcgugcgccaccaugccuggcuaauuuuucuguagagaugggguuucaccauguugccuaggcuggucucaagugaucugucugccucagccuccuaaagggcuaaaauuauaggugugagccacugcacguggccuuuuuuuuuuuuuuuucuugagacagggucuuccucugucacucaggcuggaguauaguggcaucaacauggcucacuguagccuugacaucuuggggucaccugauccuccuaccucagccucugguguagcugggacuacaggcugaaaacauuuuucuaacucuguuguuaguuugggcuuuccuucauuccagccucugaaauccauuauuuccugcccaacgggacaggccaguggugacguuggccuuuggugccagggccuguuuuuccagaucaugggcaccauacaaagauaacugcccuaaacggcaucauugccccagagucauugaauguccuuaaggugcauuugauaaaacaaaaacaguuuuuuguuuugaaaauucucaaguauuuccauacugggaaaauguucuuuuuuuuuuuuugacagggucuugcucugcugcccaggcuggagugcaguggcgggaucucaauucacugcaaccucugcauccuggguucaagcaauucuccugccucagcugggaccaccggcacaugccacuaagcccggcuaauuuuuguauuuuuaguagagaugggguuuugccauguuggccagacuggucuugaacucuugaccucaagagugacccaucugccucggccuccgagagugcugggauuacaggcaugagccaccaugccuggccaacaauguucuuuuuaaugguguuuuccccacuaucuggauagauauaugaauucaguuacuaagaugacuuagauuuaaauauaaaacacuagcauagcaguuuuugauucuuaauauuaucuuaaauccaccuccccucauuguccucuguaucuaaacacccuucaauucuugagaaaauuaagauuaccaaagauuaguaaucuauuugugauuguguguguugguggacauccuaacaaauuuaugaauaaagccaauacuguuuuguuaguguccuuauuuuuucuuuacgucuguucauauuuggaauucuaaggcacuacccagauaaucauuugauacccuuuguuggcaugacauguuuggucaauuguuuuggcaaaauuauuuauccaccacugggaacuaagcacuguaacaacuaaagaaagaggucauacaagggaaauuggaagaacuauauguuauuuguuucaauuuuuauguaguacaccuauauaugugugcaaaaaaaauguaaacuguuacaaagcaacauauugaugaauuuaaaugaguagagcauaauaaaagcaaaaaccaaacagaagagugguuggagugaggccauaauaaaccaagagauauuuucugaaggaagugaacauguuugcauuuuccagcauacugcuauggaugucagcguuaggcuaauacauaguauugcagcgugauucaaaaaggugagauagaggggaaauaagauagcuucauaaauauuaccaaggaauuuaagacaugagcauuuuauguagggagguugaaaugcauuguuauaaucaggcuguguaauuuccuucugucaagaccuacccauuuaccaguaaugauaccuucuuucucuucuauuuuugucucuuccuuuaggaaaaggaauauaugcuuacucauuauuuaaaauucagagucauuuuccuguuccaguugguuuuguuccuggaaccaccaaagaagaguagaauuaggugcaugugaaacuuuuguuucugcuuuuucuacucaaucaacuuuuaucccuuuuuaauuuuuacucucucaaccaucaguucuauaucaugguaucucuucuuggucuuuuuguauuauauuuccauaaaaccagauguacgggguuguuaaaauacugccuggacauauuaucuacccugcacuaagugguccuaucacaaaauccaguuaaacacacauugaaguauuuaaauuguuucuuuuuuaaauaacaucauauugggcauuggacuucuuaacuaaacuauuucuuucacuaaaugacauugguuaauucaacaagccauuguaggaauucuguuaacccaguagcuucuacuacuauguuacuaugguaaugacuuagcuucccauaaagcugcauuuaaauagguguuuauagucaccaauuaccagguauuucaaguacucuuugaaaggggccugcuuguggugggguggggggcguuaacauagauacuuucucagucacguagccauuugaaguuuuucagguagaagacaguugauagacuauuuggugagcaaaugaauaacuggaugaauacccaucugggaaccccuaaagaacugaagauaguucccuggccaucacuguucacagucaucuauuaugugcuuacucuaugccaaguguugggcuggauucuggggucaccaaagggaagagaaaauuuucacugccuugaggguagcuaaaaacuuaauggagggaagcugagagcaugagcgagcgugccaccccagcugggugagcggcacaccuugggaacagcugggagacccccaguggugugugucuuccuucgcccuuagcacuugcuccucuccagcucacuguguuucuuuucucucuggggucuaaggagcuuaggcuucacugccugcuccucagauugugggagcaggagcagagagugggugccugccacgggacaggggguccuagagacaggccccagcaugggaaggcaguggaaacccaugcauugcucucuggcauugccacacgucuucugcugccugccuuccagcccuuugcuuuuccccagcuccgucagcuccuugccucugacaucagugaugaaagucaggcguggggggauuagauuauuuccauuggccuugauagacuuagacauauaauagaagcuaugauaagugaguuaguuuuccauguuuguuuacugaaguuuauauuacccuuuaugucaccaaaacaugcccguuugcagucauugccaauguagucaugcaaaaucacuugagugaaauagacuuuggggaucuaaucucaggaccuaaccaccauuuauaaagcuuuuuuggggaaaauguguucuggauuucgcacagccagcuuacaaaugagcuuuggaaacacaauccacauguaaguuggagacuuccuauuauuagcauucagcccugcgaggagagcccuugcuuuguuagcaggccuauguguccucagcccuaaguuccuaaaaccagcacuacuugaggagcuugaauuggugcucuuggaguucuuuagauuaguuaugagacuucagaaccugcuuaccagcaguacugagcucaagaggaagccuaauucauauccuucagaagauaauuuuaagagaguguguauguuuucguuuugugaacaaaggaaaguuaaucuggugcuccgugucuguuuuguaauuccccaagggagaaggaaagggagggaaaugauugauuuccagauaggauaaaaaccagucagcacacaauggguuacugccaccgcuuucugauaaggauccuacuucaacuaucugaagagauucuucaagguggaggauacagugguuauauuaguuacucucacccuuguuauuauggaagguaaaauuccuggauccuagauuuaauuuuaaaauaguaauuuaauaaugucugguggaaaccucuuaaaaaaaacacuuugcagcacaucucugguagcccugugcuugagaugacuuuuaggcugccaguucagaagauggaagauauaaacuguguugaugaguugguuuuucaguggacccuguuagguuccuuuuuuaaaaaaauaauaauuuuuauaaugaguaugucuucgugagcccucacaacccuugaaguuuuuacuuguuuggcagaacuaagggcacugaacguuuguaagccguucacuaacacuuacaggaagggcauaaaagggugcucaagucagucuguagguggugggggcgggguggaaagaggggauuccuguaggccuggaugaaucagccacugauuucugaugguagccccagcugcaaaaaaguaggaagcuuuuuuuauggacagaacuacaacuccuuucuuucaaguuuuucagccuuuucacacuuuuccauucuucagacuuugcaaguuuuuaaacaaaauguuuguauuuccccaaaggaaaucacacaguugacugcauuaugagagggaaaggagcaaacucugucucaucugaggaggggcucagaucaggaguuguguagggcccucacccgguugggggugguggagccuuggcugugugcaggagugacuguucuuggagauguucugguuggaucaugaguuugggcuuggaaagcacugccucaaguucaucagcaggaaugagguagaauucacuacuugcugucuuaagaccuuucugucugccaaguguuugagcaaucccucacaucucccccuugaacuaaagagcaacaacuggucaagagcccagcagggaugaaaaagguuggccccuugcauccuucaucugcuguuuagacuaagggccgcauuguagaccacucucggccaugcuguccugaacccgaggaucagcagaauuacaggcccaauuucaggcagacgugagcuugcaucugaugacaggcaaguaccuacaugugucuuucauuacuccgcugccuuaggagaugcuguuuaaguuggcagauaugcuuauuugaaagcaaagcuuguugcuggugagauuacugaauuuacaaaaaaaaaaaaguggggggaucagaugccaagggagagggaagggaguguguagcauuuaaaaguguggugaagccaucaaguuaacaagaaaaaguagaauaaaaugugguuccaauuuguuguacugggcucaagaugauaauauugcaauaguaaacuguagggaugugugcgugcaaaugugauuacaugugugcuugcuuucugaauuucaaaauuguagaaguuauuagaaguucuaauuuuaguucccaauuuaauuuacucugauaguaaauuaguaauuuucaagggauuuacugauaaucagaacaaagauuugcaauuucuaggacagauccccaauuuugggggugggaaggagcuacuuuguauuucccugaaaccuugaguuacuggggccgaacauguagggcagauauugaaugaccaauccuaaugcucuuagcaacuuugcuaaguaaaaccccgcugccauccaguggcaauuggcuauacggcaugguagcuguaaaauaugcccuuuucugccuuuucucccucagauuccaccuuucucagaugcucccaguuuuuuuucccagauggcaccugacacaguacuugacaggaaaaauugacuuuaugucuggcuuagguaauucagggcaagugugcauuuauuuaccuugucucuucuccuagcaauacuaauuuuuaucuacguugcauuuuuauuuucuccccagauuugucauaacacacauacuuuuuccuugaauauuuuuguuaccuuagcuaaagaauuaaugcauugugguauuucugcuugucauaguuuuacuuuagaguagauuucgcuuauaucuuuguauuuaugcuuugagcugugguuuaccaauuuccuagcauguuucaugacacuuauccuacauuucagacaaggauuuaugugucccauaggauucaagcuggacuuggagaaagagccagcuagcaaauggaauuauucugacuugugaaagguuccagccuuuuaaaacuaggcucugagaaauaaaaaaacaaauauucuugggaagaaacuggguuugugaguacuuggcuagaaauuuuaggaaaggaaagaacauuuccucuggccucgggagcacauucaaugugaaauauugcugccuuuaaaagagccaaacuuaaauuucuauuuggaucauuuacuugacuuaaaaauaaagggaucuauuuuuuuuuaagguucagaacccuauuuuaaauaaaaugacauucuaguaagucaggcaagaugcccccaacaugagcuauuaauuaaaaacagccggaacuucuggagguguuagcaaguaucuacuaugagcuuggggauuggcgaaaucugguacaaguuaguuccagcugcgcacauuugccuuauuacaguucuuuaugauaaauuaaaugcaugcuucauacauccuuugguguagucauauucucucagcacuugacuaagcagguggaaagcuuauuuagucauaggaugacugaaaacaaugaacuauaaacccauguauauccacuccaagaaaagagcuaauaaaugucauguuuuuuauuuucccguggacccccuuuuuuuuuuuuuuuuuguauuuuauaaccuuuccagaaucuugagugauuuuuaaauguuugcccuuuggucauaaaugcagcaaguaaaugugagucugcacacucgaauguuguauaaaucaguugaccagucaguguuggagcaaacuucucaggauugcucugugaacucccuguucucuggcaguugccaaauacaaagauaaaccaggagagacuuauucccaagaaaagaaugauucugcauccuuaacuuacauauaaacuguugagauguuucauuguuuuguauggucaagccccuucucuuguucucucucuucaucaauuaguauggaaaauuggaaguuuacugaaaagaguuucgaaucaugggauuuuagauuugaaaaggaccagagggaucaucuacucuuccaacaaauaaaaaauaaaacccccaaaggaaugaaugauccauggcugggacauuggaaucucucuauaaaggagaaaucauauuaagguauuuucaucuuaggccucuaaccccaaggguaucuuuacaaagacuuuauuuuagugaagccuucaauaaacagugaccucaugucaagaauucuaaagagaggguuauggaauauugguuugauauuaaagucauuguuaucuuggagcuggccugaauggacuaauaaguggccugucaccaguuguaacuuacuuuuacaauuuuaaugugauuuaagggaagacacucuuggaaaugcuuaguuaugguucauacccauaaucguguuucuuuuaggucuuaaaauuuuauauaauacaggggaguagauugcaucaguacagucuuuuucuuuuuuucuuuuuuuuuuuuaugaugcaaacaaagcaguaucuuaaauuaaaucaagguuucuuaagguuccagauucuuauuccuaaauuuuccacugaguaaccuccaaauucuucuccugccuuugucccuaguugacacaagucaggccacaauuuuuuuucugcaaauggacgagcugcugcucagaggcugcacuuacuggugagagauccuucaagggaaaugaaucuggaauggccuggaacauuugucuuuggguugcuccagggcuuuauuagagcuucugagauuucuaaguaggugaugaaauuuagcagcaucugauuuucuaaaaugaccaaaggagaauuguuucagucccugauuugcaaaguacucacuuuuugguccucucaaaauuuuugucagauaaagauuuuuccgugccauggauauaagaaauaacccacucuuaccgauaaagggaaguuaguguuguaaaggaacaaauggugauucagguuugggagacuuuggagguauucauucuccacuaagcuauaucccaauaccaucauuaucugggucagccuccgauucagccucauccugugcuucagcagugggguaaaacaaaugucacuuguuagcugcuucuucaugaccuucauagacuaugcauuaauuugaagcccugcccccaaaaauagugcuugggggggaaaugaguuagugauuuugugaagauaaugggaguugaggaaaacacuuaaguuugcuuuucugagcucuagcuucauuuuacuucucagucucaguauuuaauugucuccacuguuuuuucuaacuuggaaggaaaucagauggcgaaagugaaacauacggcuaucaaugugaaaaagcugcucccuauagcacuggaauucucuugucauuaauagcucuuguagucgacagauuauaauauacagagucauaaauguucuuguugucauuuggaaaauuacaaauucccaaaaaguggugauuauuuggggcuuugggucugcaagacguuucacauuaaaaugcugauaauaucuucaaaaaccacagagccaugggccuugcaggcuugguaacugacugccuuuguggugugguuuuauucuuucuacugaagcaccugguugaaaggagugggaugcugaauucauaggggcguguucacaaaaaucuuuaacaucaaguaucuguuuauucaaaauagugcauaguucaaagcaaccuugauuccuuaaacuagauguuuuucuguucuuuaaugaaaacagccugaacgugguuauuaaucugagucuuucuccauucugaccaccccacucuguuuuucucuuugaauaucaaaaaaaaaguauaaaaacauuuuguaauuuuuuauuuauuuauuuuuguugagacggagucucgcucugucgcacaggguggagugcaauggcgcagucucggcucacugcaagcuccaccucucagguucacaccauucuccugccucagccuuccgaguagcugggacuacaggugcccgccaccacgcccagcuaaucuuuuuguauuuuuaguagagacaggguuucaccguguucaccaggagggucucgaucuccugaccuugugauccgcccgccucggccucccaaagugcugggauuacaggugugagccaccgcacccagcaacauuuuguaauuuuuuaaagggcuacauaaauucaagguauuauugcuguacuucuuuucuguuaccuuaugaaguugauuguuguugaagcaccaacaguaugcauacauggguauccagaaugaccaucuagucucaguugugcaaaauucacuauguagucucauggauugagaggggcaauuagcaagagugugagauaauggagaacaaaaaauaaugccaagcuggguuaaaaaaaaaaaaguuugggaaagaaaaaacaagugcucaagacaagccuccuauuuuucaguuuggccuagcccuagcccuauugaagaagguuaguacauucaccuggccaguuuuagcuaacuugguuaccuggcaaguggcggggaugcaguacauuaguacuuguccugugguacagagcaugugucucaggguguggccacuccagggagagggaagacgugcuuuauggggccuccucagccaucacugugauaugugccaccaggaacccaggaccuuucaugguccagucugaggugggagcaccacagaagcaagagcugccuggcccagccaagcccagauuacccuaaaaucuuacugcuuuuuucccuucagcauuuuaaauuauaggagcaaguaaaaguguacauaacgcaaggcaaucugaacagguggcugauagcugcuccauccagaggaagagccaugaaguucccccgacccacacauuucacccugucuugucuaccaaaaaucacaugaaaaugcagacauaaccauggaggaguaacccaugaacaaagggcugguaauuacaguuuaaugcuguucuuuuuaccccuuuggcuggcuggcugugcaaaggcaggccccgguaauuacgguuuaauguuguucuuuuuaccccuuuggcuggcuggcugugcaaaggcaggccccacaggggaguaauguauuugugacagccaguugggguggggagagaugggcuguacuacacuuugaauuuauuauguucugcuaauacuuuuacuccuaugcuggaaaguuauguuuuccuuccuuuguuagacaauuuuugcagaguaguuuaacauuuucaaacauuuacuauauauagcacuuuuaaaauccaggaacugucauuuccaaagaagauuccaugucuauaauauuaauucccuguccucuccucauugccuuuuucagacauccacuguagauagccucuguuccccaggaacuaacauuuccaaaggaaacucccuugccuauaauucccuguuaucuucuuguugccucuccugaauaauaauuuuugauucaguaccuuuuagcuauuuauaauguuaucguauaaucugaguuugggaacugcuugccacuuccaguuucugacacccaaaacacauuuuaugcuuagagaaaacaauagcacccugacuuuuuagaagacauaguuuucccuuggggauccaaacuggaagcagauauuugagcugugaacacauuuuuucuuagaagagucaauuaggagcuggguugaagcuucagucuaugcacuuagagucagguuuuaggaccaagagcaagcacugugggcaccuguuguaagaaaacaucugacagcacgaggugcuaaauugcuucaaaauccuccauagcucguggggaugcuaccuuuuuaguaggaguuugaagcccagaaugcacuuuauauuauaaccaacacaguugaaaaauagguuccauguucuauaagaauggauucauuaaacugcauguucuggaaaaaggauguauuagagacuuugaauuugaggauccuguguuauauacaucucugagccaucuuaucaggaagaaaagcagcuccuuaaggugccugccucuuccucuaauacuauguacauauuucgaccucugcccucuuuaaguuauuuucauuugucuuguagccaguaucagacauguuaaugaccacuaacuuuguaaaugaaauuauugcagcucauaaugucaagaugugaaccuaagcaggccuuagguuuucugacuuaauagccgaaccauaccagucuuucccugaucauugaaccuucugucuucugcagucagcagaccgucucuaaugagaggugcacagacacuuuugaugcuuauuuuaagggaagccaguggcagauggagagccaucagaugaaacuguuauuaaucacaccauuucugaagcuguucugacuccacacccugcauugugacaaacgccaggaugccaaguuccuaguauugcagcagguucuuaguacauaacaaacacuaucagugcccccagcucaacuucgacuaaaugccuuccaauagaguuaagcuguuuuuaucuaauacaugcuaacaguaaaaggacacagacccucuuauuugacccucuuagcaucuaaggaauaugauacuuuuuuucuuuauacuuagcuguguauucaaagcuaacacauucucuaaguaaccaaguucacacuaaagaaaaauugaaggccauccucuaaagccaugcugcucagugcaggagccaccagccacauggucaaagccacacagagccacugaaagguggcugcuauaaauugagauguguuaugagcauaaaacaagagagaaaugaagacuaucugcuuaauaauuuuuauauugauuauauguugauuauauuuuggauaugugggguuaaauaaaagauuaaauuucaccuuuuguuuuugcuugugauguggcuacuagaaaauguaaaauuacauguguggcuuacagcgagaccccacuauuuacagggcacugaaagucauucuuccucuuaauuccucaucuaaacucuacucauugacuauuuuguguaucugcaucuuuucuuccaaaaugaaugaucagcugcuagaaggcaugacuauggaaacaguguaucuucuacugugauuuuucaagagugaggaaguuuggcuaucaccaugggcgugaggagagggguucuguucucauuugguaaacauacaccagauaugcuaaacaucccauagaauaucuuagacaaagaaaauuacaguaaguagagaaauggaucaaagaguggcuauucuuggacucucuacuuuccaggucuuuuuggcuagagaacucuuuuucuaacuuuguugccuggcucuuggcagucaauguccaaaguagugcauugagcugccccccaaaaggggcacaguuuguaaggaaaccauaugcccuaugggaccucaugggaugacacucaguuaguacauaaggaucucuuggaagggagcugccuuuauguccucuaaaccaggucaucucuuaucaguuaaauccuggugcugacuaguacagcuauaugagccuggacaaaucacuucugagccuguuuuuccucucuguacaaugacaaugaugauagaaccuuucuuauaauguuaugaaagauuauauuuucugagauaauuuuaguaaagcaacguagcauagagccugauacauguuaaguacguuguguauauuggccaugauuauuauuggcuucuugguaaugaaagcaucaaauacuaagggcagcuuuuaguauauuauuucugaucuugugugaucagaaauaccacauuuuugagaauguauuauuuuccaaagaauuaaaugacucucagaggggaauggauaaacccacagagguucuggaaauggagcaguuuccuguaaguaucaugacuuccaauuaagccccuuugucuguuuuaucccugucacuuguacucacuguguagaucaugagcuaauuuugcuuggacucuccccucccgccaucucuuagagcccagcagugcugugcaugcauggguuaaaaauuucaaacuguccaaaugaauugcauuuauuggcaauuuaaugcugaaacucaaagagggaaaagaggagaaaaaaaaucaaagaugaaguggaaagacaagggcccuuggaugcagccggacagagguuguaauaucugcucugccaaacacuaguuaagugaucuugguguagucaccaaaccucuugagucucuuucccacauacaaaaugagguugauguguuucacaaggcuguuaucaugacucaaggaaauaaccuaaaugacuagggcagugacaguucaccucucucucuucauauugcucucaauuucaugaucuucuucuccccgcaaccccaugauuuauagaagccaaauuacguucucugauuuauagcuguuguaacuuuggaauacauuuaagaacauggaauuaguugucuuuuguuagauccacauacagaagucacagaaauguuuucaucauuuugaauuuuacuguucauucuggcaaagugaaaauguauaccaaaacacuauuuuaaaccaccuauccccuggguuagaaauuauaaguuaguguagcccagugaaguauaauuaaauguugccauucucccauuuauuuaacuuccuucccuccauauuugaaguaauuuucgcuuggugccaacuccagucauucuccagaugccugugauuucuuccagauuuucaacacacaguggcuaaagauaauauagaauuauuuuuuaaguaauuugugauuaaauguaaauuuaguaauuuuauguugggacaugugaucuccuugacauuuucuccaaaacacagaauuuaagcacuagaaaugauuuuaggacaucuaguuaaaccauuaccacuucacuguuaugacagugaggccuggagacauuaaauguuuugcccaaaguuaccaacauguuguuggcagaaaaaucuggaacauauggccucaucuauugucuaaauuuuuucuacuagugcacagugccuuuucaauugcuuuuuauuugauaauagugacaaucauaaauaggggauuuaaucaauacucuuuuaaaaaaaaaagucacagaaagaaagcaauuguauugaaaaccccuuucuaguuuuuccaguagguuacauuaaauggccccaaaaaguaauuuaugggcuaaaaugaaugucuucagaaggcuaacauaaaagaugaccaacagggggaaaccugaaacagccuuuuagguaauuugcuuaacuucuagcccuuuuaaaaaaauuacucaagcucauguuagagccaacaaaaaacaucuguuguuuuauuuauagccacaauuucuaagaagcauauucuauagcagaugaaaaaguaguugacagcuuauaauucauaaaguuacugaggccuaaucugauagaacaaaauguacaaacucccucccgugguucagacccuaucccuucccuuucugcugaagacagaaauggugcaacagaggaguggagcauagguuauuacgguuguuaaggaagaggcgacucugagaugauaaugcagaaaggaguaccccgcagugauaaaugauugcuuucaccucugggccauccaccagccugagucacugcuacuuuuucauuaacauuguauggacuuucauuauaggaagccaacauuuugcuguguucaaucuacagauuguuaacagcguauuuccaucaggaaucuaaaguguuaauuaaaacgacugauugaauaguucccucucugagggaagcuuuuaguuugccccuuccuuucaccaguuagcuguagucuauauugacauaacuuucucccugcugacucuuaagcaauuauuagaauucacucauuacucaaauaucaccucucuguaucuguuggcuuauuucugagaaucuuuuugagaacaugaccaggcuucuuucuauaauuuuuauauauauauauauauacacacacgcacacacacacauacacuacauauauauguauguagaauacauauauauaucuauauauguacauauauaucuauauguauacauauaucuauauauguauacauauagauacauagcuauauagauacauaucuaauguauacauguauacacauguaccuacauguauacacauguaucugcauguauacacauguauacacauguagaugcauguauacacauguauacacauguaucugcauguauacacauguagauacauguaucugcauguauacacauguagaugcauguagaugcauguauacauauauacauguagaugcauguagauacauguauacauauauacauguagaugcauguagauacauguauacguagauacauguauacauguagauacauguagauacauguauacauguagauacauguagauacauguauacauguagauacauguagauacauguauacauauauacauguagauacauguagauacauguauacauauauacauguagauacauguagauacauguauacauauauacauguagauacauguagauacauguauacauauauacauguagauacauguagauacauguauacauauauacauguagauacauguagauacauguauacauauauacauguagauacauguauauagauacauacauagauauauagauacauagauacauauauauuuauauauguacauauaucuacauauauaucuauauauacauauaucuacauauauaucuauauauauauuucuacauauauaucuauauauguagaaauauauauauauucuacauuuuaguucugcuauaucuauagggccuucuguauaucacaguuuuguguguuguuguuuuuuuuuaagugcauugguuuggcacaaauaacuauaguacuauuuauuauccugagcuuuuuugagaauguagugauaggguucaacaucugcccaaauugacccaucuaaaauuauaauucuaaaaccauaaccagaagaagcccauuaauuucuuuaguagagaggugaguagccucuuguuuauuucacuacugaucauagucuauugugagauaugaagauguauuagcccaccagaauuaaucaccuuugucugaaguagugaaaguauauugcuucauuuuguuaaacucugauuccuuacacaauuguuaaggauuguguuuacuuuuaucucaaaauuguuaccuuuuaauauauauagucuuauaucagugaucuuuucaaacuuuuaaaaugaagucugaauaaauauuauuuucuuaugcauuucuucugcaccagcugauagggaauuuucuguacaauguuuucaggccucuugccuuucuugccuuuauuuuucucugcaauuccacacacaggucauugcuuucccuuccucucccuuuuugaucauggaugcuucaacucccuucauauauuuguuaagcauauuuuacuaagauuucauuuugugaugcuugcaaauauacauuacaaaauauauauuuuuaaaaagugauuugaagggcccucuguccaucugaugauuaacuagaagagucuuuuguaccuugcuaaaagugauaaguuagccagcuauauuuagcuggauaaaacccauuacauccuuggggaagaaugugcuuuguuuagcuuuaugagaaaauauuuaauaaaugcugucuugaaaauauuuagccuggcugagugagcuggcaaggcuucaauacugauaaagcagaggugauggugaaaagcuggccugccaguccaagcucaaguuaaaaaaaugcaccucuugucacuaaggguugcaacugucgccaagugcuuguccaucagugucacguaaagauuuuuuaaccucacauauggcaucaugcaguuugucugccuaaaaaggcaaccuagauucacagagugguuacaauuggcuuugaagucccaucuguucuguaaaauccuagcuuuauuucuuacugcugguaugacuuuagguaacuuguuuaauuuuucuuaaucucaguuuucucaucuguaaaauggggacagugauaauuucuuagagcguuguacagauuaaaugagauuaaacgcugagcagaguuucuuacacuaaguguucacuacaugggaauuaaucagcaguaguagugauuuguaaucagccuaacauuuucugucccucccuaacuccucccaccccacaggagauacaaagagcaaaguccucuugaauguggcgagguaggaaaggcucuggcaugggcaucaggaggccuggguccucggcuugaacuuccugugggaccuugggcaaguuguggcucacauaaucccuccccacucaucaguacacagugcacagggcagcagagcuccuggcugcuagucucucuuuugauaccuaauucguugugguaucagaccaaauuugauaugauagcuagacccgccgguccgucaguaucauuuggggucugguguaagaucagccugugaaacucaggcauguaggcaacaaguuaucaguaagaaggucaaucauugggauucugucucccacaauggucuggauuuucucucuguggcuggugggcucagccccaauccuugcuacucaaagugugauugugguccgaggaccggcagcaugggcaucaccugggagccuguuggaaaugcagaaucccagacugcaccccgaccuccugaaucaggcuguuaauauguacauuaaaguuggggaaccacugccucaaacuacugcccuugggaauauucugacacgcagaggguauuuauuuacuaaauacuuacagaauuuguguuugacauugacauuuucuagacaagguuccauuccucucuuuggguguaguguacugauguguuaggucaggguuaccauaacaaaacaccacagacugguguuuaugucuguaccaccauagacauuuagaaaucuauuucucacagggugccagugugguuggguucuggugagggccuucucccuagccuccaggcugccaccuugucacugugaucucacaugggaaggguggggagaaaggucucuggugcugcuucuuauaaaggcacuaaucccaucgugagagcacuugcccucaugacuuccuguaaacucagcugccucccaaaggcccaucuccaaauauuaucacauugagggucagggcgucaacaugaaucuggggggaagggacacaauucagucuguagcaacugacuuccacaucugacuuuaaaaugcaucuuuaaaaaaaaugugcuggcagauaaauauguaaauaaagcaaauaugaaaauguuaaucguagaaucuaggugaaagauaaugugggcguucacuaaacaauucuuucaacuuuucaggauauuuaaaaaugucagagaaaaaacccccuacucucuauaguuauuuaaaaggaaucuggugcugcuuuuuucuccuuauuuccauccaggcuuucuuaagagugcuuguucggucuggcuggacaaacuugccuuuuuggcaguuucucucucucuacccacucacuuucuccuuggucagccaguggccugcuucugcacugucagugaggucccagccuggauccaaagcuucuuucuggucucuagucugccaguagcaucuuucuguccaguuccucuccaucccccugcccucuccuaauacuaaucaggggauccuucaauugcuugugacaucgcagcuucucaaguuacauuuuacaacucugcuuuauuauuuuuaagcauuucuaacaugacauuuuauaaguuugacucugaaauuuaucaucacauguaaguaggaaagaagugucuccacaaguuugcccucagccagagauagugugguucaucuggaaugccccugccuuucucugguuauuaauaggggcuccuauugcuuuuccauuuacaguguuaauuaucugcauuucaaaguaguucauaaugagagggaauauauuaacuuguuauuuggggaggaaguacaaaaacugcuauuaucaagaucauuuaacuugagcauaaucagaaaguauuaagguuauucccuugugggauugaccaucagauaucuguguguuucauaacacccuuauugcagauaccuuuuaaagaagggaggcuugcaggaaguguugggaaacuuacuauaagcuucuuuccuugacuggcacuuguauacucuggcgcagggaagacaagcccaaacuaaauacauaggcauuacuuaagagcuuugugacauuggacaaauaguuuccuugccuuuaaacuggggauaauagagacuauacaccuuugaacugcuaugaaaaauaaaugaaaauauuucuguaaaauacuuacugugggaauguggcuccuaguugauguucaguacuaaucauucauucagcaaacagccuaccgcccacugugugucauggccugugauuugucuuuuuucuuuuugggggcuucugggucauacuucguaugaaaucuuucuuagcacaccgaaagaccaacuuuccuuauaaaucauuggcuucaaaaauccuguggacucagguauaaauuauuuuucuggugaggagaggaggaaaucccuuucuuccccauuuacauccugccuagcuauuuuaauuugcuguacaccguaaauuguaaucuuagaaucaaacuccaauuuaggugauaaggaucacaauuaauuaggcuagccugucaaagauuaaauguaaucuugcauuucaguuaccuccuaacucugaggcuuuagcuaagcccgucagaaacaaagcuguuaggucugcuuagguuuaauaagaucuuugccugcuguuuguuuucuauaccagucuguugucuagaaauaaaacgaauggacagaggaucucaauucccuuucauuuguuuuuagcugugcagcaggagagauaaaugagagaagauaaacuuaacgauauuaaagacuaauuaggauaucugaggagauuugcaaacuucuaguuuaaaucugucggcaacucuuuuaauucccuccugcuaguuaucucugaaaauaauguaguuauggcugaagauuuauuuccacaucuacucuuuguacucucauuuucaguugcgcauacuuuuuuucuccuucuuccuccaaaaaaaaaagcucuuguuucggccacacucaauauaauuuagcacacagucauuccaacuucauuuugucuucacauucagaaaacugaagucuaauaucucaaauauauuaguauugugguccuuuuggggaaaguaugauaaauugaaaauauuuugguuuugacuucugaagauuuugaguauuguuuauauauacaaaggcaaaaugcaaauauauacaaggcaaaaugcaaaugugcuuccagcuugcuuccuuagaaaaguauugagaacagucuaaguaugauaauuucuggucuuaaaaccugcaauugcaaucggguauuuccauaaucuaaacaauaauaaagauuacaugacuaauucuaacaauaauaacuaccuauuaguuugugcuuucuacauacugggcacgaugccugucauguuuauauauauauauuauuuaauccuuauuacugcacauaauuacucccauuuuacagaugaauaaaugggauucaaguuaacuaacuugcccaagacuacugaauucaguaaguggcaaagcaaggauuaaaaccuaagccucuuuggcuuuaaagcucugcuucuaaucacuuuuuuacuacugauuaaacagaugugucccaaaauuaaggaagucaucguuguuuuuuuugcuuuguuuuugcuuagucaaagagcacaggccaucauuuguuguagugucacccguaaagcuuaauaaguuuaaaguucaggguguuaaucauuacaagcauaaaguaugaauaugcuuuaaagguuuauuuaagaaaagaauugggauuagauuugcccaccagaauauacauuuuucacuugaaguccugagagagauucagacagaaacagcuuugacucagcagcaguuagcagacaaacaucuugauauaauacugauccacacuuugcauauacacuuucuuuucuuuguauuacauuuuuagagguaaguggcaguuuuucacacacuuccaaacugcuuccaucaguaaugaaauauuuggcuugggcagccucuggagucccaguguuucagcuuaaacuuuccagugggcccugccaggcacuaacuucaaaauaucuuuuuuuauggugaaugccuccagaaggugcaacuguguggugguuucauuuugcacuucauaacgguguuggcaucacuuaaugcaaagaaugccacugucucccacacaccgcuggugcccaaggacugucgaggccuguccauguuagugguuugggaagggcugaaguuuggagagaaggcucuuuuucuauuccaugugauuggcugucaccagggcaaagggggaaaacuagaacgaguggaaaaugcagcaucggaugugucaucaaauauucuuccuacaaccugggacaccuaguucauugguguucuggucaacauugaaggcugaauccuccuuucuuuugaaauaaugcgugucuuggauucacuacuuuuaaaccuuucugcugaucuuuauccuuuucuuccuaagcaauacugauuucuuucaaugaaaaaugauuuagcuagugaaaaacugggauuggguuguaguaaaggaaucaacaaauuugcccagauucuuaagaguggaguugguucuccacacuuauacacugugcuacagcaagcuucacaaccaaaacccauuacuuauucagguauaaaaaucaaaagcugaacuguaaugagaauuuaaauguaaacuguuggaggauggugcucuguuaauuuguguuugcuccauaccccacccuauauaauugauaauauuugcaucuuuuuguuuuuaguacuauuauuuuuugguuuaucaaacuuuguaacauggugcuuuauuguggacuuuucaaagaacaccuugccaaauuugguaauuccuagcaauugucauuuccuguuggaauuucuuaaaguggaaucuaauggaaaaguaauucuugaccuuguguauuuaguaaaauuaaaggcauaguugauuuuaggauugucauaaaaauuaauauuuuguuuuaaaagacuuuuuagacuuucaaugcuaauugauccuauuguuggaaguagaugauauaaacuuuaaagcuuuuuggguagaacuuucacauucaccaugucuaaauauuuuaaagaggaaauggauugacucgcagacauuuuguacuaaggaauagaaaaucuuugaauugcuauuuaaaaaaaaaaaaaucccuguaaaauuuaccauuuuaaacuccaguugcaaaauccugaucagcuaugaugauucauacauuugagcgauaaagcuuuuuucaauauuacaaauucaguggggagucacucaauacauuacaaaaagaguacuuacacuuccuaguacccauguguauuuuuuuuucuuuuuaaagcaaucuggugugccuuuugagaaaaguuccaguguucucacagauccugacuugguguagcacagugcuuuucagaaacuugguccaacaccugaaugaguaauguguaaaacauauaauguuuuguagcucaggauacugcagguaaacuaacacuuuuugccgaaaaaacauugaaaagacaaaggaaagcaaggaaguuuugcuuuuuuaaaaaauuuuuucaagcuuaaugaagaaagagcuggaaauccuuuuguauggagcauuugccagcccagcaauauaacaacuuuugggugcauauuucaaucacaauuagaugaaaucuuuaauuaucauuuaauuugacuuucauauuugccugcagaaaugauuguguugauaagacucuggaaugagacaaaccuuuauuaaguaauuccauuuucagagccaacauuaaaguuuuuuuuaauuaaaaaaaugccuguguaauuuaugagaaaaggggaagaggaauuggcauguugguugcaugagaguugcauggauauguauuuacuauuuaaucuuuagcuuuuugagauuuggggugugcuaagucuuguuaguuugaggggccuaaggagugacacaauaauggaucuuaauaaauaacacuuuucuacaucauuucucuaccuuuauauuucccuucuauuauauaugcugacaggaugauauuucauuguauucaguguagaagguguuugugagagaggauacuuuugugaguugauauuaaggcaaagggaagugguuuauaauuuaucagaggaaaugaaauggugugcucuuucauuuuauaauauuucuuuuaaaauuuuauaaugcuuuuaauuggacugugaaaccuuuaagacauuuguauuugaagugcuuuucagauauauuuacauuuuaacauacagggauuugagagaugucauugcuggauuuuuucauaggaucacccacaugaauuuucuuaucaaaagaguauguccuaaagcuuauuucuaaccccaaacagguuacuagcccauuccuggauguuccgauucugaagauuuagggugguaccugggaaucaguauuucuagcacguccuccagguggugcuuagcucuggcaagugugggagagaccagagagaggugaaguucccacccagcccucugcacagugacuggaaaguuaauggccagucguuugugcuucuaugaaaccuaagauguguuacagugauguugcaguaggacaaagucacucaggaaaucgagugguaaacauugcagggcuuugaguucaaauauugauuagcucuauguuaagaugccuugucuucagggauagcuuuagagugggaucucuaacacaaagcugacucgggaaucuuucaucugccauugacaaaauuugcccuugugcaggcaaguaagacuauacucucuaauuuuaugggcacuagccaccuaugguuguuuccauuuaaaucaguuaaaauaaaaaauucaguucuucacugggaauggcugcauuuuacucaauaaccgcuguggcuagucauugcuuuaucagagagcacagcuguagaacauuuccaucaucacagaaagcucuaauagugcuacuguaggauuuucccucauaauauagcucuucucuuuuuauccuggguaguugcaauggcuaauagaauuagguggaaagaucaugcauccaucuauguacugcacauugcauacugaaaucugaaagaauguuuuugcaaaaugacuuaaucauacuucucugagaucaaaauuuaauaacauuacuuucauaacgugaauuuguucuauguugacuuuuaguacuugaaauacaggcuuaauuaaaaauuuguuggccaggugcaguggcucacaccuguaaucccagcauuuugagagauugagguggguggauugcuugaguccaugaguucgagaccagccugggcaauauggcaaaaccccgucucuacuaaaaauauacaaaaaauuagcugggagugaugcugugcacuguagucgcagcuacucaggaggcuggggggggaggaucacaugaacucaggaaguugaggcugcagcgagccaugaucacgccacuacacuccagccugggugacagagcgagacccugucucaaaaaaaaaaaaaaaaaagaaaaaggaaauuuguuuaccauaguauauggcuucuaauaaagagcuauacugguaaaaucucacagaaacaaaauugcaaauauuuagucuuucucagauuauauaaauuauuccuagaaaagacugcaagcaaugaggcuaauaaacagguuguacuuauauuuucauaaugacuuuaauuuaccuuuauuuugcaguuucacaaauuuaagaugaauauauuuagcucccucuucuggcauaauuugagaauuuuuuugcuuacaauggucuuauuuauuuuuuuuggacugagaauaagguuaucaauguaauguugaagaauguuauuuaugagugucauccaguuagauuuuuugguaucauuguaaaugguuaaaacgcaugcaaaaaguuuacgaaaacaccacauuuuaaaaacuacuaauugaccaaaaaauacauaaacaaaggcuuugacaaaguuauacagaaauuuauuuugauaucaagugggcagugaucauucauauuggcuucuggaucugagacucagcccauaccuggcauuugugaggcuuggggcaagaaugcaaaaagaggcccaaguacccugugccuaaguauuuuuguuauaaaucaugucaacuguucaauaaaaucugucccauccuuucuaggcaguuauuucuuccuaaugaccaggaggagagaucugaauucagguucuugggcuccugagaguucugcccuagagugugguauuauggggagagcuggauccugguucaucccuggcuucucccugcacauccaaacucccauccauccugccacuccccccaccuuuggggcccagggguguaccuagacagggggguuuguccuggggaggguggaccugggggaaaggccauaagaggccauuuagcaggaaauccuggagcauuacucugaguagacccuaggugagaagcagugggcauaucacuuuggccuggaaagugcaaaagcccagagcagggguucuucuugcucgggccugauguaauuaaauuauuuuguacguccuucauuguggucuaaugcauucaacuauccaaauuaaauacaauggugggauuuuguuguuugcagcuuugacucucccggaucuugcagagcaguuugccccuccugacauugccccgccucuucuuaucaagcucguggaagccauugaaaagaaagguaaccagacugcuagagggcaucaguuccuuuguucuacccuuauuucauggcucuuauuauuugucucuugugcauucauuaaguaaauuuccuacuaccagcuauguccagauacucugcuggacacucaaacuguuuggggcuaaguacugggaaaaaugucucagucuauaauuucuaacucuagauuaucauguaguuuccauauggaaacuauuaaauucuucauaauuuaauaaauaugauuaacuuucuucuuagaggccagaugguuuugccaaaauuaucaacaugccagguaagauuaauaguaggaguugacuuccaagaauauuugguacacaucuagaacagauacuggauggaaacuggaaugucucuggcagcagccucacagguucuccagagagcuguguuuugcauacauggucuguggucuguuuuguguccuaggucuggaauguucaacucuauacagaacacagagcuccagcaaccuggcagaauuacgacagcuucuugauuguggugagugucacagagcuagaaaugcaaaugggaaagacaggucuuggcuuucuguuucagguaaugcacacacacaaaauugaauuuaaucuaugcaguguucuaaauuuaaagggaacucaaaucauguacaguucucccugcccuguuaugguaacagugcaaaccuuugaaauuuuucuccugaguugggcugcaagugugugcacgccucccugcaggcauguuggucaucaucauagccaucaggcccuggguccugcagaggagagaaaccaccucuugguguuucucucgcucuguguaucuaccaucuuuccuugacccugaauuuggcuacaucuaauucaucugaaucaauuaaaaaauauuuuuaagccuaugucacuuaagaaaugucucuucugacauccuuuuucuuuuauuaccuuucccuuccauuuuccuuuuccguuucccuuucuuucuggcuugccuucuuucuuuuuuuguguugagugcauuaaguaacaucacgauauuguuauguucaguggugugcugauaaaccaacucucuaggaagaaaaaggcccugguuuguagcaucugcccauuuuuguggcaugaauauucccaccggggcuuauuucaagcuaaccaacaugaugucacuggauguggaauugggaagaauugaggacaguuuguuaaauaacacuaauuaauuuagccaagagggcuuuaguaccccaaacacccacucccuccuuuggcauagaugaaaaacuacaaaucaauuuacuugccagcauuccagcaagucaucuucuuauaaaucuuucaagauccuucauucccucauaacgcuuaaaaaaauuauauacugccucacaucauuuuaacugaaauuagguguuuaagccaaaaagagugaaacucaguuuuggacuccgucagagguauaauuguacaaagaaugcccacaugacaguaaaugagaauuugaagcaugaggcaguuucaaaaugaggcaacuucugagacuuuuagaaaagagguuuuuuuggagaaaaggaggagacuagaccuuuaucaguaucaguaaauucuuacacuugaaauguucugaccagauguuucaaaaguuaaaaaaauguuuaacuccauuuuuccuuuguacauggaaaucaguugcaugcgaacagagcauauccucuuugcugcucugccuccugcacuucccacagagcaggucauuagaaguuaacaugcagaacacucaaggugaaaaggcuuguuuuucgguguuucugacagcuuuaucagggcuuuaaggaaacgcugaauuuuguccuuagccaauugaaaugaagacacauguuugggucagaaaauuggucaaauuaugaacacguuuagucacaggaagaguuuagacaucagagcccgaugaaguggaaguuauuugagaaauagugguuagguuuauaaugugaucaacacaaaaugaugcaguuuaguuauuuaaaaaaaaaaaaaaacucuucacaccacucgugagauagagucaacaaccaagauucacgucaaugguacauuuugaccaacagguuuccuuccccagugagaucaaaacacauagaaaacugguuucauuuggagucugugcuaaaaaaaagugaaauuugugccccaccccaaaaaauauaaauaaauaaaugauguccaaacuugggaguggaucugccagaucuguuuccaacucaaagauuuuucaauacauaaaaacauuguauaauauccuggaggaagcuccaaaauagucacuuacaccuaaaaaaaaaaauuauggcuuuuaacuaaccuugugaauuaccagucuuugaaaaggacagacauggcagacaauagcccacuuuuauuagcaccuguuaugcuaguucauccauacauuaacuuugugauguauguccuaguaacuuuaacucaccagaaaagaaagcugacccucagguaaauaauuucuuucacauuuuucagugccuuaguggcuaauuuuucugacuccaaaaguccuugauuuuuuucucuuuuuuaauuuugcccuaaaaugaauuguuucuuugucucaugcaaguuuuaaugauucagauuuucaccugacaguuuuugguuucauuuaaccuaauucaggcuuucuuagccuugguacuauugacauuuuaggcuggauaauucuuugcuggaagagugggagcuugucccgugcauugugggaagcuuagccacaucccuaaccucuacccaugaggugccagcagcauucucccccaguugugacaaucagaaaugucuccagacauugccagauggcucauggcagagggcaggaucccacucccacugggaaccacuaaccuagggagagaccuaaggaagaggagacuccauuccagggggagggagggaggagugaaggguuggagaguuuacuggguaccugucaugaguagacucagugaaaagugagguaggagagaaugcaaacaccuccaacccagaccuaaagauuauguagcucuucaaaagucaucgcaugacagguaggaauagcuaauggaagagcacguuaggccaguuucaaugcagaaaaggauucuuagagagcagaagucagauaaauagaacagacuuugucacuagcucuaguagaauuugacauaagguaagguuacccaaagaccugcauaggauaauuuuauucauauacuaugaaaguucuuuugauauaccucauguguuggaaaagggcuuugaugaauuaacuucacuuguggauugagccuucuaguucaauccacaaacauuuaacacguuguaugugcuggacacugagggaugccagaagagcaggugacagccacagucccugcccuugacguaccucggucuaguagggaaacacauaaucccacacuaugauuauacuccuugggaagugucuuguuagagggguggcucauuagcacugcagaagcacagagggaaacccugccugagggagggaugugugcauauuuauuaucuuaacguuuauacugcaucaccaaauguuuuaucacauauuuuaggauaagcaaauucgguaauauuaauuuuccgggcagagagacauuagaugaaacaugcggggcaaaguguaugggaaaccagaagcacggccaagaguggugaccauagagaauuccuauagcagcacacacacaauuuuauuugacaguauuuaauuaugcucacaauugcauuaccuucaacguagauccuuuaugcagaggaucuacuacagugguauugccccucccacacuuguuaaacaugugauaugucucugguugguuguuuguaggacauuuaagugauuuaacacuucgccucuucaccuuuuaaauuuaauaauucuuuuccucaaguugaccuauccauauccuauuccagaccuacuuuucuuagagcugugugguugugugacucacuuucggaacgucggccuaccuaguggggcaaguuugguuuaugaugauauguccaaggaauuuuuguagucuuaggcucaaccuagaaugauuuguacugucauauuccauucaagguuaucuaggauacuaccuucucccacucauuuauacucaaacacuuugcaguaaacuuucauacuuccucauucucuccuaggccacagcccaaugcagucaaucaccgaguuauaugaggucucgauaauauuuuguacauuucuaacugcauuagaauucagacccccaucaccuugauucagagaacuaaaucugguaguuuuacuucuagcagcacucccuuccaauuuauucuuaacacugucauuaguaaagcuguuacaaacguaguaucuugcccaucagcccaccuuugcuccacugaguacacaaguccccagauuacuuuccucaaguuauccuucgcauugcuaguguacauccuucagcagcagccaaaguccucuccuuuucuagaggcccauggucaccccugcccccagaucuuuguuucuagcaucccuuucuucugcugggcauugugucuuuuuccaacccaaguacuuagagugccaugcguagugagugccuggagggugguauugauuaguuuuacccccauuauuggauugcuugaccuguuucccagcugagggauuuacuggacagguaugcucaucuuauuuucugagauugucugauauccacagguuagauuaguaauacucagacagaauuagggagaaacauucuaaaaauguucaaauuauuuucauggauauucuugagauugguugcuaaaagucuguaguaucuuacuguugaauccaucacucuguuggugacauuuacaugaauucugagacauaucaacucaagucuuaggaaaucugggaauaugcauuuuuaaauuuuuccuguugagguuuuaggaaacauuuacuauaugacuaaccauuccuaguuagaacccuuuucagucagggcagaaccacccucagaggauguuaggaaauguuuggguucuguauucguuugcucaggcaguuauaacaaguuaccacagacugcguggcuuaaaacgcagaaacuuggccaggcacaguggcucacaccuguaaucccagcacuuugggaggcugaggcggguggaucacgaggucaggaguuugagaccagccugaccaacaugaugaaacccugucucuacuaaaaauacaaaaauuagccaggcguggugguacacaccuguaaucccaccuacucaggaggcugaggcaggagaaucgcuugaacccgggaggugaagguugcagugagccgagaucacaccagagaugcacuccagccuuggcuacagagugagacuccaucucaaaaagcagaaacuuacuucucgugguucuggaggcuagaaguccgagaaaaaagcauguuugguuuccccugaggcuucuguccuuggcuuguagauggucaccugcucacugcauccucacagcguuucuccucugugccugugcaucccuagugugucucucucuguguccucauuuccccuccuagaaggauaucaguuacauuggauuagaguccacucuaauggccucauuuuaacuuacaugcagucacuuucugaggcauuaggaguuugggcuuagaggggugggacagaggaugggguagguaaccacugaagaugcagcccaauucagcccauaacaaaggcauuauuuuuuguugccccaaaguguggaggucugcuacuggcaucaugggcagggggucaggcauccuaagugcuugcaauaugucagagagaccuccacaggaaaaauuguucuaccccaaaugcccggagcaaccccuacaagaaguacggcuaacgaauacuuugugucuuguauuuauccucauauugcuuccuuauuuuuuuuuuuuuuugucacaugugagucaaauuguucagaaaauuagcccaacugauguauucuauaaaauaaaugucugaaauauuucuuaaauuguuuccuagauacacccuccguggacuuggaaaugaucgaugugcacguuuuggcugacgcuuucaaacgcuaucuccuggacuuaccaaauccugucauuccagcagccguuuacagugaaaugauuucuuuagcuccagguuuguuuuuucucuucugggaaccucauugaacauacauggagauguagaggugcuuguauaugucuugcauauauagaaauagugguuagaaaauaguaguaauaaccugucccucccccaacaauaccaccucaaauuuccuccuccacccaagcauccaagagaagacccagauucucauuugcuugggaagcccgucugcaugucagaaucagaaauggcucauuguuaaccuauuggucuuaacaaaguuuguacgucaaugaaggacacggucuuccaaguacuagugucagauucaaggaacugggacuagaauccagugaugggggauguucuugucaucuuuccugaguggccauaacagaauguguugagggaagauggcucucaguuuuaggagauaagguucaguuaagugcuuuggggacaggaaacugguucguaaccuucaaaguuaaaaccugugauacuuaucugaugcuccucugaguuagccaaucacacuugaagcugcucaauacuggguaaguugcugccagcacacccugaacagcuugugguuucuuuacacacugagcuuuuugcauuuccauuugaccugagauuucuacuuucucauaaugcguuuucuaaugagaaggacaaauguacugugugcuucucccaacaacuuuuuaaaugacuccuauagcuugaagaaagagcagaacuuuucuagguguuuauucacugauaccuggaaguagucgcuuacucauuucucuuuuuuuuuuuuuuuaaacuuguagaaguacaaagcuccgaagaauauauucagcuauugaagaagcuuauuaggucgccuagcauaccucaucaguauuggcuuacgcuucaguauuuguuaaaacauuucuucaagcucucucaaaccuccagcaaaaaucuguugaaugcaagaguacucucugaaauuuucagcccuaugcuuuucagauucucagcagccagguaagugaaaggagacaaacauguauuuuggggugaugaggguaguccuaaauggauuggucaugaaaauguauucugaauauacuacuccagagaugcaugugcagaugcuaucacacacauucacuugaguguauauaaaugaaaaugaguuugcuuuuagggaaaagguuucuaauaaacucucuuucuuacagcucugauaauacugaaaaccucauaaaaguuauagaaauuuuaaucucaacugaauggaaugaacgacagccugcaccagguaaugcuuuuugagcauuuaacauucucucauuguucauuuuuuagagccuuaaaaaaugauggcuauaaaccuccuuugaaguaacacagcuucuuauggaauuacaguugguaguaauauguuaccuugugauuuaaagaaaaaauagcugagugguaguguauauguuaauuauuauccgaguuucaacauuuguggauuuuaaauuaucuugguuuuaggugagaguuuggagaguucccuguacccuucaacauuuaugcuucagguuguugaagagauuuauggaguucauuuuaguuguugacauuuuuguuuuucuuucuaauacuuacaaaguaggggauuuauaauuacuauauaauuuaaaguauuuuagaauguguuuuuuggaaguggguaugcugagaaaugccugucaaaauaaacauuuucaauaaugcaagcaguaugaaaccaguguucccugcagcaaguucgagcaagccagacacuucuuugaaagcaggcugcuguucaguuagccauuuaacaaagcaggaaauguagaccauguuagcaaugcauuuaauuuaaacugauguauuuuucuucuaccguggaaagucuaaacaaccucauuuugcuauauaccaguuaaaaguuagcuaaucgacacuggucauuuagaauaguaauuaggguacuauacgugugaaguuucaggaccaguaaaagguguugcuuguagucuuaauuuaugccuggaacuuaaaaugaaacuccaugaauauauuuauuauagguaauauaugcagauuaccauauuuaucucuguaugagcaggcauggggacucaguuucaucuucaugcaauggagaguuaaguugugcuuuuucuuaauuggguauugcacagccaggcuugguuacuugcaucuggauggggcagccuaagagaggccagggccuagacucaaaacccaccugcagcagguaggauagaggauaggguagguaaacacugaagaugcggguauugggaaagguuuauguggacaggcccaaaauguaccaaaggugagagagagguauccgguauaguagauaaggcaagcaugggauguuccaaaucacagcaagcagaauguuuuaacaggggugcccagaauucuagguaaacuacgucaaagaagacugucaacagguagggacuaggacuucaguccagggguuggccaaaaggcuucaucucgugugaguacacaggucacugugaauggauuugggagcucugugcugguguucagaggcugccuuuggacuuaguggaaaagaauugggguagggguguggcacauggcacuuaaguugagguuuauguuagagacuagguagagcuggacccugcucucagugaagggcuaguggguaguccugaucuuuucaguggccacuccucuagagagaggagacacauggaagccaaagccagacaggguuugacagauacccacaaaugaauuuaucacauggaauuuuggagaauuucuacuacacaagguauagcagaaucagugguagaguuugauuagccugacugguguaaacuaguuaaacgccuuuguuaguuucauccuaauuccaccaaaguaaaaacggguaucugcacuauuuucauaaugccacccggaaagcuguuugauaugucaaaggacccuacauuucucugcugagcaauuggugcgccuguuucaaaggaggauuaguuccaucagcucugcuaaaggaugacaaagccuugaacauuugcuagaucaucccaguauuuauguggccucuuaaaaaaaauuaaauccaagucgguuuuaaacucuaguuugagccguuuucccaggaaguuugugugauuuguauaggaccuuuggaauuaaauggcuguuuuagugucucucaugugugcauacauuguacugcccacuccaggaacaaaacguccccauccagaacaucuucguauucaggaauggcuccagugcaaaugacugcuauggcagccuggguugaagaaaugauucuuaggccugguuuaaaaaaugcaauaauuucuuagaguccuucagcauugccacagcaugugcuaguaccagacagaacuuugaaagcacagcaccuuacaucuccagcgaauggccauuuacaguaacauuguugugaacacaaaugaguaccugaaugauguuuaagggagacaaaagcaagacucuguuauagggcagauagacagcauuucuaauuauuaccagauagaacuugaaaugacaaagcuuaugauguuugaggcaaaguaucaguucaaauaagagccauuagcacauaguaucuaauuaaaugcuaggugggaguacacauacucuaaguacaaaaagaacuuuagaaaugcagcuggugacuuucuaggguaauggaguagacagaaaaggcucauagaagaaauagggcuugaaaugugccuugaagaauagguacaauuugaauaggcaaaggagaaauagcauuuugaugcauggaguuuaaagacuuauucaaaauaaauuacacaguacaaaauaauggcuugguauuuuacaaaagcaguacauauuuuaagugauaguaucacaaaaaacaucauuuuagaguugaaagcauuguccagcuuuaccaauuuggacaugaggaaaccgaggcccacagauagagguucgcucugugcuacccggccaguaugggcccaaaccgggucugcccaggagccgccuccuacacuccagcccauucuaucugccaugcccugcugccuggauuuuuggaaacuucgugagcaaugaggcugcuuuuaguguccaaucaaaaacuccucugaaguuuccagcauguaauaaacuaaaaauaugugaaauuagcccccaugggucacauauaguaaacaaagucagggcaauguuuauacuuuucaggauaaggcuccaaaucacuccaugagcugugcaguggaaaaaaaagugggcuucugacucaaauagaucuggauuggaaucucaacucucucgaguaacucagcuuuuccaaauuguuuuccagacuguggaauuggguuaaugccucucuccugggguugguaugagauuuaaugaacugauaauuucucugcuaucuaucgcaucaacucuagcuuuugaggccuuaugggagcuguccucauucagcaggucugauuccuucaguccacccauuccucauuaguugugugaauccugucaggccuuuuuccuuacugacgccauguucccagccagcagagcuacggccucuaggagccuguaggggcuaaaagggacacuugggaaguugccacccugauguggguacauugcuuggagggagaaaggugccuuuguaugaauauguggcuuggugaauggagcagccuagauuucaucaccacuccuccaucuugccuaggugccuuugcacagugcacaaaauaugcaaccauacgucgcugccccaagcagugccauccacuuuaucugcacucaaguagguccuucccguuuuauaugcaaguuaagucgacccauucaguauguuuaugccuuuaagcuuccugucaccuuauguuuaacugucuauaguuuuuccuauucaucugcuuaauuacauuucuaaaggguagggguaaaggcuuuuucuccuuuugagcucuuccuagcagagaacuagguacagcauaauaauuaucuaaauuuuucuuugauaaacuuccaacuuucaaagaauaguaauacaucaacacaucuaauacauccagcaauccugggaaauaaggauucuccucauuuacagagggaagcuaagauuuggaaaagguagggcacagaguaagcucucuagacuuuguugauaguuugcuguucuauuuuguuacuaaaaagucuuaacuugucguuuggcuuucaauauuuuuuucuugaaucauuguguuaucuuuacccaauuaaugcuuaggcagguaaaguagauuucuguaggcaaaccaagguaaaaauaagucuauuuaacacagggugccuuugaaugaaacccauuauaaguguauuuacauauuucagauuucauggauauauucagaaauauuaauguaauauaauugaagucuaauauugcacccucaagcccagaguggaaaauaaaugacucuuucuaccccuugcccuucuacaccugucaaaguuaauuuuuaaccacuggcacauugcaaaacauucauccugaagagccugauucauaaaucuuguuuuaaaugcucugggcuugguucucaacccagacuaaaggcaagcacuaagguagagggaaaugacauucaaagaguuuuacuugucucugauuuaauuuuuauugguuuaaaauguggucugacauuagaggguugcuucaaaggugaaaaaugaaacuuugaaaaauuacauguuuguagaugcguagaacuaaacgggcaagccacacuagguuuugucaaacaauaguuuuauuuguguccugagagacacagguauuuugguauguauguguuuaggagggguauauagucaguuuuacuuuuguuuucacagugcagaugucucuuugucucaagggacaaagaucugagggagaauugcaggggggacuacuuuauucugcuaagcaguggggaugccuuuaucagaaaccugguagaaugugucagaguuuauacauacguaaaccugggcuuauuuauauacuuaaauggauguuuuccuuagcauaaugucaguuaagaccaguggauauggagcaaauaauuugaauuacccuaaaaggcccucuguucuaaguugucuuaaguuaaaauuaugaagagagguauucauuuuacccuuagaugaagauuuugguuaauuuuuguugucuauucuuuuuuucauggucuuuguucauaaaugauguccagaaaaagaagaaguuuucuagguugaaagcugcuugugcaacauuugccacuugauggugacuuguacauaugaaauauaguauucaguuuguaacuuuugaacaguuuaaggaucaagagacauuuuccuaacuauaucugcugagaagugaaacaaugggcuguauuugccucugaaaugaguuuuacgaaacuuugaggaaagggagaaugauacauauuguuuuaaagaauccagaagguaaaguuaguuuuccagugugucuaggccuuugaggucccagagaaaugcugacauuaaaauaaaaguuuuccuacaacacuagcagcuucgugaaaacuguacuuuugauuuacuaauuagugagucauauagaucaagugacaguaauacaauuauguacauuaguuggugucaaauuuggacauacgaaauauacagaaaguugaugguuuucucccaaagcaggaauuacugauucaguucuaccagcagagggcucccuuuuuuaagcuaauaaagaacaugugucuugcagaucacuuuuuaaacacuaaaauucaacgggaaaaagauucagcucacacuuuccuaauauaauaggaccucuuugguagaugauuguacauauugugagaaauuuguuuaaggcaaaguuuuuccaaucuauuucaagacuuucuauacguugagagaguacugcuuuccaguggcuuauuuucuucugaaacagaaaauauacugguggacuuaacagagcauuuuaaucuuagaagguuuugacaugaaacaucaugugaauccagacagguaugcuuaggagacugauguuuccaauguuucuagcuuuagaaaggcuauuuuuaaaaguagggcaagauuaugcagcucaggaugcaaggguauucucugaacuaaccauaugucccuaugaucagauggcagauucacuuauagacuguuauuuccauugggaaaguuuuucaauauuauaucaguugcacuaaaggaaaguuuguaaaaucacuuucauuguggguuuaacagcacuuuccagauauuucaaguaacccugaagcuaguugcugcuguuggccuguguggacuuuaugugaccacuggaucacuuucccaugcagaguaugaggguauuauugaaagaaccuaugucuucaaagggaaugaaauguuuuguuuuaauuuaagcaagcuaaaaauagaaaacagaaaaaaccagaguuuuguuaggggugugaaauuuuuugcauguggcuuaaaagauuaacuucaguuuuguccauuuuuuuuuacguucucuagcaaagggaagugaggagcagggacaauggguagagaagggcauuugaaaccaucagaagauuggguucuagucuuagggcuauaaucuucuguaaaccacuucaccucccugggucagauuucguuuuccccucuauggcaugcaggaauugauugaagugaacucuaaauuacuuucugguguaaaguuuggugauuucccuggauaaccuuaaagcuaucuaugcucaugcaacugaaaauuuucuuagaucaaauuuuaauuaaauaguagucaguaaucccaagucugguccauugccacuuucucaaauaaagggcaaacauccgcuuagaaagguaugcccuucucugcccuucuauccuuuaccccauuagcuggcacauaaaccuaaugcagagacaccuuuuaauuagcaggucauauggccauuuaaaugcgaguugcaaucgaccucauaaaaauagccgcaguguuguuuuauucugaaucgucacaugaucauggaguauaguaugcauauggugugggguuuaauauucguccgaggaugcccuccuacuacuuacuauugaacauuuuuguaaucuccucccugcccgaguugcucacaagggcuuuccuguuacaccugcagggcugucugugcuggugugugggaggaggugcaagagguggacacgagcgaggcgcuguguucuggguuguuccaagagguucaggccuuuacaagugaggcuuugauucuauuuuuugcugaacuagcucagccacuuccuguguuuggcugugcauagugccucgcuucacugucggcuacuugagccccgcgagccagccagcgcgcucagcagccagugagacuauuuuagguccccucacaauggccuucucauuucccaggcgaaaaugagcaaguuggucuugcauuggccacuugucagccgaugacaacuuugacuugggcuccccucccccucccgaaaucccuagcucagcaaauauuugaaccugcccaaguuaaucaugaagcugcgaucuuuaucuaagggagacgugcgagcgccugggcuccuuuccuccccgauacaguagcgaaauccaguuggcuucucaaugaggagccggcagugagcggcgguggcccggacgcacugccgggcggggcguggggcggagggacgagccgagccgagccaagcggagcugggccacugugcacgcccggaggguccuggcggcgcccccgcuccugcgcgcacucucggcgccggacacgagcacugccugccgggaacaggcuggggggaggugcgggggcuuggcccacuugguggaagaacagcuuuggggauuuuuuuuuuuucauugucggauacaggcauuucaaagggaaaccguugaaaugcauaaccugcaaaguaaguugccuugaauuugugcacuucucuguuccuuaucugagcggugccuuucuguaguuugucuuggaguacgugugugugcgugcgccccuguaagcgcugccuggggaggacagaugggagauuaggggagacacucccccuguccucgagggggacaguggcugggaaagauaggguuuagguuggaauuucaguaagaagguacuaauuacaacgugcuugguuggaaguuggugccaggccagggcuuggagagaccaugggaaaaucaccugucucccugccuucucccugaguuaguuugccacagaagauccaacagccagacugguuugcaccgacgguucccaaaugcauggacuggcacucugggcuguuacacccgccacagcugcucggagaacuugucuccuugcuucgggggagggucgacauuuuaauuaaacuaaaaaagaauguuuuucugaaucuuagggcauacagccacuuuuaccauuuuuauuugaauuugaguucagguaaacuuaggcaaauagaaaagugggagagggugggaagagacaaggugagccugcuuuucccaauacugggaaaaugaauuaaacuagacgggggacgucagagaacagaaugccuugccuuuggucugcuuuuuaauauauuuuaugaucccaaauuuuacagaaagucucaaggguuucuguguuuuuuaaauggucaaauaugugacauacauguguacauagaucacagagccccacuguaguuuuuuaaaugagccacauuuaccuuggggaagagccccuccccccccgccaucauaauauugugaauguaaagagagauugguucacaaugagaauguacaguaggcuccuauaagggugacaggauuauaugcagaaugacuuugaagagccaaaauugauuuauuuauguuaaguagugcuaagaaggaauauuugucccggagugaggcauuugagauagagggggaaaagcaaaaaaaaaaaaaaaaaaaaaaaaaaagugauuacaucaucuucccguucaagcaguauuaguagcgaagauggguucaucagugaaauauuuugcaaagauaaauauaccuccacucugcauucugaucuauagccucuuucuuuuuggaagaagcauuuucuuugcccaguuuuuuuaggcagucacauuaaaauucucauuaauaauguugacagacaauuacguuuauuauuucugcuaauaggcaucugcauuccuauucagaauuuucauuguuagucuauaaagucuaguuuuaacuuuggaauguuugguagaggaggacaucuauacauuuucuuuuaacuguccuuucuaaugugguacauuugugacaguguuugaauucuggguuuucagugaauuauggaggacuaaaauaccaggaguaguccguacugcuucucuuauacaugagagauaucuaaggacuauaaaacauaacuuaaguauacccuuuuaaugccuuuguaagauuuuuaaaccaaggaaugacugggcuaucuauaaacccagaugcacuaaguggggagaaaagcucggagcugcagcauaucagcuuuugucaaccugccaacagcagagcguaccaugcugcaaggaguaauaaacaaggaauuagaaaacucgcugcuggagaacagucaaauuaaacaccuuuuugaaaggaugagcauguauauauugcaguucuauuaaauguagcuucuuagugagguuggcauuauguuaaggcugguauggaagagaacugaugaagcaggaguggucuggugacauuuuucugacuugauuggcuggggcgugugauguaauagguuucagugcagccccuuauagguuuuaaaaugaauuccaagacaccauuacaaagaaagccggacucuuuucuuauaacugagcucagccaaggaaacucuugcacaaauguacaauacuguuuggaauauggaagaccuggauuuagaauaugccaagacagauauaaauuguggcacagacuugauguuuuauauagaaauggacccaccagguaauacugcaguauuauuguagagaguuaguuaauuucguggcuuuuuaauuuuucgaaagcuacuguaaaagauccuuuuuggauuucuguuuuuauuaauuuguuucauugauaaaaauuaguuugcucauggcuuaaaaauuaaacagauuguuugacugucuguggaagcaagcagcucaggcugugugugguaaaugcuuauucuuacuugaauggauaugaauugaacuccaguuuuucacuggugucuuuuguuaaucgagauccuucccugggugaguuauguugugggauauugucccuguaauuaaaaugaugcaucuuuugugcugcuuuucucuguugccaguggaugagaacaguguagcacuuugcagugauaacacuugguacuuuagaaagcauguaaaauguagcagugauuacaacucaguucucuaaauguugagacuuugcuugcucucucauauuaagauauuauaaugaaaaaagaaguugacuuuccauuauuguuagucuuuguaaaauauucuugguagauaccugaaaucauuuuuuguauaaguuaaaauaguaacagugcuuuaaaacuuaugacagaauuuaccuaaaaauccuagauuuauuuuguuuccuaaguaaguuguuuuauuccaauguuagcucucccccugcccccauuuaagguauucaggaauacugcagucuuuuauuugucaccaauugguauauaugaauacugauuugacauugaggaagggggauaucauuuuuaaucagaccuaguauauagagcacaauuuauccaacagaauauuaacauauuaaagagauuuagggcacagaugagaguuucuuaaaguggcuuuuggcagaacagugccugaaauacuaagauuagagaaacccaauugcuccucuuaaaacauacugcuguagaugagccuuuuuauuacugcaacagaguuuguggaggacagagaccaaauuugucuuucguaauuaaauaagaggaaauuaaagccaacucauguuauuccugcuacucauauguucauaguuucuuacuuuagauggauuugaccaggcaugaaacuuuaauauaacuagaaucuagaaguacagaaugucaugacucuggauuuacuuugaaauuuauucacauggccagcccaauuuauuuguuaguuucuaaggcucucucucuuuucuccuuuucaguuucauuucuuuuugagccaugcucugaaagauuuuuuuuaagaaaauuaucuuccauauugcauggaauugugaacuaaugcuauauauuucaguuacucuaacuuuuuauuuuuuuaaaguaaaaguauucaucuaaagaaauuuaguucuaauguaguugggauugcgaacaacuuuuucuuuuucaucugcagcacugccuccuaaaccaccaaaaccuacuacuguagccaacaacgguaugaauaacaauauguccuuacaagaugcugaaugguacuggggagauaucucgagguaaggcuacagaaacuucauuuucagagaguuuuagauuaaaagaaagaaaagcaccagcuugcuaaguuccauuuuuaggauaucauccaacauaagcaugaagcauaguugguucucuuccaaagacgaccagaaaaagucacugagcacuggagaacugugggugcuggaugccacaggaaauuaaauacccgggaaguuucauuauugacagagaugucagugaagugccagagugaaguggcacugccuaagaacagagugugaaggcacucuaucuauuaagcacaacucuaagaauucuugccuuaaacacaauaagaaaacaaugccauuuuauguuagcuuugggaagggggaguaagguuggagaaacucuuuugagaucaugaguuucugugcucauuugucagagagauuguaauguuugguugaaaaaauaaaaacuuaguaccacagauacaccaauagugaaagugauaugcaccuguuugugaugagacugcaauugcuaacauuucuauuuaaacaaauuauuagcucuuauuagugagcucugaaaaugcaauucauuaauuuaaaucuaugugggcaggaggaauaugggcacucacuguacuuuccacuugauuuugcugugaaccuaaaacugcucuaaaaaauagccuauuuuaaaaaauauaaaucuguggucacuaaaccuuaagaugagcauuguuuuguguuuucauuucagggaagaagugaaugaaaaacuucgagauacagcagacgggaccuuuuugguacgagaugcgucuacuaaaaugcauggugauuauacucuuacacuaagguaagccagggaauauagcugaaauuaggguuuugggcugauauuaaaacauauuuccuuauuccaaaauguuaauaccuuuauuuuuauauuguuuuuacaggaaagggggaaauaacaaauuaaucaaaauauuucaucgagaugggaaauauggcuucucugacccauuaaccuucaguucugugguugaauuaauaaaccacuaccggaaugaaucucuagcucaguauaaucccaaauuggaugugaaauuacuuuauccaguauccaaauaccaacagguaauaaaaacugaaugaauuauccaguuacgauguuuagacaagauccuuuuaauacuuagaaaacauuugaagcagaugaauuacauguaaucaagucuaaaaaacuugacacucguaauuacauaauugcaauuuuaaagauguuuccaugucagcuauuuuguuaaacaauuguuauuugauuaaauaccuuauccauugaauuuauuuuaaucuuucuaggaucaaguugucaaagaagauaauauugaagcuguagggaaaaaauuacaugaauauaacacucaguuucaagaaaaaagucgagaauaugauagauuauaugaagaauauacccgcacaucccaggugaguuuucuaugaaaaucagauuaaaaaauaagaguucuaaacuuuuaaagacuaacauggaaaaaagaauuuaaaagguugaguuuuuacgaaugaggugggggugagagcauuuauuugugaaucauuguugauuauucuaguguaauaucucuaaagcuuuaaaccaaaaauuuuaaguaucagaauaauaaauuaaguucacgugauaacugaagcagucacugaguuucaaguugauuuaauucgugauagaaggauccuguuuagauuggaaguuaguaauaacuggaaguuucacagacuugucuaaucccugaaauggagauuuaggcauuaauauauauccuaccaugaaaaggaagggcuauauacugcugugcuuuucuagacccuuauucuucacuggucacucauguaucugggaaugccagagggaacagaaaacaacagggaugcuauaaacuacaauagcuuuuaagaagauaaaaacuauaggaaauugcuacgcaaucauuuuucauagauugagaaaauucuccagaggaaauacuuguuucugggauacuguuuuaauggauuuuaugaauuugagucccacucugcuaauaauacagaucaaauguccugguagugucuugcaguaagagauuguucuaugaaagguaugacauuaucuuuuuaaaauuauguugcaggaaauccaaaugaaaaggacagcuauugaagcauuuaaugaaaccauaaaaauauuugaagaacagugccagacccaagagcgguacagcaaagaauacauagaaaaguuuaaacgugaaggcaaugagaaagaaauacaaagguugguguuucccuuguucuugugcuagagauaaccaaaauccucuaaaaccauuuaaagaugaucucgcuuucugugcuuugaaugaucacguggacacaggaaggggaauaucacucuggggacuguggugggguggggggaggagggagggauagcauugggagauauaccuaaugcuagaugacgaguuagugggugcggcgcaccagcauggcacauguauacauauguaacuaaccugcacaaugugcacauguacccuaaaacuuaaaguauaauaaaaauaaaaaaauaaaauaaaauaaaauauguugagccacuccaaaaaaaaaaaaaaaugacaggaagagaagccacgcuuuaccuaaggaaaacugcugggaaaccauagugaaacuuuucauaaacuuuggggaccguuccugauguacccagauaauaacaaauacguuucuuuugccugcaggauuaugcauaauuaugauaaguugaagucucgaaucagugaaauuauugacaguagaagaagauuggaagaagacuugaagaagcaggcagcugaguaucgagaaauugacaaacguaugaacagcauuaaaccagaccuuauccagcugagaaagacgagagaccaauacuugauguaaguauuugaaauggaauccuauacaugaauaauuggugauugcuacaauucaggaugaguuaaugcguucucuuuucaaaacuguuuuucaggugguugacucaaaaagguguucggcaaaagaaguugaacgagugguugggcaaugaaaacacugaagaguaaguaguuacuaaagauggugauagcagaagauuuuucucauuuuaggaaaaugcaugacuugcuuuguuuuuagaacaagugaggaauuuuacugaguuuggaacaucuuguaggagaaaauguauaaacucagugccauuauccagaauuuuaaaaaaagaaagcuuagcuaaggaggacuaggauuuauuuuuacucauaaugcugugaaacaacucucuguguccauaaugaugucccugaacaucugaaaaaucccaaaauauuuuuggaacagucagagaaaaaauaauuaugcuuaauauauuuuaaagcuuaaguauauacuuuguuugaauuagucaaaaacuggcaaucugccuagucaauuuccugaucuaaacuggauaaacgagauuguuuuaauaccuuccacucugcccagguaccugagugugguugcuugaaaacagaaauaguacaguugauugguaacucuuuguccugggagguugcacuggaggcugaauaccaggagaggaaaacucaggucgggcagaggcaggcaugugauggccagucugacuggcuugguaggggccaggagggaagugacggggguaugccuagggaagacagcaaggcaggcugauggcuccugcacucuucauuuagaaacuuucuguccugccugccuagccaauauucacugguggaagaugaugaagauuugccccaucaugaugagaagacauggaauguuggaagcagcaaccgaaacaaagcugaaaaccuguugcgagggaagcgagauggcacuuuucuuguccgggagagcaguaaacagggcugcuaugccugcucuguaguguauguaucuccagcaaacuuuucuuuacaacaucucaugaagagauguuucauuuauucauucauugaguuuugggggcaaagauuugacauaguuuuagucuugaauaagcuuacaguacaauaauguagaagagaaaccaaagcagcuguaauaccauuuuaaagucuagccagaaguguauguuaauacagucuaauagauaccuacuguuuaguuggaagacuagguuuggauucccauucagugcuaauuaaucaugagaaaucgccaagucuuuuuuucucaucuuuaaaauggaaguggcagugccugccuuuuuugccucucaaggcuacuauaguuagaaucugagguaauuuaugugagaacaucacccauaggaaaaauacucaucaggaacaggugaaaaaaaaaaggauucugaucauuauccuugagauagguacacccacauuggaucacugacaucaccauuuccaagaaauuaauguccucuaguagggaaugguucuaaaaguauguuacacuccaugaucaccuuucauuuaaugagagaaauaguccuacagcaaagaaggguacuuuuguccuuacugugcauaagggcacaugcagagauggagaguugugcagacaccucaaggacagccagaaagaaggaauccuaugaauagucauaaugggaguaauaguaacacugcuagucauggagcacugcagauaguuguccucaucaugauuggaagcuaccacuuguugcaugcuuacugcaugucaggcauucuaucuagcauuuugcaugcaugaucucauuucauuucucaaaguaacuguauuacauguauuuuacuauugucuucccuuuaaaccauuuuaaagaugaaaauacagucagucagugaagcuggguuaccuacccaaggcacucggccaggugucaguuguaaccuaggacccuuuccccaaguugagacugcacaauaaugcuuuuuauuaaagaugcccugaagaguugugaauugucuuggacaagcucaaaagacaguuuuucuucucuccucucuaggguggacggcgaaguaaagcauugugucauaaacaaaacagcaacuggcuauggcuuugccgagcccuauaacuuguacagcucucugaaagaacuggugcuacauuaccaacacaccucccuugugcagcacaacgacucccucaaugucacacuagccuacccaguauaugcacagcagaggcgaugaagcgcuuacucuuugauccuucuccugaaguucagccacccugaggccucuggaaagcaaagggcuccucuccagucugaucugugaauugagcugcagaaacgaagccaucuuucuuuggaugggacuagagcuuucuuucacaaaaaagaaguaggggaagacaugcagccuaaggcuguaugaugaccacacguuccuaagcuggagugcuuaucccuucuuuuucuuuuuuucuuugguuuaauuuaaagccacaaccacauacaacacaaagagaaaaagaaaugcaaaaaucucugcgugcagggacaaagaggccuuuaaccauggugcuuguuaaugcuuucugaagcuuuaccagcugaaaguugggacucuggagagcggaggagagagaggcagaagaacccuggccugagaagguuugguccagccugguuuagccuggauguugcugugcacgguggacccagacacaucgcacuguggauuauuucauuuuguaacaaaugaacgauauguagcagaaaggcacguccacucacaagggacgcuuugggagaaugucaguucauguauguucagaagaaauucugucauagaaagugccagaaaguguuuaacuugucaaaaaacaaaaacccagcaacagaaaaauggaguuuggaaaacaggacuuaaaaugacauucaguauauaaaauauguacauaauauuggaugacuaacuaucaaauagauggauuuguaucaauaccaaauagcuucuguuuuguuuugcugaaggcuaaauucacagcgcuaugcaauucuuaauuuucauuaaguuguuauuucaguuuuaaauguaccuucagaauaagcuuccccaccccaguuuuuguugcuugaaaauauuguugucccggauuuuuguuaauauucauuuuuguuauccuuuuuuaaaaguaaauguacaggaugccaguaaaaaaaaaaaauggcuucagaauuaaaacuaugaaauauuuuacaguuuuucuuguacagaguacuuggcuguuagcccaagguuaaaaaguucauaacagauuuuuuuuggacuguuuuguugggcagugccugauaagcuucaaagcugcuuuauucaauaaaaaaaagaaaugaaaaagauauaugaauaugacaaaguauugcugaguccaacaauguuguuuuaagacucuuaaaauacgguaccuggcaauguuuauuucauaaagaauugugaacuucuugaaucuagggagggggaauguagugaagggauguaucaagugggguggugggagggggaggcaagguuauaugcacuuucucaugauuuacagagaagugaauaacugcaaagugaaguugcuucuucuacuucagucuucucucacuuugauuugcuaguuguuaucaauuaaugacaauuacaaaccuacuguaucucuaauacagugugacuggucagguauuucaguucuuaggaaggaagugccaaguuuguuuuuggguuccuggaacagcgcucaccuuuguuuagaacacugguuuaaagggauaaucaucucugucacauuagacuauccaucaugaccagcaaauacucauuuuaggaaaaaaaaaagcaugaucugaaaaauacuuuuggugguauguugguuacccuccuagcuuuccauuugguuuagaacauaaagcaaauagacacagucauacugucacugcucuggacuguguggagcucgcuaaagucauggucauugcaggaauccaaguggcaguccuucucauucauucuaaucauuguaugugcuucacuacgggggggagaaggaaacguuagcaucauguuucccauuuagggcaggagugagaggucucucuuccugauuuagauaugcaaaagcugguauguucaguaggaacuguacauguguugggaggcauaaagacuaauuagcaaccauaauauggucacuacccuaauagacuaaaugaaaucuugcaauuucaaauuacucuuucuccauauuagauuuacccacagcuauauuucuguuuaaguacuagggugaggguuuucuguuacuuuguuuuuuaauguuguuccuuuugaaagaaucagucuugcagcugagugaaaaaucuguggaauguauuauuuguccucuuuacaugaaacuacucauacuuaagcaaaagucagucuuauagcaagacuguuagcccucaaacuugacucuacugaucugaccauuucccucucaucgccagacaacugacgauuucccugguuuuagucugcgucucugcuuuaaaguuauugugauauccuucuagaucauacacaagucuaacaguuaauuaguuaacaguuuuuaaacuagguuuguggguauuuuuuugguagcacauguaugcuauuacauacaaauuuuuauuucuaaaauauaagaucugagauugaauauuuucauuaaaagcuacaguuuugugaaucuuugugcuucaacauucuuugcaagaugauacgguauuuaggcauuugccuuauuuuugcaucucacaaacauaagugcaauagaucuuuucauugaacagcaaaguaggauucaucauuccauaugacuugaguuacaccagaccuguucugcccaaugccuuuuugauuacaguguagcuugcccaccgcauuugucguuuuagauacuuugcuagccggccacuuuggauuucaucagacaguccuaacaauauugucugaacggcugaauaugaauagauacagcagaggcacuccugauauaugauuuuuauccaugcgucaguuuuucccacccaguguagcauccuaaagauaaagccagaagcuaagcugcagugaggcugugauugggcguagaagugggagcauugggaccucacauuacacacacgagagaucauaaccaugugaaaaggcaaaaagcauguguuugcaacaucugauaacuucauggccuuugauaaauguauauauguauaugugcauggacuguguuuccaguacaccuuucagccaaaacagauccacaguaguuguugaguucaaguacauaaaguacauaacaagcgaacgucuaguacaauucuuacuuauguguaugggauuuuucccuuugagguugcuuuguuuugucuuacaaaggugaaaauuguuuguaagugaagugagaaguucauauuucuuuggcuuuuuuguguuuuuaaaaguuacuccuuuuagggagcuggucugaugacuugcuuagcuuggaaauccuuguuuucagugugucgagucaaaauguguuuaugugagcugucacuguggggaaccaauugcuuugucauauagcugguuaugaacuaguaacauguuugggaaguccuacugauguuccuuuggaagaaaaaaucugcugguuuuaacaacugugcuuuugcuauguaugguauccaaguuaguugaaacgcagacacugagaucuguuugaguuuagggucauuuuuagaaaggggcaguuuaaagcacaaugucucacaugggacaaaguuccaaaaugccaaauucuuauuuuuuaaaaagcuaguucuauaaaauacugguauuauggguggggaggaaauagaauugagucaauuggaaagacuauccaacuuaacaugaaacuugucaccaugagauagcauuagcugcccaggaugcugcuauauauauauauauauauauauauguguguguguguguguguguguguguauauauauauauauauauauauauauauauauauauauauguguguguauauauauauauauguguauauauauauguauauacauauauguauauauaugcacauauauauauguauuuaaaaaaaucaaaacaaaaaaaaacucauuuauaccuguguauuuuuuaaagcuacaaucuguucaauguuuuuaaaaaucuguuuauaugacauuguuaaaauaaaguuggucuuuugacgagagggaggaugucacggucaguuguaacuuugccuucacaaggcaacuggggugggggguggggguagugugccuccuugacauuucguucaaguuauagauucaauggagcuaugucuuguuuuaaguugcuuuaaugcauuguauuagaucuucaaacagaauaaagguuguuuugaaacugaa

SEQ ID NO: 61561 - RNA, 13398 nt, Homo sapiens
agcgaaauccaguuggcuucucaaugaggagccggcagugagcggcgguggcccggacgcacugccgggcggggcguggggcggagggacgagccgagccgagccaagcggagcugggccacugugcacgcccggaggguccuggcggcgcccccgcuccugcgcgcacucucggcgccggacacgagcacugccugccgggaacaggcuggggggaggugcgggggcuuggcccacuugguggaagaacagcuuuggggauuuuuuuuuuuucauugucggauacaggcauuucaaagggaaaccguugaaaugcauaaccugcaaaguaaguugccuugaauuugugcacuucucuguuccuuaucugagcggugccuuucuguaguuugucuuggaguacgugugugugcgugcgccccuguaagcgcugccuggggaggacagaugggagauuaggggagacacucccccuguccucgagggggacaguggcugggaaagauaggguuuagguuggaauuucaguaagaagguacuaauuacaacgugcuugguuggaaguuggugccaggccagggcuuggagagaccaugggaaaaucaccugucucccugccuucucccugaguuaguuugccacagaagauccaacagccagacugguuugcaccgacgguucccaaaugcauggacuggcacucugggcuguuacacccgccacagcugcucggagaacuugucuccuugcuucgggggagggucgacauuuuaauuaaacuaaaaaagaauguuuuucugaaucuuagggcauacagccacuuuuaccauuuuuauuugaauuugaguucagguaaacuuaggcaaauagaaaagugggagagggugggaagagacaaggugagccugcuuuucccaauacugggaaaaugaauuaaacuagacgggggacgucagagaacagaaugccuugccuuuggucugcuuuuuaauauauuuuaugaucccaaauuuuacagaaagucucaaggguuucuguguuuuuuaaauggucaaauaugugacauacauguguacauagaucacagagccccacuguaguuuuuuaaaugagccacauuuaccuuggggaagagccccuccccccccgccaucauaauauugugaauguaaagagagauugguucacaaugagaauguacaguaggcuccuauaagggugacaggauuauaugcagaaugacuuugaagagccaaaauugauuuauuuauguuaaguagugcuaagaaggaauauuugucccggagugaggcauuugagauagagggggaaaagcaaaaaaaaaaaaaaaaaaaaaaaaaaagugauuacaucaucuucccguucaagcaguauuaguagcgaagauggguucaucagugaaauauuuugcaaagauaaauauaccuccacucugcauucugaucuauagccucuuucuuuuuggaagaagcauuuucuuugcccaguuuuuuuaggcagucacauuaaaauucucauuaauaauguugacagacaauuacguuuauuauuucugcuaauaggcaucugcauuccuauucagaauuuucauuguuagucuauaaagucuaguuuuaacuuuggaauguuugguagaggaggacaucuauacauuuucuuuuaacuguccuuucuaaugugguacauuugugacaguguuugaauucuggguuuucagugaauuauggaggacuaaaauaccaggaguaguccguacugcuucucuuauacaugagagauaucuaaggacuauaaaacauaacuuaaguauacccuuuuaaugccuuuguaagauuuuuaaaccaaggaaugacugggcuaucuauaaacccagaugcacuaaguggggagaaaagcucggagcugcagcauaucagcuuuugucaaccugccaacagcagagcguaccaugcugcaaggaguaauaaacaaggaauuagaaaacucgcugcuggagaacagucaaauuaaacaccuuuuugaaaggaugagcauguauauauugcaguucuauuaaauguagcuucuuagugagguuggcauuauguuaaggcugguauggaagagaacugaugaagcaggaguggucuggugacauuuuucugacuugauuggcuggggcgugugauguaauagguuucagugcagccccuuauagguuuuaaaaugaauuccaagacaccauuacaaagaaagccggacucuuuucuuauaacugagcucagccaaggaaacucuugcacaaauguacaauacuguuuggaauauggaagaccuggauuuagaauaugccaagacagauauaaauuguggcacagacuugauguuuuauauagaaauggacccaccagguaauacugcaguauuauuguagagaguuaguuaauuucguggcuuuuuaauuuuucgaaagcuacuguaaaagauccuuuuuggauuucuguuuuuauuaauuuguuucauugauaaaaauuaguuugcucauggcuuaaaaauuaaacagauuguuugacugucuguggaagcaagcagcucaggcugugugugguaaaugcuuauucuuacuugaauggauaugaauugaacuccaguuuuucacuggugucuuuuguuaaucgagauccuucccugggugaguuauguugugggauauugucccuguaauuaaaaugaugcaucuuuugugcugcuuuucucuguugccaguggaugagaacaguguagcacuuugcagugauaacacuugguacuuuagaaagcauguaaaauguagcagugauuacaacucaguucucuaaauguugagacuuugcuugcucucucauauuaagauauuauaaugaaaaaagaaguugacuuuccauuauuguuagucuuuguaaaauauucuugguagauaccugaaaucauuuuuuguauaaguuaaaauaguaacagugcuuuaaaacuuaugacagaauuuaccuaaaaauccuagauuuauuuuguuuccuaaguaaguuguuuuauuccaauguuagcucucccccugcccccauuuaagguauucaggaauacugcagucuuuuauuugucaccaauugguauauaugaauacugauuugacauugaggaagggggauaucauuuuuaaucagaccuaguauauagagcacaauuuauccaacagaauauuaacauauuaaagagauuuagggcacagaugagaguuucuuaaaguggcuuuuggcagaacagugccugaaauacuaagauuagagaaacccaauugcuccucuuaaaacauacugcuguagaugagccuuuuuauuacugcaacagaguuuguggaggacagagaccaaauuugucuuucguaauuaaauaagaggaaauuaaagccaacucauguuauuccugcuacucauauguucauaguuucuuacuuuagauggauuugaccaggcaugaaacuuuaauauaacuagaaucuagaaguacagaaugucaugacucuggauuuacuuugaaauuuauucacauggccagcccaauuuauuuguuaguuucuaaggcucucucucuuuucuccuuuucaguuucauuucuuuuugagccaugcucugaaagauuuuuuuuaagaaaauuaucuuccauauugcauggaauugugaacuaaugcuauauauuucaguuacucuaacuuuuuauuuuuuuaaaguaaaaguauucaucuaaagaaauuuaguucuaauguaguugggauugcgaacaacuuuuucuuuuucaucugcagcacugccuccuaaaccaccaaaaccuacuacuguagccaacaacgguaugaauaacaauauguccuuacaagaugcugaaugguacuggggagauaucucgagguaaggcuacagaaacuucauuuucagagaguuuuagauuaaaagaaagaaaagcaccagcuugcuaaguuccauuuuuaggauaucauccaacauaagcaugaagcauaguugguucucuuccaaagacgaccagaaaaagucacugagcacuggagaacugugggugcuggaugccacaggaaauuaaauacccgggaaguuucauuauugacagagaugucagugaagugccagagugaaguggcacugccuaagaacagagugugaaggcacucuaucuauuaagcacaacucuaagaauucuugccuuaaacacaauaagaaaacaaugccauuuuauguuagcuuugggaagggggaguaagguuggagaaacucuuuugagaucaugaguuucugugcucauuugucagagagauuguaauguuugguugaaaaaauaaaaacuuaguaccacagauacaccaauagugaaagugauaugcaccuguuugugaugagacugcaauugcuaacauuucuauuuaaacaaauuauuagcucuuauuagugagcucugaaaaugcaauucauuaauuuaaaucuaugugggcaggaggaauaugggcacucacuguacuuuccacuugauuuugcugugaaccuaaaacugcucuaaaaaauagccuauuuuaaaaaauauaaaucuguggucacuaaaccuuaagaugagcauuguuuuguguuuucauuucagggaagaagugaaugaaaaacuucgagauacagcagacgggaccuuuuugguacgagaugcgucuacuaaaaugcauggugauuauacucuuacacuaagguaagccagggaauauagcugaaauuaggguuuugggcugauauuaaaacauauuuccuuauuccaaaauguuaauaccuuuauuuuuauauuguuuuuacaggaaagggggaaauaacaaauuaaucaaaauauuucaucgagaugggaaauauggcuucucugacccauuaaccuucaguucugugguugaauuaauaaaccacuaccggaaugaaucucuagcucaguauaaucccaaauuggaugugaaauuacuuuauccaguauccaaauaccaacagguaauaaaaacugaaugaauuauccaguuacgauguuuagacaagauccuuuuaauacuuagaaaacauuugaagcagaugaauuacauguaaucaagucuaaaaaacuugacacucguaauuacauaauugcaauuuuaaagauguuuccaugucagcuauuuuguuaaacaauuguuauuugauuaaauaccuuauccauugaauuuauuuuaaucuuucuaggaucaaguugucaaagaagauaauauugaagcuguagggaaaaaauuacaugaauauaacacucaguuucaagaaaaaagucgagaauaugauagauuauaugaagaauauacccgcacaucccaggugaguuuucuaugaaaaucagauuaaaaaauaagaguucuaaacuuuuaaagacuaacauggaaaaaagaauuuaaaagguugaguuuuuacgaaugaggugggggugagagcauuuauuugugaaucauuguugauuauucuaguguaauaucucuaaagcuuuaaaccaaaaauuuuaaguaucagaauaauaaauuaaguucacgugauaacugaagcagucacugaguuucaaguugauuuaauucgugauagaaggauccuguuuagauuggaaguuaguaauaacuggaaguuucacagacuugucuaaucccugaaauggagauuuaggcauuaauauauauccuaccaugaaaaggaagggcuauauacugcugugcuuuucuagacccuuauucuucacuggucacucauguaucugggaaugccagagggaacagaaaacaacagggaugcuauaaacuacaauagcuuuuaagaagauaaaaacuauaggaaauugcuacgcaaucauuuuucauagauugagaaaauucuccagaggaaauacuuguuucugggauacuguuuuaauggauuuuaugaauuugagucccacucugcuaauaauacagaucaaauguccugguagugucuugcaguaagagauuguucuaugaaagguaugacauuaucuuuuuaaaauuauguugcaggaaauccaaaugaaaaggacagcuauugaagcauuuaaugaaaccauaaaaauauuugaagaacagugccagacccaagagcgguacagcaaagaauacauagaaaaguuuaaacgugaaggcaaugagaaagaaauacaaagguugguguuucccuuguucuugugcuagagauaaccaaaauccucuaaaaccauuuaaagaugaucucgcuuucugugcuuugaaugaucacguggacacaggaaggggaauaucacucuggggacuguggugggguggggggaggagggagggauagcauugggagauauaccuaaugcuagaugacgaguuagugggugcggcgcaccagcauggcacauguauacauauguaacuaaccugcacaaugugcacauguacccuaaaacuuaaaguauaauaaaaauaaaaaaauaaaauaaaauaaaauauguugagccacuccaaaaaaaaaaaaaaaugacaggaagagaagccacgcuuuaccuaaggaaaacugcugggaaaccauagugaaacuuuucauaaacuuuggggaccguuccugauguacccagauaauaacaaauacguuucuuuugccugcaggauuaugcauaauuaugauaaguugaagucucgaaucagugaaauuauugacaguagaagaagauuggaagaagacuugaagaagcaggcagcugaguaucgagaaauugacaaacguaugaacagcauuaaaccagaccuuauccagcugagaaagacgagagaccaauacuugauguaaguauuugaaauggaauccuauacaugaauaauuggugauugcuacaauucaggaugaguuaaugcguucucuuuucaaaacuguuuuucaggugguugacucaaaaagguguucggcaaaagaaguugaacgagugguugggcaaugaaaacacugaagaguaaguaguuacuaaagauggugauagcagaagauuuuucucauuuuaggaaaaugcaugacuugcuuuguuuuuagaacaagugaggaauuuuacugaguuuggaacaucuuguaggagaaaauguauaaacucagugccauuauccagaauuuuaaaaaaagaaagcuuagcuaaggaggacuaggauuuauuuuuacucauaaugcugugaaacaacucucuguguccauaaugaugucccugaacaucugaaaaaucccaaaauauuuuuggaacagucagagaaaaaauaauuaugcuuaauauauuuuaaagcuuaaguauauacuuuguuugaauuagucaaaaacuggcaaucugccuagucaauuuccugaucuaaacuggauaaacgagauuguuuuaauaccuuccacucugcccagguaccugagugugguugcuugaaaacagaaauaguacaguugauugguaacucuuuguccugggagguugcacuggaggcugaauaccaggagaggaaaacucaggucgggcagaggcaggcaugugauggccagucugacuggcuugguaggggccaggagggaagugacggggguaugccuagggaagacagcaaggcaggcugauggcuccugcacucuucauuuagaaacuuucuguccugccugccuagccaauauucacugguggaagaugaugaagauuugccccaucaugaugagaagacauggaauguuggaagcagcaaccgaaacaaagcugaaaaccuguugcgagggaagcgagauggcacuuuucuuguccgggagagcaguaaacagggcugcuaugccugcucuguaguguauguaucuccagcaaacuuuucuuuacaacaucucaugaagagauguuucauuuauucauucauugaguuuugggggcaaagauuugacauaguuuuagucuugaauaagcuuacaguacaauaauguagaagagaaaccaaagcagcuguaauaccauuuuaaagucuagccagaaguguauguuaauacagucuaauagauaccuacuguuuaguuggaagacuagguuuggauucccauucagugcuaauuaaucaugagaaaucgccaagucuuuuuuucucaucuuuaaaauggaaguggcagugccugccuuuuuugccucucaaggcuacuauaguuagaaucugagguaauuuaugugagaacaucacccauaggaaaaauacucaucaggaacaggugaaaaaaaaaaggauucugaucauuauccuugagauagguacacccacauuggaucacugacaucaccauuuccaagaaauuaauguccucuaguagggaaugguucuaaaaguauguuacacuccaugaucaccuuucauuuaaugagagaaauaguccuacagcaaagaaggguacuuuuguccuuacugugcauaagggcacaugcagagauggagaguugugcagacaccucaaggacagccagaaagaaggaauccuaugaauagucauaaugggaguaauaguaacacugcuagucauggagcacugcagauaguuguccucaucaugauuggaagcuaccacuuguugcaugcuuacugcaugucaggcauucuaucuagcauuuugcaugcaugaucucauuucauuucucaaaguaacuguauuacauguauuuuacuauugucuucccuuuaaaccauuuuaaagaugaaaauacagucagucagugaagcuggguuaccuacccaaggcacucggccaggugucaguuguaaccuaggacccuuuccccaaguugagacugcacaauaaugcuuuuuauuaaagaugcccugaagaguugugaauugucuuggacaagcucaaaagacaguuuuucuucucuccucucuaggguggacggcgaaguaaagcauugugucauaaacaaaacagcaacuggcuauggcuuugccgagcccuauaacuuguacagcucucugaaagaacuggugcuacauuaccaacacaccucccuugugcagcacaacgacucccucaaugucacacuagccuacccaguauaugcacagcagaggcgaugaagcgcuuacucuuugauccuucuccugaaguucagccacccugaggccucuggaaagcaaagggcuccucuccagucugaucugugaauugagcugcagaaacgaagccaucuuucuuuggaugggacuagagcuuucuuucacaaaaaagaaguaggggaagacaugcagccuaaggcuguaugaugaccacacguuccuaagcuggagugcuuaucccuucuuuuucuuuuuuucuuugguuuaauuuaaagccacaaccacauacaacacaaagagaaaaagaaaugcaaaaaucucugcgugcagggacaaagaggccuuuaaccauggugcuuguuaaugcuuucugaagcuuuaccagcugaaaguugggacucuggagagcggaggagagagaggcagaagaacccuggccugagaagguuugguccagccugguuuagccuggauguugcugugcacgguggacccagacacaucgcacuguggauuauuucauuuuguaacaaaugaacgauauguagcagaaaggcacguccacucacaagggacgcuuugggagaaugucaguucauguauguucagaagaaauucugucauagaaagugccagaaaguguuuaacuugucaaaaaacaaaaacccagcaacagaaaaauggaguuuggaaaacaggacuuaaaaugacauucaguauauaaaauauguacauaauauuggaugacuaacuaucaaauagauggauuuguaucaauaccaaauagcuucuguuuuguuuugcugaaggcuaaauucacagcgcuaugcaauucuuaauuuucauuaaguuguuauuucaguuuuaaauguaccuucagaauaagcuuccccaccccaguuuuuguugcuugaaaauauuguugucccggauuuuuguuaauauucauuuuuguuauccuuuuuuaaaaguaaauguacaggaugccaguaaaaaaaaaaaauggcuucagaauuaaaacuaugaaauauuuuacaguuuuucuuguacagaguacuuggcuguuagcccaagguuaaaaaguucauaacagauuuuuuuuggacuguuuuguugggcagugccugauaagcuucaaagcugcuuuauucaauaaaaaaaagaaaugaaaaagauauaugaauaugacaaaguauugcugaguccaacaauguuguuuuaagacucuuaaaauacgguaccuggcaauguuuauuucauaaagaauugugaacuucuugaaucuagggagggggaauguagugaagggauguaucaagugggguggugggagggggaggcaagguuauaugcacuuucucaugauuuacagagaagugaauaacugcaaagugaaguugcuucuucuacuucagucuucucucacuuugauuugcuaguuguuaucaauuaaugacaauuacaaaccuacuguaucucuaauacagugugacuggucagguauuucaguucuuaggaaggaagugccaaguuuguuuuuggguuccuggaacagcgcucaccuuuguuuagaacacugguuuaaagggauaaucaucucugucacauuagacuauccaucaugaccagcaaauacucauuuuaggaaaaaaaaaagcaugaucugaaaaauacuuuuggugguauguugguuacccuccuagcuuuccauuugguuuagaacauaaagcaaauagacacagucauacugucacugcucuggacuguguggagcucgcuaaagucauggucauugcaggaauccaaguggcaguccuucucauucauucuaaucauuguaugugcuucacuacgggggggagaaggaaacguuagcaucauguuucccauuuagggcaggagugagaggucucucuuccugauuuagauaugcaaaagcugguauguucaguaggaacuguacauguguugggaggcauaaagacuaauuagcaaccauaauauggucacuacccuaauagacuaaaugaaaucuugcaauuucaaauuacucuuucuccauauuagauuuacccacagcuauauuucuguuuaaguacuagggugaggguuuucuguuacuuuguuuuuuaauguuguuccuuuugaaagaaucagucuugcagcugagugaaaaaucuguggaauguauuauuuguccucuuuacaugaaacuacucauacuuaagcaaaagucagucuuauagcaagacuguuagcccucaaacuugacucuacugaucugaccauuucccucucaucgccagacaacugacgauuucccugguuuuagucugcgucucugcuuuaaaguuauugugauauccuucuagaucauacacaagucuaacaguuaauuaguuaacaguuuuuaaacuagguuuguggguauuuuuuugguagcacauguaugcuauuacauacaaauuuuuauuucuaaaauauaagaucugagauugaauauuuucauuaaaagcuacaguuuugugaaucuuugugcuucaacauucuuugcaagaugauacgguauuuaggcauuugccuuauuuuugcaucucacaaacauaagugcaauagaucuuuucauugaacagcaaaguaggauucaucauuccauaugacuugaguuacaccagaccuguucugcccaaugccuuuuugauuacaguguagcuugcccaccgcauuugucguuuuagauacuuugcuagccggccacuuuggauuucaucagacaguccuaacaauauugucugaacggcugaauaugaauagauacagcagaggcacuccugauauaugauuuuuauccaugcgucaguuuuucccacccaguguagcauccuaaagauaaagccagaagcuaagcugcagugaggcugugauugggcguagaagugggagcauugggaccucacauuacacacacgagagaucauaaccaugugaaaaggcaaaaagcauguguuugcaacaucugauaacuucauggccuuugauaaauguauauauguauaugugcauggacuguguuuccaguacaccuuucagccaaaacagauccacaguaguuguugaguucaaguacauaaaguacauaacaagcgaacgucuaguacaauucuuacuuauguguaugggauuuuucccuuugagguugcuuuguuuugucuuacaaaggugaaaauuguuuguaagugaagugagaaguucauauuucuuuggcuuuuuuguguuuuuaaaaguuacuccuuuuagggagcuggucugaugacuugcuuagcuuggaaauccuuguuuucagugugucgagucaaaauguguuuaugugagcugucacuguggggaaccaauugcuuugucauauagcugguuaugaacuaguaacauguuugggaaguccuacugauguuccuuuggaagaaaaaaucugcugguuuuaacaacugugcuuuugcuauguaugguauccaaguuaguugaaacgcagacacugagaucuguuugaguuuagggucauuuuuagaaaggggcaguuuaaagcacaaugucucacaugggacaaaguuccaaaaugccaaauucuuauuuuuuaaaaagcuaguucuauaaaauacugguauuauggguggggaggaaauagaauugagucaauuggaaagacuauccaacuuaacaugaaacuugucaccaugagauagcauuagcugcccaggaugcugcuauauauauauauauauauauauauguguguguguguguguguguguguguauauauauauauauauauauauauauauauauauauauauguguguguauauauauauauauguguauauauauauguauauacauauauguauauauaugcacauauauauauguauuuaaaaaaaucaaaacaaaaaaaaacucauuuauaccuguguauuuuuuaaagcuacaaucuguucaauguuuuuaaaaaucuguuuauaugacauuguuaaaauaaaguuggucuuuugacgagagggaggaugucacggucaguuguaacuuugccuucacaaggcaacuggggugggggguggggguagugugccuccuugacauuucguucaaguuauagauucaauggagcuaugucuuguuuuaaguugcuuuaaugcauuguauuagaucuucaaacagaauaaagguuguuuugaaacugaa

SEQ ID NO: 61562 - RNA, 11183 nt, Homo sapiens
uagguuuuaaaaugaauuccaagacaccauuacaaagaaagccggacucuuuucuuauaacugagcucagccaaggaaacucuugcacaaauguacaauacuguuuggaauauggaagaccuggauuuagaauaugccaagacagauauaaauuguggcacagacuugauguuuuauauagaaauggacccaccagguaauacugcaguauuauuguagagaguuaguuaauuucguggcuuuuuaauuuuucgaaagcuacuguaaaagauccuuuuuggauuucuguuuuuauuaauuuguuucauugauaaaaauuaguuugcucauggcuuaaaaauuaaacagauuguuugacugucuguggaagcaagcagcucaggcugugugugguaaaugcuuauucuuacuugaauggauaugaauugaacuccaguuuuucacuggugucuuuuguuaaucgagauccuucccugggugaguuauguugugggauauugucccuguaauuaaaaugaugcaucuuuugugcugcuuuucucuguugccaguggaugagaacaguguagcacuuugcagugauaacacuugguacuuuagaaagcauguaaaauguagcagugauuacaacucaguucucuaaauguugagacuuugcuugcucucucauauuaagauauuauaaugaaaaaagaaguugacuuuccauuauuguuagucuuuguaaaauauucuugguagauaccugaaaucauuuuuuguauaaguuaaaauaguaacagugcuuuaaaacuuaugacagaauuuaccuaaaaauccuagauuuauuuuguuuccuaaguaaguuguuuuauuccaauguuagcucucccccugcccccauuuaagguauucaggaauacugcagucuuuuauuugucaccaauugguauauaugaauacugauuugacauugaggaagggggauaucauuuuuaaucagaccuaguauauagagcacaauuuauccaacagaauauuaacauauuaaagagauuuagggcacagaugagaguuucuuaaaguggcuuuuggcagaacagugccugaaauacuaagauuagagaaacccaauugcuccucuuaaaacauacugcuguagaugagccuuuuuauuacugcaacagaguuuguggaggacagagaccaaauuugucuuucguaauuaaauaagaggaaauuaaagccaacucauguuauuccugcuacucauauguucauaguuucuuacuuuagauggauuugaccaggcaugaaacuuuaauauaacuagaaucuagaaguacagaaugucaugacucuggauuuacuuugaaauuuauucacauggccagcccaauuuauuuguuaguuucuaaggcucucucucuuuucuccuuuucaguuucauuucuuuuugagccaugcucugaaagauuuuuuuuaagaaaauuaucuuccauauugcauggaauugugaacuaaugcuauauauuucaguuacucuaacuuuuuauuuuuuuaaaguaaaaguauucaucuaaagaaauuuaguucuaauguaguugggauugcgaacaacuuuuucuuuuucaucugcagcacugccuccuaaaccaccaaaaccuacuacuguagccaacaacgguaugaauaacaauauguccuuacaagaugcugaaugguacuggggagauaucucgagguaaggcuacagaaacuucauuuucagagaguuuuagauuaaaagaaagaaaagcaccagcuugcuaaguuccauuuuuaggauaucauccaacauaagcaugaagcauaguugguucucuuccaaagacgaccagaaaaagucacugagcacuggagaacugugggugcuggaugccacaggaaauuaaauacccgggaaguuucauuauugacagagaugucagugaagugccagagugaaguggcacugccuaagaacagagugugaaggcacucuaucuauuaagcacaacucuaagaauucuugccuuaaacacaauaagaaaacaaugccauuuuauguuagcuuugggaagggggaguaagguuggagaaacucuuuugagaucaugaguuucugugcucauuugucagagagauuguaauguuugguugaaaaaauaaaaacuuaguaccacagauacaccaauagugaaagugauaugcaccuguuugugaugagacugcaauugcuaacauuucuauuuaaacaaauuauuagcucuuauuagugagcucugaaaaugcaauucauuaauuuaaaucuaugugggcaggaggaauaugggcacucacuguacuuuccacuugauuuugcugugaaccuaaaacugcucuaaaaaauagccuauuuuaaaaaauauaaaucuguggucacuaaaccuuaagaugagcauuguuuuguguuuucauuucagggaagaagugaaugaaaaacuucgagauacagcagacgggaccuuuuugguacgagaugcgucuacuaaaaugcauggugauuauacucuuacacuaagguaagccagggaauauagcugaaauuaggguuuugggcugauauuaaaacauauuuccuuauuccaaaauguuaauaccuuuauuuuuauauuguuuuuacaggaaagggggaaauaacaaauuaaucaaaauauuucaucgagaugggaaauauggcuucucugacccauuaaccuucaguucugugguugaauuaauaaaccacuaccggaaugaaucucuagcucaguauaaucccaaauuggaugugaaauuacuuuauccaguauccaaauaccaacagguaauaaaaacugaaugaauuauccaguuacgauguuuagacaagauccuuuuaauacuuagaaaacauuugaagcagaugaauuacauguaaucaagucuaaaaaacuugacacucguaauuacauaauugcaauuuuaaagauguuuccaugucagcuauuuuguuaaacaauuguuauuugauuaaauaccuuauccauugaauuuauuuuaaucuuucuaggaucaaguugucaaagaagauaauauugaagcuguagggaaaaaauuacaugaauauaacacucaguuucaagaaaaaagucgagaauaugauagauuauaugaagaauauacccgcacaucccaggugaguuuucuaugaaaaucagauuaaaaaauaagaguucuaaacuuuuaaagacuaacauggaaaaaagaauuuaaaagguugaguuuuuacgaaugaggugggggugagagcauuuauuugugaaucauuguugauuauucuaguguaauaucucuaaagcuuuaaaccaaaaauuuuaaguaucagaauaauaaauuaaguucacgugauaacugaagcagucacugaguuucaaguugauuuaauucgugauagaaggauccuguuuagauuggaaguuaguaauaacuggaaguuucacagacuugucuaaucccugaaauggagauuuaggcauuaauauauauccuaccaugaaaaggaagggcuauauacugcugugcuuuucuagacccuuauucuucacuggucacucauguaucugggaaugccagagggaacagaaaacaacagggaugcuauaaacuacaauagcuuuuaagaagauaaaaacuauaggaaauugcuacgcaaucauuuuucauagauugagaaaauucuccagaggaaauacuuguuucugggauacuguuuuaauggauuuuaugaauuugagucccacucugcuaauaauacagaucaaauguccugguagugucuugcaguaagagauuguucuaugaaagguaugacauuaucuuuuuaaaauuauguugcaggaaauccaaaugaaaaggacagcuauugaagcauuuaaugaaaccauaaaaauauuugaagaacagugccagacccaagagcgguacagcaaagaauacauagaaaaguuuaaacgugaaggcaaugagaaagaaauacaaagguugguguuucccuuguucuugugcuagagauaaccaaaauccucuaaaaccauuuaaagaugaucucgcuuucugugcuuugaaugaucacguggacacaggaaggggaauaucacucuggggacuguggugggguggggggaggagggagggauagcauugggagauauaccuaaugcuagaugacgaguuagugggugcggcgcaccagcauggcacauguauacauauguaacuaaccugcacaaugugcacauguacccuaaaacuuaaaguauaauaaaaauaaaaaaauaaaauaaaauaaaauauguugagccacuccaaaaaaaaaaaaaaaugacaggaagagaagccacgcuuuaccuaaggaaaacugcugggaaaccauagugaaacuuuucauaaacuuuggggaccguuccugauguacccagauaauaacaaauacguuucuuuugccugcaggauuaugcauaauuaugauaaguugaagucucgaaucagugaaauuauugacaguagaagaagauuggaagaagacuugaagaagcaggcagcugaguaucgagaaauugacaaacguaugaacagcauuaaaccagaccuuauccagcugagaaagacgagagaccaauacuugauguaaguauuugaaauggaauccuauacaugaauaauuggugauugcuacaauucaggaugaguuaaugcguucucuuuucaaaacuguuuuucaggugguugacucaaaaagguguucggcaaaagaaguugaacgagugguugggcaaugaaaacacugaagaguaaguaguuacuaaagauggugauagcagaagauuuuucucauuuuaggaaaaugcaugacuugcuuuguuuuuagaacaagugaggaauuuuacugaguuuggaacaucuuguaggagaaaauguauaaacucagugccauuauccagaauuuuaaaaaaagaaagcuuagcuaaggaggacuaggauuuauuuuuacucauaaugcugugaaacaacucucuguguccauaaugaugucccugaacaucugaaaaaucccaaaauauuuuuggaacagucagagaaaaaauaauuaugcuuaauauauuuuaaagcuuaaguauauacuuuguuugaauuagucaaaaacuggcaaucugccuagucaauuuccugaucuaaacuggauaaacgagauuguuuuaauaccuuccacucugcccagguaccugagugugguugcuugaaaacagaaauaguacaguugauugguaacucuuuguccugggagguugcacuggaggcugaauaccaggagaggaaaacucaggucgggcagaggcaggcaugugauggccagucugacuggcuugguaggggccaggagggaagugacggggguaugccuagggaagacagcaaggcaggcugauggcuccugcacucuucauuuagaaacuuucuguccugccugccuagccaauauucacugguggaagaugaugaagauuugccccaucaugaugagaagacauggaauguuggaagcagcaaccgaaacaaagcugaaaaccuguugcgagggaagcgagauggcacuuuucuuguccgggagagcaguaaacagggcugcuaugccugcucuguaguguauguaucuccagcaaacuuuucuuuacaacaucucaugaagagauguuucauuuauucauucauugaguuuugggggcaaagauuugacauaguuuuagucuugaauaagcuuacaguacaauaauguagaagagaaaccaaagcagcuguaauaccauuuuaaagucuagccagaaguguauguuaauacagucuaauagauaccuacuguuuaguuggaagacuagguuuggauucccauucagugcuaauuaaucaugagaaaucgccaagucuuuuuuucucaucuuuaaaauggaaguggcagugccugccuuuuuugccucucaaggcuacuauaguuagaaucugagguaauuuaugugagaacaucacccauaggaaaaauacucaucaggaacaggugaaaaaaaaaaggauucugaucauuauccuugagauagguacacccacauuggaucacugacaucaccauuuccaagaaauuaauguccucuaguagggaaugguucuaaaaguauguuacacuccaugaucaccuuucauuuaaugagagaaauaguccuacagcaaagaaggguacuuuuguccuuacugugcauaagggcacaugcagagauggagaguugugcagacaccucaaggacagccagaaagaaggaauccuaugaauagucauaaugggaguaauaguaacacugcuagucauggagcacugcagauaguuguccucaucaugauuggaagcuaccacuuguugcaugcuuacugcaugucaggcauucuaucuagcauuuugcaugcaugaucucauuucauuucucaaaguaacuguauuacauguauuuuacuauugucuucccuuuaaaccauuuuaaagaugaaaauacagucagucagugaagcuggguuaccuacccaaggcacucggccaggugucaguuguaaccuaggacccuuuccccaaguugagacugcacaauaaugcuuuuuauuaaagaugcccugaagaguugugaauugucuuggacaagcucaaaagacaguuuuucuucucuccucucuaggguggacggcgaaguaaagcauugugucauaaacaaaacagcaacuggcuauggcuuugccgagcccuauaacuuguacagcucucugaaagaacuggugcuacauuaccaacacaccucccuugugcagcacaacgacucccucaaugucacacuagccuacccaguauaugcacagcagaggcgaugaagcgcuuacucuuugauccuucuccugaaguucagccacccugaggccucuggaaagcaaagggcuccucuccagucugaucugugaauugagcugcagaaacgaagccaucuuucuuuggaugggacuagagcuuucuuucacaaaaaagaaguaggggaagacaugcagccuaaggcuguaugaugaccacacguuccuaagcuggagugcuuaucccuucuuuuucuuuuuuucuuugguuuaauuuaaagccacaaccacauacaacacaaagagaaaaagaaaugcaaaaaucucugcgugcagggacaaagaggccuuuaaccauggugcuuguuaaugcuuucugaagcuuuaccagcugaaaguugggacucuggagagcggaggagagagaggcagaagaacccuggccugagaagguuugguccagccugguuuagccuggauguugcugugcacgguggacccagacacaucgcacuguggauuauuucauuuuguaacaaaugaacgauauguagcagaaaggcacguccacucacaagggacgcuuugggagaaugucaguucauguauguucagaagaaauucugucauagaaagugccagaaaguguuuaacuugucaaaaaacaaaaacccagcaacagaaaaauggaguuuggaaaacaggacuuaaaaugacauucaguauauaaaauauguacauaauauuggaugacuaacuaucaaauagauggauuuguaucaauaccaaauagcuucuguuuuguuuugcugaaggcuaaauucacagcgcuaugcaauucuuaauuuucauuaaguuguuauuucaguuuuaaauguaccuucagaauaagcuuccccaccccaguuuuuguugcuugaaaauauuguugucccggauuuuuguuaauauucauuuuuguuauccuuuuuuaaaaguaaauguacaggaugccaguaaaaaaaaaaaauggcuucagaauuaaaacuaugaaauauuuuacaguuuuucuuguacagaguacuuggcuguuagcccaagguuaaaaaguucauaacagauuuuuuuuggacuguuuuguugggcagugccugauaagcuucaaagcugcuuuauucaauaaaaaaaagaaaugaaaaagauauaugaauaugacaaaguauugcugaguccaacaauguuguuuuaagacucuuaaaauacgguaccuggcaauguuuauuucauaaagaauugugaacuucuugaaucuagggagggggaauguagugaagggauguaucaagugggguggugggagggggaggcaagguuauaugcacuuucucaugauuuacagagaagugaauaacugcaaagugaaguugcuucuucuacuucagucuucucucacuuugauuugcuaguuguuaucaauuaaugacaauuacaaaccuacuguaucucuaauacagugugacuggucagguauuucaguucuuaggaaggaagugccaaguuuguuuuuggguuccuggaacagcgcucaccuuuguuuagaacacugguuuaaagggauaaucaucucugucacauuagacuauccaucaugaccagcaaauacucauuuuaggaaaaaaaaaagcaugaucugaaaaauacuuuuggugguauguugguuacccuccuagcuuuccauuugguuuagaacauaaagcaaauagacacagucauacugucacugcucuggacuguguggagcucgcuaaagucauggucauugcaggaauccaaguggcaguccuucucauucauucuaaucauuguaugugcuucacuacgggggggagaaggaaacguuagcaucauguuucccauuuagggcaggagugagaggucucucuuccugauuuagauaugcaaaagcugguauguucaguaggaacuguacauguguugggaggcauaaagacuaauuagcaaccauaauauggucacuacccuaauagacuaaaugaaaucuugcaauuucaaauuacucuuucuccauauuagauuuacccacagcuauauuucuguuuaaguacuagggugaggguuuucuguuacuuuguuuuuuaauguuguuccuuuugaaagaaucagucuugcagcugagugaaaaaucuguggaauguauuauuuguccucuuuacaugaaacuacucauacuuaagcaaaagucagucuuauagcaagacuguuagcccucaaacuugacucuacugaucugaccauuucccucucaucgccagacaacugacgauuucccugguuuuagucugcgucucugcuuuaaaguuauugugauauccuucuagaucauacacaagucuaacaguuaauuaguuaacaguuuuuaaacuagguuuguggguauuuuuuugguagcacauguaugcuauuacauacaaauuuuuauuucuaaaauauaagaucugagauugaauauuuucauuaaaagcuacaguuuugugaaucuuugugcuucaacauucuuugcaagaugauacgguauuuaggcauuugccuuauuuuugcaucucacaaacauaagugcaauagaucuuuucauugaacagcaaaguaggauucaucauuccauaugacuugaguuacaccagaccuguucugcccaaugccuuuuugauuacaguguagcuugcccaccgcauuugucguuuuagauacuuugcuagccggccacuuuggauuucaucagacaguccuaacaauauugucugaacggcugaauaugaauagauacagcagaggcacuccugauauaugauuuuuauccaugcgucaguuuuucccacccaguguagcauccuaaagauaaagccagaagcuaagcugcagugaggcugugauugggcguagaagugggagcauugggaccucacauuacacacacgagagaucauaaccaugugaaaaggcaaaaagcauguguuugcaacaucugauaacuucauggccuuugauaaauguauauauguauaugugcauggacuguguuuccaguacaccuuucagccaaaacagauccacaguaguuguugaguucaaguacauaaaguacauaacaagcgaacgucuaguacaauucuuacuuauguguaugggauuuuucccuuugagguugcuuuguuuugucuuacaaaggugaaaauuguuuguaagugaagugagaaguucauauuucuuuggcuuuuuuguguuuuuaaaaguuacuccuuuuagggagcuggucugaugacuugcuuagcuuggaaauccuuguuuucagugugucgagucaaaauguguuuaugugagcugucacuguggggaaccaauugcuuugucauauagcugguuaugaacuaguaacauguuugggaaguccuacugauguuccuuuggaagaaaaaaucugcugguuuuaacaacugugcuuuugcuauguaugguauccaaguuaguugaaacgcagacacugagaucuguuugaguuuagggucauuuuuagaaaggggcaguuuaaagcacaaugucucacaugggacaaaguuccaaaaugccaaauucuuauuuuuuaaaaagcuaguucuauaaaauacugguauuauggguggggaggaaauagaauugagucaauuggaaagacuauccaacuuaacaugaaacuugucaccaugagauagcauuagcugcccaggaugcugcuauauauauauauauauauauauauguguguguguguguguguguguguguauauauauauauauauauauauauauauauauauauauauguguguguauauauauauauauguguauauauauauguauauacauauauguauauauaugcacauauauauauguauuuaaaaaaaucaaaacaaaaaaaaacucauuuauaccuguguauuuuuuaaagcuacaaucuguucaauguuuuuaaaaaucuguuuauaugacauuguuaaaauaaaguuggucuuuugacgagagggaggaugucacggucaguuguaacuuugccuucacaaggcaacuggggugggggguggggguagugugccuccuugacauuucguucaaguuauagauucaauggagcuaugucuuguuuuaaguugcuuuaaugcauuguauuagaucuucaaacagaauaaagguuguuuugaaacugaa

SEQ ID NO: 61563 - RNA, 9254 nt, Homo sapiens
auuauugacagagaugucagugaagugccagagugaaguggcacugccuaagaacagagugugaaggcacucuaucuauuaagcacaacucuaagaauucuugccuuaaacacaauaagaaaacaaugccauuuuauguuagcuuugggaagggggaguaagguuggagaaacucuuuugagaucaugaguuucugugcucauuugucagagagauuguaauguuugguugaaaaaauaaaaacuuaguaccacagauacaccaauagugaaagugauaugcaccuguuugugaugagacugcaauugcuaacauuucuauuuaaacaaauuauuagcucuuauuagugagcucugaaaaugcaauucauuaauuuaaaucuaugugggcaggaggaauaugggcacucacuguacuuuccacuugauuuugcugugaaccuaaaacugcucuaaaaaauagccuauuuuaaaaaauauaaaucuguggucacuaaaccuuaagaugagcauuguuuuguguuuucauuucagggaagaagugaaugaaaaacuucgagauacagcagacgggaccuuuuugguacgagaugcgucuacuaaaaugcauggugauuauacucuuacacuaagguaagccagggaauauagcugaaauuaggguuuugggcugauauuaaaacauauuuccuuauuccaaaauguuaauaccuuuauuuuuauauuguuuuuacaggaaagggggaaauaacaaauuaaucaaaauauuucaucgagaugggaaauauggcuucucugacccauuaaccuucaguucugugguugaauuaauaaaccacuaccggaaugaaucucuagcucaguauaaucccaaauuggaugugaaauuacuuuauccaguauccaaauaccaacagguaauaaaaacugaaugaauuauccaguuacgauguuuagacaagauccuuuuaauacuuagaaaacauuugaagcagaugaauuacauguaaucaagucuaaaaaacuugacacucguaauuacauaauugcaauuuuaaagauguuuccaugucagcuauuuuguuaaacaauuguuauuugauuaaauaccuuauccauugaauuuauuuuaaucuuucuaggaucaaguugucaaagaagauaauauugaagcuguagggaaaaaauuacaugaauauaacacucaguuucaagaaaaaagucgagaauaugauagauuauaugaagaauauacccgcacaucccaggugaguuuucuaugaaaaucagauuaaaaaauaagaguucuaaacuuuuaaagacuaacauggaaaaaagaauuuaaaagguugaguuuuuacgaaugaggugggggugagagcauuuauuugugaaucauuguugauuauucuaguguaauaucucuaaagcuuuaaaccaaaaauuuuaaguaucagaauaauaaauuaaguucacgugauaacugaagcagucacugaguuucaaguugauuuaauucgugauagaaggauccuguuuagauuggaaguuaguaauaacuggaaguuucacagacuugucuaaucccugaaauggagauuuaggcauuaauauauauccuaccaugaaaaggaagggcuauauacugcugugcuuuucuagacccuuauucuucacuggucacucauguaucugggaaugccagagggaacagaaaacaacagggaugcuauaaacuacaauagcuuuuaagaagauaaaaacuauaggaaauugcuacgcaaucauuuuucauagauugagaaaauucuccagaggaaauacuuguuucugggauacuguuuuaauggauuuuaugaauuugagucccacucugcuaauaauacagaucaaauguccugguagugucuugcaguaagagauuguucuaugaaagguaugacauuaucuuuuuaaaauuauguugcaggaaauccaaaugaaaaggacagcuauugaagcauuuaaugaaaccauaaaaauauuugaagaacagugccagacccaagagcgguacagcaaagaauacauagaaaaguuuaaacgugaaggcaaugagaaagaaauacaaagguugguguuucccuuguucuugugcuagagauaaccaaaauccucuaaaaccauuuaaagaugaucucgcuuucugugcuuugaaugaucacguggacacaggaaggggaauaucacucuggggacuguggugggguggggggaggagggagggauagcauugggagauauaccuaaugcuagaugacgaguuagugggugcggcgcaccagcauggcacauguauacauauguaacuaaccugcacaaugugcacauguacccuaaaacuuaaaguauaauaaaaauaaaaaaauaaaauaaaauaaaauauguugagccacuccaaaaaaaaaaaaaaaugacaggaagagaagccacgcuuuaccuaaggaaaacugcugggaaaccauagugaaacuuuucauaaacuuuggggaccguuccugauguacccagauaauaacaaauacguuucuuuugccugcaggauuaugcauaauuaugauaaguugaagucucgaaucagugaaauuauugacaguagaagaagauuggaagaagacuugaagaagcaggcagcugaguaucgagaaauugacaaacguaugaacagcauuaaaccagaccuuauccagcugagaaagacgagagaccaauacuugauguaaguauuugaaauggaauccuauacaugaauaauuggugauugcuacaauucaggaugaguuaaugcguucucuuuucaaaacuguuuuucaggugguugacucaaaaagguguucggcaaaagaaguugaacgagugguugggcaaugaaaacacugaagaguaaguaguuacuaaagauggugauagcagaagauuuuucucauuuuaggaaaaugcaugacuugcuuuguuuuuagaacaagugaggaauuuuacugaguuuggaacaucuuguaggagaaaauguauaaacucagugccauuauccagaauuuuaaaaaaagaaagcuuagcuaaggaggacuaggauuuauuuuuacucauaaugcugugaaacaacucucuguguccauaaugaugucccugaacaucugaaaaaucccaaaauauuuuuggaacagucagagaaaaaauaauuaugcuuaauauauuuuaaagcuuaaguauauacuuuguuugaauuagucaaaaacuggcaaucugccuagucaauuuccugaucuaaacuggauaaacgagauuguuuuaauaccuuccacucugcccagguaccugagugugguugcuugaaaacagaaauaguacaguugauugguaacucuuuguccugggagguugcacuggaggcugaauaccaggagaggaaaacucaggucgggcagaggcaggcaugugauggccagucugacuggcuugguaggggccaggagggaagugacggggguaugccuagggaagacagcaaggcaggcugauggcuccugcacucuucauuuagaaacuuucuguccugccugccuagccaauauucacugguggaagaugaugaagauuugccccaucaugaugagaagacauggaauguuggaagcagcaaccgaaacaaagcugaaaaccuguugcgagggaagcgagauggcacuuuucuuguccgggagagcaguaaacagggcugcuaugccugcucuguaguguauguaucuccagcaaacuuuucuuuacaacaucucaugaagagauguuucauuuauucauucauugaguuuugggggcaaagauuugacauaguuuuagucuugaauaagcuuacaguacaauaauguagaagagaaaccaaagcagcuguaauaccauuuuaaagucuagccagaaguguauguuaauacagucuaauagauaccuacuguuuaguuggaagacuagguuuggauucccauucagugcuaauuaaucaugagaaaucgccaagucuuuuuuucucaucuuuaaaauggaaguggcagugccugccuuuuuugccucucaaggcuacuauaguuagaaucugagguaauuuaugugagaacaucacccauaggaaaaauacucaucaggaacaggugaaaaaaaaaaggauucugaucauuauccuugagauagguacacccacauuggaucacugacaucaccauuuccaagaaauuaauguccucuaguagggaaugguucuaaaaguauguuacacuccaugaucaccuuucauuuaaugagagaaauaguccuacagcaaagaaggguacuuuuguccuuacugugcauaagggcacaugcagagauggagaguugugcagacaccucaaggacagccagaaagaaggaauccuaugaauagucauaaugggaguaauaguaacacugcuagucauggagcacugcagauaguuguccucaucaugauuggaagcuaccacuuguugcaugcuuacugcaugucaggcauucuaucuagcauuuugcaugcaugaucucauuucauuucucaaaguaacuguauuacauguauuuuacuauugucuucccuuuaaaccauuuuaaagaugaaaauacagucagucagugaagcuggguuaccuacccaaggcacucggccaggugucaguuguaaccuaggacccuuuccccaaguugagacugcacaauaaugcuuuuuauuaaagaugcccugaagaguugugaauugucuuggacaagcucaaaagacaguuuuucuucucuccucucuaggguggacggcgaaguaaagcauugugucauaaacaaaacagcaacuggcuauggcuuugccgagcccuauaacuuguacagcucucugaaagaacuggugcuacauuaccaacacaccucccuugugcagcacaacgacucccucaaugucacacuagccuacccaguauaugcacagcagaggcgaugaagcgcuuacucuuugauccuucuccugaaguucagccacccugaggccucuggaaagcaaagggcuccucuccagucugaucugugaauugagcugcagaaacgaagccaucuuucuuuggaugggacuagagcuuucuuucacaaaaaagaaguaggggaagacaugcagccuaaggcuguaugaugaccacacguuccuaagcuggagugcuuaucccuucuuuuucuuuuuuucuuugguuuaauuuaaagccacaaccacauacaacacaaagagaaaaagaaaugcaaaaaucucugcgugcagggacaaagaggccuuuaaccauggugcuuguuaaugcuuucugaagcuuuaccagcugaaaguugggacucuggagagcggaggagagagaggcagaagaacccuggccugagaagguuugguccagccugguuuagccuggauguugcugugcacgguggacccagacacaucgcacuguggauuauuucauuuuguaacaaaugaacgauauguagcagaaaggcacguccacucacaagggacgcuuugggagaaugucaguucauguauguucagaagaaauucugucauagaaagugccagaaaguguuuaacuugucaaaaaacaaaaacccagcaacagaaaaauggaguuuggaaaacaggacuuaaaaugacauucaguauauaaaauauguacauaauauuggaugacuaacuaucaaauagauggauuuguaucaauaccaaauagcuucuguuuuguuuugcugaaggcuaaauucacagcgcuaugcaauucuuaauuuucauuaaguuguuauuucaguuuuaaauguaccuucagaauaagcuuccccaccccaguuuuuguugcuugaaaauauuguugucccggauuuuuguuaauauucauuuuuguuauccuuuuuuaaaaguaaauguacaggaugccaguaaaaaaaaaaaauggcuucagaauuaaaacuaugaaauauuuuacaguuuuucuuguacagaguacuuggcuguuagcccaagguuaaaaaguucauaacagauuuuuuuuggacuguuuuguugggcagugccugauaagcuucaaagcugcuuuauucaauaaaaaaaagaaaugaaaaagauauaugaauaugacaaaguauugcugaguccaacaauguuguuuuaagacucuuaaaauacgguaccuggcaauguuuauuucauaaagaauugugaacuucuugaaucuagggagggggaauguagugaagggauguaucaagugggguggugggagggggaggcaagguuauaugcacuuucucaugauuuacagagaagugaauaacugcaaagugaaguugcuucuucuacuucagucuucucucacuuugauuugcuaguuguuaucaauuaaugacaauuacaaaccuacuguaucucuaauacagugugacuggucagguauuucaguucuuaggaaggaagugccaaguuuguuuuuggguuccuggaacagcgcucaccuuuguuuagaacacugguuuaaagggauaaucaucucugucacauuagacuauccaucaugaccagcaaauacucauuuuaggaaaaaaaaaagcaugaucugaaaaauacuuuuggugguauguugguuacccuccuagcuuuccauuugguuuagaacauaaagcaaauagacacagucauacugucacugcucuggacuguguggagcucgcuaaagucauggucauugcaggaauccaaguggcaguccuucucauucauucuaaucauuguaugugcuucacuacgggggggagaaggaaacguuagcaucauguuucccauuuagggcaggagugagaggucucucuuccugauuuagauaugcaaaagcugguauguucaguaggaacuguacauguguugggaggcauaaagacuaauuagcaaccauaauauggucacuacccuaauagacuaaaugaaaucuugcaauuucaaauuacucuuucuccauauuagauuuacccacagcuauauuucuguuuaaguacuagggugaggguuuucuguuacuuuguuuuuuaauguuguuccuuuugaaagaaucagucuugcagcugagugaaaaaucuguggaauguauuauuuguccucuuuacaugaaacuacucauacuuaagcaaaagucagucuuauagcaagacuguuagcccucaaacuugacucuacugaucugaccauuucccucucaucgccagacaacugacgauuucccugguuuuagucugcgucucugcuuuaaaguuauugugauauccuucuagaucauacacaagucuaacaguuaauuaguuaacaguuuuuaaacuagguuuguggguauuuuuuugguagcacauguaugcuauuacauacaaauuuuuauuucuaaaauauaagaucugagauugaauauuuucauuaaaagcuacaguuuugugaaucuuugugcuucaacauucuuugcaagaugauacgguauuuaggcauuugccuuauuuuugcaucucacaaacauaagugcaauagaucuuuucauugaacagcaaaguaggauucaucauuccauaugacuugaguuacaccagaccuguucugcccaaugccuuuuugauuacaguguagcuugcccaccgcauuugucguuuuagauacuuugcuagccggccacuuuggauuucaucagacaguccuaacaauauugucugaacggcugaauaugaauagauacagcagaggcacuccugauauaugauuuuuauccaugcgucaguuuuucccacccaguguagcauccuaaagauaaagccagaagcuaagcugcagugaggcugugauugggcguagaagugggagcauugggaccucacauuacacacacgagagaucauaaccaugugaaaaggcaaaaagcauguguuugcaacaucugauaacuucauggccuuugauaaauguauauauguauaugugcauggacuguguuuccaguacaccuuucagccaaaacagauccacaguaguuguugaguucaaguacauaaaguacauaacaagcgaacgucuaguacaauucuuacuuauguguaugggauuuuucccuuugagguugcuuuguuuugucuuacaaaggugaaaauuguuuguaagugaagugagaaguucauauuucuuuggcuuuuuuguguuuuuaaaaguuacuccuuuuagggagcuggucugaugacuugcuuagcuuggaaauccuuguuuucagugugucgagucaaaauguguuuaugugagcugucacuguggggaaccaauugcuuugucauauagcugguuaugaacuaguaacauguuugggaaguccuacugauguuccuuuggaagaaaaaaucugcugguuuuaacaacugugcuuuugcuauguaugguauccaaguuaguugaaacgcagacacugagaucuguuugaguuuagggucauuuuuagaaaggggcaguuuaaagcacaaugucucacaugggacaaaguuccaaaaugccaaauucuuauuuuuuaaaaagcuaguucuauaaaauacugguauuauggguggggaggaaauagaauugagucaauuggaaagacuauccaacuuaacaugaaacuugucaccaugagauagcauuagcugcccaggaugcugcuauauauauauauauauauauauauguguguguguguguguguguguguguauauauauauauauauauauauauauauauauauauauauguguguguauauauauauauauguguauauauauauguauauacauauauguauauauaugcacauauauauauguauuuaaaaaaaucaaaacaaaaaaaaacucauuuauaccuguguauuuuuuaaagcuacaaucuguucaauguuuuuaaaaaucuguuuauaugacauuguuaaaauaaaguuggucuuuugacgagagggaggaugucacggucaguuguaacuuugccuucacaaggcaacuggggugggggguggggguagugugccuccuugacauuucguucaaguuauagauucaauggagcuaugucuuguuuuaaguugcuuuaaugcauuguauuagaucuucaaacagaauaaagguuguuuugaaacugaa

SEQ ID NO: 61564 - RNA, 85634 nt, Homo sapiens
gcggagcgugugacgcugcggccgccgcggaccuggggauuaaugggaaaaguuuuggcaggagcgggagaauucugcggagccugcgggacggcggcgguggcgccguaggcagccgggacaggucaguccgagacgagagaagcggucaggcaaguggcggagggaagcgccgggccugggccgaggcggccagcgggacuggggcgcaaggcccggcggcggggaacggggugcggggagcugccgggguccgcggacagcgucacggcggcuuccugaugcuccggcccgcuccggucagccgucgugcguugccauguaggcgccccgcugacccugcgcccccccgcccuuggacccccauagcugcuugagugaguccgaaauacgggccuccuuccacccuacucuuugcccccucuugggccugguggcuucgucuucucccacuugugagaaccccgucucaggcccgggggccucucccauuccccuccccugccucugaccucuuccuucacccguuucugguguuccugaauccacugcccuaucuagcgagagucuucucugggaucuuuuccucugucccccucguuauccuugucuccugccuucauccucccauccuugcucucucaggcuuuacucucucuccccaucccuguccccuucuuaucuguggucugaucccuccuaguauuauggguccccauccucuuccccaggguguuccuaggcuuuuuccaacuccgugccugcagucccugucucccuaagacucucaccuugguucccugagaggcccuguuuuugcuccuuuuuccgauuuccuucguaucaauucuguccccuacauuccugucgcccaccuccuuuucucucccuguuccuuuccccugcuucagggagaagccuuagcuccacacucuacucuacuuucacuugaccugcaguugacauaaccaugggguggggguggagguguucagaccuugaucgaauuaagaggcugauugacuaaaggaaauaacagauugugugggagaauguacguggguguugcaucagagaugauguccaauuuguaggccauucuucuuaucucagcuuuaauacuuccccuuuauggggcuguugacuuccaggaacccuugggggagacggcgcugagcuggaugugugccacggguagccggaggcuuuguccaauucuuuuccccuuccaggaaccgggguuuugugucuuuccacucuggauguguggaauacacuuauaccaugauaccccagccucucucugcccucacucccacccuccacccugugcuccauccgaaaggacuaagagaauucuccagaagcugugcuccagaaaauacuugugguccucaaccuuuuuucuguguacuggcuccagaacuuuuuuuuuucccguuugaguuuugaaauagauugcuggccugauagcccuggggcuggcgggcaucuguccccuuuuauuauugguggcuugaaacagcugcugauuuucucucauaucucuuugacaaucuuuggccaacugaaugugccucugauguuggucacugaacauguucucuuggagucucuucucccucuuuuuucuuuguucuuuucugaaucuagggaauccaaauugucccucuuuuucccugggagcuuaauuuccucuguauccaggaggaacggcaaucccagagcucuguucccuuugcccaggcauaguaugagguaucagauugauaacuacccuggugggcuguggggcugcaguaguuagaccuugucaggaacuugagcagacacaucugcuuccagucacauagaucaucuucucuggggcuugagagcccaccaccuuccaugugugucuggauguuuaaccuuaccaagcagaagauucucgucauauccuucaguuugagcuccuuuauuuggcguugguucucuaaagaaguauucaagaaauaacauauccuuuguuucuacccagucugaucuuggaggauucugaaagcgugacccacucucauguuuagaaaugaaggcucauuguuucaccuggccccagguuucuaggggcuccucuuuugaugauugugcugucuuugagccagauuggacaugggaguuggcaaccuuuaggagcugcgguggagagccaaaggaaccagcuugaccagacuuuaaaguuuuguaauccucuuguacacuguuuucugugaaagcaauaggauuguggauggccuguuguugagccagucccuucuccacugacccccagacccccuuugcagcacuugcaaagauuuggguagacuggaccagaggguuuuccuuguuccugugaauagcaucucuccaggguuuuaguggaucauucuaaagagguagaggucaaguguuggacagauuuuuagucuagucucuggcuuucaaggacuccuccuuacucuuuugagcaguuuguuacuucuggccgugcuuaccccuuaguagugcucucugcugugguggcaggugagagauuugagaacaggucaaggccaguccuuguggagcagcuugggcaccagcagcccuagauggauagcuucuugcaguuuguccacucucauuuucugagaagguagucaugauugucaauuaccaaauuccuuccccauucagugauuuuugcagagucugggucuggauuuucuuuccuucuuucuuuucugacacaagguuuuguucuauugcccaggcuggagugcaguggugcuaucauagugcacuguaaccucgaacuccugggcucaagggaucuuccugcuucagccuccagaguagcggggacuacaggugcacaccaccacacucagcuaauuaaaaaacaauuuuuuuguaaagacaggcucucacaaugucucgaacuccuggccucaagcaguccuccucaccuuggccucucagagcacugagauuacacugacugcucguucaggugccuuucuccuugccucuucaccauggccuucuugugugauauaugccuuaacccauucaggaagaauugcuccuacucagccuuucaacccgaccuguggucccuuagacgccuucccuuagggccugguaagaggauagacaguguagagcacuagccugggaagccauuaggccucugcuuugggccuacagcuguccugacuguugugcaagcugucuucagggccugcagauucuggcacauccugggauagugcagcuccucucucucaggaguuggaccugucacuuuuuuuucguuuuuuuuuuuuuuuuuuuugagauggagucucgcucugucgcccaggcuggagugcaguggugcgaucuuggcucacugcaagcuccaucucccagguucacgccauucuucugccucagccuccugaguagcugggacuacaggcgcccgccaccacgccuggcucauuuuuuuuuguaguuuuaguagagacaggguuucaccguguuagucgagauggucucgauuuccugaccucgugaucugcccgccucagccucccaaagugcugggauuacaggcgugagccaccacaaccagccuggaccugucacuucuaagggcuucagcuauauccugucccugaggcccaccucccugagugcucucugcaggcugggaagcugaacaguggugccuugcuccagugccucugaagggcuuggaaauugcaggacacagcuuuacugcucagcauugcccacacuggaaacauucucuuccucccuacccaggucucugugggcuuuguccguucugccaggcccuugcuuauaugaugucagaagcccugugcccggugccauugucaaugccaugucccagauuaccuaauggcugcuucuuggagaugguuugguguccaugcacauuuuucucugccguuggagccagggugaggagcugcuugcaacagcuggauuccagggugucagaggagcccuuggagcuugccuugagccuggcagggagaacauggccccuugcaucagguuucagacauaugggucuucuuccuuggcagauggcuccuagccuucauaacucagcaggcuggugauuggcaugugacuccaguucauucugcaggggcuuuggugaaggcaucaacuaugacucaggacaucuucauuuaugagcuucuacccagcucccuucuuaccuugccugcgccuucugcgccgaccugauaaaaucagcaaagccagugucugcuuacuugggagugagcagacuccuuccaggauuggggaaauauuugcugacucaggcucagaaucacaucucagggugguguguaagggaccgacgaggagccagauuaccuuaggaacacucuuugaguuacgguggguauaacuuauuagaguugcuuugagggccccuggcaccugucagcuaaagcuguugggguuuuuucuauccugcaguguuguacaguguuuugggcaugcacgugauacucacacaguggcuucugcucaccaacagaugaagacagaugcaccaacgagguaaucccauuuucuuuacucaggggucucugaccaccacugacacaggauccagauuuaagauccugaccuugaagaugaaauaauuucacuagggcuuauucccagauuccagguuccugucacagcaucugguaccaguugcuuaugcauaguauaggcauuuauuaaguaauuauugaaagucuauggcuuacauaguuuuuucaggagcauggagauucccaccuuugcgcccauuaaaagauaaacuccacagggcagggaguuguuuugcugccuguugugucuaggauagugccuggcacagaggagauaaugaauaaauuuuuguugaaugaguaaaugaacgaacuuucgucuuugccuauauggguaccuagggugccaggccacaaagaugguguccaucauucucucuuauuagggggcaaauauauauauauauauauauuuuguuuguuuguuuguuuuugagacgaagucuugcucuugucccccagacuggagugcaauggcgugaucuuggcucacugccaccuccuucuccuggguucaagugcuucuccugucucagccucccaaguagcugggauuauaggcaccugccaccacgcccggcuaauuuuuguauuuuuaguagagaugggguuucaccauguuggccaggcuggucuggaacuccugaccucaggugauccgcccgccucagccucccaaagugcugggauuacaggcgugagccaccgcaccuggccuuuuuuuuuuuuuuuugagauggaguuucgcucuuguuguccaggcuggagugcaaugccgugaucucggcucacugcaaccuccgccucuuagguucaagcgauucuccuaccucagccuccugaguagcugagauuacaggcaugcgccaccacaucuggcuaaauuuuguauuuuuaguagagacgggguuucaccauguuagccagacuggucucaaacuccugaugucagaugaucuacccgccucagccucccagagugcugggauuacagaugugagccacugugcccagccgggaacaaauauuuuuaagugccaacuaugugccaggcacuugggaaaugauaauaguaaaaaacagauccaaucucugccucaugggucugugguuugcugguauauaugagagcuggccauaacacacagaauuguuucuuccaucucugcagggguaggagguucucaccaagagucugaacaaugcucuggguucccauugcuguuuccauguucucaggaugccuggcagguuuuauaaacucucagaaguggagcuccagggaauacaauguucauuguccuauuuggaaggcuggguuguugugggucccugcugggggccggggaaacgugggccuccugccugauuuguuuuaaucucugaaguucagugguuccaguagcuguuugugggcuucacuuccccuucucugccuuuaacacccugcagguuuuccuguugucagacaggguggugagucccugugucucucugucugugggggucagguuguuuguagaucuuucaggaagguccuggguggggggcccuccugcuuucaaacccauaccaagugcuuuccucugaagggaaugugagggaggaagaaggggggaguuucagagacuucugagguuccccaagagggaagaggucaaaguaccuccugagcggggagagcuacugaguugaacugauuugcuuugccauuugcuuuagcagcagccaggcccaguggcagcaauuguacgugcauuuccaggggucaguuguccaguucaucccugagccuugagcucccagucgcagguaggaacuucucuucuccuuucuuuuuuuuuuuuuuuuugagacggagucucgcucugucacccaggcuggagugcaguggcgcgaucuaggcucacugcaagcucugccuccuggguucacaccauucuccugccuaagccuccugaguagcugggacuacaggcgcccgccaccacgcccggcuaauuuuuuguauuuuuaguagagacgggguuucaccguguuagccaagauggucucgaucuccugaccucgugauccaccggccucggccucccaaagugcugggauuacaggcgugagccaccgcgcccggccucuucuuucuuucuugauuggguacugcuauaucaccuaggaccagggguguguccaaucuuuuggcaucccugggccacauuggaagaagaauuauuaucuugggcuauacauaaaauacacuaacacuaacaauagugaugagcuaaaaauaaaaauggcaaaagaaucucauguuuuaauaaaguuuacguauuugcguugggaugcauucagagcucuccugggcugcaugcagucaugggccauggguuggauaagcuuggccucccuaggcaguccucucaccacagccucccaaguagcugggacuacaggugcacaccacugugccuggcuaaguuuuuuuuuuguuuguuuuuguuuuuuuuuaauuuaauggguacauaguaguagguguauauuucuuuuuuucuuuucuuuuuuguuuuuuugagauggaaucuugcucuugucacccaggcuggagagcaauggcacaaucuuggcucccuguaaccuccaccuccuggguucaagcgauucuccugccucagccucccaaguagcucagauuacaggcgcccgccaccacgcccagcuaauuuuuguauuuuuaguagagaugggguuuugucauguuggccaggcuggucucgaacuccugaccucaagugaucugccugccucagccucccaaaauguugggauuacaggcaugagcuaccacacccggccuuguaugucuucuuuugagaaaugucuauuaaaaucuuuugcccauccuuuuauuagauuauucguuuuuuuccuauagaguuguuugagcucguuauauauucuuguuauuaaccccuugugaaauggguaguuugcaaauauuuucucucauucuguggguugucucuucacuuuguugauuguuuccuuugcugugcagaaacuguuuaaugugaugugaucccauuugaccauuuuugcuuugguugccugugcuugcgggguauugcucaagaaauuuuugcccagaccaguguccuggagauuuucuccuguuuucuuguaguacuuucaugguuugaagucucagauuuaagucuuuauuuugauuugguuuuuguggauggcaagagguaggggucuaguuucauucaucuccauaugaauauccaguuuuccaagcaccauuuauugaagagacugucuuuuccucaguguauguucuuggcaccuuugucaaaagugaguucacuguagauguguggauuuguuucuggguucucuauucuguuccauuggucuaugugucuuuuuuuuuuuuuuuuuuuuuucucugagacagaguuuugcucuguugcccaggauggagugcaguggcguggcgugauguuggcucacugcagccucugccucccguguucgagcaguucuccugccucagucucccaaguagcugggauuacaggcaugugucaccaugccuggcuaauuuuuuguguuuuuaguagagaugggguuucaccauguuggucaggcuggucuugaacuccugaccucaggugaucugcccaccucggucucccaaagugcugggauuacaggcaugagccaccgcgccugggcgaaagauggcuuauuuugaagucaacuuuagaauauuauaaaacagcauucucaaacuuuuuggccucaagaucccuuuagauucuuuuuuuguuuguuuguuuguuuuuguuuuuugagacggagucucucucugucacccaggcuggagugcaguggcacaaucucggcuuacugcaagccccgccucccggguucaugccauucuccugccucagccucccgaguagcugggacuacaggugcccgccaccacgcccagcuaauuuuuuguguuuuuaguagagacgggguuucaccauguuagccaggauggucucaaucuccugaccucgugauucacccgcgucggccucccaaagugcugggauuacagaugugagccacugcgccagucccuuuagauucuuaaaaauuauugaagaccccaagggcuuauguuuaccauguuagaaguuauaauaggccgggcgggugacauucguuaauaucaccacugaucucauuuuuaaaaagucuuuaaguauugggaagcugucgggcucacaguggucaauacacguuuucuaaauuugaguuuucucuugaaaguuugauuuuuaucauugguaacauacuguugguucuuuuguuugauuuugucugagauagcaucucccucagucacccaggcuggagugcaguggugcagucauagcucacuugcagccuccaacuucugggcucaaguaauccuccugccucagcguccagaguagcuaggacuacagguaugugcuaccaugcccagcucauuuuaaaauuuuuuguaaagauggugucuugugaucuugcuacaucgaccaggcuggucuugaauuccuggccucaagugauccaucugccucagccucccaaauuacugggauuauaggcaugagccaccacacccagccuuuuuuuuuuuuuuuuuuuuuuuugauauggggucucacucuugcccaggcuugagugcgguggcacagucuuggcucacuguaucuagccuugacuuccaggcucaagugauccuuucaucucagccucccaaguagcuaagacuacaugcaugcaccaucaugcccaccucauuuuuuaacuuguuguagagaucaggucucccuguguuguccaggcuggucucaaacuccugagcucgagccauucauuccugccuuggccucccaaagugcugggauuaaaggcaugagccacugugcccagccaguucuuuuuuguuuuguuuuguuuuguuuugagaugaagucucacucugucacccaggcuagagugcaguggugugaucucggcucacugcaaccuccgccucguggguucaagugauucuucugccucagccucccaaguagcugggaccacaggcgcgcaccccaaugcccggcuaauuuuuguauuuuuuuaguagagaugggguuucaccauauuggucaggccggucucgaacuccugaccucaugaucugcccaccucagccucccagagugcugggauuacaggcgugagccaccgcgcccggccacaaagaauauuuaaaagacagauaucaaagguggagauuuuaauaaaguuaguuuuuauuuauucaucuaggacauucuuaaauuggcauuuuauugucuuucaugguucuguggauuaacugggcccagcugggugguucuugcuugggauaugucauguugcuauagucaaaugaagacggggcaggugucaucugaaggcucagcugggcuggguguccacgcuggcuuaggcacauggguggcacuugaugcuguugaauggagugcguauacaugaccucucuaugugccuugggcuucucauagcaugagagcuggguucugagcagaagcauucccaaaaugaauguauugagagauucagaaagaaaugucaauguuucucauguccuagccuuggaaguuacacagugccacuuccucuauucccuuggucucaggaccaguucagauucaaggagaggacuacacaagggugugaauacuaagaggcgugauucacugaggagagaaacaggccuccuuggagaccagcuacuacuuuucagcauccuuaugugagguaauguggucuugauacuuccaagagaaaagcacaucuucucaugauuuucauuccuggaagcuacuguuaguuaggaaauuccuaauagguugauggaggacauugaaugcuaggugaaggaauuuguacucuguucuuugggcaaugggggagccaucagugguuuuggagcaaggaguggugguguuaauauugcaaaaagguagauuaggaauggagauagagaggauagguaggggacugcaguggucuaaauguaaggaaauucuucuucacauuaaaucugaguuccucugguugcaauuuaaguguauugauuuugauauuucagccacacagauuaagcacccagagccaggguggaauaacccaucccuaccccauauccauuuagggcuguugaugcacaggagagauuaagaguucacaaacuuuagaaggcaacuaaauuuagguuuuauugucaaagcacauaaaaaguuaagcauaaauuauucaaaaauaaaaagcaagaaaggugaaacuucauuuaacaccacuaaccauguuucaaauacgcuucaguuucaguauuauagaagcaaggaguggagccagaggaaggaauggggaggacaaauuagagaaugguaggaagagggacaaaaguaggggaagaaaggagucaggaggggcacacagcagaaagaauuugaaggaggucagauuggagcaacuacuugaagcugagagaaggcuccguauggggcuaacauguuagcaaagagcuggugccuucuguguuucccugaggcacuggcuucuggguuuuagcaucugguauccucacccuuucuuuaauacagacaguccccaacuuaugaugguucaacuuuacagugauguaaaagccauacacggcugggcgcauggcucacgccuguaaucucagcacuuugggaggccgaggugggaggaucacgaggucaggagauugagaccauccuggcuaacacagugaaacccugucucuacuaaaaauacaaaaaauuagcugggcgugguggugggcgccuguagucccagcuacuugggaggcugaggcaggagaauggcaugaacccgggaggcggagcuugcagugagccgagugcaugccacugcauuccagccugggcgacagagcgagacuccgucucaaaaaaaaaaaaaaaaaaaaaagcgauacacauucaacagaagccccauccuuuaguacucauacaaccauucuuuuuuuuuuuuuuuugagauggcgucucacucuugcccaggcugcagugcaguggugugaucucggcucacagcaaccucugccucccggguuaaagugauucuccugccucagccuccugaguagcugggauuauaggcgacugccaccaggccuggcuaauuuuugaauuuuuaguagagauaggauuucacaauguuggccaggcugguuucuaacuccugaccaggugaccugcccaccucggccucccaaagugcuggaauuacaggcaugagccaccgugccccgguucucauacgaccauucuguuuuuucacuuucaguacaguauucaauuacaugagauauucaaaauuguaacauaagcucuguguuagaugauguugcccguaggcucauggaaauguucuggcacauuugcaguaggcuaugcuaaguaaguuaugguguucggcagguuacauauauuacaugcguuuuugacuugugacguuuucaacauaugauggguuuguccuuauaaguugaggaacauuuguagccauuucaucgucugugaagaggccugaguggauuuugugcuggagaccggugugacucagcuccaguguugacugaccuucuaaccaugggcuugugacugaauguccugagccuucauuuucuucccugugaggauuaaaaugaaccucaggaaaugcuggcuuguccucuuucugucaagcuggguucugagggggugagcccagguaggagugacuucugaaccagcccagauuuacaggcuugggcauagggagcccagccucagccugggagccucaucuuccauuaaauagcuccuggcauucaggggagugcguugcagcaccccauuuuuuuuucauugaaguccugucuuccagccaggcacagugaaucacuugaggccacgaguuugagaccagccuagccaucauggggaaaccccaucuauacuaaaaauacaaaaauuaucugggcacgguggcgcacaccuguagucccagcacaccagaguucaagaccagccugggcaacauggcgaaaccccgucucuacaaaaaauacaaaaauuauccaggcguggugguacaugccuguaguuccuacuccuuggggggcugagguaggagaaucacucaagccgaggagguugaggcugcagugagccauauuuguaccacuguacuccagccugggugacagaguaaggcccugucuguaaaaaaaaaaaaaaaaaaaaaaaaaagugcuuucuucuucuucuucuuuuuuuuuuuuuuuuuuuuuuuuuuuuuuugagacggagucucgcuuuguugcccaggcuggagugcaguggcgugaucucggcucacugcaagcuccgccucccagguucgcgccguucuccugccucagccucccgaguagcugggacuacaggcgcccgccaccacuccuggcuaauuuuuuguauuuuugguagagacaggguuucacgguguuagccaggauggucucgaucuccugaccuugugauccgcccgucucagccucccaaagugcugggauuacagucaugagccacgaugcccgaccucuuucuuauauaauuuuuuuuuuuaaucgggcagcccucagaaucacagcagauucagaaagacuccccagaaaaguucuuucacuccuaacuucuacccagccucauggucaccucagcagcucuccugagaccguuacuaaguucuccacagcuaaugguaacucagcuuggaaagaguucucuuguaggaggaugcugaagggagguugccaaguggugugggaaacugcuucaugcuuaaguucacuuccauaucaugauacuaaaagguaucuaacagcugauuuucauugcuuucauuugugaucugcuaggaccacuugauccuuaucacugcuuuuggcacacuccucauccaagaguugaucgcagaggcagaguuccuugccaccaguccaguggaaguacaagccaacuuugcucuccaaauggcagcaguagcugagcaggccgcccugcauucucuccucauaaacaugcuguucucaaguuugucagaauccagagcucucuacucauuacccccuuuuccaaacaagcaagcaaagcaugcucuuccuuuguuucccuuaauugccuaaaacaucuccaugcucauagcuguugacucucuuugccuccuaguuccuguuccucugguguaggauuucucagcccuagcacuguaaacauguugggcuggauaaucaucucuuguaugggcuguuugugcauuguaggauguugagcagcaucccuggcuucuacacacuaagugccagugacacucuucuccccuccccagcuguaaaacccaaaugucugcggacauugccaaaugucuccuagggggcaaaaucaccccugguugagagucacugcucuaucauuuauucacuaaauacugcuggucagcuggguccacuggcgaaccucacaucaauaaaccugguaauagaagcauauuguucuuacauuagaaguuuacucucuucaguuaucucacugggcccuugagggcuuuggggaggagugaugggaaaugguuuacaauuaacagcauauuccaaugaagaaagaaagcauaugaugucugcacaacagaggagaguguccacaauguacagcucuucccuggagcaguuauguuucucagggugugcuuuuccaagucauuuugugucugguuagaagccaccuucccuuagcauccagaggugccauguagacuaggguuggucacaguguguagauugccauugaccugcccauuccuaguguuugaccugguggucauggcacucugaccacaucaguuuuccucuccaagcccagauggguucucagaacccuccaccccaagcugcacucaugagaggcggcacuucugccauccugaucuagagcuuguucaugugguccagaccauuucuuugcagcccccucuccuguguaaaagccuuuaggaaagugcagagauccugauggauuccccuugacccucagcacgcacauccugguauguagugcucagcacuccguugggggcuucagacuggagaagagaaaacugcccuucccuuucaaggacauccuccaagggccagaaugcucaguuccguaaaauuaacucuccacugccuacuuuuuuuuuuuuuuuuuuaagacagucucacucugugccccaggcuggagcgcaguggugugaucuuggcucacugcaaccuccgccucccggguucaagcaauucuccuaccucagccuuccaaguagcugggauuacaggcaugcgccaccucacccagcuaauuuuuguauuuuuaguagagacgggauuucacuaucuuggccaggcuggucucaaacuccugaccucuagugauccacuugccucggccucccaaagugcuaguauuacagucaugagccaccaugccuggccugcugccuauuuaaauagcaagcaguuacaguuaaagaaagacccuggccuggggacgcugccaaggcuccuaaucugacacuucuuucauguggaccagggaucugaacuguguuucuuccaaacuuuuggagcuugcuuccuuggugguaagcuaaauaguggcccccaaaauauaccccuuuauaaccccuguaaccugugaauauuauaugacauaauggacuuugcacauguaauuaaauuaaggaucuugagaugaggggauuauccuagauuaucuggguggaccccuaaaugcaaucccaaguguccuuaugagugggggccagagagagagauuggacacaggagaaggaggcaaugugacuacugcagcaagaugcuacacugcuggcuuuggagguggaagagaaggccaaaaaugcaacgaacguagcuuuggaagcuggaaaaggcaaggaaacuguuuucccuuagaaccucuggaggaaguguggcccugccaacacacugauuuuagcccagugaaacuaauuuugaauuucugaccucuagaacuguaagagaauaaauguguuuuguuuuaagucgcuaaguuugugguaaugugguaauuuguuacagugcaguaggaaacuaauacagggcucaucugccuccagguacaagugguggcuuggcugaucccuguucuuauuuuaaggcgucccucucauggcacaaggagagcauaggcccagcauuuuccugaaccaguauuugaaacaaucugcacuuugggggaaccuguuggggaguucuuggaagcaagagagaaagccucauaugguacccgauccuugcuuuggaacucucccagcaccuucagugauaucaugaacaaagaguucuuucagaccagugaggauguaggauuauuaaaaucugauucuaauuccaucuuccccucuccucuuccauuuauucaauaaauguuuauuguguaccuccuaugugcuaggcacuggggaugaagggauaaacaaagcagauaaaaaaucuccugcucucgugguaacugaggugggggaaguggagggagccagaguuaagucaacagcaugugagauggcuucagaugcucucuagaaaacuaagcagaaaggaggguaguggcaguuccacauagagggccggggaaggucucaccacgaaggugacauuuaaguggaaagaggagagugaacuauugugggaagaaucucgcaggcagagggaaagcaaguuccaaggcccugcacugggacacagcugagguguucaacgcauagcgaggaggccagcguggcuggacagagggagggaggagaccaggagaugaaguuagagacgagauugguggcccugaagugccauaacagcuuuuacuuugcuuggcauuuugccccuucuuucuccucuccucccccucacaccaccucacgaguuuuaggcccauguuccucaguuccuuuccaugggauauuuaucccaucauacuuagggacuaccagcaggcaaacauagucacuuaaaaauauuagaagagggggaaaaagcagccuccucuuucugaaugaugaaagcaguuccauggcaguguuggcauggcacuguguaucuagcagugcaggcuggccauucaccgcguaguucugggugguuucugagagguuccccuccauggccuucuucagcccaugaggaaguccaaccccccuggcccgcuguuucuuuccauuucaccccucuuggucuccccagugggacucccacagcugacuucuauccccaccugugucuaauccccuuuccauggcugagccgguagauaaccuaguaacgaucugaguagaauauggcucccacauguugaaugcauugugcugaucacuacauauaucacuuugauucacacaacaacccugagagguaggaaccauuguaccccuuuuagagaugaggauacugaggcucagacugguuaggaaaauugccuaaaguugcacagcuaaugaauggcagagcugggauuugaacccaagugauuaaagcccaugucuuugaucacuacauagcagggccuucuaggaaggauggcuggcuggaucuaguuguuccaguuuggaaaguaccugcuugacuggccagacugcuguuggcuucagaaaauagcagucucuuguuggucacugagaagaggcaaaauuuuggcaggccuuggggccuccugcagagucucauuccaggucaguggacagaggaggcccugagaauagucgugcauacuggcucccuggaucugcuccaagacagugagcagccccuagaaccacaagagacuggccagccaagcugugggcccggccuguaggguggaaggaacucuuaagagaaaaaaaaaaucucugcugugauuaaucaacagcuucagucuggugaagugaaaagagaaaaguuggcccagaugugcacauagggagagaaauaagggagggaaauugccuuuauucauguucucccuuaggccagucguuaccccacggaugagaucaccuuccuuuuacaccagccugcaagagguguguagugguagucucauuuuacagacaagguguaggaucagagagguuaacucgcccaagucaaacagcuaacaagugguggaauuggaauuugagcccuguucuucucaguucaguagcccugcuguucuugcugaugucaccucagcaugggcucuccagguaugugcaaauaguuaugcaaguguugcauccacaggcuugugagcagaggcugaaagggagccagggcucuugguacuugcccucucaacaugggcccugccuaagcuagcaggacucacuauacccaaaccagcaguggcauuauauuuuucucuuuucuugcaccuugccauccccgauuuauuuuuagagagccuuuucuauuucuguucccauuucuuggcuuggaugcaggggcuggggugcagggauggcgcuagaaaucagaagaggcaggcauagauggcaucucacugguggccuuggcuggucucugggaacugugcccaucugccugcccugcuggcuccuccucaggccagcuguaggccccagggaucauagagcucggguagcuagaggcugggagggcaggcgagacagagaaacagccacacuucucauuucuuuggcuucucagagggggaugagcuuccuccuggaacagagaagggaguagcucacugccuguuucucaggguuagguuacggacuucuagggaauaugggguagugcuuaagagccagacucuguguggcaugggggugauaacuguagacccuccaccucuggggauuaaaugagcucauacauguaaaggcacagaggaggcacucacugaaugaugauuguuucauuagugucuuuagacccucagcacccagcaccauagguggaugccagucauuauugguuagaccaaacagaacuucaaggcagcugggcaugguggcucacaccuguaauaccagcacuuugggaggccaaggugggagggucaccugaggucaggcauuugagaucaaccugggcaacguagugagacccagugucuauuuauuuaaaaaaauaaaauaauaauaaaaaaagaaaaauaacuuuaauguuauuuuugucguccucuucaucugaacauuggccugcguagguauuaaccugaguccagugauuguuuguggagccccacaggguacuucccagugacagcagccuggagugugcuccugccagccccugccugggcccuggaaaaggcagggcagugcagcgaggaaucuucuggccuaaggaugccuguaaccaccaaaccuuauguuuaguuuuacaccuugcugagggucuggcuuuuggauaugagcucuggagugguaggggucugugucccauggggacaggugguucuggguguugggcacgaggugauggaggaagggccugccacuugcaagcuguuuaucugacuaguaauaaacaguggaugacaccuuuaggaaacuguauuugggagcuuugaaauuaaucagaugccaccaauggcauuuuuaauuuaguuaaaaauguuuuaguuauauaaauaaugcucauucguuauagaugauuagaaaauacagauaagcacugaggagaaaaaaguaauauauuaucacacauaaguggcugcuuugauauaugauuuuuuuuucuuaccuagguucuuuucaaauuguguauaccuaguuauuuuuucugucuuucgaaaugggaugcuguuuaacauuuaguuuugugacuugccuuucccauuuuucaggugguuuuguggugucugcuuguccuccgaccuccucucccauuugugggaaaggcauuuggccuggagggaggcacuugggaagaacugucugguuguuccuugauguuauugccagacuugcagaggguagagaggugcaugaagucuuacucugccucuccccaucugugucucucccugucccuguccagcgccccaucugcucugccuacucaccacuccugccuuuuuuuuuuuuccuuccauacaaauccagaaaaggauaccaccuccagucugaagguuucuuucuauggcuuuuagggaugaaucucucaggaguuuagaaaaaaagaugcacagacaguauauaggaaggguaaugccagggcugggggugggggucuugggaagagcaacugagaggagggccugggucccuggugcugucuugagucagugagaagaagcugcgugggugauggguuggggcgggguaggcagcaggugacugcagggaccucucugaaacagcaagcaagcuggccaggaagacgccuggagaauaaggggcccagauaggggccagacauaggggagaagaaaaugugucucaguggcaccugcuccuccacccuggccccacucuuuccaugaucuuuccagagauucucucuuuuucugccugaucugcuucccucaccuggcagugcccagccccaguaguuugacacaucugguauaucuggcuacugugcucuacugacaccuguguggcagcagcugcacagcuucuuggcaucucccugggcaguaggcagggauccgagcauagaggaagauguuccaugcaucaguaacucagauuccguuccagaaacgcaucucaaagcaagggagaaaauugaagaugggguauuuuguggggaacaagcuaugccuuccugucacuucuuacagaauaaaauggggucucuggcaguaggcaaggagaaggccuuucugagcacugagggucaguggcuucucaggucuuuucugggccacuuuggccugcacacagguugggcuaggaauucaugcuuaaaagcaggcugauuuccauaggcugugcguuccugugggccugccuggaucauaucuguucugcugugaucccaggccuggugagacccacuggcuuccuguacguccccucaaagccugcgccaccgccucucccuucaccacucccaagcuauaauuaaguucccaugugaaacuguaucccucagcugacacacgcuuguaacuacagcccuggccauuggacggcucaucuggggugacuucuggggcuggugccucagccuccagacgcucuccaguaggucugaguaggugguguggacccaccaggaaaggguggauccagugaggcgggggccaggccuugcccaagagucagaaagugggaagucacgggggagaugaagggcgagugagcagcuagaaagugccaggggacacaaaaaugggggagacaggcagccuuuuggggcuggagggcauggacagggugacugaugccugagccacaggcagaaugugagcaguuuauuuuauuuuauauucuacauauuuuuauagcauaaaauuaagauauaguucacauaaccaaauucaccacuuuaaaguguguacuuugaugguuuuuguauauuaacuguguuuuauauauuauauuaaauuaauauauuuauauauuauauuaacgguuuuauauauuauuuuagcuguguuguuuauauauuauauuaacuguguucuauuaaccacuaauuccaggacacuucuaucaccuaaaaaacccuuuaccugucagcaguuacuccaucccuuggcugcuaaucuacuucccuucucuauggcuuucccuauccuggacauuucauaugaauggaauuauauaauauguagccuuuugugucugaacaauuucacuuagcauguuuucgagguucauccauguuguagcauauaauaguacuguauuccuuuuuguggcugaguauuccauuguguguauauauuccauuuuauuuauugguaaauugguggacauuuggguuguuuccauuuuuugacugcugugaacauucauguacaagcuuuuguguggacauaugcuuuagguucucuugggaauauacuuagugaaauugcugggucauauaguauuccauguuuaacuuuuuuuuuuuuuuuuuuuugagacggcaucuugcucuguugcccaggcuggagugcaguggcacgaucuuggcucacugcaaccugaaccucccugguucaagcaauuucccugccucagccaccugaguagcugggauuacaggugcaugccaccacgccuggcuaauuuuuuuuuuguauuuuuaguagagacgagguuucaccguguuggccagacuggucucaaacuccugaccucaggcaaucuccccgccuuggccucccaaguguuacucuuuguuuuuuguuuguuuuuuuuuuugagacggggucucacucugucuggagugcaguggcgcgauuucgccucacugcaaccuccaccuccuggguucaagugauucuucugccucagccucccgaguagcugggacuacaggcgcaugccaccaugcccagcuaauuuuuuguauuuuuaguagagacgggguuucacuguguuagccaggauggucucgaucuccugaccuugugauccacccgccucggccucccaaaguggugggauuacaggcgugagccaccgcgcccggccccaaguguuacucguuaggcagauaccugauaccugucugcuauacucacuggucugcaccuugcuucacuuauuauaucuuggccaucuuugcauaccagacauguagagcuuccuuauucuuuuuuuuuuuuuuuuuuuugagauggagucucgcucugucacccaggcuggagugcaguggcgcgaucucagcucacugcaagcuccaccuccugguucacaccauucuccugccucagccucccgaguagcugggaauacaggugcuugccaccacacccagcuaauuuuuguguguguguguauuuuuaguagagacaggguuucaccguguuagccaggaaggucucgaucuccugaccucaugauccgcccgccucggccucccaaaguccugggauuacaggugugagccaccacgcccagccccucauucuuuuuuuuuuaacaguuggcucauccauuguauggaugugccagucucuucuuuuuuuuuuuuagacagauuuuugcucugucacccaggcuggagugcaguggcaugaucucggcuuacugcaaccucugccuccugggucaagcgauucucccgccucagccuccugaguagcugggauuacaggcaugugccaucaugcccagcugauuuuuguauuuuuaguagagacaggguuucacuuuguuggccaggcugguccugaacuccugaucucaaaugauuugcucaucucggccucccaaagugcuaggauuacaggcgugagucaccaugcacggccuggaugugccauucucuuauucauugaugaaugugcaggugacuucuagucuuuuuuggcaaugaauaaccuugucauuuuacacacagauaaacagauugacaaugcuucugugugauaggugcaguaauggagauagacacuggggaacuagggaaggcuuccagaggauaguuaagaaaggcucagggugagugagcgcugguaucugagugggccuugcaggccuggcagaauuucagcaggcugagauguuguaggaagggcaaauaugacugaagaaaagaacaacagcucaggugugacaggggaaaugaagaguauuaguuaucuauuccugcauaacaaauuaccccaaaacuuaguagcuuaaaacacuaucucgcaguuucuauggguuaggagagauuuacacaaauaugugaauaccagaaggugaggauuguugccagccauuuuagaaggcugacucuaauagcaaguugcaguaaggauaggauuggccaaggcaacagauggagccaugauuguggacaaucuuacauacuuagcugagagguugucagagauugaucugagaacagugugagccauggaaggucuuugagcaggagaauaaugugauaguugcuauacaggacaauuaaucugauagcauuuaugcuagaggggucaaaauggagagagauacacaggcagaggccuagauuaggagauggcuauaguaguacaggugagaaauuccuggccuguaguacuaaauacuuuuuuuuuuuuuuaagacaaucucacucugucacccaggcuggagugcaguggcaugaucucggcucacugcaaccucugccucccggguucaagcaauucuagugccucagccuccuuaguggcugugacuacaggcguguaccaccaugccuggcuaauuuuucuauuuuuaguagaaaugggguuucacgguguuggccaggcuggucuugaacuccuggccucaaguaauccacccacuuuggccucccaaagugcugggauuaugggcgugagccgcugcauccggccucuguauuaaauacuuuagcugcauauucuuucuucgaaaugaccacaaaaagaagguauuacugauuaauaugcauauggucuugcguauggccagacuuaugacuugcguauggucauaaagguaguaaguugcagagcagcacucagaccugccuggcuuugaugaccgugccuugauggcacuggaaguggaaaggugggggugacuggggaggugagguuuuguccguucccuggaugcuaaaaggaaauggaggaguguaagagguugauucuuugaaccuggauggcuggggcaaagauaacacuguaacaggaagaagagaggccggagggaacacugaugugaugggagaaggugagugauuugggaacauggggcauuuguuggcaggguccuucccaauuauagggcgaguauaaauaguuccugugcuuuguguaugaagagguacccuuggcccaaaaagacucuaaauguggaaaaaggauaugguggugugguggugguuugaacauuggguuugcgcagauagugaugguaacuggcacuggccugcgcuucagacuuucacagcccguucacuucuguugaaacucacacaacccuauucagguuaucaucauucccuaucugauugaugaggaaacuaaggcucagaaaaauccauuugcucaaggagaaacaguguuucaguuaccuacugcuguguaacaaaucaccugugaaacucaguaguuuaaaacaaccaccauuuauccuuucucuugauugugugaauuggguccagaugcuugguucugccccacaugaugucggccaagcuugcccauuugucuguguuuagcugcacuguaauguccaaggcagcuucucuuugcauggccucuaauccuucaagagucuauccugaacuucuugcagcauggcaucugggggccaagacaguggaagccagucguguugaggccugggcucacgucccagaacaucaccucaaucauguucuauuggucagagcugucacugggccagcccagauuccagguugggaacuagacgccaccucuugauggaaagaguggcaaaagguuuguagccauauuuaauccacagacagccgguaguggauaccuggauuugaacccagaucugugugacucagacucacagucugucaugccauacugcaucccuuucugcuucugguuccuugggaguugcaaagcuugcuggcucuuuugugugguuggagagggcugauuuuucuuguggucucccacaguggaaguuguacuagucaucccccuuuucacagaugagcauccaagaucacugugucuuagggaaccuuccaaaauagguuugcucuagggauuugcuagcuucccccaagcuucagcagugauagccagacaugcauggaauuucccuguggaguuucccuuucugcgcuuaguggccuuuugaugcacagugcucacugggugggauuccugcugcauuguagccagauguggaggcuagcccuauuuugaguuaucccagaugguauccagcccagugagucccauacuugacucaacuggcauauucaccagggaguuuuggggaaaauguagauuccugggccuuccucaugccuauugaauuagaauucccagggauggcguccaggaaccugccuuuaaagcuccccauugauuugggaguacagccugguugggaaaccaaugacuuccagaggcuggcacccucccucagcccagucauuucagaaagaugccuuugaagucacugaucagaggaggccacaugggagagaaugauuuguccagagggccucacacuucacaaccaggaagugacuccugaaaguguccaggaaguuucuauuugaaucugcucaaaucuuugauguuguuuugcaugcuuugauaguaucugagcuuuaugguggccucuggguguuuuucuuugaaaguguuugcagagaguagcaagcucuuccagcagucagcagacacucccuaaccaggagcuacuuggucugauuuauuugaaauaugaaauuccuuugcuuggcugucugguugguaucuuuggugugaagaauaugacaacccuagagauaccuagguuagcacagcaguuggaccuuucuagucuugugccuuggacauacuuaagguacacuuggaaaaguagauuuuaaaacccuggauaauuugguuugccaguuaaauaaacuucuauauuuuagaauauuuggaaaauaaagauaaauauaaggaagaccauaaaauuaccuagaacuuuccucucagagaauuuccacgguuaauguuuugaauggcuauucauccuuccccucaugacccuucacacccccucuuuuugaaaaccauauugaagucauauugaauguuacuuuuuagcaguuuuguugagauguaagucauaaaguccaccuguugacagugugcaauuugaugguuuuuaguauuuacagaguuguacaaccaucaccacaaucuaguuuuagaacauuuucuuagucccaaaaagacaucuuauaauccauuagcgugcauucccgccucgaugccccaucccgcccuuacuccagcccaagacuaccacucaucugcuuucucuacguacagauuuaccuguucuggacauuucauauaaaugggaucauacaauaugugaucuuuugugauuggcuucugucacuggacauaaucaugguacuguuuugaaaccugcuuuaaacauuuauauccuagcaauuugaauauaguuuucaagaaugcacuuuuaauagcagagcgguauucauucuuaugagaauaucuaaucuuauuuaaucaguccugccaacagacguuuagguuauuucucaucuuuugcucuuauagccagugcucucugcacucagaaauuauuuuguugauuuauugguuaauuguccgaaucugugacuagaacaaaagcucuuugagaacagucaccuucucugucuccccuacuacuuggcauaguuccuggcacuugguagguauucaguuuuuaaaggauguguauguguguauaugugcaaauuuugaaugaaucaaaauguaaggauauuaauaaauguugccauauugccaaauucuagaaaguuguacuaauuuacccucucacugcaguauaaggguaccugacucccuguuccuuugaaucuggguuaauuuguacaggaaguccugugaucuuuugaaugaugauauucucugaccugucaaccaguuaguuugggaauugaugcugucuguguccugacccugucugugggccaggaagggucuggcuguugggaaagaugguggugugugggagcucuagcugcccggguccucauuguggcuccgugguauuguaucguuuccuguugcccuuagaaaggcugcaucguguugucuggccacuuccucuauugugugcaggcauguuggggagugaguagaguuggguggauaaaguauguguaagaagauacugguuauggcugcugauuggagugccuuuugaagucgucaggagagaugucacucuggaaguucagugucuucaaaaauagaaaugaagaaaugcuuccaggaagucugaugcaacuggcccagucugcccccaucugaggguggugggcacccacauggcugguaaacgcuucaugagucacccacuggccacagucccugcuccucuccacacacuuccugucuggaaaagccugcuacccgcccauggugaagagucaccccagagaacuugccagggaugcagggcaggucuucccaggucacagcagcagccucucgcucauggguuucacagcaguucuucuccccaagaugaguugugguaacugcuuuuuagauaaauauguggaauggaugguugggauuggaaaaaaaaagagcggcuagauggcaaggcagcucuuguguguagcagggagcucacacgagccccaugguggggcaguuaaggccccagaauucaccuucuccagcagcuggcugcucauucuuuucuucuucucgugguuuucccaucacauuucccuugggguuucuuccaggccuuccccuacucaccccacacccucucagaagaugcugccucauguaacuuggccaagcucucaagcauuacagaugccuuuaccuucuuuucuuugcaucuuagaaaucacucacauguuggucucucucacauaauugcuuuuuauuauuacuucagcgguugccaagugccuacucuaugccuaguaccuuguuagacucgggaaugaugcagaagaaagagacuggacccugcccccuaggaggguaaaugucuguucucccauggccucuguuucccuuccucucugacugcgccuuugcugcccugguuccucuuccucuuuccgcugccugagugucaacauucuucaggcuucugcccucucuccucucccuccacgcgcuugucccuuccuguggcugugaccaucugcucuuauagcuaccaaauacuaaaguucuuuucuccugaaaaccaggucccuguguccaccugccugcuggagugugcagccuuaaaagcagaguccaucuuugucucugcucuuugcauauccccuuucuguuaauaauccgucauucucucaguuucccggagccuuacugacagcuuuaaaccucauuccucugccaugcacaggucguuccucccguucuuuugaguguuucuccccacugauuuuccugccuguagugaguuggaugguugccccuccaaaagauauguccaaguccuaaccccuagaaccugugaacaugaccaccuuguuuggaaaaaaacucauugcagagauucuuuccuaugcugcagacguacaugaaccugugcucauugaccuccucucugggccuggccuuguuggucucuggcuugaaauagugacuguacuucuaguccacacagugauuacauauuuauuacucuguuugagcuccccuaguccaaaggcaaaguucacugccugcccuuuccacuaacuccuaggucagacuugcuagguugugugcacagcagcuacaagugugguuucuaaggugggucuggguuugaauccugguucugucauuuauuagccaagggccuuugacagauuguaaccuuucugggcuucaguuuccucuucuggaaaauggagcuaauggauuguugugagaauuagauugcauagugucuagcacugugccugacacucugagcuuuauuuuuauuuauuuuuauuuuuugagacggagucucgcucuguugccuaggcuggaguggaguggcaugaucucgguucacugcaaccuccaccucccagguucaagccauucuccugcuucagccucccgaguagcuggguuuacaggcucccgccaccaugcccggcaaguuuuuguauuuuuuaguagagacgggguuucaccauguuggccagguuagucuugaacuccugaccucaggugaucugcccaccuuggcuucccaaagugcugggauuacaggugugagccaccacguccagcccacucugagcuuuauaaccagagagaugcuguggcuagccaaaucgcucaaccuauacuuggaggaucccaagcuuggaugaguguaagagcugugacuuaaauccagccuacuuguaugucauucugccacaguugucuuugucucuccacaguuuguccuggagcugggcauggugagggcuaagacaauggauuacagagcuacaggucuaggagggcauguggaauuaugccuauaugagauagaugacaaaguggguaagagcaugugcucuggaguuagaccuggguucagauucaggcucuaugacccuaucucagugaccuugggaaacuuuucuuugcaucucugggucucaguuuucucaucuguaaauugggaauaacaaugguucauaccugucuuagucugugcugcuauaacaaaauuccugagauggguaauuuauaaacaaaagaaacugauuucucacaguucuggaggcugggaaguucaagaucaaggcauuggcagacuugaugucuggugaaggcugcuguccacuuccaagauggcaccuuguugcuguguccuccagaggggaugaaugcuguguccuuacauggcagaagggugaaaguggcccagcuaguucccuggagcccuuuuauaagagcacuaauccguuccugagggcagagccuucaugaccuaaacaccuccaaaggccacaccucuuaauaccguuguauuggggauuaaguuucaacaugaauuuuggaggguucacaacauucaaaccauagcaaugucuuauagaguaaucgggaugauuaaaugaaagaaugcccauaaaacauugaacacaugccugacucuuuguaaacaauaauuauuagguaucgcuauuauagagaccagcuucugcuguggagaguguuaagugccuugaugccacaagccacuggacacgcagcugcauggaucaauguaccccuguaauuauguaacaaggggacauggagaaaaaaacauuuccaauguugccuccucuguaacaugauuguaccccuaaacugcacagaggagcuuucuguucuuugaacuccauagcuguugguacgucucuugugggguuugccauagucugucuuauacuaugacuguucuucacucuacgguacauuucuuucuuucuuuguuucuuucuuucuuuuuuuuuuuugagacaaagucuccuugugucauccaggcuggagugcaguggugcaaucucagcucacagcagcccugaccuccccaacucaagcaauccucacaccucagcuucccaagaugcugggacugcuggcaugugccaccacaccuggcuaauuuuuuuuguauuuuuuguagaaaugggauuucaccauguugcucaggcuggucuugaacuucugggcucaagcaguccacccaucucagccuaccaaaguacugggauugcagugugagccaccacgccuggccuacuguauguuucuugaggucaagauugggcacuggguaacugauuacuugaauugaaccuugggauucagccagugaaagugguccaccuggcaguagugaaccucuggcuccugaccucugcugcuggugaaucuguuucuccuauggcugcacagacacaggguuuccugccuccaaagagcuuuuccacucuguacaugggaccugaaccggcuccagaaaccuuggagccuggcaccacuuuucacaucacccagcaggagcagaacuuagauggaccaggcauagaugggaaacauggguuuauugcuaaggucaugguuaguucucggcgguggggcggggggguuuagugggcaauugcuuuuuggauuuuuguuuuguuuuagaaguaaaaaauaugggccaggcgcgguggcucaugccuguaaucccagcacuuugggaggccgaggcgggcggaucacaaggucaggagauugagaccauccuggcuaacacggugaaaccccaucucuacuaaaaaauauaaaaaauuagccgggcaugguggcaggcaccuguagucccagcuacucgggaggcugaggcaggagaauggcgugaacccgggacacagagcuugcagugagcugagaucgcgccccugcacuccagccugggcgacagagcgagacucugucucaaaaaaaaaaaaaaagaaaaggaaaaauauguacauuuuuaauagugguaguaagaauuuucuguaacuacuuacgggacaucuucacugaggggucuccagagcuccuaaaacucagcacucccccagugauucuuacauuuuccugccagacuugcucuucuucccacaauccccaccuuaauggaaucauccacaucccccuggucaccugacaguugcccucuauuucuuuauucuccucagccucuuuuaaucagccaccaagucuuguuuguccuuccucccuaaugucacuccuguuuuuugccgugaggucugauggcacuagugcugccugggguugcuacugccucaucucuucaaccuuuuugugucacgauguuuaggaguuucuuucauaaacagaauguggcuggauuuaaaucaaaucugacaaucugucuuaaguaauuuauguacauuuuugggauuuaacuuaacguauuacuguauuauauuuuuuaguacuuuccauguauuuccauuuuugccuauuuuucuccuuccgaguuuuuuuuuuuuuuuuuuuuuuuuuggagauggagucuugcucugucacccaggcuggagugcagugguguaaucucagcucagcgcaaccucugccucccagguucaagugauucuccugccucagccucccaaguagcugggacuacaggcacgugccaccacacgcggcuaauuuguauuuuuaguagagacaggguuucgccauguuggccaggcuggucuugaacuccugaccucaggugauccacccaccucggccucccaaagugcugggauuacaggcaugagccacugcucccggcccggaauuuucuuuauuucuauacauuuuacuuccguuguuuuuuucuuuuuugagacagggucuagcucuuuugccuaggcugaagugcaguggugugaucacagcucacuguagcuuugaccuccugggcucaagcaauccucccaccucagccuccuaaguagcugagauuauaggugcacaccaccaugcucagauaauuuaaaaaaaaauguuuucuagagaugggauguuacuguguugcccaggcucgucuugaacuccucacucaagcccuccucccaccuuggccuccaaaagugcugggauuacaggugugagccaccuuaccuggccuuuauuucuguucuuacuccaacauuuucucaucuuuucucccauccuuuuacuuagaaaaauguuaaaauuagaggaaauaguacaaugaacaugaguauucucuuuaaucuuauucaauuaauauauuucucuguauauguauauaugcuuuuguuuggaaucauuugaaauuaaguguggauuuguucuccaucuucuugcucaggauuuggugugcugcuuuuaucugaggacucauuuauaaaagaaaaaacaaagaaaaagccuuuuuacuuuaaaaugauuguagauaaacuuagcuuuacacagaguuucuguauuccuucacccagcuuccccuaauguuaaucucuuacauuuaauucuuucuuaaguucuggaaaauuucagccauugccucuuuggcuuucucguuuucucuacaguggccucuggaaugccucuuagacauauuguugagcauuuuaccaccaaagucucuauauuuguucuuucuguguuccuuuaucuguuuaaucauccaaguuuucuuguguaguuucuuugagacugucuuauuucugauucuugggaugcuacuucucuuuuugugucugaggcuugccccucuuggugguuuauuuccuugugugguuuguaacuuugggugugaguucaucuccaggagggauucucuuuucuggcugagacuuggguccugaauuaugaaaguauaccucagagcagcuuguuugccucuggcggggccaugaguguuucagugguccuggcucaguuuuuguucacugcuuagugcggcaccccuuuacuacccuaguaguguaaguucaguuuuauauccaugggcaggacuagcuugguggcuuaagaaagggugaccucccgccgggcaugguggcucacaccuguaaucccagcacuuugggaggccgaggcagggggaucaugaggucaggagauugagaccauccuggcuaacgcggugaaaccccgucucuacuaaaaauacaaaaaauuagccgggugagguggugggugccuguagucccagcugcugggaaggcugaggcaggagaauggcaugaacccgggaggcagagcuugcagugagcugagaucacgccacugcacugcagcccgggcgacagagugagacucugucucaaaaaaaaaaaaagaaagggugaccucccacccauaccugacccacagagccuuggagaaguguucagcuucuuguugcuuuccuuuacugggcagcccuuugaggcucucuucuugauacuggggcucaaagccacaggcaggcuuuaaaccgcuucauuugugggugcgaaaguccacaggccauuguggugucaguuccacucacuguuuauguuucaauucuucucgcacauaggcauuucucuuuccaauuuggcugcaugucuacggacgucauuuguuuuauuuuaucugguauuuuucugugauagugguggaaaggggaagcucuuucacguuaauuuagucccguauccuacugaaaguuuguucaaaugcuuagcgugucauaugaagcuuuucaugaugcagcccauucuaccucuccugcauaaacuuagcucuuaaauuuuacacuucagcaaauugaacuauuugcauaccauguacuguaauguuuaaaagcacagguuuuaggguccagcuguuuggcuuggaaccugucuuuucauaagguaugauuuuggacaaguuacuuaucccuuccauaacucagcuuucucaucuguaaaauggcagcguccggcaugcaguaacccugaucccuguuggcugccucugugguugcugcccccagcaguugaggcugccaggccucugcgcaauugcacuguuuauuccuuugcuggaauugccugucuccccuccucuccuugaucccucccaggagagcagccuuuacuccuucagagcuuggggucucugucuguaguaacuaucacucugugggucgcugcuuguuuacguaucuuuuuuuuuuugagacagaguguugcucugucgccaggcuggagugcaguggugcgaucuuggcucacggcaaccucugccuucuggguucaggccauucucuugccucagccucccacguagcugggacuacaggcgugcaccaccaugcccagcuaauuuuuguauuuuuaguagagacgggguuucacccuguuggccaggauggucuccaucucuugacuuugugauccgcccgccucggccucccaaagugcugggauuacaggcaugagcuacugcgccuggccacguaucuccuuuuuucagccgacucugacccccuugagagcagggucuuguuuuucuugguacuugaaacuccuuacauucuaccugucauuuggugggcauucaguguugguaguuuaauugcauugaauuucucuggcugaguagaggcaagugcugggagugguaugggacgcagaggcagggaaugacagcaggaaagcuuguuuuuuggcacauuuugugccaaguugauggaaaugugaaucaguauggcugggacacaagguaacaauucuuagucuagcugaggaugccagagacuuaaaacaagccaguggccagaaaaagccacuaaaucuugcaaauuaaagugguuuccagacuuaagaaugcaugccccacauucccuucccaaacucagcgucucugagugccagguggaggaauacaaacuaauuauaauccuagugggcccugagaaucuuuaauuuuagaauaaggcugcacuucugaaaggcgcaguugcuuuaggaguaggugacucuguaugcccggggccuccgaggagaccaggaugugaaaacucaguaccuggcauuuagagcugugucacccaucacuucugaccucguuaagauuucuacccuacugcgacuuaacaacuaaaaagggcagaugagauagguccggggcagagcuuaauggccugugucauucuccucagcuuugccugaauucucuggacucuugagacucuaucauaggaauauucucagaagagaaggcaaucgaaccuuuaaagauccccagauuauccaucagauaacagucucaugagagugaugaacaaugacagcaccaacucucaauucccuuggcuggaauuucaggaaucagcuugaacucagaggugggcacaggguuagggcuuggaguaggcgucuuuucuuucuuuuuuuuuuuuuuuuucuuuuuugagauagcgucucacucuuguugcccaggcuggagugcaauggcucaaucucugcucacugcaaccuacgccuccugguuucaagcgauucuccugccucagccucccgaguagcugggguuacaggcauccgccaccacgcucggcuaauuuuuguauuuuuaguagagaugggguuuuaccauguugcccaggcuagucucgaacuccugaccuuguggucugcccaccuuagccucccaaagugcugguauuacaggcaugagccaccgcgccuggcuugcaguaggcaucuuugcccaacccacgugaaucccauuaguucuuucuugacagcucucagucuguggucauauauuaagcaacuauguguucaguacugugcugggugcuauugcugaagauacggaaauaguaaugccacaagucccucuucuuagagaggagagcuugcacucuaguuggagagaauuccuagcacacagaaagcugcaaccaguggugcccaacaguaaugcugucugaugccacugcaugcaagugugucccuuugacaacuuggugcuuuugcccaaaaggagcuguucucuuucugaggcuuggacuauucguuuguuuuuucucagaugacuugcuggcacuguuacagacuggucugaauuaacuaggacuaccuuuuaucuguuucugaggaauagccccaaaugugcucucucuuggucuuuaugaacuuuuccuuucuuccauuucuccaaauuaugauagauuaacuuugcagugucaucugcuaaucuccaaggucuucuaggggcacgucaucagcaguugcugcuuuugagguaucaagguuuguccuguggagucucagauaguuucuuuaccuguucaaugaaucugauuuuccauuuuucuaggagaguguaucucaaagugauugcugaaucagaaugucugggagugugacuuggaaucuauuacugaagauuagaggaaaauguagcaaauugugaucugaagcauuuauggauggauugauggauugauggauagggauucugacugaguuagguagucuauagucucagacaguuguggaagcuccauuaggucaugagcaacccagacuccuuccaauucugugcccugccauucuuaggguguggcugcuguccucaugguccaaaaugguugccgugguuccacaucucacagugagauagaagaagacagaagaaugaugucucaccucccuucuaaggagacuucagcaaagccugccucuaccacuuucugugacugagggaaaguuaauucauacucagagccaauuaaccucguguuuuuuuuuuuuguuuguuuuuuuuuuuuuuuuuuuuuuuuuuuuuugagacaaggucuuacuuugucgcccaggcuguagugcaguagcacaaucucggcucacugcagccucgaccuuucgggcucaagcagggcuccucccugcucagccucccgaguagcuggaacuacaggcacaugcaccacacccggcuaauuuuuaaauuuuuucguagagauugggggucuuguuauguugcccagguuggucuggaacuccugggcucaagugauccuccugcccuggccucccaaagugcugggauuacaggagugagccacugcacccaaccaguuaccucauuuguaaaacaggcaugguaacacuuagugcaggagcaagaggaucagggagcacacauacauacaaagugcuuggugcugaugcccagccugcagcaccuguucucuaaaucauagcagcaauugcugcugcagcacacuucucuuucuccucucuccaccgcuccaucucuccagggucucuaccuugccugucaggcuccacuuuccuuugcuccugccuuuugcaucuguuccucucugcauucuccccucaucuccucucuuccgugcaccucauuuuccugcuccccuccugccucugucccucaucuucuuuucagagacuuaaaaccagccaguggccacuggcuuuucagugucuccuccuccuccuugaacuaccucuuccuucuagugcuucuguccuucccuccuccugaccuccagugaacaauaauuauuuguaacguaaugacaaauuaucguuacguuacaaagaccagagguuagagguggugauuggccuuguaaacuguaggucagcgaugaguaauuuaagaaaacuaaauuuaauugguuuacucaugagucaguuaggaauucuauuuggcagcuagaacagaaauagcaguggcuuaaaccaguagaaauuuuuucuauugugaaaagaaaucuagggggacagucuagggcuugucucuccgcucugccauccuuagugcagggcguccaaccccaagguuguaucauggucuaagauggcugcgggagccccaaccaucaugucagguucuaggaagaaagcaggaagaagagaggaaaggcaaaaagaacacaugcuccaucuuaaggagcuuuccugcaagucccaccaaauagcuucagcuucuccuccuugccuccauuaguugcaagggaggcugagacaucauuuagcugagcacauugcuaccugagguagaauugggauucugucaccaagaaagaaggggagaauggauauuguguaaacaauuagcaaggucugccgccauucauucaacauuaauuuagcaccuacaaucuacuaguuaugaagaacagucaaggugccccauuccagagggaagacauagauaaguaaacaaguacaguacacaggaugggugaggaagagggggagaguggagaaaggcaugaaguggguaucuuacauacccuccaagggcgcauucuagaguucgucaugcagacauucuugccugugguuuguuuccucuucugcucucuccuuuuugucauugucgccauuguuguuguugggguuuguuuuugccccuccauucugacgucagcaguagccccuagaaccuuaggaaacagaaacaguuggccuagugggaagcucugggaugggagccauguguuugaagagccaagucccagggccauuaggcaauuagaggccuguggcaggagagcauucguuccuggacaugccguggcacugccaggagacuuuacuccaggaauggggucguugucaggaggcauguucuaaccaggcaccuggcaucaccuauacugugcuugccauaaaaugaaauuuuggagcaguaaaauucuccaggucccgugaaauggguauaauuguuucacccacauuaauuuaaccagaggucuugguaugcuauaguguuaauuauguguaaaaauacuucuacuuacuauaaaauguauugacaguuagacauugauauuccuucuuagaacucaaaaauucuaggaauaacuugggagacccacauuaucuuucauuuugaucccaagaacaucuauugcuguuuccuuugggaaguuagagaggcaaugggaagccugcugcagagauuuucuaaacaggcauaucccagccccuaaggaguuugaaagugucagagaaggcuaaaggauuaaaagaucguuuguucuggcacagugcaauccuuaugagguuguacugugacccugggcaaguuaccauccuauccucaguuucuucaucugucaaauuuugauccuguggacccuccccaacagggcugugauggaaaugaagagacacaugggaagcauucaguauguguuguuguuauuaucaucauuauuguuauuuuuauuauuauuagugcuacugguagugcuagcccacuagcccacugggcagcgacugcacccguaucagaguguggaaagccuuggaugccacauuaaggaguuggauuuugugggcaagggugugacaggucauggcugggcuuagaaaugucacugacaggaguggagaggcagaucuaggugaggagugggcagggcuugaaccuggccagucaaggaaaggggagaauggauaccugaguggugagggaggacccacuggugcuggaguucagccugugugcccaagggauggugucccauugacuugggugggaagcacuagagguggagcaguugggguggcaggaggggaaagaagcauauggugaucagcucagcaaacaaauggguaacuugcgcacucagugcucgguggugcccaggcuggagugcaguggcguggucccggcucgcuacaaccuccaccucccagccgccugccuuggccucccaaagugcugagauugcagccucugcccggccgccaccccgucugggaagugaggagcgucucugcuuggccacccaucgucugggauguggggagccccucugccuggcugcccagucugggaggugaggagcgucuccgaccggccgccaucccaucuaggaggugaggagcgccucuuuccggccgccaucacaucuaggaaggaggagcgucucugcccggccgcccaucgucugagauguggggagcgccucugccccgccgccccgucugggaugugaggagcaccucugcccggccacgaccccgucugggaggugaggagcaucucugccccgccgccccgucugagaagugaggagacccucugcccggcaaccaccccgucugagaagugaggagacccuccacccggcagcugccccgucugagaaaugaggagccucuccgcccggcagccaccccgucugggaagugaggagcgucuccgcccggcagccaccccguccgggagggagguggggggggucagcccccccgccaggccagcagccccauccgggagggaggugggggggucagccccacgccccgccagccgccccgucagggagggaggugggggggucagccccccgccaggccagccgccccguccgggagggaggucggggcgucagccucccgcccggccagccgccccguccgggaggugaggggcgccucugccuggccaccccuacugggaagugaggagccccucugcccggccagcggccccguccgggagggaggugggggggucagccccccgcccggccagccgccccgucagggagggagguagguucagccccccgccaggccagccgccccguccgggagggaggucggggcgucagccucccgcccggccagccgccccgucugggaggugaggggcgccucugccuggcugccccuacugggaagugaggagccccucugccaggccagccgccccguccgggagggagguggcggggucagccccccgcccggccagccgccccguccgggagggaggugggggggucagccccccgcccggccagccgccccguccgggaggugaggggcgccucugcccggccgccccuacugggaagugaggagccccucugcccggccagccgccccauccgggagggaggugggggggucaggccccgcccggccagccgccccguccgggagggaggugggggggucagccccccgccuggccagccgccccgucugggaggugaggggcgccucugcccggccgccccuacugggaagugaggagccccucugcccggccagccgccccauccgggagggaggugggggggucaggccccgcccggccagccgccccguccgggagggaggugggggggucagccccccgccuggccagccgccccgucugggaggugaggggcgccucugccuggccgccccuacugggaagugaggagccccucugccaggccagccgccccauccgggagggaggugggggggucagccccccgccgggccagccgccccguccgggagggaggugggaggggucagccccccacccggccagccgccccguccgggaggugacgggcgccucugcccggccgccccuacugggaagugaggagccccucugcccggccaccaccccgucugggaggugugcccaacagcucauugagaacgggccaggaugacaauggcggcuuuguggaauagaaaggcgggaaagguggggaaaagauugagaaaucggaugguugccgugucuguguagaaagaaguagacaugggagacuuuucauuuuguucuguacuaagaaaacuucugccuugggauccuguugaucugugaccuuacccccaacccugugcucucugaaacaugugcuguguccacucaggguuaaacggauuaagggcggugcaagaugugcuuuguuaaacagaugcuugaaggcagcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugugagaaacacccaagaauuaucaauaaaaaauaaauaaauuuaaaaaaaaaaaaaaaaaaaaacaaauggguaacuugcugccugccagggacuccuguggccuggcaugaagauaauugacuguguuuugaacgcauuauaaggccccugcgaggccuccgugugguauuuagacagucagcaggagagaggccccggacaguggugugggaugcagucccggugugugaaauugccagugguuggauugugcagcggauggauugagcagggaagccagccaagaacagaaugggguggggagggcguuggggguaggaaaggaggaucaucauuucaagggcgggugagggaagaacaagcagcagagugcaaagcccccagagggaagggcgauccuuaugagguuggacugugacccugggcaaguuacccuccuguccucgggaggaagugguugacagaaucauugcagcagugagauggaagcaggaccagggcagcagccaagggccucuuagauggcggggcgagaggaggucauccaggaccuccaagagaacuguuucaaaaugggaggagaaagcaguguuccucugguggugguucuaaugcuuuguauuuguaguucuuagucguuuucaaggcccuuugcauucuuugcaucgugcucucuuaccacgaugcauagugagaccccaccucuacaauuuuuuuuuuuuuuuuuuuuuuucagugagccagguguggcaguacacaccuguagucccagcuacuugggaggcugagguggaaggauugcuugagcccaggagguugaggcugcagugagcuguggucaugccacugcauuccaaccugggugacagagcgagaccccaucuuaaaaacaaacaaacaaacaaauacuugguucauuugguacuuggcuuuuuggaucuuggggaauauuggagaugacggaauaacuucaaggagacuaacuucaaggucaagacuccugccaagacuccaccagacauaaaauaggaaaaugaugauagaaucuaccucacuguuggccuggcagugggaguuuguugauaacccugaagaugaacuccucaaggugaagagcaaggcuucagaaugggcugcucuauagaugugagagacagagacagaccuagccuugcaaaaagguugcuguagucuuucuccuaccauuuccagcacaggaugguuucuggucccaggaggcccugucuugugcugugugggacccuuagugcugugaagacuagcagcacccuggaggucuuuguuccuucugcccuuucccuuagauugcaucuccuaaccuugguuuauauauuugucaggaggugggggaaaccugcuuucccccaccuccugacaaauauauaaacuggaaauugauccaguccuggaucaguuugggucacacaacagggucggcaguguuggcccacagagggcccugggccccuuauuuccccuuuggcccuaggcucugagcucucagguuuuggcuaccaagcaaaagguggaguugcaucaguuguugcucuuuaccaggcccccagggguugcugucggugagcucacaggauguuuucuucucucugcuuugacuugugcugaauuucugacugaccccaugcagcaucugcguggcuucuggggcccgagcccagguuucagcaagcugcccaugguuuacccucaggaugaacucuaggaagcuggggagcacugugguggugguauaaguucagccccucauuuuaguuuauuuuuauguuaaaauguuuauuaauacaaaauaacacauagaucagaauguuguaugacagaaagggacugacuggacucaggaucucccaccccagccccaggggugaaggugaaggugauugguuuccuggguaucguuccuuccacgguuuuuccaugcacgcucucaugugcguguguuuuuauccucauccugcucuucaccguggcaguggggagcacacuaaauugcucugacaccuaguuaguuuuuuuuuugauugaguguaucuugggaaucuuuccauaucagcauauacagauacacugcauucuuuuuuuuuuuuuuuuuuuuuuugagauggagucuugugcugucucccaggcuagaguggaauggcacgaucucugcucacugcaaccuccaccucucaggcucaagcgauucuccugccucagccucccaaguagcugggauuacaggcacccaccaccacgccuggcucauuuuuguauuuuggguagagaugggguuucaccauguuggccaggcugguuucaaacuccugaccucaaaugaucugcccaccucggccucccaaagugcugagauuacaggugcgagccaccacaccuggccauucuuuuuuuuuuuuuuuuaaagcuuuuuuguuguacauaugauguauguuagguggacuguggcuuauaaaaccucuucauagcuguuuuccagugcgauccuucuagcccugugaggaagacagaccagaagaaauuuuuugcagcuuaggauacucugcaaacaaggaggaagugagaggaguuggggcucauuuaaugcagacuaaaacaggaucuuuccuuugagagacugagacaggaugaggagcaggcuguagaugugcacacauauccacucagagagaacaugagaggcagcaucugcagaggagccuggugggcagcacgugccgcgggggcaggaaggggagagcuuccgggaaggggauggaacuugagccaaaccuuuuucucaaaaagaggggaggccggguguaguggcucacaccuguacccagcacuuugggaggcugaggugugcagaucacuugaggucaggaguuugagaccagccugggcaacauagcaaaaccccaugucuauuaaaauuacaaaaaguagccgggcgugguggcgcacacguguaaucccaacuacucaggaggcugaggugggacgaucacuugaaccugggaugcggagguugcagugagccgagaucgcgccacugcacuccagccugggugacagagugagacucugucucaaacaaaagaggggaagguaggaaugagacaaaggaaaaggggaggcgggcauuucaggcaggagagcagcauaggcagaaggugcaaacauguggcagagggucgguguccauggacacgcuuccaccaccuggucuaaucauugacuuaucagacaucuaaaugccugcugcgugcccagcacuguagagggccacaaggcagcaggaaccucucagugccugcccucugugggcucugacuccaaccaggagaaacuggacgcacaacagcaggcaaaacuagcugauggugauagaggucagaagagugguuuacagccaggcacagugacucacaccuguaaucccaguacuuugggaggcugaggugggaggauagcuugagccuaggaggcugaggcugcagugagcugugaucaggccaccacugcauuccagcuuggccuggacaacagagcaagacccugucucaaaaaaagcggaguaguuacuuauuguggagauuagcuguucaggggcacaaagaaccuuguagggugcuggaaauguuuacugucuugaccugggugauggguuuuuuugguuuguuuuuuguuuguuuauuuuguuuuuuugagauggagucuugcucuugugccccaggcuggagugcaauagcacuaucucggcucacugcaaccuccaccuccuggcuucaggcaauucuccugccucagccucucgaguagcugggacuacaggcgccugccaccaugcccggcuaauuuuuguauuuuuaguagagacagggguuucaccauguuggccaggcugaucuugaacuccugaccccaggugauccgcccgccucggccuuccaaagugcuaggauuacaggcgugagccaccgcgcccagccugggugaugguuuuauggugguauauaaauguaggaauucauggggcuuauuauguuuaagauuaaugcagauugcauacucuaaccaugaguauguuauaccccaauuauaaaucaagcaggcaaauaaauagcauauuccccaaaauaaagaaguaaaaugcaauagcaagaaagugugcaaagagcuaugccugggaaaauacaggaacuguaucauuuugaaagggugagagaugagauuucagacccucacccucucucacugugucauuucugaagggcccuggugacuuucuuugccccucuccacucuuacagucauuggaaccagagggcagaaccccgggccucaaaauuaagucuauacaccuuagaaacuaggaauucaaggcuagccagguccuggcccuuuaucuguccuucagagaguggggugccccagccaaagcggacagcucgccauucccagaugugcccuguguucucggcugcguugccugacucaccuuggccuucccugggagugccuuuucuaguuuucuggcccagcuagaagaaagggccauuacaccuacuccagaaucaucccugcugcucccaaguuggaauauuucuuccuccacaguggccaccucuuaugugcccuccaucacacaguuuguauacuuaccucuucaagggcaggcuguguuuuacuccuuuugucaucucuccccauaggggucuaggucagugcuuuuguacauggugccugaaacagucccauaaaugauauuuuauuugaguggggcucucuggcuggagcuacuagguggaauguugccaugugggagcaggggucauaacgaaggcuggccaucaagaugcugguacuuccaaauucccaacaguuauuaacuuucaggauugaggaacaaguaauagaaauucccuggaaugcccaaaaucauaacuuuuucuauaucuuuccuaacacuuuaugaguuuuuaaauaaggaguggucauaauaauaaauggaauuauuuuuucugugauaaaauuucagagguguuucuguaaaaaaaaaagaaagaaaagaaaaagagaaaaaaagauguaacauuaaaugcgugguuuggugguuugguugggcacaguggcucacaccuguaaucccagcacuuugagaggccaaggcaggaggauggcuugagcucaggaguuugagaccagccuguuaacagagaaagauuuugucucuauuaaaaauaaaaaaaauuagccagcaugguggcaugugccuguagucccaguuacucaggaggcugaggcaggaggaucacuggagcccaggaguuuguggcugcagugagcuaugauagcaccacuccggguggugacagucuuggugacagagugagaccccaucuaaaaaauuaaaauaauaaaaauaaaauaaaugcauaguuuauuguuauuauggacaaauauauugugauauaugauuguauauauuucauuagcauguaaaaaugaucucuaucugauauagacaucugauaauagaaaaugcggaagagagcauuaacacaaaaugaauaccaaauaaaaaucacuuaaugauuuaagaguaauacuacacauauuuaauauuuaaaaguuacucuuaaagguuaaaacuagagaaaaguuaaaagaauaaaacaaugaauuucuguauuuccuucaccaagauucaccaguugcuaacaguuuggcgcauuugcuugaugugucauagauuguccacauuccauaucuguuggauuguuuccuugugauuagauucggguuuacguuguuggugggaacccacauagaugaggugugcuuccuguugcuuacaucaggaggcacaguggugccaguuggcccuaguaaaagugaugcuaacuugauucaccuaguuaaguuggcaucugugaaggcuacuuuuguauuaaggcagugaacuucgaaaggaacuuuucccugacuuugggaauugcugacagccauuuaggaaaagagacgacuguuuucucugucacguguagcugcaguuaagaaacauccuaguauagucagacaagcucuggaagccaguaugucaggaccugggaccaagcucuacagccaucucucccugugaccauagccaagucauuucugagcuaugugagacuguacguauaaggaaauagacacucagagaagugaagcaguuugcccaaagcuacucagcuagugagugacagagcuaggauucaaacccauuuuugucuggggacaaagcccugcccuuguccuuaugccaagcugccuccuuugugaggcagcugguuguuaugauuguggcacugaccacucagauguugugcucggaaccaagcagaagagcaccaagccuuauaggcccugacaggugagagggaagagagaggugccuuccuucauccaucuggacugcccuuggaauuccugggccaauuuggggaacccuggcaccaacccuaacaugggccagugccagcaccagguauaugcagccuguacuucccagucugggcaggcaaaggcuggaaccgcaccagcagcucuccucuguaacgcagcacggaaguauuuauuucaaggguggcucagagaagugaagcaguuugcccaaagcaaacugguuccuccccugcauguggcaggcuguccugcaagcugggaggcgggcuguuggacgcuccccagccacccuugaaauaaaugcuuccaugcuguguugcagaggugaguugcuggcaccguuccagccuccgccugcccagacugggaaguacaggcugcacauaccuggcacuggcccacuuuaggguugaugcaugggauccccagauuggcccaggaauuccaaggccaguccagauggaugaaggaagguauugccucagccugccuggguuccucgggggagagagggagacaggaagcauuaaugggggaaaggugugccaagccuugccaagcaggucauuguggguggggagacaccgccuacgugcucgggacgccccaggauuuggguggagguucuugaggaggcagcgagaaaggagagcugugacagcgacucuggagcacucuagaauggcucuuagugaccuucugcucuggugacccaccagcagcccaccaaccugucaucuuccaguuagcagccauccccagggccaguagcaccugagcacuugguaaguagaaagacccagugucugcuccucauguuacccugguguccuuccccagagcaguuguuuugggaaaaacuggcuccggcugaagcaggaaauggugcuccuugucaaggucauguuguccuguugcuauagaacugagagacccugaggaucagcccucugagguuccuguuaccucucuuuacacuauucauccucauaggccuccaggaagggggccaaauucagggccaggaccagggccaguggcuuggugaggcauaggcuuugcuguaugggcccuguggggagcucuggggaguucuuauuccccuggcucauggccaccaucauggagagacccccagggcucuggcagccaagugggcaggagcggagggagggggcaucuugggagggagagccccgaaaggaaacaggguuuauagacagacucccggucaucacugcuuguaaugcuugcucagugaacaguggcagugcuuuuccugacucuuucaagagagucccuucucucuccugcuaggugggcugagauccagacugguuagaagccuaacaugaccuggcgugugagaccuugcacucucugaauguauuccccaagugucaucaauaagucacuccgguucuggcauuucccuaucuuauccugcauaccccuccuccuggcucugaguccugaggagugagauugcaguuuuugacccauguucuuacugagaagugggcugucaugcagguauaauauaaaauccagaagcugcugucagaauuaugugagaauugggaggugacagcaugggccaauuuucugaaucucuagggugcuuugaugcuuaagaagucuuucugggcucccugagauuugaaaccucuuguuuuaucuguccuuucacucugguucuuccuuuccuuucuuggggacuucaugcuucucaaauauuuguuaagugggugcuuauaugggaccuuagaaagcaaccagcuaggcaugcacuuggaaagggacaggaggacugagaacaagacuaaacauuucugugagauugagcagcaggagagcuuugcuucuuuacuggugucaguaugugccugcagcuccugggcugccuuuacucgagugagauccauuuacaagacuccugacucuucuacuccacuuuauuacaaaagauguugaugcucguuuuaaaaacaauuuaaacuacaaacaugaauaaagguauuuaucuccccaccagucccccucauucucccuucccuccuguucuuagacugguuuccccucccaguaguuuagguuguggggcaaguguguguagcucugcaucagugucuuaaacaaaaugagugugucgcggaugcgcagcucggccacuuccuguuuucuucggcuguaugucacggccauccugccauggcaccaugucugugccaccugcugcucuugggcaucugcagagaauuccaugacauggaucuugagguagucuucuucagcuuuuucuacuucaucuuauuuucuacaaucauuuauaucugcuuguaaaaccuuuuuuuaaaaaacuugcuuacuagacacagcacauguucauuuuagaaaauguagaaaaaucagauaagcagccgggcaugaugacucaugccuguaaucucagcacuuugggaggccaaggcaggcagaucaccugaggucaggaguucgagaccagccuggccaacauggugaaaccccaucucuacuaaaaauacaaaaauuaucugggugugguggugcguaccuguagucucaguuaccugggaggcugaggugggagaaucacuugaacccaggagguggagguuccagugagccgagaucaugccacuguacuccaaccuacgugacagagugagacccugucuccccgccccccccaccaaaaaaaaaaaaaaucagauaagcaauaaaaaaaguagaaaugaccccuaagagguaacauuuugguguguauaauacaaaugucuuuuacauuugcucccucaucucagcauugccacugccauuaaagaaggcacauggucauuagucccaucucacagauagaaagccugagccacagagaggguagcagguugcccagagguacacagcauaguaaagacagagcuggggguguaccugucauauaacucagcacuaaugcucucuccacuguagcccacuugcugucuucgcaccuugggacagagaggggggugccaggcauuggauuucagaugcauugaacugccuuauccgaagguuaauagacagaugacugcuugaggaaagccccugauugacuuaggagaagagguagaagacacgcucuucagguuuacagacaauaugagacaagggauuguuugcgcuuuagagaacagaaucgggcuuagaaaacccucaaagagcucuaaugacaggucaggagcaacaggauaaacuuuggaagggguggauguaaaggggcccccuucuauuuccguaagcacaggaaggccugacuugauguucaggcagugaugacuggucugccugggagucauaguggacuguaagcagggggacaugucauuucaacacuuuaacuucaucuuacuuccugggaguguuaggagccacacaucaagaggacgugaugaacuaaggaagaggguuugggaaccugucaaaugacaaaugcugcagugacagagguuucaccuagagaagauggguuuggggaggaaaaggugcaggccaagacuuggugaccagggccaggcaggacaggaccaggaauggcaguuaguugaagggagagucuaauuggucaggauacagaacaccuuuuuagcauuagaguucaggaauaguagcgagaggcaguacaguagagugguuaagagcuccugcucugauggcuuacuggcucccggcucccagagucuuggaaguuaccucacucuuccauguuccaauuuucucaucuguaaauggggauaauggguaccugccuuauaguccacuuguaaaaccuaagggaguuacuccaugaaagcagcuuagaauaaugccuggcacacagaggugcugugcacuguuugauucacacggaagcuggguaggcuccauggaagaagaguuguagaaggucuucugcaugcauuugguaugaccugcuuacccagccuuuuccauucccugccucccugucuccuucuuucuuucuccaucuuccucuccugggucuaggauccuacauuuccccuaccuaggacacccuaccccucaaucuuuauuuucuucuuugaaacucuuaaguauuuuauuucuucuucuucuucuuuuuuuuuuuagacagagucucgcucugucgcccaggcuggagugcaguggcacgaucuuggcuuacugcaagcuccaccucccagguucacgccauucuccugccucagccucccgaguagcugggacuauaggcgcccgccaccacgccuggccaauuuuuuguauuuuuaguagagacagggugucaccguguuagccaggauggucucgaucuccugaccucgugauccacacaccucggccucccaaagugcugggauuacaggcgugagccaccgcgccuagcccuauuucuucuucuuuaaauuguuuuuauuaaaaaaaaaaaaaaaggccaggcgugguggcucaugccuauaaucccagcacuuugggaggccgaggcgggcagaucaugaggucaggagacagagaccauccugguuaacguggugaaaucccgucuuuacuaaaaauacaaaaaauuagcugggcgugguagcaugcgccuguagucccagcuacucaggagacugaggcaggagaaucgcuuuaacccaggaggcagagguugcagugagccgagauugcaccacugcacuccaaccugggcaacagagugagacucugucucaauaaagaaaaaaaugagacagggucuuucuguguugcccaggguggucuggaacuccugggcucaagcaauccucccaucucaaccucccugcccagcugcugugcccagcaguauuuucuauaauuagcauaguguacuuuucagauuaucuugaagacccagcucuccuugaccuugaaccuucccugaggccuccagaggcaauuuccuccucaggacucagcugcccuucacucuucccucgugcacagccuguccugugaguaggugcagguacugacuggucuuaucuuucgcccugaaaauauaaacguuuuaaaggcaccugaggauuugucagcaccuccccacccccacccugggucugaccuaggacucugagucagggaggccucccuccacugaguaauaguagccuugggaucugcucagcaagaggauuguauaguuuaagggaggaagaagcaccagugcugccuccccaugggaaaaaugaagcccccccucccgcaaccaccaccaccacagaaccaccaaccccaacgucacuuggcagauuagcaaaagaacuagccagacgcugcuaggccccucaggcuucuagauucgcucuccaccacauuucuaccaauuuaugcucaucuugauaagcuccuccuuugaagggucuggaauggucuggaguggucuggaaagcagggucagauaccccuggaaaacugaagcccguggagcagugaucucuacaggacugcuucaaggugcguggugaacagacgucuuuuugcaauuaugccaguugcuccucugauacuugaggguuaugugaaucuaacaacagacaaaaaucucugccuccuggggcuuauauucuuugggaagagacaagcacuaaacaaauaaggaaauauauauacacucugccagauagccauaagacggauggagaaaguugaagcagggaagggagauggaaguaccugaggguggacuacgcauauuugaaauagggaagccagggaagaccucacugagauggccacauuugagaaaggaccugaagaaggugaggcagugagcuguggagguggguaacuggggagggggaagaacuuuagcuagagagaaaagccgcugcaaaggcccacugaaggcaggauaugccugcugugucgagaccagcaggaggccgugugccugguacuuaauauaccagaaggaguggagcaggcagggguaccaguuccagaaggacuugcuggcagguauuaagaugggcuuuuucucugugauaggaagcuccaggaaggauuugaucacaggagggacagaaucugaauuguauuuuagaaggaucacuuugacugcuguacagagaguggguggugaggugggaggcagaagccagaaagccaguuaggaggcuguuaaguaauccaggcaggagaugguguuggcugggaccagggucauagcaguagagguggugagaaguaauuagauuccguauauuuauuaaaggcaaagccagcaagauuccuugacucuaacuuaaagguuggaguugucauuuacugagaugagagagaccauggggggaagguaaagggcucgguuuuggauguguuaggcuugugcugccauuggacauccguguggaggugucagagaagcuggccuggagaaauaaauuggggaaucaucagcauacugaaggcauuggaaggcacaagcuggcauaagaucagaaagagauggagcguagauggagaaugaaagagaccuuuagagauuaggaagaaaauuacugacugagaccaacaaaguagauugauacggagcagccagugauaucagagcaaaaccugggaggaagccaaaugaagagaaggcguagaggaggagggaucgagcagucauaucacuaucacaugcuaucgugggucaaguaaaauaaagaucauaaguguuaccgaaaguuucaaaguacagugacauuggccaggcgcgguggcuuaugucuguaaucccagcacuuugggaggccaagguggguggaucacuugagguuaugaguucaagaucagccuggcccacauggugaaacccugacucuaccaaaaaauauaaaaauuagccgggcguggugacgcaugucuguagucccagcuaugggagucugaggugggagaauugcuugaauccaggaggcagaaguugcagugagcugagaucgagccauugcacuccagccugggcaacagugagacccugucccccaaaaaaaaggccgggcguaguggcucaugccuguaaucccagcacuuugggaggccgagguaggcggauaacuugagguggguucaagacuagccuggccaacguggugaaacuccaucucuacuaaaaauacaaaaauuagcugggugugguggcaggugccuguaaucccagcuacucuggaggcugagacaggagaaucacuugaaccggggaggcagaguuugcacugagcugagaucgugccacuauacuccagccuggacgacaaagugagacucugucucaaaaaaaaaaaaaaaaaaaacaaaggcugggugcaguggcucaugccuguaauuccaacacuuugagaugccaaggcgggaggaucacuugugauccgggaggaguucaguucaagaccagccuggccaacauggugaaaacccaucucuacuaaaaauacaaaaauuaguugggugugguggcaugaaucuguagucccagcuacucuggaggcugaaguaggaggaucacuugagccuaggaggugguucagugaacugaggucacaccugcaccccagccuagugacagagcaagacucugucucaaaaaaaucaccuaccacccucuucauacaggggaacuuucuucuauucuuuuucuagucauuuucaugagaaucaugaucuuuauguaaauucguauuguauuuuucacuuauguuauuaaauauucuaugaaaacaugaguuuaaugacuagguaauacucaguugucugggugugcccuaauauauuuaaccauuccucuauuauugggcauugggccauuucugauuuuuuguuauuauaaauaacauugcagugaacagcucaguguuuuccuauaaggggaaguauagggucaaagaacgugaacgcuuuuaggugagacuugaacuugagaucccuggguucuccuggacagaccgaccaaucacagcuuaacugugggauuuuuccaugucuccucucucccugggaagguugagaagucucucugcccugcagaucccuauuccugccuccccgcugcaauugcacgucccauuucuccugggccagucagaguuucauugccucucauggggccugcuggccacccacucaguggcugcccuucuccuuaccaccagccuucguccccucaccuagagcauucacaggcgagcaagagccagucagagcuucccucagaguaggggguguagugauaaaugaaauagcccugccuucacucaucucacugggucgauuaagugaugugugauguaccugaaagcacuucaggaacuuaagagucucaugcucuaccaacugagcuagccaggugcccuuaaagggcuguccuagucuuaauuguuuguaaagaaauagguagcugggcaugguggcucacaccuguaaucucagcacuuugggaggcugaggcggguggauaaccugagcccaggaguucgagaccagccugggcaacauggcaaaaccccgucucuacaaaaaauacaaaaauuugccaggcgugguggugcacaccuguggucccagcuacucaggaggcugaagugggagaaucaccugauccuaggaaaucgaggcugcagugagcugugauugugccacugcacucuagccugggugacagggagaucuugucuuaaaaaaaaaaaaagaaaagaaaaagguauaaguggugguguccacauuguaaccacagagccccuaaagcagggcuguugaccuaugguuggcauccuggucacaagagcucugugucagaugugugaggggcuuggguguaguugucaagccugggaauguggcuguuaguaucgauuggccucaugccaagcagugccaagcgccacgucugcuccccagauaccuguguuuguaugugugugucauagucgggaaucacugagaccaggaccucugggaggcugaacccugggagggcagagcaggaacaggccuuggagaugaucuaauucugacauuuuacucagugaggacacagguggggcagccagagagguacucagcucugagucagggccccaucccucaacuccucagccugagucuucccaggaacacaacaggcagcugcuucccagaccuugcagggcuccagguggccuuccccuccugccgacucccuugccagguuugcuguaacuauugcuccuccgagccuggcugaaaucaucuucagucuguuaucaccuucagucuguucucaucuucagucuguucuccacagcagccugaaaagucuuuguaaaaaugcagcucuguuccuccccauccucuucauaacccccuuggcucucugcuccucccagaauaaauacccacauccucagcuuacccuucaagacgcugagugaccucuagccacagcccuucucucuacccacagacagcccagguccucauuccuugggccuuuucacaucacuguucccaucacccuggaaucccacucagccugccugggccagaggcuacguaagguccucaggaaagcgucuccuggccacucgcaccugacucaugugcucugagugccacaccuugcuuggcauuuguccuucauagcccuggucauugcuggcuaauguagccuggcacauggugguagguacuugacaaauauuuguugaacaagugaaugaaaccagcuggcagggaccagaagggcagaggggcagggacaguguccacaaccauagccccuguggucuuagcugagaagggcucuggcucggucucuggugagucucucugcuggccggcagaaccacccuacccuggaagcccucuccauguagugugaggggucucaggcccauucaggcuucaguaggagagaucugggucucuucugggaccugagcaggccuuuccuuuaccucguuggcaucucucagcauuuuauuugguuuuaaaaaugucucccccuucccccgaccaaccccagauuauaaagguaucccacgcucacugugaagaaauuggauaacauaggaaaauauaauuaagaaaaucgaaaucaccuacagcuccaccccucagagaaaaguacccuuaacauuuguggccaugucuuuucaguuuuguuuuuaugcauguguaugugcuuugacauugcugagcuucucuuugugaaaaccacagauuuuucgcagucuucaguggcugcggucagagguggucagcacguuagugcucccaguggagaggugaugcagggaucugggugccccuuucucccuacugcaggugggugggugggcacacccaaggcccccuucuguggcagcuuuccuaucccuggugaagaguacccuccugucucuggucucuucuccaggacauucuccagcccuggaggcuguuccuagggggcugccucuuggggcaaugggaagaauuguggaaugcguggguggccuccuggcugucuuuucucugguuccagcacucucugaacaaaaccagccccaggccacuccuggggauuggccucaggugacucucugggcugacucuggccagcuagaaggccacccgggcuucuccuguguccuuaagaggguggggugaccuggauuggcaaauaguaagcagagaacacggcagaguugcuggccuagaaaaccaggucacuaggucagcacuuggauuaaugauugauaagaaagguugggagagaaucagccagacccauucucccaugacaucccucacuucugaucccaaaagcaccugccacggagacggggcaaccucugucuuguauccagaggcugccccuuauuccguugcaguaugggaggaaggaggugacagcaacugggucaccugcauguggggcgagaaggggaggaagguuuaggcccuucucccugaaaaaagaagcaugugcccagaguagggggcucccugccgguucucuccccacaauugauggugaggcagggaacugggaaguucugucuguggaggucccuuggguuucagcaggcuagcacauuucuaggacuggaauaucaccauacaaucccuuaacacaagccaugggugauaauaauagcagcagccacugugguccuuauuuguaggacccuuacuaucuaccuggcacuguuaagcaguuacugcaucguuauuuauuccacacagcagccucucagguuaggugguaguauuccaguuuuaaugucuuccccaagucauaggaugggagggaugagccagggugugaacccaggccugacugaagccgguggaauucacuucuuuggaguauugcaucucgauggcaguaauauaugaaaacugauacaguggcaagugcuacaacucagaauaguguggcuaaggcucauguuuuuaguauauuuauucauccagcaaacguauguugaggacccacuaaaugccaggcaccgugccaggugcugggaccuaccucaguaagauacagggcauucucugggaaacugauaacauggugaggccagagcaguuagcagacauugcaguuugguguagugauugcagaucuggagggcccgggucaggguuguggugagaaggaacagaauggagcuaguccaggagagcuucccggaagaggaggugcagacaggucgcgaaggagagaagguuuuagcuaguggaggggauggcauucaaggcaggugccaguucaagccuccaugcucagggagugaugugggaucaugaggcacauaggcaggcagagcaggaggauaggccuggagagggaggcagggacgagagccuguggcugucuucagcacacaggagucauuuucuggcaguaauguccagaagggcuuugaccaagguguucuugacagaaacagcuggggacuggcagccagacagaggauucagaggugauggcuccagacugagacuaaggagccccagcugggcaaggacaugccagcuccugguccagucuuacccagcaccauauaugaggcacacaguagaguggcuaagacuugagccaaccugccuugacucaaauccugcuucucuaguuacugugugaccuugagccaauuacuuugccucucugugccauaauuuccacgucaguuaaauggagaugauaauaguaccugccucuuaggguuguugugaggauuacauuugccaacauacacagagcaugguguguaauaaguccuuggagaagggaagcuaguacuauugugauggagguggugauccagcuuaggcucugguacaguaagaagguccaucaggcuguaccauguggcagauggagcccauggaggauggaggccccuggcacacugacuguccccacucauccccuggguagggcagaaguguucccacaccguacagccugccagugggcaucagggaaacaccugagucaccacgaggaguacgaggcacuuggggguugcccagcugaccaggagcacagagggcugcccugaaagugagccccucccuacuccuagcagagacggggaagggagacaacuggacuuggugggaaggacugggccccagguggcuuaguugcucuggccccagaccaggucucucuagagcucugggccauuuggguuaagcuucuaacuaccacugcccaugaaauucaccugccaaugggcaauggauggagucaugccccucccugcaccuaaguucucugaagggcugaguuucuucuuggggccagacaguggguauuggaaugggagcaugggggcugcaugugcacugcaggcuuuguguguguguguguguguguguguguguguguguguguguguguguacacacauacauauaugucagaauuggaauaguccagggguuuguuuugcaagaaauccuuuuauuuuuauuuuuugagauggagucuugcucuguugccaggcuagagugcaguggugugauuuuggcucacugcaaccucugucucccuaguucaagcgauucucuugccucagccucccagguagcugggauuacaggugcgugccaccacacccggauaaccagggguuuugccauguuggccaggguagucuugaacuccugaccucaggugaucugccugccucagccucccaaagugcugggauuauaggugugagcccccuugcccuucccccaugccccaugcaagaaauuauuuugcuagggacuacuuuuuggugaggggcuacauugcugcauucgugcccccucauucuggcucagggcccuuguguugucugggggucugaagcuccagccucuuaaguggggcaaagcugugacaugaucagagggcuucuggcucuggcauagugcuggggcguggagaggggagauagccaacacugggagccagaccaaaaaaaaaaaaagccaggguuuuuugccggcauacaaauuaaacuuagugccuggcuguauugugguuguuguuguuguuuugagacagagucuccucugucacccaggcuggagugcaguggugcgaucucggcccacugcaaccucugucucccagguucaggcgauucucgugccucagccacccacguagcugggauuacaggcgugcgccaccaugccuggcuaauuuuuguauuuuuaguagagaugggguuucaccauguuggccaggcuggucucgaacaccugaccucaagugauccacccaccuuggccucccaaagugcugggauuacaggcaugaaccaccgcaccuggacuuuuuuuuuuguuuuugagacagggucucaaucuguccucaggcuggagugcagcagugcgaucuuggcucacugaaaccucuccccuccggguucaagugauucucgugccucagccuccgaguagcugggauuacaaaugugcaccaccgcaccuaucugauuuuuguguuuuuaguagagacaggguuuugccauguugcccaggcuggucucgaacuccuagccucaugugaucugccugccucagccucucaaagugcugggauuacaggcaugagccaugcccagcccagccugugcuaucuuuagugccagggcuuaagaaaggaagaggagaauaggguucauugcaggaauuguggugggugggguggcagcuaccugagaaaaucuagacagugggccuagguccagugggucaggggagagagccuaggggucaagguugcuccuggcugggcaagcugagaacagggagcaaccuuggcucaggguagaugacagaccucagcuguagauggagcaaggaggccauaugaaaauggcaggcuucuggcaaaaugcagggaugggcugcagcacagcaguucaaucuaaauaggagcagcccaagggacguggguagguuuuagaacagccaggcuacagcuccccuuccucuucacugguguccuugagaggccacagucagaagagacaauuccaggcuagggagagaugucagcgugggaacuagagacccuggucccaaauucagaacucuagccagaguccagaacugcaucugagucuaagaggcaaccacuuacuuacaccucccgaaacugagaacaguuuuaccgguucuggugaaaaaaacccacuaccagcucauaugugggagugggagcugaggcucugcugaguaacacggcccagugcacacagcugucagggccuggcccggcucgaguccugcuguguccgaagcucugccguuuucugcuucguccucuagcauguucugagaugcccuguugggauccucaggccugucacuuuugucaucugcaaggggggccuauaaggccuuaaugggggcuggcgaggcuugagugggagcgugacgcauagugggagcucagucagcucccuccccucccuccaggauuugguccugacagggagcuccaucaggucuuccccagggucaccagaggcucagaugcuguguugucaaguauauauaccaggcaguauuguagcuuuuccuccucuguuacugccugcuaagcggggaccccacaucuucacguccuccucuuccuggcucucaucaccacagccuggugugcauugccccguguccacugacacccacgccacauggguccaaaaacagaguguguucucauugccucaucccacucacccugggcucugccgccacugcgcuguggcucucgggggucccaccaucugacccuugucacccgugcugcuccuucucuugggacucaucccuucugaggccucccguggccccuucucacccuccccuaccuccuccaucuccaggcuuucaaucugguggagcauaaagaaucaguguuucugguacuuguuauuuggauaauggcaccuaaugcuaaaugacgaguuaaugggugcagcacaccagcaucgcacauguauauauagguaacuaaccugcacauugugcacauguacccuaaaacuuaaaguauaauaauaauaaaauaaauaaauaaauaaaauaaaauaaaauaaacuuugaaaaaaaagauuucagcuaaaauuaguuuccucuccaugccgagucugaauauauuauaaaaauaaaagaauaauugucuuucacacaauuaaaaaaaaaaaaagcugacuaaugccacuacagucacacacugcuguugguaauugcuaggguccuuuuuccaguauuguggccaacuuccaccccagaaccccacucuacucuugagcuaagugucuuuaugucuccuauuuuaaauuaggauugcguucaguugcaugcaacagaaauccggcaaucagugccugguaaaacaaguuugauuuuuucaccuaacaagcagucuggaggccggcauugcaggguggguccagcagcuuugggaggccacaguggccaggugcuuucggacuuuucacccacccuccuacccugucuucugcugcuccgaaggcagcugcuacaccucuaggcauaguauuccuguuccaggcaggaagaugggaggggcagaaguuugucucucuauuaggaaauaauagcuuuuucggaagcuccuccugguagauuucuguucacauauugcuggucagaauuaugccaaugaacacuguagcugcaagagagcuuggggaaauugaguguuuagguaggcacagauugcugauccagagaagacugagacucagaaggaaggagaauggagcuggggagaaguaggagugacugccccagcugccacuuggagaaagccacggggugagcaggacagcaccugugaacauuuccugugcucugggucuggugcuucucaaguuuaacacccaggggcgaguggucagggacugauccuugaggaacugauguacauuaaacaaacuaucaagucccugcaaugcaguguaaaugaguaaagagccugcaggggagaaacugccacuaguggagaccaugcgagugggcagccgauugcuuggcucugggggugggugccagaggcaugcaggugcccaagggccaggucugcccaauuuucaagagaagccagaaaaccaaaauuuuuaaagguuuuuucguucuaacucuauuuugaaaaaaguucgguguuacagaguaaguugcagagauuguacagaguccccacauauccuuuacccagcucacauuaaaucuuacauaaaggaacacugguacaauacuauuaaccaaagucaguguguuguucagaccuuaccaguuuuucugccacugcccccuuucugcuucggggaucugguccaggaucccacauucauuuaguugugucucuguggucugcuccugucugugaggcuuccucagucacaaagcuagagguuuacgugaccuuuuccagguuuucccacucuaaugauuuggaaaucauacaucggcaucuugagacaucuuuugagaaguaaagggacuugagcugauugaauguugaucacucccucucaucuuccacauuauuaaguuuugccuucuuauuuuauuauaauuuaaauuauuuuuaagccaggcacaguggcucaugccuguaauuccaauaccuugguaggccaaggugggcagauugcuugagcccaggaguccaaaaccagccggggcaacauagcaaaaccuuaucccuaaaaaaaaauacagaaauuagcuggugugguagugcacaccuguggucccagcuacuuggguggcugaggugggaggaucccuugagcacgggagauaaaggcugcagugagccaugauugcgccacugcacuccagccuaggcgacagagugagacugucucaaaaaacaauaacaacaacaacaaaaaaacccaucagaaaacagcuaagaguuuuguggugguguuuuauuuuagguucaggguacagaugcagguuuguuaugugggugaacuugugucacaggcguuuauuauacagauuauuucaucacccagguacuaagacuaguacccgauaguuauuuuuucugcuccucuccuccucccagccuccacccucaaguaggccccgagguuauuguuaaguccaagcaagggaaggccugguggaaaugaauguguagccuuaacauguuuuguacaaacuuggcuguacauuacaaucaccaggacaauuaaaaaauaagaaacccaauguccaagcugcuccccaaaccaaucaaaggagaaucucuggggaugggaccaggcaucugucuuuuuaaaaacuccccagugacuacaguguacagccgaguuggcaggucuagagcagggagagagagcagaaggagucucugaucacuccagguucugguucugaugaguggguagacaggcagguggguugcuaaaguaaagauuacuagaggacgaauggguuuggggaaaaugauggguucuguuuggauagauugaguuugagcugucgguaaaauaucugagaguuggggucccacagaugcuuaacaucuuaaagcagaucuuuucuucuccugauccuuccacaaggucuggugcagacauuuccccgcugggagacucuccacaguaccucaugaucuuaucaucucugacuguggcauuuguggauaauguuuuacuugcuaaggguuggaacugucuccuccugggugauguggacguggcaucaccacccaguaaguugucaccuuggaaagacuccaggauggagcacaucuuccuuuuucugaugucucugcuauugaggccaugguugcagaucugcugucaacaugagccaagaacagcagggcuuuaugucuuuuuuccacacccaaccacugaaaggaugggacucaccccuucaggaacaguagcacagcagagccgugauucuugggccugagugcugauagggacagggucggggaugggaggcgugaugcauaucuggaucuccaggugggcuggagaguugggaaaagccccucaagucauuccaaugugcuuccuggagacucagaacagaaggcagcagaggaggcagggaaggguggcacagugaugugucaccucucuaguuuauggagccugcuccgaaccccacaaacccacuacaagagccaggugggaagggugauagggcaggugacuugugauacaaggagcagagaccaugguauagcacugcaggaacuagggaaggagcaggagcagaagaacccccuccaugacagcagcccccaagcgugccccacucgcaccauccucuuccuugucacugccuccccugaccucuuccugucuucuccucugcccaggcugaugggaaccacccuguagagguccaucugcguucagacccagacgaugccagagcuaugacugggccugcagguguggcgccgaggggagaucagccauggagcagccacaggaggaagccccugagguccgggaagaggaggagaaagaggaaguggcagaggcagaaggagccccagagcucaaugggggaccacagcaugcacuuccuuccagcagcuacacaggugaggagaggacuggcaggggacacggggcagaggaggcacagcccagugcaguggggauccuggcccucugcaaacgccaucauguggggcgcagaguagcagagugcugaaggacuggagccggaagccuggguucacgcccagugcgguggggaucugcucugccacucaccagcaguggggccuggagcaagcugcaccacuuccuucuguaaaacaggccaaaggaugguaggugauguggauaugggcuuucgugagaauuaaaugagugggcaucuguaacacaugucaucaucauuauuaguauucccaccacuguuaacacaaggcaucugagaccaaucuccacuaacagcacacuagaaagaucagcuguaccugggauuguuaugaucagucgaaacacacaguucaauuggucugguaauaauuauacacaucaucauugagccguaucauaauuagauaaaaaugcuaagcaguuaguaugaauaacucaacuaauauuauuuuuaugcagccaagcaguuguagcuucuccugucucacuuauugguuccccuuuauuuaucagcagugcagacaguuuucucuaguacccuguacuguucugucaucuucaucaucaucauguuauguuuaccuucaaaagcacccagaauccaugcagccccuggcuuucccugcugcaguucccccugcuuuuuuguuuuugugguuuuugagacaaagucuccuucuguugcccagacuagagugcaguggcacagucucagcucacugcaaccucugccuccuggguucaagugauucuccugccucagccucccgaguagcugggauuauaggcgugcaccaccacgcccggcuaauuuuuguauuuuuuuaguaaagaugggguuucaccauguuggccaggcuggucucgaaccgcugggcucaagcaauccacccaccucagccucccaaagugcugggauuacaagcaggagccaccgcgccuggccugaucccucugcuucuugcuuucucccaccacuucucuccuuacccaagugcugcaggccugcacaugcagcucauccucgcuccuccccuuagagggaacucagggucauaaggauauacugcugggaguagacacccugcacucgcugcugcuuucagcugcaggagauccuagccacaggcggugacucaggcagaggagcaagcccaccccgcagaaaugggcucuggaccccugugacugcauggagcaggaggaggcaguuaguguccaagcuaaggcagggugaaggcuguggagguagcgcaggcuccuguuugggucugcagcuaagaugggucugaauccuggagccacaccaccuugaaccugcaaagcaagucccagaauuuugcagaaguucuuccucuucaguguauagaguuggguggagggaguauagagccaucauucaguccuucucaucucacccaggaucaccugggagugaccaaaguaggccaaaugugauucuagggccaaagugaagguguccgccauuccccgaguaagcaacuuccugucuauuggcugguaacugggauggcuuuggagacacagccugucucagaagagaggaacagcuaaccaggagugauaauucacucagugccaguagcacauacuguucuaaaucugaagaagguagggaggguuagaaagcaaagggaagacaguggggacuaagaaugagugugggaugucaugaggauucaggggagaaugcaaggagaagagacggccacaggguuuguggcuaugccgccugccguggcccaccucauccccacaucugagcccaggcagauggaaguccccugcagagcaguguucuguccuggaguuuccuccacaccccuucuugggaccagggcuguuucccaaauagcaucacuguucccgugcaggccaggugaggugccugggagcagggguagggugaggcaggcauggcggugaccucucaggcagcuucguugugggauuuagggcacagcgggaaacguccagggcagagguugccucaccagucacaugguacuauguaggcggugguguuuaauagauucuguuuaucaauaaguggaugaaguggagauagacuuccuuguucagucauugaaacaggagagaggguuacuugacauaaucacuuuguguuaaagcuguaguguaugaaaaguucccaaaaauucuacaagacaagcaaccuagcaggaaaaucagaacagguaacaguaagacaaauacgaauggccugaaaucccgacagguuuuucagucuaaccaacucaaagaaagcaccuuaaguugcaaugccauuucaccugucagauggguggggaggacuugguccucccaccaccaggggugaaaggguagugugggccaacacuucuuaaugugugauucuuuuuuuuuuuuuuugagacagagccuggcucugucgcucaggcuggagugcaguggcacacgaucucaacucacugaaaccucugccucccgggcucaagcgauucuccugccucagccucccaaguagcuggaauuacaggcgugcaccaccgugccuggcuaauuuuuguauuuuuaguagagaugggguuccacuguguuggccaggcuagucacgaacuccucaggugauccucccgccucggccucccaaaguguugggauuucaggugugagccaccacaccuggccaagugugcauuucuuuuacccugcauucccacuucuaggaacguguccuguguaaguacuugcucagcaugcucagagauucccaugccagcuuauuuacugcaggacugcucauaagagcaaaaauaggaacgugcccaucuguggggaacugguuauguaaacugugguagagccauaugguggaauacucuggagucauugaaaaggauaaggcugguuuauauauauauuaaauaaguuccugacaaguuggggaucccauuguuuaaaauccuuauguuucauagaaggcaccggaagagucuauaccgaaggacucaggggcuaacucugaggagcaggaucaugguuaaggaggcugugucauaagauccugcauacccuucuguguuuuucucaacaagucugcacuacuuccauaauuugaaaggcaacuguacuuuuuuuaaggguaaaauuaacuguuuaaaaggggggugaggaucuggcaggugaggggcccuggagacagagccugaucauguguccagagcagaagggcuuggagaucacagagaccagggcaggcaucccaggucugucacugugagcuguagcccucgccagugccaucacuucuccaagucucauucucuucaccuuuauaggcuguguccuacccagccugagggccagccaggugagagucaguggggguaugugacacaucgcaggucucagcaccugcuaguucucugccccauccccaugaguuauuacuuuggccucgggaguccccugagggacccauaaggacagcgcacagcuuugagcccugaaacagcaggaaggcuccacagucaccccugaccacccuccucagcaguucagcacugacucucagugcagauauugagcucaacaccugccaugcaccuucucacccuccccccagccaggcaggacagaccuucccaucaacaaggaaacugagguuaccagaaacccacuugccaggguccccugggcguguaggaguagagacagcuagagccaggauucaccucccauucccauucucaucccuccugcuucagugacauccaucccaaucacccuugagaaagaggaagauaaaguguccuuccuccuggccucagcaccuccucacuuggcaagcacuuggugggcaucaggcugggcccagcacugugcccagggcuggccauacagugguggacaaggcugagugccugucccaaggagcccacaguucaggcaaacaggacagcagaaguaaagaggcugcucaguaacccagccucaaaucccugcagaauuuggccugacuucagaagcugcugggugcuuguuugccugugagcucugccagcaaaguaaauagaccaaucgggcgccuccuggcugucuucacagccaugacaacggcauucucccagcauuggaggcuagauaugcaggagagcucucagccacaaaugaugugaauaaggucaauagugucuauuugcugaacuugucaucaaagauggugaaacugauacuuuacucucugggugagagggcuaguguuuacacugaauccaaacauuuggauaaugacauggugccuccucagcagugacugugucuucuuguucaucauaauaauguuauugauuagcgguacugaacauguagguaugcguaguagugagaugccgagguuaagagcucagcuccaggaauugcaugguucuagguuauaauucuugcucugucacuguauuagucaggguucuccagagaaggagaaccuguguguguguguguguguguguguugaaagaaagagauguguuuuaacgaauugguucacacaguuguuggaguggcaaguccaaauuuugaaaggcaggcaggcuggagagccggggaaguugauguugcagcucaaguccaaaggcagccuggaggcagaauuuccuguuccacaguggggccacgguaggcacucagucuuuuuucuuaaggccuucaguuguuggaugagggccacucacauuauggaggguaaucugcuuuacucaaagucuucugauuuaaauguuaauugcaucuaaaaaauaucuucuuaguggccgggcacaguggcucaugccuguaaucccagcacuuugggaggccaagguggguggaucaccugaggucaggaauucaagaccagcccagccaacauggugaaaccccaucucuacuaaaaauaccaaaaaaaacuagcugggcgccuguaaucccagcuacucggggggcugaggcaggagaaucgcuugaacccgggaggcagaaguugcagugagcugagaucgcgccauugcacuccagccuggggaacaaaagcgagacuucaucucaaaaaaaaaaaaaaaaaaaaaaaaaaaaaaaaaaaacaccuucuuagcacauuguuuggucaaacaacugggcaccguggccuaaucaaguugauauguaagaccaacauagccgcugccagcaaguuacuaacacuucugagccuuggagccucggcuuccuugccuguaaaguggggguaagaagaccaucuugaaagguuguuuugagguuuuacgugagaugaaauggguguccaauggagugccuuuagcaggacaccugcuuacccccaccucuacccaggacaucaugaugcgggggaagugguggaaccuucagaacccagccccuaguaugagaagaauucugccaucaccuuucuuucagcagagagggaagcaguccccuuccgugacagucacaugcgugagugauggcuccuuccaauauccugcacuucuuacugccccuuaccuggcguugcuccacucugucucauguucuaguuuucuuaucucuuucucuuuuuuuuucuauuuuauuuuuuuccuguaggcacaagugaguuacaguagguuaaguuacaccuuaccuuuccuuguuuuucuuguuuauuuauuuguuuauuuauuuuuuugagacaaggucuuguucugucaccacaggcuggaguacaguggugcaaucacagcucacugcaaccuggaccucccaggcucaagucaucuucccacauucaggcaauccucccaccucagccucccaaguaucugggacuacaggcaugugccaccacacccagcuaguuuuuaaaauuuuuuauagagauagagacagggucucacuauguugcccaggcuggucucaaacuccugggcucaagugauccucccgccucagccucccaaaguguugggaucacaggugugagccacugcaccuggccuuuuguuuuuuuuaaguagagacagucuugcuuuaucacccaggcugguauacgauggcacaaucacagcucuccuaggcucaaggauuuuccugccucagccuccucaguagcuggcacuauaggcaggugccacgacacccaacuauuuuuuuuuuuuuacuuuuuauagagacagggucucacuauguugcuccuggccucagguaauccuccugccuuggccucccaaaguacugcgauuacuggcgugagccaccacacucagccgagugcaauggcgcgaucucagcucacugcagccuccgccccccugcccccggguucaagugauucuccuuccuuagccucccgaguagcugggacuacaggcaugugccaccacgcccagcuaauuuuuguauuuuuaguagagaugggguuucaccauguuggccaggaugguuucaaucucuugaccucgugauccgcccgcgucggccucccaaagugcugggauuacaggcgugagccaccacacccagcccugcuguuaccucuuucuuaccucagcuauuugaggauagagucuagguccuguccugcauauagaaggugcuuaucaugugucuuuugagugaacacagagggugacauugucacgugcagugccaacagaaaccaaaugacuagacaccugcugaccuuccauggccacagggaggaugagaaaggcaccuccaggaggugugaauaaucugaggguauuggccacuguggacaagacucggugguggaagugagcucagagauccaaagggaacgugaguagagacaugcagagucucgcagaggaagcagacgugcaggccacaaagacaaaauuacaagaaaugccccaacacgagcauaugcucacggacugcacagauucaaggaggaagugccagaaacccugccugccccagcaucugcacaggcauccacaaaggguuucugucauguuaucucuuuuucuuccaacauccggugcugugaguuuuauugucccuguuauaaaugccuccaggaguggcagguccugcccagccccaucagccaguuggugcugcagucaggacacccaggcagccugaggacugccagaugugcagagagcuaucgcgugccugcugcgugcccagcaccucacacagcucucagugucugaccacgcuggugcccugguggacaaaguuccugcccuuguggcccuuuugucuaguggguggcuuccaacaaugaacacacacaggauaugucaggcggugacaaaggcuacugagaagaccaaagcggcuucacccucccagagcacagcuuuucccucccaggcccgagagauguagggagcccacugucccagucugggucaagaggaacaguuacaacaccuuggaaugacugaaguugggagcuaaggugccaggacaagacaggccauuuuaggaaccagagacuuguguuaccccuaaaccucaccagccaggaggggagcagcccacuggguccucucugccacaguugggugcuucuugugcucccccuccuguggucaggauaggggaagcaggcuuuccugcugccacuccuaggacccaaggggaagcugggggaguggggagaccaugugggaaggauggagugcacuuugauugguagcagguggauagguacucccaugguggggaaaucaaaguugcuuggccuguguaguagacagguauuaccacaggccuggaaaacauuagccuggguuuaucucuguggcuucggucccccaacauccccuucuacucaaaauggcugauucucugguuuggagguuuggcaccugcuuuuggggagguugcucagucauuagagaagagugcagagguuggacggucaucauggcagagguaggacagcugguauguggggccaugaaaccagcuuugggcuaggagucaggaagcugagacucaguucagguccccuuuccaagaugaagagaucauuuccgaguguccaaagggcacugggaagagaauccuagcaguucuuaugaaaucaucugacagcagauauauccugaagucauagccuuagcaaacugccuuucucgccaacacacucaacaccccgugguucaaacaucuauacgucugauagaaaaacuuggagaaauucaguguguugcuuaaucaauaugacugauaccuaagcuguucuacucaagaaguuuucaugggaaugaacuugagcuucuugaagagauuguuuacagcaucccuggagucuaugcaagaauagaacuuccugugggggaugguggggaggcuagcucugcagaggucuacaguccugcaguuucugcaaaacacguugcacacaucuccauaugggccacacgguggcaaccucugaaccaggagagcugcuuccuaagggcuaagacccucugucugcuuucucucucuugcuuuccucccaaaacacagccauccuccuccccacugcuaccccauggugaguucagcccaggaagccucugacccagcccugaugguaauagcugcuguguacuggacaucuucuguauguuaggcucugggagaaaugcuguggagacuuuuugcccauccucccagagaagcugucaguacccccuguucuaggugaagaaacugguccucagaaagguugacucccugaggccacacagcuguuaaguggcugaggcgagggcuguggggcuguucccacgcccuggcuuccaggccuggcagcauguggagcugccccuccaucguguguccgcagaccucucccggagcuccucgccacccucacugcuggaccaacugcagaugggcugugacggggccucaugcggcagccucaacauggagugccgggugugcggggacaaggcaucgggcuuccacuacgguguucaugcaugugaggggugcaagguacggacuggggggagcgguggcuggccacugaggcuguggucacauggugaauugacccuccacaaagcuuuccuugccuugggguggggcccugacuguaccuauugcagaauuccugcccaggaggcagccaggcccuugugcuccagaccucagcucugggcacugcaggagaagaggggguucccuugucaagccuacccugcugggcaccuguguugacccagcucugugggugauugugucccccuggggaccaggcagcuagggcagaaugagggucuugggcugagccaucgucuuaccugaggucuggguuucuuguuucucaaggcucaaagcgggcucugagaaaaaaggacagacauuuguuuuuccagugauauuuguggguccuuccuaacuucacacccaucaaaaucucacagauuauuuuauugaaucaccaccucacaaauacacagaaccagauacauuuaugaagaaaucaaguuagccgugagacaaucuuauguuaccaaacuaacaaagaagcuuuuuuuuuuuuuuuuuuuuuuuuugagauggaaucucgaucugucgcccaggcuggagugcaguggcgugaucucaguuaacugcaaccuccaccucccggguucaggagauucuccugccugagccuccagaguagcugggauuacagguacaugccaccaugccuggcuaauuuuuguauuuuuaguagagaugggguuucaccacauuggccaggcuggucucgaacuccugaccucaggugauccaccugccuuggccucccaaagugcuaggauuacaggugugaaccacugugccugacccaauuuuuguaguuuuaauagggacgggguuucaccauguuggcuaggcuggucuugaacuccugaccucaggugauccacccaccucggccucccaaagugcugggauuacaggcgugagccacuguguccagccccaacaaagaagcuuuaggacuucuuuagacauuuaaaauaguuguguuuuuuuuuuguuuuguuuuguuuuauuuuguuuuguuuuguuuugagauggaguuucacucuuguuguccaggcuggaguguaauggcgcgaucuuggcugacugcaaccuccaccucccggguucaagcgauuccccugccucagccuccugaguagcugggauuacaggggugugccacuacacccagcuaauuuuucuguauuuuuaguagagacgggguuucaccauguuggccaggcuggucucaaacuccugaccucaggugauccgcccaccucggccucucaaagugcugggauuacaggcgugagccacugugccugaacuaaaauaguuuuaauuaaaguuuuagaauuacuuuccuucuccaucuccccuccaaaaaaauuucuucucguuacuuccaaaugucaggaguguuuacaccuuauacauaaucgggcccuuuggcacagccucccucccaccuccugguggccuuuccucaccuguucuuggugcuucagggcuucuuccgucguacgauccgcaugaagcuggaguacgagaagugugagcgcagcugcaagauucagaagaagaaccgcaacaagugccaguacugccgcuuccagaagugccuggcacugggcaugucacacaacggugagagcugaccagggcaacucacgggcugcuggcuccacacagccugaaaccaagguccagggagcccuuggggcagccuagagggggcaccuguagagcagugccuggcgcacaguaagcaccauggcuguuggcuguuggcuuugcugaucuggaccuuggaucuuagagccuaagaccugccacuuccucagacugccagcaucuaccaugggucccaggcgugggguaguguuuaccucccuauaccugagguuuacgcauucuggcccagaagggaacugauaauugauaccagcuugaacaauuuggggaacaccagucccagaaacucaagccugucucagaugaccugacacagcaugaaagcuacugccaaggccagguggcccuucuugguuauagaaggcaggcaguaaccaguaaguaaccacauuugucaacugccaggagccaggcagaaguuucuuggaggucacccacucccaggagacagagccuucucugcccugugcuccaggccuccugcagagccuugucuucggaccccaggguaggauauugcaaagcccaccuguccccucaguaccucucugaguaagaccccuagaggacaggggagagccucuugugaucucuacaggcagguuagcugcuuggccagcuuuuacccagggaugcccuaacugccuugcaucuuagaggguagcaguaccugagcccuccauuugcggcucuccuggguaauggggucuggcaggucuggguuugacuccuuucuuaggaaaucucggaacugacugaaucccucuccuuacgcuaacuccaggagaagucgaauucguauccuacucaauuacuaaugacaacaauuuuugagugcuuacuaugugaggauucuuauuuaauugaucuaauaacucaguaaguuuuaaaaaguauuagccucauuuuucugauuaaaaaagaaaaguggccaggugcaguggcucacaccuguaaucccaucacuuugggaggccaagguaggaggauugcuugaguccaggaguuuaagaccagccugagcaacauagugagaccucaucucuacaaaaaaaaaaaaaaaaaaaaaaaaaauuuagccaggcuugguggcgugcaccuguagucccagcuacucagaaggcugaggcgggaggaucacuuuagcccaggaggucaaggcugcagugagccaugauugugccacuguacuccagccuggaugagagugagacccugucucaaaacaaaaaaagaaaaaggcugggcaugguggcacaugccuauaauccuagcacuuugggaggccaaggcgaguggaucaccugaggucagcaguucaagaccagccuggccaagauggugaaacucugucucuacuaaaaaaaaaauacaaaaauuagccaggcaugguggugggcgccuauaaucccagcuacucgggaggcugagacagagaauugcuugaacccgggaggcagagguugcagugagccgagaucgugccacugcacuccagccugggagacagagcgagacucugucucaaaaaaaaaaaaagaaaagaaaaagaaaagugaaggagucugccccaagucacaaagcuaguaaacugcugagcuggaacucaagcccaggccuuugucaccaaagucugucuuaccccagcuagcguagcucagucacucaguaaguuagaguccuugugugcugggcacugugaacaaaacagacaaaaucacugcucuugcaaagauacaccaaaaaaaaaaaaaaaucacaucuuguggagcuugcgaucuggaggggccaccccaucauuccuaccuugcugacucuagagcuucugggggccuuaggcuccaaaaggauuuggcccaugcaccuguaaagggauggggaugucagaggugcuggggccugccugggcuccuugcugacugcccccuucccugugcagcuauccguuuuggucggaugccggaggcugagaagaggaagcugguggcagggcugacugcaaacgaggggagccaguacaacccacagguggccgaccugaaggccuucuccaagcacaucuacaaugccuaccugaaaaacuucaacaugaccaaaaagaaggcccgcagcauccucaccggcaaagccagccacacggcggugaguguugcugcugcuuggccuggcagcauccugggcucugggucccacugccgccugccugacuccgggagagccaggccuucucccucccucaacuucauggugcaggcaagggacauggggagcacagggugggggucucccgaggccugaucucuaacggggccugguuuucagcccuuugugauccacgacaucgagacauuguggcaggcagagaaggggcugguguggaagcaguuggugaauggccugccucccuacaaggagaucagcgugcacgucuucuaccgcugccagugcaccacaguggagaccgugcgggagcucacugaguucgccaagagcauccccagcuucagcagccucuuccucaacgaccagguuacccuucucaaguauggcgugcacgaggccaucuucgccaugcuggccucuaucgucaacaaggacgggcugcugguagccaacggcaguggcuuugucacccgugaguuccugcgcagccuccgcaaacccuucagugauaucauugagccuaaguuugaauuugcugucaaguucaacgcccuggaacuugaugacagugaccuggcccuauucauugcggccaucauucuguguggaggugagugagaguggggcaggugggcuggccuggcacacccagucguccuggggguuggcccucacugcagggcacugugccugagcucugacaguguggggaagugucccugugaucuuggcaguggaacaugcaaggcacugacugagcaugcaggaucagcuccaucucauuauguacguagauagagguggagacaggaaaaagacuaagccagacgugguggcucacaccuguaaucccagcacuuuggcaggccgaggcggguggaucacuugaggucaggaguucgaaaccagccuggccaacauggugaaaccccgucucuacuaaaaauacaaaaaauuagccagaugugguggcacgcgccuguaaucccagcuacuugggaggcugagccaggagaaucgcuugaacccgagagguggagguugcagugagccaaaaucccaccacugcacuccagccugggugacagagugagacccugucucaaaaaaaaggaaaaggacuaacaggcaguaugcugucauguuaaugugggguggaaaaauugucugcauuuuuucugcauuuuuaaaauuccaacacaauaaauacaauaauaacuaugcuaacuaacaguggucuagagcuuacuucaugccaggcacuguucuuuucaucgaugaugacucacuugauccucacaacaacccugugcaggaagaauguuuugugucuccauuuuacacaucagagaggcugaaugaccugccuauagccucacaggcagacacaggauuugaauuaagcauugagucucuuaaccacaauacuacguugccuaaucgggggggagguggggacaaauuggcaaaaaacaaaagaaguggauuaagaccagggguagggagauuagaacacccaguggagcauugcugaugggacagggcuuggucugucacggccaaggaggccugccguccccugggccaagucaccucuugggguggaaguaggggagcuccacugccuuucugagcucccuggcgugcccuguguccccacagaccggccaggccucaugaacguuccacggguggaggcuauccaggacaccauccugcgugcccucgaauuccaccugcaggccaaccacccugaugcccaguaccucuuccccaagcugcugcagaagauggcugaccugcggcaacuggucaccgagcacgcccagaugaugcagcggaucaagaagaccgaaaccgagaccucgcugcacccucugcuccaggagaucuacaaggacauguacuaacggcggcacccaggccucccugcagacuccaauggggccagcacuggaggggcccacccacaugacuuuuccauugaccagcccuugagcacccggccuggagcagcagagucccacgaucgcccucagacacaugacacccacggccucuggcucccugugcccucucucccgcuuccuccagccagcucucuuccugucuuuguugucucccucuuucucaguuccucuuucuuuucuaauuccuguugcucuguuucuuccuuucuguagguuucucucuucccuucucccuugcccucccuuucucucuccaccccccacgucuguccuccuuucuuauucugugagauguuuuguauuauuucaccagcagcauagaacaggaccucugcuuuugcacaccuuuuccccaggagcagaagagaguggggccugcccucugccccaucauugcaccugcaggcuuagguccucacuucugucuccugucuucagagcaaaagacuugagccauccaaagaaacacuaagcucucugggccuggguuccagggaaggcuaagcauggccuggacugacugcagcccccuauagucauggggucccugcugcaaaggacagugggcaggaggccccaggcugagagccagaugccuccccaagacugucauugccccuccgaugcugaggccacccacugacccaacugauccugcuccagcagcacaccucagccccacugacacccaguguccuuccaucuucacacugguuugccaggccaauguugcugauggcccccugcacuggccgcuggacggcacucucccagcuuggaaguaggcaggguucccuccaggugggcccccaccucacugaagaggagcaagucucaagagaaggaggggggauuggugguuggaggaagcagcacacccaauucugccccuaggacucggggucugaguccuggggucaggccagggagagcucggggcaggccuuccgccagcacucccacugccccccugcccaguagcagccgcccacauugugucagcauccagggccagggccuggccucacaucccccugcuccuuucucuagcuggcuccacgggaguucaggccccacucccccugaagcugccccuccagcacacacacauaagcacugaaaucacuuuaccugcaggcuccaugcaccucccuucccucccugaggcaggugagaacccagagagaggggccugcaggugagcaggcagggcugggccaggucuccggggaggcagggguccugcagguccuggugggucagcccagcaccugcucccagugggagcuucccgggauaaacugagccuguucauucugauguccauuugucccaauagcucuacugcccuccccuuccccuuuacucagcccagcuggccaccuagaagucucccugcacagccucuaguguccggggaccuugugggaccagucccacaccgcuggucccugcccuccccugcucccagguugaggugcgcucaccucagagcagggccaaagcacagcugggcaugccaugucugagcggcgcagagcccuccaggccugcaggggcaaggggcuggcuggagucucagagcacagagguaggagaacugggguucaagcccaggcuuccuggguccugccugguccucccucccaaggagccauucugugugugacucuggguggaagugcccagccccugccccuacgggcgcugcagccucccuuccaugccccaggaucacucucugcuggcaggauucuucccgcuccccaccuacccagcugauggggguuggggugcuuccuuucaggccaaggcuaugaagggacagcugcugggacccaccucccccuccccggccacaugccgcgucccugccccgacccgggucuggugcugaggauacagcucuucucagugucugaacaaucuccaaaauugaaauguauauuuuugcuaggagccccagcuuccuguguuuuuaauauaaauaguguacacagacugacgaaacuuuaaauaaaugggaauuaaauauuuaagagcugacuggaa

SEQ ID NO: 61565 - RNA, 82839 nt, Homo sapiens
gcggagcgugugacgcugcggccgccgcggaccuggggauuaaugggaaaaguuuuggcaggagcgggagaauucugcggagccugcgggacggcggcgguggcgccguaggcagccgggacaggucaguccgagacgagagaagcggucaggcaaguggcggagggaagcgccgggccugggccgaggcggccagcgggacuggggcgcaaggcccggcggcggggaacggggugcggggagcugccgggguccgcggacagcgucacggcggcuuccugaugcuccggcccgcuccggucagccgucgugcguugccauguaggcgccccgcugacccugcgcccccccgcccuuggacccccauagcugcuugagugaguccgaaauacgggccuccuuccacccuacucuuugcccccucuugggccugguggcuucgucuucucccacuugugagaaccccgucucaggcccgggggccucucccauuccccuccccugccucugaccucuuccuucacccguuucugguguuccugaauccacugcccuaucuagcgagagucuucucugggaucuuuuccucugucccccucguuauccuugucuccugccuucauccucccauccuugcucucucaggcuuuacucucucuccccaucccuguccccuucuuaucuguggucugaucccuccuaguauuauggguccccauccucuuccccaggguguuccuaggcuuuuuccaacuccgugccugcagucccugucucccuaagacucucaccuugguucccugagaggcccuguuuuugcuccuuuuuccgauuuccuucguaucaauucuguccccuacauuccugucgcccaccuccuuuucucucccuguuccuuuccccugcuucagggagaagccuuagcuccacacucuacucuacuuucacuugaccugcaguugacauaaccaugggguggggguggagguguucagaccuugaucgaauuaagaggcugauugacuaaaggaaauaacagauugugugggagaauguacguggguguugcaucagagaugauguccaauuuguaggccauucuucuuaucucagcuuuaauacuuccccuuuauggggcuguugacuuccaggaacccuugggggagacggcgcugagcuggaugugugccacggguagccggaggcuuuguccaauucuuuuccccuuccaggaaccgggguuuugugucuuuccacucuggauguguggaauacacuuauaccaugauaccccagccucucucugcccucacucccacccuccacccugugcuccauccgaaaggacuaagagaauucuccagaagcugugcuccagaaaauacuugugguccucaaccuuuuuucuguguacuggcuccagaacuuuuuuuuuucccguuugaguuuugaaauagauugcuggccugauagcccuggggcuggcgggcaucuguccccuuuuauuauugguggcuugaaacagcugcugauuuucucucauaucucuuugacaaucuuuggccaacugaaugugccucugauguuggucacugaacauguucucuuggagucucuucucccucuuuuuucuuuguucuuuucugaaucuagggaauccaaauugucccucuuuuucccugggagcuuaauuuccucuguauccaggaggaacggcaaucccagagcucuguucccuuugcccaggcauaguaugagguaucagauugauaacuacccuggugggcuguggggcugcaguaguuagaccuugucaggaacuugagcagacacaucugcuuccagucacauagaucaucuucucuggggcuugagagcccaccaccuuccaugugugucuggauguuuaaccuuaccaagcagaagauucucgucauauccuucaguuugagcuccuuuauuuggcguugguucucuaaagaaguauucaagaaauaacauauccuuuguuucuacccagucugaucuuggaggauucugaaagcgugacccacucucauguuuagaaaugaaggcucauuguuucaccuggccccagguuucuaggggcuccucuuuugaugauugugcugucuuugagccagauuggacaugggaguuggcaaccuuuaggagcugcgguggagagccaaaggaaccagcuugaccagacuuuaaaguuuuguaauccucuuguacacuguuuucugugaaagcaauaggauuguggauggccuguuguugagccagucccuucuccacugacccccagacccccuuugcagcacuugcaaagauuuggguagacuggaccagaggguuuuccuuguuccugugaauagcaucucuccaggguuuuaguggaucauucuaaagagguagaggucaaguguuggacagauuuuuagucuagucucuggcuuucaaggacuccuccuuacucuuuugagcaguuuguuacuucuggccgugcuuaccccuuaguagugcucucugcugugguggcaggugagagauuugagaacaggucaaggccaguccuuguggagcagcuugggcaccagcagcccuagauggauagcuucuugcaguuuguccacucucauuuucugagaagguagucaugauugucaauuaccaaauuccuuccccauucagugauuuuugcagagucugggucuggauuuucuuuccuucuuucuuuucugacacaagguuuuguucuauugcccaggcuggagugcaguggugcuaucauagugcacuguaaccucgaacuccugggcucaagggaucuuccugcuucagccuccagaguagcggggacuacaggugcacaccaccacacucagcuaauuaaaaaacaauuuuuuuguaaagacaggcucucacaaugucucgaacuccuggccucaagcaguccuccucaccuuggccucucagagcacugagauuacacugacugcucguucaggugccuuucuccuugccucuucaccauggccuucuugugugauauaugccuuaacccauucaggaagaauugcuccuacucagccuuucaacccgaccuguggucccuuagacgccuucccuuagggccugguaagaggauagacaguguagagcacuagccugggaagccauuaggccucugcuuugggccuacagcuguccugacuguugugcaagcugucuucagggccugcagauucuggcacauccugggauagugcagcuccucucucucaggaguuggaccugucacuuuuuuuucguuuuuuuuuuuuuuuuuuuugagauggagucucgcucugucgcccaggcuggagugcaguggugcgaucuuggcucacugcaagcuccaucucccagguucacgccauucuucugccucagccuccugaguagcugggacuacaggcgcccgccaccacgccuggcucauuuuuuuuuguaguuuuaguagagacaggguuucaccguguuagucgagauggucucgauuuccugaccucgugaucugcccgccucagccucccaaagugcugggauuacaggcgugagccaccacaaccagccuggaccugucacuucuaagggcuucagcuauauccugucccugaggcccaccucccugagugcucucugcaggcugggaagcugaacaguggugccuugcuccagugccucugaagggcuuggaaauugcaggacacagcuuuacugcucagcauugcccacacuggaaacauucucuuccucccuacccaggucucugugggcuuuguccguucugccaggcccuugcuuauaugaugucagaagcccugugcccggugccauugucaaugccaugucccagauuaccuaauggcugcuucuuggagaugguuugguguccaugcacauuuuucucugccguuggagccagggugaggagcugcuugcaacagcuggauuccagggugucagaggagcccuuggagcuugccuugagccuggcagggagaacauggccccuugcaucagguuucagacauaugggucuucuuccuuggcagauggcuccuagccuucauaacucagcaggcuggugauuggcaugugacuccaguucauucugcaggggcuuuggugaaggcaucaacuaugacucaggacaucuucauuuaugagcuucuacccagcucccuucuuaccuugccugcgccuucugcgccgaccugauaaaaucagcaaagccagugucugcuuacuugggagugagcagacuccuuccaggauuggggaaauauuugcugacucaggcucagaaucacaucucagggugguguguaagggaccgacgaggagccagauuaccuuaggaacacucuuugaguuacgguggguauaacuuauuagaguugcuuugagggccccuggcaccugucagcuaaagcuguugggguuuuuucuauccugcaguguuguacaguguuuugggcaugcacgugauacucacacaguggcuucugcucaccaacagaugaagacagaugcaccaacgagguaaucccauuuucuuuacucaggggucucugaccaccacugacacaggauccagauuuaagauccugaccuugaagaugaaauaauuucacuagggcuuauucccagauuccagguuccugucacagcaucugguaccaguugcuuaugcauaguauaggcauuuauuaaguaauuauugaaagucuauggcuuacauaguuuuuucaggagcauggagauucccaccuuugcgcccauuaaaagauaaacuccacagggcagggaguuguuuugcugccuguugugucuaggauagugccuggcacagaggagauaaugaauaaauuuuuguugaaugaguaaaugaacgaacuuucgucuuugccuauauggguaccuagggugccaggccacaaagaugguguccaucauucucucuuauuagggggcaaauauauauauauauauauauuuuguuuguuuguuuguuuuugagacgaagucuugcucuugucccccagacuggagugcaauggcgugaucuuggcucacugccaccuccuucuccuggguucaagugcuucuccugucucagccucccaaguagcugggauuauaggcaccugccaccacgcccggcuaauuuuuguauuuuuaguagagaugggguuucaccauguuggccaggcuggucuggaacuccugaccucaggugauccgcccgccucagccucccaaagugcugggauuacaggcgugagccaccgcaccuggccuuuuuuuuuuuuuuuugagauggaguuucgcucuuguuguccaggcuggagugcaaugccgugaucucggcucacugcaaccuccgccucuuagguucaagcgauucuccuaccucagccuccugaguagcugagauuacaggcaugcgccaccacaucuggcuaaauuuuguauuuuuaguagagacgggguuucaccauguuagccagacuggucucaaacuccugaugucagaugaucuacccgccucagccucccagagugcugggauuacagaugugagccacugugcccagccgggaacaaauauuuuuaagugccaacuaugugccaggcacuugggaaaugauaauaguaaaaaacagauccaaucucugccucaugggucugugguuugcugguauauaugagagcuggccauaacacacagaauuguuucuuccaucucugcagggguaggagguucucaccaagagucugaacaaugcucuggguucccauugcuguuuccauguucucaggaugccuggcagguuuuauaaacucucagaaguggagcuccagggaauacaauguucauuguccuauuuggaaggcuggguuguugugggucccugcugggggccggggaaacgugggccuccugccugauuuguuuuaaucucugaaguucagugguuccaguagcuguuugugggcuucacuuccccuucucugccuuuaacacccugcagguuuuccuguugucagacaggguggugagucccugugucucucugucugugggggucagguuguuuguagaucuuucaggaagguccuggguggggggcccuccugcuuucaaacccauaccaagugcuuuccucugaagggaaugugagggaggaagaaggggggaguuucagagacuucugagguuccccaagagggaagaggucaaaguaccuccugagcggggagagcuacugaguugaacugauuugcuuugccauuugcuuuagcagcagccaggcccaguggcagcaauuguacgugcauuuccaggggucaguuguccaguucaucccugagccuugagcucccagucgcagguaggaacuucucuucuccuuucuuuuuuuuuuuuuuuuugagacggagucucgcucugucacccaggcuggagugcaguggcgcgaucuaggcucacugcaagcucugccuccuggguucacaccauucuccugccuaagccuccugaguagcugggacuacaggcgcccgccaccacgcccggcuaauuuuuuguauuuuuaguagagacgggguuucaccguguuagccaagauggucucgaucuccugaccucgugauccaccggccucggccucccaaagugcugggauuacaggcgugagccaccgcgcccggccucuucuuucuuucuugauuggguacugcuauaucaccuaggaccagggguguguccaaucuuuuggcaucccugggccacauuggaagaagaauuauuaucuugggcuauacauaaaauacacuaacacuaacaauagugaugagcuaaaaauaaaaauggcaaaagaaucucauguuuuaauaaaguuuacguauuugcguugggaugcauucagagcucuccugggcugcaugcagucaugggccauggguuggauaagcuuggccucccuaggcaguccucucaccacagccucccaaguagcugggacuacaggugcacaccacugugccuggcuaaguuuuuuuuuuguuuguuuuuguuuuuuuuuaauuuaauggguacauaguaguagguguauauuucuuuuuuucuuuucuuuuuuguuuuuuugagauggaaucuugcucuugucacccaggcuggagagcaauggcacaaucuuggcucccuguaaccuccaccuccuggguucaagcgauucuccugccucagccucccaaguagcucagauuacaggcgcccgccaccacgcccagcuaauuuuuguauuuuuaguagagaugggguuuugucauguuggccaggcuggucucgaacuccugaccucaagugaucugccugccucagccucccaaaauguugggauuacaggcaugagcuaccacacccggccuuguaugucuucuuuugagaaaugucuauuaaaaucuuuugcccauccuuuuauuagauuauucguuuuuuuccuauagaguuguuugagcucguuauauauucuuguuauuaaccccuugugaaauggguaguuugcaaauauuuucucucauucuguggguugucucuucacuuuguugauuguuuccuuugcugugcagaaacuguuuaaugugaugugaucccauuugaccauuuuugcuuugguugccugugcuugcgggguauugcucaagaaauuuuugcccagaccaguguccuggagauuuucuccuguuuucuuguaguacuuucaugguuugaagucucagauuuaagucuuuauuuugauuugguuuuuguggauggcaagagguaggggucuaguuucauucaucuccauaugaauauccaguuuuccaagcaccauuuauugaagagacugucuuuuccucaguguauguucuuggcaccuuugucaaaagugaguucacuguagauguguggauuuguuucuggguucucuauucuguuccauuggucuaugugucuuuuuuuuuuuuuuuuuuuuuucucugagacagaguuuugcucuguugcccaggauggagugcaguggcguggcgugauguuggcucacugcagccucugccucccguguucgagcaguucuccugccucagucucccaaguagcugggauuacaggcaugugucaccaugccuggcuaauuuuuuguguuuuuaguagagaugggguuucaccauguuggucaggcuggucuugaacuccugaccucaggugaucugcccaccucggucucccaaagugcugggauuacaggcaugagccaccgcgccugggcgaaagauggcuuauuuugaagucaacuuuagaauauuauaaaacagcauucucaaacuuuuuggccucaagaucccuuuagauucuuuuuuuguuuguuuguuuguuuuuguuuuuugagacggagucucucucugucacccaggcuggagugcaguggcacaaucucggcuuacugcaagccccgccucccggguucaugccauucuccugccucagccucccgaguagcugggacuacaggugcccgccaccacgcccagcuaauuuuuuguguuuuuaguagagacgggguuucaccauguuagccaggauggucucaaucuccugaccucgugauucacccgcgucggccucccaaagugcugggauuacagaugugagccacugcgccagucccuuuagauucuuaaaaauuauugaagaccccaagggcuuauguuuaccauguuagaaguuauaauaggccgggcgggugacauucguuaauaucaccacugaucucauuuuuaaaaagucuuuaaguauugggaagcugucgggcucacaguggucaauacacguuuucuaaauuugaguuuucucuugaaaguuugauuuuuaucauugguaacauacuguugguucuuuuguuugauuuugucugagauagcaucucccucagucacccaggcuggagugcaguggugcagucauagcucacuugcagccuccaacuucugggcucaaguaauccuccugccucagcguccagaguagcuaggacuacagguaugugcuaccaugcccagcucauuuuaaaauuuuuuguaaagauggugucuugugaucuugcuacaucgaccaggcuggucuugaauuccuggccucaagugauccaucugccucagccucccaaauuacugggauuauaggcaugagccaccacacccagccuuuuuuuuuuuuuuuuuuuuuuuugauauggggucucacucuugcccaggcuugagugcgguggcacagucuuggcucacuguaucuagccuugacuuccaggcucaagugauccuuucaucucagccucccaaguagcuaagacuacaugcaugcaccaucaugcccaccucauuuuuuaacuuguuguagagaucaggucucccuguguuguccaggcuggucucaaacuccugagcucgagccauucauuccugccuuggccucccaaagugcugggauuaaaggcaugagccacugugcccagccaguucuuuuuuguuuuguuuuguuuuguuuugagaugaagucucacucugucacccaggcuagagugcaguggugugaucucggcucacugcaaccuccgccucguggguucaagugauucuucugccucagccucccaaguagcugggaccacaggcgcgcaccccaaugcccggcuaauuuuuguauuuuuuuaguagagaugggguuucaccauauuggucaggccggucucgaacuccugaccucaugaucugcccaccucagccucccagagugcugggauuacaggcgugagccaccgcgcccggccacaaagaauauuuaaaagacagauaucaaagguggagauuuuaauaaaguuaguuuuuauuuauucaucuaggacauucuuaaauuggcauuuuauugucuuucaugguucuguggauuaacugggcccagcugggugguucuugcuugggauaugucauguugcuauagucaaaugaagacggggcaggugucaucugaaggcucagcugggcuggguguccacgcuggcuuaggcacauggguggcacuugaugcuguugaauggagugcguauacaugaccucucuaugugccuugggcuucucauagcaugagagcuggguucugagcagaagcauucccaaaaugaauguauugagagauucagaaagaaaugucaauguuucucauguccuagccuuggaaguuacacagugccacuuccucuauucccuuggucucaggaccaguucagauucaaggagaggacuacacaagggugugaauacuaagaggcgugauucacugaggagagaaacaggccuccuuggagaccagcuacuacuuuucagcauccuuaugugagguaauguggucuugauacuuccaagagaaaagcacaucuucucaugauuuucauuccuggaagcuacuguuaguuaggaaauuccuaauagguugauggaggacauugaaugcuaggugaaggaauuuguacucuguucuuugggcaaugggggagccaucagugguuuuggagcaaggaguggugguguuaauauugcaaaaagguagauuaggaauggagauagagaggauagguaggggacugcaguggucuaaauguaaggaaauucuucuucacauuaaaucugaguuccucugguugcaauuuaaguguauugauuuugauauuucagccacacagauuaagcacccagagccaggguggaauaacccaucccuaccccauauccauuuagggcuguugaugcacaggagagauuaagaguucacaaacuuuagaaggcaacuaaauuuagguuuuauugucaaagcacauaaaaaguuaagcauaaauuauucaaaaauaaaaagcaagaaaggugaaacuucauuuaacaccacuaaccauguuucaaauacgcuucaguuucaguauuauagaagcaaggaguggagccagaggaaggaauggggaggacaaauuagagaaugguaggaagagggacaaaaguaggggaagaaaggagucaggaggggcacacagcagaaagaauuugaaggaggucagauuggagcaacuacuugaagcugagagaaggcuccguauggggcuaacauguuagcaaagagcuggugccuucuguguuucccugaggcacuggcuucuggguuuuagcaucugguauccucacccuuucuuuaauacagacaguccccaacuuaugaugguucaacuuuacagugauguaaaagccauacacggcugggcgcauggcucacgccuguaaucucagcacuuugggaggccgaggugggaggaucacgaggucaggagauugagaccauccuggcuaacacagugaaacccugucucuacuaaaaauacaaaaaauuagcugggcgugguggugggcgccuguagucccagcuacuugggaggcugaggcaggagaauggcaugaacccgggaggcggagcuugcagugagccgagugcaugccacugcauuccagccugggcgacagagcgagacuccgucucaaaaaaaaaaaaaaaaaaaaaagcgauacacauucaacagaagccccauccuuuaguacucauacaaccauucuuuuuuuuuuuuuuuugagauggcgucucacucuugcccaggcugcagugcaguggugugaucucggcucacagcaaccucugccucccggguuaaagugauucuccugccucagccuccugaguagcugggauuauaggcgacugccaccaggccuggcuaauuuuugaauuuuuaguagagauaggauuucacaauguuggccaggcugguuucuaacuccugaccaggugaccugcccaccucggccucccaaagugcuggaauuacaggcaugagccaccgugccccgguucucauacgaccauucuguuuuuucacuuucaguacaguauucaauuacaugagauauucaaaauuguaacauaagcucuguguuagaugauguugcccguaggcucauggaaauguucuggcacauuugcaguaggcuaugcuaaguaaguuaugguguucggcagguuacauauauuacaugcguuuuugacuugugacguuuucaacauaugauggguuuguccuuauaaguugaggaacauuuguagccauuucaucgucugugaagaggccugaguggauuuugugcuggagaccggugugacucagcuccaguguugacugaccuucuaaccaugggcuugugacugaauguccugagccuucauuuucuucccugugaggauuaaaaugaaccucaggaaaugcuggcuuguccucuuucugucaagcuggguucugagggggugagcccagguaggagugacuucugaaccagcccagauuuacaggcuugggcauagggagcccagccucagccugggagccucaucuuccauuaaauagcuccuggcauucaggggagugcguugcagcaccccauuuuuuuuucauugaaguccugucuuccagccaggcacagugaaucacuugaggccacgaguuugagaccagccuagccaucauggggaaaccccaucuauacuaaaaauacaaaaauuaucugggcacgguggcgcacaccuguagucccagcacaccagaguucaagaccagccugggcaacauggcgaaaccccgucucuacaaaaaauacaaaaauuauccaggcguggugguacaugccuguaguuccuacuccuuggggggcugagguaggagaaucacucaagccgaggagguugaggcugcagugagccauauuuguaccacuguacuccagccugggugacagaguaaggcccugucuguaaaaaaaaaaaaaaaaaaaaaaaaaagugcuuucuucuucuucuucuuuuuuuuuuuuuuuuuuuuuuuuuuuuuuugagacggagucucgcuuuguugcccaggcuggagugcaguggcgugaucucggcucacugcaagcuccgccucccagguucgcgccguucuccugccucagccucccgaguagcugggacuacaggcgcccgccaccacuccuggcuaauuuuuuguauuuuugguagagacaggguuucacgguguuagccaggauggucucgaucuccugaccuugugauccgcccgucucagccucccaaagugcugggauuacagucaugagccacgaugcccgaccucuuucuuauauaauuuuuuuuuuuaaucgggcagcccucagaaucacagcagauucagaaagacuccccagaaaaguucuuucacuccuaacuucuacccagccucauggucaccucagcagcucuccugagaccguuacuaaguucuccacagcuaaugguaacucagcuuggaaagaguucucuuguaggaggaugcugaagggagguugccaaguggugugggaaacugcuucaugcuuaaguucacuuccauaucaugauacuaaaagguaucuaacagcugauuuucauugcuuucauuugugaucugcuaggaccacuugauccuuaucacugcuuuuggcacacuccucauccaagaguugaucgcagaggcagaguuccuugccaccaguccaguggaaguacaagccaacuuugcucuccaaauggcagcaguagcugagcaggccgcccugcauucucuccucauaaacaugcuguucucaaguuugucagaauccagagcucucuacucauuacccccuuuuccaaacaagcaagcaaagcaugcucuuccuuuguuucccuuaauugccuaaaacaucuccaugcucauagcuguugacucucuuugccuccuaguuccuguuccucugguguaggauuucucagcccuagcacuguaaacauguugggcuggauaaucaucucuuguaugggcuguuugugcauuguaggauguugagcagcaucccuggcuucuacacacuaagugccagugacacucuucuccccuccccagcuguaaaacccaaaugucugcggacauugccaaaugucuccuagggggcaaaaucaccccugguugagagucacugcucuaucauuuauucacuaaauacugcuggucagcuggguccacuggcgaaccucacaucaauaaaccugguaauagaagcauauuguucuuacauuagaaguuuacucucuucaguuaucucacugggcccuugagggcuuuggggaggagugaugggaaaugguuuacaauuaacagcauauuccaaugaagaaagaaagcauaugaugucugcacaacagaggagaguguccacaauguacagcucuucccuggagcaguuauguuucucagggugugcuuuuccaagucauuuugugucugguuagaagccaccuucccuuagcauccagaggugccauguagacuaggguuggucacaguguguagauugccauugaccugcccauuccuaguguuugaccugguggucauggcacucugaccacaucaguuuuccucuccaagcccagauggguucucagaacccuccaccccaagcugcacucaugagaggcggcacuucugccauccugaucuagagcuuguucaugugguccagaccauuucuuugcagcccccucuccuguguaaaagccuuuaggaaagugcagagauccugauggauuccccuugacccucagcacgcacauccugguauguagugcucagcacuccguugggggcuucagacuggagaagagaaaacugcccuucccuuucaaggacauccuccaagggccagaaugcucaguuccguaaaauuaacucuccacugccuacuuuuuuuuuuuuuuuuuuaagacagucucacucugugccccaggcuggagcgcaguggugugaucuuggcucacugcaaccuccgccucccggguucaagcaauucuccuaccucagccuuccaaguagcugggauuacaggcaugcgccaccucacccagcuaauuuuuguauuuuuaguagagacgggauuucacuaucuuggccaggcuggucucaaacuccugaccucuagugauccacuugccucggccucccaaagugcuaguauuacagucaugagccaccaugccuggccugcugccuauuuaaauagcaagcaguuacaguuaaagaaagacccuggccuggggacgcugccaaggcuccuaaucugacacuucuuucauguggaccagggaucugaacuguguuucuuccaaacuuuuggagcuugcuuccuuggugguaagcuaaauaguggcccccaaaauauaccccuuuauaaccccuguaaccugugaauauuauaugacauaauggacuuugcacauguaauuaaauuaaggaucuugagaugaggggauuauccuagauuaucuggguggaccccuaaaugcaaucccaaguguccuuaugagugggggccagagagagagauuggacacaggagaaggaggcaaugugacuacugcagcaagaugcuacacugcuggcuuuggagguggaagagaaggccaaaaaugcaacgaacguagcuuuggaagcuggaaaaggcaaggaaacuguuuucccuuagaaccucuggaggaaguguggcccugccaacacacugauuuuagcccagugaaacuaauuuugaauuucugaccucuagaacuguaagagaauaaauguguuuuguuuuaagucgcuaaguuugugguaaugugguaauuuguuacagugcaguaggaaacuaauacagggcucaucugccuccagguacaagugguggcuuggcugaucccuguucuuauuuuaaggcgucccucucauggcacaaggagagcauaggcccagcauuuuccugaaccaguauuugaaacaaucugcacuuugggggaaccuguuggggaguucuuggaagcaagagagaaagccucauaugguacccgauccuugcuuuggaacucucccagcaccuucagugauaucaugaacaaagaguucuuucagaccagugaggauguaggauuauuaaaaucugauucuaauuccaucuuccccucuccucuuccauuuauucaauaaauguuuauuguguaccuccuaugugcuaggcacuggggaugaagggauaaacaaagcagauaaaaaaucuccugcucucgugguaacugaggugggggaaguggagggagccagaguuaagucaacagcaugugagauggcuucagaugcucucuagaaaacuaagcagaaaggaggguaguggcaguuccacauagagggccggggaaggucucaccacgaaggugacauuuaaguggaaagaggagagugaacuauugugggaagaaucucgcaggcagagggaaagcaaguuccaaggcccugcacugggacacagcugagguguucaacgcauagcgaggaggccagcguggcuggacagagggagggaggagaccaggagaugaaguuagagacgagauugguggcccugaagugccauaacagcuuuuacuuugcuuggcauuuugccccuucuuucuccucuccucccccucacaccaccucacgaguuuuaggcccauguuccucaguuccuuuccaugggauauuuaucccaucauacuuagggacuaccagcaggcaaacauagucacuuaaaaauauuagaagagggggaaaaagcagccuccucuuucugaaugaugaaagcaguuccauggcaguguuggcauggcacuguguaucuagcagugcaggcuggccauucaccgcguaguucugggugguuucugagagguuccccuccauggccuucuucagcccaugaggaaguccaaccccccuggcccgcuguuucuuuccauuucaccccucuuggucuccccagugggacucccacagcugacuucuauccccaccugugucuaauccccuuuccauggcugagccgguagauaaccuaguaacgaucugaguagaauauggcucccacauguugaaugcauugugcugaucacuacauauaucacuuugauucacacaacaacccugagagguaggaaccauuguaccccuuuuagagaugaggauacugaggcucagacugguuaggaaaauugccuaaaguugcacagcuaaugaauggcagagcugggauuugaacccaagugauuaaagcccaugucuuugaucacuacauagcagggccuucuaggaaggauggcuggcuggaucuaguuguuccaguuuggaaaguaccugcuugacuggccagacugcuguuggcuucagaaaauagcagucucuuguuggucacugagaagaggcaaaauuuuggcaggccuuggggccuccugcagagucucauuccaggucaguggacagaggaggcccugagaauagucgugcauacuggcucccuggaucugcuccaagacagugagcagccccuagaaccacaagagacuggccagccaagcugugggcccggccuguaggguggaaggaacucuuaagagaaaaaaaaaaucucugcugugauuaaucaacagcuucagucuggugaagugaaaagagaaaaguuggcccagaugugcacauagggagagaaauaagggagggaaauugccuuuauucauguucucccuuaggccagucguuaccccacggaugagaucaccuuccuuuuacaccagccugcaagagguguguagugguagucucauuuuacagacaagguguaggaucagagagguuaacucgcccaagucaaacagcuaacaagugguggaauuggaauuugagcccuguucuucucaguucaguagcccugcuguucuugcugaugucaccucagcaugggcucuccagguaugugcaaauaguuaugcaaguguugcauccacaggcuugugagcagaggcugaaagggagccagggcucuugguacuugcccucucaacaugggcccugccuaagcuagcaggacucacuauacccaaaccagcaguggcauuauauuuuucucuuuucuugcaccuugccauccccgauuuauuuuuagagagccuuuucuauuucuguucccauuucuuggcuuggaugcaggggcuggggugcagggauggcgcuagaaaucagaagaggcaggcauagauggcaucucacugguggccuuggcuggucucugggaacugugcccaucugccugcccugcuggcuccuccucaggccagcuguaggccccagggaucauagagcucggguagcuagaggcugggagggcaggcgagacagagaaacagccacacuucucauuucuuuggcuucucagagggggaugagcuuccuccuggaacagagaagggaguagcucacugccuguuucucaggguuagguuacggacuucuagggaauaugggguagugcuuaagagccagacucuguguggcaugggggugauaacuguagacccuccaccucuggggauuaaaugagcucauacauguaaaggcacagaggaggcacucacugaaugaugauuguuucauuagugucuuuagacccucagcacccagcaccauagguggaugccagucauuauugguuagaccaaacagaacuucaaggcagcugggcaugguggcucacaccuguaauaccagcacuuugggaggccaaggugggagggucaccugaggucaggcauuugagaucaaccugggcaacguagugagacccagugucuauuuauuuaaaaaaauaaaauaauaauaaaaaaagaaaaauaacuuuaauguuauuuuugucguccucuucaucugaacauuggccugcguagguauuaaccugaguccagugauuguuuguggagccccacaggguacuucccagugacagcagccuggagugugcuccugccagccccugccugggcccuggaaaaggcagggcagugcagcgaggaaucuucuggccuaaggaugccuguaaccaccaaaccuuauguuuaguuuuacaccuugcugagggucuggcuuuuggauaugagcucuggagugguaggggucugugucccauggggacaggugguucuggguguugggcacgaggugauggaggaagggccugccacuugcaagcuguuuaucugacuaguaauaaacaguggaugacaccuuuaggaaacuguauuugggagcuuugaaauuaaucagaugccaccaauggcauuuuuaauuuaguuaaaaauguuuuaguuauauaaauaaugcucauucguuauagaugauuagaaaauacagauaagcacugaggagaaaaaaguaauauauuaucacacauaaguggcugcuuugauauaugauuuuuuuuucuuaccuagguucuuuucaaauuguguauaccuaguuauuuuuucugucuuucgaaaugggaugcuguuuaacauuuaguuuugugacuugccuuucccauuuuucaggugguuuuguggugucugcuuguccuccgaccuccucucccauuugugggaaaggcauuuggccuggagggaggcacuugggaagaacugucugguuguuccuugauguuauugccagacuugcagaggguagagaggugcaugaagucuuacucugccucuccccaucugugucucucccugucccuguccagcgccccaucugcucugccuacucaccacuccugccuuuuuuuuuuuuccuuccauacaaauccagaaaaggauaccaccuccagucugaagguuucuuucuauggcuuuuagggaugaaucucucaggaguuuagaaaaaaagaugcacagacaguauauaggaaggguaaugccagggcugggggugggggucuugggaagagcaacugagaggagggccugggucccuggugcugucuugagucagugagaagaagcugcgugggugauggguuggggcgggguaggcagcaggugacugcagggaccucucugaaacagcaagcaagcuggccaggaagacgccuggagaauaaggggcccagauaggggccagacauaggggagaagaaaaugugucucaguggcaccugcuccuccacccuggccccacucuuuccaugaucuuuccagagauucucucuuuuucugccugaucugcuucccucaccuggcagugcccagccccaguaguuugacacaucugguauaucuggcuacugugcucuacugacaccuguguggcagcagcugcacagcuucuuggcaucucccugggcaguaggcagggauccgagcauagaggaagauguuccaugcaucaguaacucagauuccguuccagaaacgcaucucaaagcaagggagaaaauugaagaugggguauuuuguggggaacaagcuaugccuuccugucacuucuuacagaauaaaauggggucucuggcaguaggcaaggagaaggccuuucugagcacugagggucaguggcuucucaggucuuuucugggccacuuuggccugcacacagguugggcuaggaauucaugcuuaaaagcaggcugauuuccauaggcugugcguuccugugggccugccuggaucauaucuguucugcugugaucccaggccuggugagacccacuggcuuccuguacguccccucaaagccugcgccaccgccucucccuucaccacucccaagcuauaauuaaguucccaugugaaacuguaucccucagcugacacacgcuuguaacuacagcccuggccauuggacggcucaucuggggugacuucuggggcuggugccucagccuccagacgcucuccaguaggucugaguaggugguguggacccaccaggaaaggguggauccagugaggcgggggccaggccuugcccaagagucagaaagugggaagucacgggggagaugaagggcgagugagcagcuagaaagugccaggggacacaaaaaugggggagacaggcagccuuuuggggcuggagggcauggacagggugacugaugccugagccacaggcagaaugugagcaguuuauuuuauuuuauauucuacauauuuuuauagcauaaaauuaagauauaguucacauaaccaaauucaccacuuuaaaguguguacuuugaugguuuuuguauauuaacuguguuuuauauauuauauuaaauuaauauauuuauauauuauauuaacgguuuuauauauuauuuuagcuguguuguuuauauauuauauuaacuguguucuauuaaccacuaauuccaggacacuucuaucaccuaaaaaacccuuuaccugucagcaguuacuccaucccuuggcugcuaaucuacuucccuucucuauggcuuucccuauccuggacauuucauaugaauggaauuauauaauauguagccuuuugugucugaacaauuucacuuagcauguuuucgagguucauccauguuguagcauauaauaguacuguauuccuuuuuguggcugaguauuccauuguguguauauauuccauuuuauuuauugguaaauugguggacauuuggguuguuuccauuuuuugacugcugugaacauucauguacaagcuuuuguguggacauaugcuuuagguucucuugggaauauacuuagugaaauugcugggucauauaguauuccauguuuaacuuuuuuuuuuuuuuuuuuuugagacggcaucuugcucuguugcccaggcuggagugcaguggcacgaucuuggcucacugcaaccugaaccucccugguucaagcaauuucccugccucagccaccugaguagcugggauuacaggugcaugccaccacgccuggcuaauuuuuuuuuuguauuuuuaguagagacgagguuucaccguguuggccagacuggucucaaacuccugaccucaggcaaucuccccgccuuggccucccaaguguuacucuuuguuuuuuguuuguuuuuuuuuuugagacggggucucacucugucuggagugcaguggcgcgauuucgccucacugcaaccuccaccuccuggguucaagugauucuucugccucagccucccgaguagcugggacuacaggcgcaugccaccaugcccagcuaauuuuuuguauuuuuaguagagacgggguuucacuguguuagccaggauggucucgaucuccugaccuugugauccacccgccucggccucccaaaguggugggauuacaggcgugagccaccgcgcccggccccaaguguuacucguuaggcagauaccugauaccugucugcuauacucacuggucugcaccuugcuucacuuauuauaucuuggccaucuuugcauaccagacauguagagcuuccuuauucuuuuuuuuuuuuuuuuuuuugagauggagucucgcucugucacccaggcuggagugcaguggcgcgaucucagcucacugcaagcuccaccuccugguucacaccauucuccugccucagccucccgaguagcugggaauacaggugcuugccaccacacccagcuaauuuuuguguguguguguauuuuuaguagagacaggguuucaccguguuagccaggaaggucucgaucuccugaccucaugauccgcccgccucggccucccaaaguccugggauuacaggugugagccaccacgcccagccccucauucuuuuuuuuuuaacaguuggcucauccauuguauggaugugccagucucuucuuuuuuuuuuuuagacagauuuuugcucugucacccaggcuggagugcaguggcaugaucucggcuuacugcaaccucugccuccugggucaagcgauucucccgccucagccuccugaguagcugggauuacaggcaugugccaucaugcccagcugauuuuuguauuuuuaguagagacaggguuucacuuuguuggccaggcugguccugaacuccugaucucaaaugauuugcucaucucggccucccaaagugcuaggauuacaggcgugagucaccaugcacggccuggaugugccauucucuuauucauugaugaaugugcaggugacuucuagucuuuuuuggcaaugaauaaccuugucauuuuacacacagauaaacagauugacaaugcuucugugugauaggugcaguaauggagauagacacuggggaacuagggaaggcuuccagaggauaguuaagaaaggcucagggugagugagcgcugguaucugagugggccuugcaggccuggcagaauuucagcaggcugagauguuguaggaagggcaaauaugacugaagaaaagaacaacagcucaggugugacaggggaaaugaagaguauuaguuaucuauuccugcauaacaaauuaccccaaaacuuaguagcuuaaaacacuaucucgcaguuucuauggguuaggagagauuuacacaaauaugugaauaccagaaggugaggauuguugccagccauuuuagaaggcugacucuaauagcaaguugcaguaaggauaggauuggccaaggcaacagauggagccaugauuguggacaaucuuacauacuuagcugagagguugucagagauugaucugagaacagugugagccauggaaggucuuugagcaggagaauaaugugauaguugcuauacaggacaauuaaucugauagcauuuaugcuagaggggucaaaauggagagagauacacaggcagaggccuagauuaggagauggcuauaguaguacaggugagaaauuccuggccuguaguacuaaauacuuuuuuuuuuuuuuaagacaaucucacucugucacccaggcuggagugcaguggcaugaucucggcucacugcaaccucugccucccggguucaagcaauucuagugccucagccuccuuaguggcugugacuacaggcguguaccaccaugccuggcuaauuuuucuauuuuuaguagaaaugggguuucacgguguuggccaggcuggucuugaacuccuggccucaaguaauccacccacuuuggccucccaaagugcugggauuaugggcgugagccgcugcauccggccucuguauuaaauacuuuagcugcauauucuuucuucgaaaugaccacaaaaagaagguauuacugauuaauaugcauauggucuugcguauggccagacuuaugacuugcguauggucauaaagguaguaaguugcagagcagcacucagaccugccuggcuuugaugaccgugccuugauggcacuggaaguggaaaggugggggugacuggggaggugagguuuuguccguucccuggaugcuaaaaggaaauggaggaguguaagagguugauucuuugaaccuggauggcuggggcaaagauaacacuguaacaggaagaagagaggccggagggaacacugaugugaugggagaaggugagugauuugggaacauggggcauuuguuggcaggguccuucccaauuauagggcgaguauaaauaguuccugugcuuuguguaugaagagguacccuuggcccaaaaagacucuaaauguggaaaaaggauaugguggugugguggugguuugaacauuggguuugcgcagauagugaugguaacuggcacuggccugcgcuucagacuuucacagcccguucacuucuguugaaacucacacaacccuauucagguuaucaucauucccuaucugauugaugaggaaacuaaggcucagaaaaauccauuugcucaaggagaaacaguguuucaguuaccuacugcuguguaacaaaucaccugugaaacucaguaguuuaaaacaaccaccauuuauccuuucucuugauugugugaauuggguccagaugcuugguucugccccacaugaugucggccaagcuugcccauuugucuguguuuagcugcacuguaauguccaaggcagcuucucuuugcauggccucuaauccuucaagagucuauccugaacuucuugcagcauggcaucugggggccaagacaguggaagccagucguguugaggccugggcucacgucccagaacaucaccucaaucauguucuauuggucagagcugucacugggccagcccagauuccagguugggaacuagacgccaccucuugauggaaagaguggcaaaagguuuguagccauauuuaauccacagacagccgguaguggauaccuggauuugaacccagaucugugugacucagacucacagucugucaugccauacugcaucccuuucugcuucugguuccuugggaguugcaaagcuugcuggcucuuuugugugguuggagagggcugauuuuucuuguggucucccacaguggaaguuguacuagucaucccccuuuucacagaugagcauccaagaucacugugucuuagggaaccuuccaaaauagguuugcucuagggauuugcuagcuucccccaagcuucagcagugauagccagacaugcauggaauuucccuguggaguuucccuuucugcgcuuaguggccuuuugaugcacagugcucacugggugggauuccugcugcauuguagccagauguggaggcuagcccuauuuugaguuaucccagaugguauccagcccagugagucccauacuugacucaacuggcauauucaccagggaguuuuggggaaaauguagauuccugggccuuccucaugccuauugaauuagaauucccagggauggcguccaggaaccugccuuuaaagcuccccauugauuugggaguacagccugguugggaaaccaaugacuuccagaggcuggcacccucccucagcccagucauuucagaaagaugccuuugaagucacugaucagaggaggccacaugggagagaaugauuuguccagagggccucacacuucacaaccaggaagugacuccugaaaguguccaggaaguuucuauuugaaucugcucaaaucuuugauguuguuuugcaugcuuugauaguaucugagcuuuaugguggccucuggguguuuuucuuugaaaguguuugcagagaguagcaagcucuuccagcagucagcagacacucccuaaccaggagcuacuuggucugauuuauuugaaauaugaaauuccuuugcuuggcugucugguugguaucuuuggugugaagaauaugacaacccuagagauaccuagguuagcacagcaguuggaccuuucuagucuugugccuuggacauacuuaagguacacuuggaaaaguagauuuuaaaacccuggauaauuugguuugccaguuaaauaaacuucuauauuuuagaauauuuggaaaauaaagauaaauauaaggaagaccauaaaauuaccuagaacuuuccucucagagaauuuccacgguuaauguuuugaauggcuauucauccuuccccucaugacccuucacacccccucuuuuugaaaaccauauugaagucauauugaauguuacuuuuuagcaguuuuguugagauguaagucauaaaguccaccuguugacagugugcaauuugaugguuuuuaguauuuacagaguuguacaaccaucaccacaaucuaguuuuagaacauuuucuuagucccaaaaagacaucuuauaauccauuagcgugcauucccgccucgaugccccaucccgcccuuacuccagcccaagacuaccacucaucugcuuucucuacguacagauuuaccuguucuggacauuucauauaaaugggaucauacaauaugugaucuuuugugauuggcuucugucacuggacauaaucaugguacuguuuugaaaccugcuuuaaacauuuauauccuagcaauuugaauauaguuuucaagaaugcacuuuuaauagcagagcgguauucauucuuaugagaauaucuaaucuuauuuaaucaguccugccaacagacguuuagguuauuucucaucuuuugcucuuauagccagugcucucugcacucagaaauuauuuuguugauuuauugguuaauuguccgaaucugugacuagaacaaaagcucuuugagaacagucaccuucucugucuccccuacuacuuggcauaguuccuggcacuugguagguauucaguuuuuaaaggauguguauguguguauaugugcaaauuuugaaugaaucaaaauguaaggauauuaauaaauguugccauauugccaaauucuagaaaguuguacuaauuuacccucucacugcaguauaaggguaccugacucccuguuccuuugaaucuggguuaauuuguacaggaaguccugugaucuuuugaaugaugauauucucugaccugucaaccaguuaguuugggaauugaugcugucuguguccugacccugucugugggccaggaagggucuggcuguugggaaagaugguggugugugggagcucuagcugcccggguccucauuguggcuccgugguauuguaucguuuccuguugcccuuagaaaggcugcaucguguugucuggccacuuccucuauugugugcaggcauguuggggagugaguagaguuggguggauaaaguauguguaagaagauacugguuauggcugcugauuggagugccuuuugaagucgucaggagagaugucacucuggaaguucagugucuucaaaaauagaaaugaagaaaugcuuccaggaagucugaugcaacuggcccagucugcccccaucugaggguggugggcacccacauggcugguaaacgcuucaugagucacccacuggccacagucccugcuccucuccacacacuuccugucuggaaaagccugcuacccgcccauggugaagagucaccccagagaacuugccagggaugcagggcaggucuucccaggucacagcagcagccucucgcucauggguuucacagcaguucuucuccccaagaugaguugugguaacugcuuuuuagauaaauauguggaauggaugguugggauuggaaaaaaaaagagcggcuagauggcaaggcagcucuuguguguagcagggagcucacacgagccccaugguggggcaguuaaggccccagaauucaccuucuccagcagcuggcugcucauucuuuucuucuucucgugguuuucccaucacauuucccuugggguuucuuccaggccuuccccuacucaccccacacccucucagaagaugcugccucauguaacuuggccaagcucucaagcauuacagaugccuuuaccuucuuuucuuugcaucuuagaaaucacucacauguuggucucucucacauaauugcuuuuuauuauuacuucagcgguugccaagugccuacucuaugccuaguaccuuguuagacucgggaaugaugcagaagaaagagacuggacccugcccccuaggaggguaaaugucuguucucccauggccucuguuucccuuccucucugacugcgccuuugcugcccugguuccucuuccucuuuccgcugccugagugucaacauucuucaggcuucugcccucucuccucucccuccacgcgcuugucccuuccuguggcugugaccaucugcucuuauagcuaccaaauacuaaaguucuuuucuccugaaaaccaggucccuguguccaccugccugcuggagugugcagccuuaaaagcagaguccaucuuugucucugcucuuugcauauccccuuucuguuaauaauccgucauucucucaguuucccggagccuuacugacagcuuuaaaccucauuccucugccaugcacaggucguuccucccguucuuuugaguguuucuccccacugauuuuccugccuguagugaguuggaugguugccccuccaaaagauauguccaaguccuaaccccuagaaccugugaacaugaccaccuuguuuggaaaaaaacucauugcagagauucuuuccuaugcugcagacguacaugaaccugugcucauugaccuccucucugggccuggccuuguuggucucuggcuugaaauagugacuguacuucuaguccacacagugauuacauauuuauuacucuguuugagcuccccuaguccaaaggcaaaguucacugccugcccuuuccacuaacuccuaggucagacuugcuagguugugugcacagcagcuacaagugugguuucuaaggugggucuggguuugaauccugguucugucauuuauuagccaagggccuuugacagauuguaaccuuucugggcuucaguuuccucuucuggaaaauggagcuaauggauuguugugagaauuagauugcauagugucuagcacugugccugacacucugagcuuuauuuuuauuuauuuuuauuuuuugagacggagucucgcucuguugccuaggcuggaguggaguggcaugaucucgguucacugcaaccuccaccucccagguucaagccauucuccugcuucagccucccgaguagcuggguuuacaggcucccgccaccaugcccggcaaguuuuuguauuuuuuaguagagacgggguuucaccauguuggccagguuagucuugaacuccugaccucaggugaucugcccaccuuggcuucccaaagugcugggauuacaggugugagccaccacguccagcccacucugagcuuuauaaccagagagaugcuguggcuagccaaaucgcucaaccuauacuuggaggaucccaagcuuggaugaguguaagagcugugacuuaaauccagccuacuuguaugucauucugccacaguugucuuugucucuccacaguuuguccuggagcugggcauggugagggcuaagacaauggauuacagagcuacaggucuaggagggcauguggaauuaugccuauaugagauagaugacaaaguggguaagagcaugugcucuggaguuagaccuggguucagauucaggcucuaugacccuaucucagugaccuugggaaacuuuucuuugcaucucugggucucaguuuucucaucuguaaauugggaauaacaaugguucauaccugucuuagucugugcugcuauaacaaaauuccugagauggguaauuuauaaacaaaagaaacugauuucucacaguucuggaggcugggaaguucaagaucaaggcauuggcagacuugaugucuggugaaggcugcuguccacuuccaagauggcaccuuguugcuguguccuccagaggggaugaaugcuguguccuuacauggcagaagggugaaaguggcccagcuaguucccuggagcccuuuuauaagagcacuaauccguuccugagggcagagccuucaugaccuaaacaccuccaaaggccacaccucuuaauaccguuguauuggggauuaaguuucaacaugaauuuuggaggguucacaacauucaaaccauagcaaugucuuauagaguaaucgggaugauuaaaugaaagaaugcccauaaaacauugaacacaugccugacucuuuguaaacaauaauuauuagguaucgcuauuauagagaccagcuucugcuguggagaguguuaagugccuugaugccacaagccacuggacacgcagcugcauggaucaauguaccccuguaauuauguaacaaggggacauggagaaaaaaacauuuccaauguugccuccucuguaacaugauuguaccccuaaacugcacagaggagcuuucuguucuuugaacuccauagcuguugguacgucucuugugggguuugccauagucugucuuauacuaugacuguucuucacucuacgguacauuucuuucuuucuuuguuucuuucuuucuuuuuuuuuuuugagacaaagucuccuugugucauccaggcuggagugcaguggugcaaucucagcucacagcagcccugaccuccccaacucaagcaauccucacaccucagcuucccaagaugcugggacugcuggcaugugccaccacaccuggcuaauuuuuuuuguauuuuuuguagaaaugggauuucaccauguugcucaggcuggucuugaacuucugggcucaagcaguccacccaucucagccuaccaaaguacugggauugcagugugagccaccacgccuggccuacuguauguuucuugaggucaagauugggcacuggguaacugauuacuugaauugaaccuugggauucagccagugaaagugguccaccuggcaguagugaaccucuggcuccugaccucugcugcuggugaaucuguuucuccuauggcugcacagacacaggguuuccugccuccaaagagcuuuuccacucuguacaugggaccugaaccggcuccagaaaccuuggagccuggcaccacuuuucacaucacccagcaggagcagaacuuagauggaccaggcauagaugggaaacauggguuuauugcuaaggucaugguuaguucucggcgguggggcggggggguuuagugggcaauugcuuuuuggauuuuuguuuuguuuuagaaguaaaaaauaugggccaggcgcgguggcucaugccuguaaucccagcacuuugggaggccgaggcgggcggaucacaaggucaggagauugagaccauccuggcuaacacggugaaaccccaucucuacuaaaaaauauaaaaaauuagccgggcaugguggcaggcaccuguagucccagcuacucgggaggcugaggcaggagaauggcgugaacccgggacacagagcuugcagugagcugagaucgcgccccugcacuccagccugggcgacagagcgagacucugucucaaaaaaaaaaaaaaagaaaaggaaaaauauguacauuuuuaauagugguaguaagaauuuucuguaacuacuuacgggacaucuucacugaggggucuccagagcuccuaaaacucagcacucccccagugauucuuacauuuuccugccagacuugcucuucuucccacaauccccaccuuaauggaaucauccacaucccccuggucaccugacaguugcccucuauuucuuuauucuccucagccucuuuuaaucagccaccaagucuuguuuguccuuccucccuaaugucacuccuguuuuuugccgugaggucugauggcacuagugcugccugggguugcuacugccucaucucuucaaccuuuuugugucacgauguuuaggaguuucuuucauaaacagaauguggcuggauuuaaaucaaaucugacaaucugucuuaaguaauuuauguacauuuuugggauuuaacuuaacguauuacuguauuauauuuuuuaguacuuuccauguauuuccauuuuugccuauuuuucuccuuccgaguuuuuuuuuuuuuuuuuuuuuuuuuggagauggagucuugcucugucacccaggcuggagugcagugguguaaucucagcucagcgcaaccucugccucccagguucaagugauucuccugccucagccucccaaguagcugggacuacaggcacgugccaccacacgcggcuaauuuguauuuuuaguagagacaggguuucgccauguuggccaggcuggucuugaacuccugaccucaggugauccacccaccucggccucccaaagugcugggauuacaggcaugagccacugcucccggcccggaauuuucuuuauuucuauacauuuuacuuccguuguuuuuuucuuuuuugagacagggucuagcucuuuugccuaggcugaagugcaguggugugaucacagcucacuguagcuuugaccuccugggcucaagcaauccucccaccucagccuccuaaguagcugagauuauaggugcacaccaccaugcucagauaauuuaaaaaaaaauguuuucuagagaugggauguuacuguguugcccaggcucgucuugaacuccucacucaagcccuccucccaccuuggccuccaaaagugcugggauuacaggugugagccaccuuaccuggccuuuauuucuguucuuacuccaacauuuucucaucuuuucucccauccuuuuacuuagaaaaauguuaaaauuagaggaaauaguacaaugaacaugaguauucucuuuaaucuuauucaauuaauauauuucucuguauauguauauaugcuuuuguuuggaaucauuugaaauuaaguguggauuuguucuccaucuucuugcucaggauuuggugugcugcuuuuaucugaggacucauuuauaaaagaaaaaacaaagaaaaagccuuuuuacuuuaaaaugauuguagauaaacuuagcuuuacacagaguuucuguauuccuucacccagcuuccccuaauguuaaucucuuacauuuaauucuuucuuaaguucuggaaaauuucagccauugccucuuuggcuuucucguuuucucuacaguggccucuggaaugccucuuagacauauuguugagcauuuuaccaccaaagucucuauauuuguucuuucuguguuccuuuaucuguuuaaucauccaaguuuucuuguguaguuucuuugagacugucuuauuucugauucuugggaugcuacuucucuuuuugugucugaggcuugccccucuuggugguuuauuuccuugugugguuuguaacuuugggugugaguucaucuccaggagggauucucuuuucuggcugagacuuggguccugaauuaugaaaguauaccucagagcagcuuguuugccucuggcggggccaugaguguuucagugguccuggcucaguuuuuguucacugcuuagugcggcaccccuuuacuacccuaguaguguaaguucaguuuuauauccaugggcaggacuagcuugguggcuuaagaaagggugaccucccgccgggcaugguggcucacaccuguaaucccagcacuuugggaggccgaggcagggggaucaugaggucaggagauugagaccauccuggcuaacgcggugaaaccccgucucuacuaaaaauacaaaaaauuagccgggugagguggugggugccuguagucccagcugcugggaaggcugaggcaggagaauggcaugaacccgggaggcagagcuugcagugagcugagaucacgccacugcacugcagcccgggcgacagagugagacucugucucaaaaaaaaaaaaagaaagggugaccucccacccauaccugacccacagagccuuggagaaguguucagcuucuuguugcuuuccuuuacugggcagcccuuugaggcucucuucuugauacuggggcucaaagccacaggcaggcuuuaaaccgcuucauuugugggugcgaaaguccacaggccauuguggugucaguuccacucacuguuuauguuucaauucuucucgcacauaggcauuucucuuuccaauuuggcugcaugucuacggacgucauuuguuuuauuuuaucugguauuuuucugugauagugguggaaaggggaagcucuuucacguuaauuuagucccguauccuacugaaaguuuguucaaaugcuuagcgugucauaugaagcuuuucaugaugcagcccauucuaccucuccugcauaaacuuagcucuuaaauuuuacacuucagcaaauugaacuauuugcauaccauguacuguaauguuuaaaagcacagguuuuaggguccagcuguuuggcuuggaaccugucuuuucauaagguaugauuuuggacaaguuacuuaucccuuccauaacucagcuuucucaucuguaaaauggcagcguccggcaugcaguaacccugaucccuguuggcugccucugugguugcugcccccagcaguugaggcugccaggccucugcgcaauugcacuguuuauuccuuugcuggaauugccugucuccccuccucuccuugaucccucccaggagagcagccuuuacuccuucagagcuuggggucucugucuguaguaacuaucacucugugggucgcugcuuguuuacguaucuuuuuuuuuuugagacagaguguugcucugucgccaggcuggagugcaguggugcgaucuuggcucacggcaaccucugccuucuggguucaggccauucucuugccucagccucccacguagcugggacuacaggcgugcaccaccaugcccagcuaauuuuuguauuuuuaguagagacgggguuucacccuguuggccaggauggucuccaucucuugacuuugugauccgcccgccucggccucccaaagugcugggauuacaggcaugagcuacugcgccuggccacguaucuccuuuuuucagccgacucugacccccuugagagcagggucuuguuuuucuugguacuugaaacuccuuacauucuaccugucauuuggugggcauucaguguugguaguuuaauugcauugaauuucucuggcugaguagaggcaagugcugggagugguaugggacgcagaggcagggaaugacagcaggaaagcuuguuuuuuggcacauuuugugccaaguugauggaaaugugaaucaguauggcugggacacaagguaacaauucuuagucuagcugaggaugccagagacuuaaaacaagccaguggccagaaaaagccacuaaaucuugcaaauuaaagugguuuccagacuuaagaaugcaugccccacauucccuucccaaacucagcgucucugagugccagguggaggaauacaaacuaauuauaauccuagugggcccugagaaucuuuaauuuuagaauaaggcugcacuucugaaaggcgcaguugcuuuaggaguaggugacucuguaugcccggggccuccgaggagaccaggaugugaaaacucaguaccuggcauuuagagcugugucacccaucacuucugaccucguuaagauuucuacccuacugcgacuuaacaacuaaaaagggcagaugagauagguccggggcagagcuuaauggccugugucauucuccucagcuuugccugaauucucuggacucuugagacucuaucauaggaauauucucagaagagaaggcaaucgaaccuuuaaagauccccagauuauccaucagauaacagucucaugagagugaugaacaaugacagcaccaacucucaauucccuuggcuggaauuucaggaaucagcuugaacucagaggugggcacaggguuagggcuuggaguaggcgucuuuucuuucuuuuuuuuuuuuuuuuucuuuuuugagauagcgucucacucuuguugcccaggcuggagugcaauggcucaaucucugcucacugcaaccuacgccuccugguuucaagcgauucuccugccucagccucccgaguagcugggguuacaggcauccgccaccacgcucggcuaauuuuuguauuuuuaguagagaugggguuuuaccauguugcccaggcuagucucgaacuccugaccuuguggucugcccaccuuagccucccaaagugcugguauuacaggcaugagccaccgcgccuggcuugcaguaggcaucuuugcccaacccacgugaaucccauuaguucuuucuugacagcucucagucuguggucauauauuaagcaacuauguguucaguacugugcugggugcuauugcugaagauacggaaauaguaaugccacaagucccucuucuuagagaggagagcuugcacucuaguuggagagaauuccuagcacacagaaagcugcaaccaguggugcccaacaguaaugcugucugaugccacugcaugcaagugugucccuuugacaacuuggugcuuuugcccaaaaggagcuguucucuuucugaggcuuggacuauucguuuguuuuuucucagaugacuugcuggcacuguuacagacuggucugaauuaacuaggacuaccuuuuaucuguuucugaggaauagccccaaaugugcucucucuuggucuuuaugaacuuuuccuuucuuccauuucuccaaauuaugauagauuaacuuugcagugucaucugcuaaucuccaaggucuucuaggggcacgucaucagcaguugcugcuuuugagguaucaagguuuguccuguggagucucagauaguuucuuuaccuguucaaugaaucugauuuuccauuuuucuaggagaguguaucucaaagugauugcugaaucagaaugucugggagugugacuuggaaucuauuacugaagauuagaggaaaauguagcaaauugugaucugaagcauuuauggauggauugauggauugauggauagggauucugacugaguuagguagucuauagucucagacaguuguggaagcuccauuaggucaugagcaacccagacuccuuccaauucugugcccugccauucuuaggguguggcugcuguccucaugguccaaaaugguugccgugguuccacaucucacagugagauagaagaagacagaagaaugaugucucaccucccuucuaaggagacuucagcaaagccugccucuaccacuuucugugacugagggaaaguuaauucauacucagagccaauuaaccucguguuuuuuuuuuuuguuuguuuuuuuuuuuuuuuuuuuuuuuuuuuuuugagacaaggucuuacuuugucgcccaggcuguagugcaguagcacaaucucggcucacugcagccucgaccuuucgggcucaagcagggcuccucccugcucagccucccgaguagcuggaacuacaggcacaugcaccacacccggcuaauuuuuaaauuuuuucguagagauugggggucuuguuauguugcccagguuggucuggaacuccugggcucaagugauccuccugcccuggccucccaaagugcugggauuacaggagugagccacugcacccaaccaguuaccucauuuguaaaacaggcaugguaacacuuagugcaggagcaagaggaucagggagcacacauacauacaaagugcuuggugcugaugcccagccugcagcaccuguucucuaaaucauagcagcaauugcugcugcagcacacuucucuuucuccucucuccaccgcuccaucucuccagggucucuaccuugccugucaggcuccacuuuccuuugcuccugccuuuugcaucuguuccucucugcauucuccccucaucuccucucuuccgugcaccucauuuuccugcuccccuccugccucugucccucaucuucuuuucagagacuuaaaaccagccaguggccacuggcuuuucagugucuccuccuccuccuugaacuaccucuuccuucuagugcuucuguccuucccuccuccugaccuccagugaacaauaauuauuuguaacguaaugacaaauuaucguuacguuacaaagaccagagguuagagguggugauuggccuuguaaacuguaggucagcgaugaguaauuuaagaaaacuaaauuuaauugguuuacucaugagucaguuaggaauucuauuuggcagcuagaacagaaauagcaguggcuuaaaccaguagaaauuuuuucuauugugaaaagaaaucuagggggacagucuagggcuugucucuccgcucugccauccuuagugcagggcguccaaccccaagguuguaucauggucuaagauggcugcgggagccccaaccaucaugucagguucuaggaagaaagcaggaagaagagaggaaaggcaaaaagaacacaugcuccaucuuaaggagcuuuccugcaagucccaccaaauagcuucagcuucuccuccuugccuccauuaguugcaagggaggcugagacaucauuuagcugagcacauugcuaccugagguagaauugggauucugucaccaagaaagaaggggagaauggauauuguguaaacaauuagcaaggucugccgccauucauucaacauuaauuuagcaccuacaaucuacuaguuaugaagaacagucaaggugccccauuccagagggaagacauagauaaguaaacaaguacaguacacaggaugggugaggaagagggggagaguggagaaaggcaugaaguggguaucuuacauacccuccaagggcgcauucuagaguucgucaugcagacauucuugccugugguuuguuuccucuucugcucucuccuuuuugucauugucgccauuguuguuguugggguuuguuuuugccccuccauucugacgucagcaguagccccuagaaccuuaggaaacagaaacaguuggccuagugggaagcucugggaugggagccauguguuugaagagccaagucccagggccauuaggcaauuagaggccuguggcaggagagcauucguuccuggacaugccguggcacugccaggagacuuuacuccaggaauggggucguugucaggaggcauguucuaaccaggcaccuggcaucaccuauacugugcuugccauaaaaugaaauuuuggagcaguaaaauucuccaggucccgugaaauggguauaauuguuucacccacauuaauuuaaccagaggucuugguaugcuauaguguuaauuauguguaaaaauacuucuacuuacuauaaaauguauugacaguuagacauugauauuccuucuuagaacucaaaaauucuaggaauaacuugggagacccacauuaucuuucauuuugaucccaagaacaucuauugcuguuuccuuugggaaguuagagaggcaaugggaagccugcugcagagauuuucuaaacaggcauaucccagccccuaaggaguuugaaagugucagagaaggcuaaaggauuaaaagaucguuuguucuggcacagugcaauccuuaugagguuguacugugacccugggcaaguuaccauccuauccucaguuucuucaucugucaaauuuugauccuguggacccuccccaacagggcugugauggaaaugaagagacacaugggaagcauucaguauguguuguuguuauuaucaucauuauuguuauuuuuauuauuauuagugcuacugguagugcuagcccacuagcccacugggcagcgacugcacccguaucagaguguggaaagccuuggaugccacauuaaggaguuggauuuugugggcaagggugugacaggucauggcugggcuuagaaaugucacugacaggaguggagaggcagaucuaggugaggagugggcagggcuugaaccuggccagucaaggaaaggggagaauggauaccugaguggugagggaggacccacuggugcuggaguucagccugugugcccaagggauggugucccauugacuugggugggaagcacuagagguggagcaguugggguggcaggaggggaaagaagcauauggugaucagcucagcaaacaaauggguaacuugcgcacucagugcucgguggugcccaggcuggagugcaguggcguggucccggcucgcuacaaccuccaccucccagccgccugccuuggccucccaaagugcugagauugcagccucugcccggccgccaccccgucugggaagugaggagcgucucugcuuggccacccaucgucugggauguggggagccccucugccuggcugcccagucugggaggugaggagcgucuccgaccggccgccaucccaucuaggaggugaggagcgccucuuuccggccgccaucacaucuaggaaggaggagcgucucugcccggccgcccaucgucugagauguggggagcgccucugccccgccgccccgucugggaugugaggagcaccucugcccggccacgaccccgucugggaggugaggagcaucucugccccgccgccccgucugagaagugaggagacccucugcccggcaaccaccccgucugagaagugaggagacccuccacccggcagcugccccgucugagaaaugaggagccucuccgcccggcagccaccccgucugggaagugaggagcgucuccgcccggcagccaccccguccgggagggagguggggggggucagcccccccgccaggccagcagccccauccgggagggaggugggggggucagccccacgccccgccagccgccccgucagggagggaggugggggggucagccccccgccaggccagccgccccguccgggagggaggucggggcgucagccucccgcccggccagccgccccguccgggaggugaggggcgccucugccuggccaccccuacugggaagugaggagccccucugcccggccagcggccccguccgggagggaggugggggggucagccccccgcccggccagccgccccgucagggagggagguagguucagccccccgccaggccagccgccccguccgggagggaggucggggcgucagccucccgcccggccagccgccccgucugggaggugaggggcgccucugccuggcugccccuacugggaagugaggagccccucugccaggccagccgccccguccgggagggagguggcggggucagccccccgcccggccagccgccccguccgggagggaggugggggggucagccccccgcccggccagccgccccguccgggaggugaggggcgccucugcccggccgccccuacugggaagugaggagccccucugcccggccagccgccccauccgggagggaggugggggggucaggccccgcccggccagccgccccguccgggagggaggugggggggucagccccccgccuggccagccgccccgucugggaggugaggggcgccucugcccggccgccccuacugggaagugaggagccccucugcccggccagccgccccauccgggagggaggugggggggucaggccccgcccggccagccgccccguccgggagggaggugggggggucagccccccgccuggccagccgccccgucugggaggugaggggcgccucugccuggccgccccuacugggaagugaggagccccucugccaggccagccgccccauccgggagggaggugggggggucagccccccgccgggccagccgccccguccgggagggaggugggaggggucagccccccacccggccagccgccccguccgggaggugacgggcgccucugcccggccgccccuacugggaagugaggagccccucugcccggccaccaccccgucugggaggugugcccaacagcucauugagaacgggccaggaugacaauggcggcuuuguggaauagaaaggcgggaaagguggggaaaagauugagaaaucggaugguugccgugucuguguagaaagaaguagacaugggagacuuuucauuuuguucuguacuaagaaaacuucugccuugggauccuguugaucugugaccuuacccccaacccugugcucucugaaacaugugcuguguccacucaggguuaaacggauuaagggcggugcaagaugugcuuuguuaaacagaugcuugaaggcagcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugugagaaacacccaagaauuaucaauaaaaaauaaauaaauuuaaaaaaaaaaaaaaaaaaaaacaaauggguaacuugcugccugccagggacuccuguggccuggcaugaagauaauugacuguguuuugaacgcauuauaaggccccugcgaggccuccgugugguauuuagacagucagcaggagagaggccccggacaguggugugggaugcagucccggugugugaaauugccagugguuggauugugcagcggauggauugagcagggaagccagccaagaacagaaugggguggggagggcguuggggguaggaaaggaggaucaucauuucaagggcgggugagggaagaacaagcagcagagugcaaagcccccagagggaagggcgauccuuaugagguuggacugugacccugggcaaguuacccuccuguccucgggaggaagugguugacagaaucauugcagcagugagauggaagcaggaccagggcagcagccaagggccucuuagauggcggggcgagaggaggucauccaggaccuccaagagaacuguuucaaaaugggaggagaaagcaguguuccucugguggugguucuaaugcuuuguauuuguaguucuuagucguuuucaaggcccuuugcauucuuugcaucgugcucucuuaccacgaugcauagugagaccccaccucuacaauuuuuuuuuuuuuuuuuuuuuuucagugagccagguguggcaguacacaccuguagucccagcuacuugggaggcugagguggaaggauugcuugagcccaggagguugaggcugcagugagcuguggucaugccacugcauuccaaccugggugacagagcgagaccccaucuuaaaaacaaacaaacaaacaaauacuugguucauuugguacuuggcuuuuuggaucuuggggaauauuggagaugacggaauaacuucaaggagacuaacuucaaggucaagacuccugccaagacuccaccagacauaaaauaggaaaaugaugauagaaucuaccucacuguuggccuggcagugggaguuuguugauaacccugaagaugaacuccucaaggugaagagcaaggcuucagaaugggcugcucuauagaugugagagacagagacagaccuagccuugcaaaaagguugcuguagucuuucuccuaccauuuccagcacaggaugguuucuggucccaggaggcccugucuugugcugugugggacccuuagugcugugaagacuagcagcacccuggaggucuuuguuccuucugcccuuucccuuagauugcaucuccuaaccuugguuuauauauuugucaggaggugggggaaaccugcuuucccccaccuccugacaaauauauaaacuggaaauugauccaguccuggaucaguuugggucacacaacagggucggcaguguuggcccacagagggcccugggccccuuauuuccccuuuggcccuaggcucugagcucucagguuuuggcuaccaagcaaaagguggaguugcaucaguuguugcucuuuaccaggcccccagggguugcugucggugagcucacaggauguuuucuucucucugcuuugacuugugcugaauuucugacugaccccaugcagcaucugcguggcuucuggggcccgagcccagguuucagcaagcugcccaugguuuacccucaggaugaacucuaggaagcuggggagcacugugguggugguauaaguucagccccucauuuuaguuuauuuuuauguuaaaauguuuauuaauacaaaauaacacauagaucagaauguuguaugacagaaagggacugacuggacucaggaucucccaccccagccccaggggugaaggugaaggugauugguuuccuggguaucguuccuuccacgguuuuuccaugcacgcucucaugugcguguguuuuuauccucauccugcucuucaccguggcaguggggagcacacuaaauugcucugacaccuaguuaguuuuuuuuuugauugaguguaucuugggaaucuuuccauaucagcauauacagauacacugcauucuuuuuuuuuuuuuuuuuuuuuuugagauggagucuugugcugucucccaggcuagaguggaauggcacgaucucugcucacugcaaccuccaccucucaggcucaagcgauucuccugccucagccucccaaguagcugggauuacaggcacccaccaccacgccuggcucauuuuuguauuuuggguagagaugggguuucaccauguuggccaggcugguuucaaacuccugaccucaaaugaucugcccaccucggccucccaaagugcugagauuacaggugcgagccaccacaccuggccauucuuuuuuuuuuuuuuuuaaagcuuuuuuguuguacauaugauguauguuagguggacuguggcuuauaaaaccucuucauagcuguuuuccagugcgauccuucuagcccugugaggaagacagaccagaagaaauuuuuugcagcuuaggauacucugcaaacaaggaggaagugagaggaguuggggcucauuuaaugcagacuaaaacaggaucuuuccuuugagagacugagacaggaugaggagcaggcuguagaugugcacacauauccacucagagagaacaugagaggcagcaucugcagaggagccuggugggcagcacgugccgcgggggcaggaaggggagagcuuccgggaaggggauggaacuugagccaaaccuuuuucucaaaaagaggggaggccggguguaguggcucacaccuguacccagcacuuugggaggcugaggugugcagaucacuugaggucaggaguuugagaccagccugggcaacauagcaaaaccccaugucuauuaaaauuacaaaaaguagccgggcgugguggcgcacacguguaaucccaacuacucaggaggcugaggugggacgaucacuugaaccugggaugcggagguugcagugagccgagaucgcgccacugcacuccagccugggugacagagugagacucugucucaaacaaaagaggggaagguaggaaugagacaaaggaaaaggggaggcgggcauuucaggcaggagagcagcauaggcagaaggugcaaacauguggcagagggucgguguccauggacacgcuuccaccaccuggucuaaucauugacuuaucagacaucuaaaugccugcugcgugcccagcacuguagagggccacaaggcagcaggaaccucucagugccugcccucugugggcucugacuccaaccaggagaaacuggacgcacaacagcaggcaaaacuagcugauggugauagaggucagaagagugguuuacagccaggcacagugacucacaccuguaaucccaguacuuugggaggcugaggugggaggauagcuugagccuaggaggcugaggcugcagugagcugugaucaggccaccacugcauuccagcuuggccuggacaacagagcaagacccugucucaaaaaaagcggaguaguuacuuauuguggagauuagcuguucaggggcacaaagaaccuuguagggugcuggaaauguuuacugucuugaccugggugauggguuuuuuugguuuguuuuuuguuuguuuauuuuguuuuuuugagauggagucuugcucuugugccccaggcuggagugcaauagcacuaucucggcucacugcaaccuccaccuccuggcuucaggcaauucuccugccucagccucucgaguagcugggacuacaggcgccugccaccaugcccggcuaauuuuuguauuuuuaguagagacagggguuucaccauguuggccaggcugaucuugaacuccugaccccaggugauccgcccgccucggccuuccaaagugcuaggauuacaggcgugagccaccgcgcccagccugggugaugguuuuauggugguauauaaauguaggaauucauggggcuuauuauguuuaagauuaaugcagauugcauacucuaaccaugaguauguuauaccccaauuauaaaucaagcaggcaaauaaauagcauauuccccaaaauaaagaaguaaaaugcaauagcaagaaagugugcaaagagcuaugccugggaaaauacaggaacuguaucauuuugaaagggugagagaugagauuucagacccucacccucucucacugugucauuucugaagggcccuggugacuuucuuugccccucuccacucuuacagucauuggaaccagagggcagaaccccgggccucaaaauuaagucuauacaccuuagaaacuaggaauucaaggcuagccagguccuggcccuuuaucuguccuucagagaguggggugccccagccaaagcggacagcucgccauucccagaugugcccuguguucucggcugcguugccugacucaccuuggccuucccugggagugccuuuucuaguuuucuggcccagcuagaagaaagggccauuacaccuacuccagaaucaucccugcugcucccaaguuggaauauuucuuccuccacaguggccaccucuuaugugcccuccaucacacaguuuguauacuuaccucuucaagggcaggcuguguuuuacuccuuuugucaucucuccccauaggggucuaggucagugcuuuuguacauggugccugaaacagucccauaaaugauauuuuauuugaguggggcucucuggcuggagcuacuagguggaauguugccaugugggagcaggggucauaacgaaggcuggccaucaagaugcugguacuuccaaauucccaacaguuauuaacuuucaggauugaggaacaaguaauagaaauucccuggaaugcccaaaaucauaacuuuuucuauaucuuuccuaacacuuuaugaguuuuuaaauaaggaguggucauaauaauaaauggaauuauuuuuucugugauaaaauuucagagguguuucuguaaaaaaaaaagaaagaaaagaaaaagagaaaaaaagauguaacauuaaaugcgugguuuggugguuugguugggcacaguggcucacaccuguaaucccagcacuuugagaggccaaggcaggaggauggcuugagcucaggaguuugagaccagccuguuaacagagaaagauuuugucucuauuaaaaauaaaaaaaauuagccagcaugguggcaugugccuguagucccaguuacucaggaggcugaggcaggaggaucacuggagcccaggaguuuguggcugcagugagcuaugauagcaccacuccggguggugacagucuuggugacagagugagaccccaucuaaaaaauuaaaauaauaaaaauaaaauaaaugcauaguuuauuguuauuauggacaaauauauugugauauaugauuguauauauuucauuagcauguaaaaaugaucucuaucugauauagacaucugauaauagaaaaugcggaagagagcauuaacacaaaaugaauaccaaauaaaaaucacuuaaugauuuaagaguaauacuacacauauuuaauauuuaaaaguuacucuuaaagguuaaaacuagagaaaaguuaaaagaauaaaacaaugaauuucuguauuuccuucaccaagauucaccaguugcuaacaguuuggcgcauuugcuugaugugucauagauuguccacauuccauaucuguuggauuguuuccuugugauuagauucggguuuacguuguuggugggaacccacauagaugaggugugcuuccuguugcuuacaucaggaggcacaguggugccaguuggcccuaguaaaagugaugcuaacuugauucaccuaguuaaguuggcaucugugaaggcuacuuuuguauuaaggcagugaacuucgaaaggaacuuuucccugacuuugggaauugcugacagccauuuaggaaaagagacgacuguuuucucugucacguguagcugcaguuaagaaacauccuaguauagucagacaagcucuggaagccaguaugucaggaccugggaccaagcucuacagccaucucucccugugaccauagccaagucauuucugagcuaugugagacuguacguauaaggaaauagacacucagagaagugaagcaguuugcccaaagcuacucagcuagugagugacagagcuaggauucaaacccauuuuugucuggggacaaagcccugcccuuguccuuaugccaagcugccuccuuugugaggcagcugguuguuaugauuguggcacugaccacucagauguugugcucggaaccaagcagaagagcaccaagccuuauaggcccugacaggugagagggaagagagaggugccuuccuucauccaucuggacugcccuuggaauuccugggccaauuuggggaacccuggcaccaacccuaacaugggccagugccagcaccagguauaugcagccuguacuucccagucugggcaggcaaaggcuggaaccgcaccagcagcucuccucuguaacgcagcacggaaguauuuauuucaaggguggcucagagaagugaagcaguuugcccaaagcaaacugguuccuccccugcauguggcaggcuguccugcaagcugggaggcgggcuguuggacgcuccccagccacccuugaaauaaaugcuuccaugcuguguugcagaggugaguugcuggcaccguuccagccuccgccugcccagacugggaaguacaggcugcacauaccuggcacuggcccacuuuaggguugaugcaugggauccccagauuggcccaggaauuccaaggccaguccagauggaugaaggaagguauugccucagccugccuggguuccucgggggagagagggagacaggaagcauuaaugggggaaaggugugccaagccuugccaagcaggucauuguggguggggagacaccgccuacgugcucgggacgccccaggauuuggguggagguucuugaggaggcagcgagaaaggagagcugugacagcgacucuggagcacucuagaauggcucuuagugaccuucugcucuggugacccaccagcagcccaccaaccugucaucuuccaguuagcagccauccccagggccaguagcaccugagcacuugguaaguagaaagacccagugucugcuccucauguuacccugguguccuuccccagagcaguuguuuugggaaaaacuggcuccggcugaagcaggaaauggugcuccuugucaaggucauguuguccuguugcuauagaacugagagacccugaggaucagcccucugagguuccuguuaccucucuuuacacuauucauccucauaggccuccaggaagggggccaaauucagggccaggaccagggccaguggcuuggugaggcauaggcuuugcuguaugggcccuguggggagcucuggggaguucuuauuccccuggcucauggccaccaucauggagagacccccagggcucuggcagccaagugggcaggagcggagggagggggcaucuugggagggagagccccgaaaggaaacaggguuuauagacagacucccggucaucacugcuuguaaugcuugcucagugaacaguggcagugcuuuuccugacucuuucaagagagucccuucucucuccugcuaggugggcugagauccagacugguuagaagccuaacaugaccuggcgugugagaccuugcacucucugaauguauuccccaagugucaucaauaagucacuccgguucuggcauuucccuaucuuauccugcauaccccuccuccuggcucugaguccugaggagugagauugcaguuuuugacccauguucuuacugagaagugggcugucaugcagguauaauauaaaauccagaagcugcugucagaauuaugugagaauugggaggugacagcaugggccaauuuucugaaucucuagggugcuuugaugcuuaagaagucuuucugggcucccugagauuugaaaccucuuguuuuaucuguccuuucacucugguucuuccuuuccuuucuuggggacuucaugcuucucaaauauuuguuaagugggugcuuauaugggaccuuagaaagcaaccagcuaggcaugcacuuggaaagggacaggaggacugagaacaagacuaaacauuucugugagauugagcagcaggagagcuuugcuucuuuacuggugucaguaugugccugcagcuccugggcugccuuuacucgagugagauccauuuacaagacuccugacucuucuacuccacuuuauuacaaaagauguugaugcucguuuuaaaaacaauuuaaacuacaaacaugaauaaagguauuuaucuccccaccagucccccucauucucccuucccuccuguucuuagacugguuuccccucccaguaguuuagguuguggggcaaguguguguagcucugcaucagugucuuaaacaaaaugagugugucgcggaugcgcagcucggccacuuccuguuuucuucggcuguaugucacggccauccugccauggcaccaugucugugccaccugcugcucuugggcaucugcagagaauuccaugacauggaucuugagguagucuucuucagcuuuuucuacuucaucuuauuuucuacaaucauuuauaucugcuuguaaaaccuuuuuuuaaaaaacuugcuuacuagacacagcacauguucauuuuagaaaauguagaaaaaucagauaagcagccgggcaugaugacucaugccuguaaucucagcacuuugggaggccaaggcaggcagaucaccugaggucaggaguucgagaccagccuggccaacauggugaaaccccaucucuacuaaaaauacaaaaauuaucugggugugguggugcguaccuguagucucaguuaccugggaggcugaggugggagaaucacuugaacccaggagguggagguuccagugagccgagaucaugccacuguacuccaaccuacgugacagagugagacccugucuccccgccccccccaccaaaaaaaaaaaaaaucagauaagcaauaaaaaaaguagaaaugaccccuaagagguaacauuuugguguguauaauacaaaugucuuuuacauuugcucccucaucucagcauugccacugccauuaaagaaggcacauggucauuagucccaucucacagauagaaagccugagccacagagaggguagcagguugcccagagguacacagcauaguaaagacagagcuggggguguaccugucauauaacucagcacuaaugcucucuccacuguagcccacuugcugucuucgcaccuugggacagagaggggggugccaggcauuggauuucagaugcauugaacugccuuauccgaagguuaauagacagaugacugcuugaggaaagccccugauugacuuaggagaagagguagaagacacgcucuucagguuuacagacaauaugagacaagggauuguuugcgcuuuagagaacagaaucgggcuuagaaaacccucaaagagcucuaaugacaggucaggagcaacaggauaaacuuuggaagggguggauguaaaggggcccccuucuauuuccguaagcacaggaaggccugacuugauguucaggcagugaugacuggucugccugggagucauaguggacuguaagcagggggacaugucauuucaacacuuuaacuucaucuuacuuccugggaguguuaggagccacacaucaagaggacgugaugaacuaaggaagaggguuugggaaccugucaaaugacaaaugcugcagugacagagguuucaccuagagaagauggguuuggggaggaaaaggugcaggccaagacuuggugaccagggccaggcaggacaggaccaggaauggcaguuaguugaagggagagucuaauuggucaggauacagaacaccuuuuuagcauuagaguucaggaauaguagcgagaggcaguacaguagagugguuaagagcuccugcucugauggcuuacuggcucccggcucccagagucuuggaaguuaccucacucuuccauguuccaauuuucucaucuguaaauggggauaauggguaccugccuuauaguccacuuguaaaaccuaagggaguuacuccaugaaagcagcuuagaauaaugccuggcacacagaggugcugugcacuguuugauucacacggaagcuggguaggcuccauggaagaagaguuguagaaggucuucugcaugcauuugguaugaccugcuuacccagccuuuuccauucccugccucccugucuccuucuuucuuucuccaucuuccucuccugggucuaggauccuacauuuccccuaccuaggacacccuaccccucaaucuuuauuuucuucuuugaaacucuuaaguauuuuauuucuucuucuucuucuuuuuuuuuuuagacagagucucgcucugucgcccaggcuggagugcaguggcacgaucuuggcuuacugcaagcuccaccucccagguucacgccauucuccugccucagccucccgaguagcugggacuauaggcgcccgccaccacgccuggccaauuuuuuguauuuuuaguagagacagggugucaccguguuagccaggauggucucgaucuccugaccucgugauccacacaccucggccucccaaagugcugggauuacaggcgugagccaccgcgccuagcccuauuucuucuucuuuaaauuguuuuuauuaaaaaaaaaaaaaaaggccaggcgugguggcucaugccuauaaucccagcacuuugggaggccgaggcgggcagaucaugaggucaggagacagagaccauccugguuaacguggugaaaucccgucuuuacuaaaaauacaaaaaauuagcugggcgugguagcaugcgccuguagucccagcuacucaggagacugaggcaggagaaucgcuuuaacccaggaggcagagguugcagugagccgagauugcaccacugcacuccaaccugggcaacagagugagacucugucucaauaaagaaaaaaaugagacagggucuuucuguguugcccaggguggucuggaacuccugggcucaagcaauccucccaucucaaccucccugcccagcugcugugcccagcaguauuuucuauaauuagcauaguguacuuuucagauuaucuugaagacccagcucuccuugaccuugaaccuucccugaggccuccagaggcaauuuccuccucaggacucagcugcccuucacucuucccucgugcacagccuguccugugaguaggugcagguacugacuggucuuaucuuucgcccugaaaauauaaacguuuuaaaggcaccugaggauuugucagcaccuccccacccccacccugggucugaccuaggacucugagucagggaggccucccuccacugaguaauaguagccuugggaucugcucagcaagaggauuguauaguuuaagggaggaagaagcaccagugcugccuccccaugggaaaaaugaagcccccccucccgcaaccaccaccaccacagaaccaccaaccccaacgucacuuggcagauuagcaaaagaacuagccagacgcugcuaggccccucaggcuucuagauucgcucuccaccacauuucuaccaauuuaugcucaucuugauaagcuccuccuuugaagggucuggaauggucuggaguggucuggaaagcagggucagauaccccuggaaaacugaagcccguggagcagugaucucuacaggacugcuucaaggugcguggugaacagacgucuuuuugcaauuaugccaguugcuccucugauacuugaggguuaugugaaucuaacaacagacaaaaaucucugccuccuggggcuuauauucuuugggaagagacaagcacuaaacaaauaaggaaauauauauacacucugccagauagccauaagacggauggagaaaguugaagcagggaagggagauggaaguaccugaggguggacuacgcauauuugaaauagggaagccagggaagaccucacugagauggccacauuugagaaaggaccugaagaaggugaggcagugagcuguggagguggguaacuggggagggggaagaacuuuagcuagagagaaaagccgcugcaaaggcccacugaaggcaggauaugccugcugugucgagaccagcaggaggccgugugccugguacuuaauauaccagaaggaguggagcaggcagggguaccaguuccagaaggacuugcuggcagguauuaagaugggcuuuuucucugugauaggaagcuccaggaaggauuugaucacaggagggacagaaucugaauuguauuuuagaaggaucacuuugacugcuguacagagaguggguggugaggugggaggcagaagccagaaagccaguuaggaggcuguuaaguaauccaggcaggagaugguguuggcugggaccagggucauagcaguagagguggugagaaguaauuagauuccguauauuuauuaaaggcaaagccagcaagauuccuugacucuaacuuaaagguuggaguugucauuuacugagaugagagagaccauggggggaagguaaagggcucgguuuuggauguguuaggcuugugcugccauuggacauccguguggaggugucagagaagcuggccuggagaaauaaauuggggaaucaucagcauacugaaggcauuggaaggcacaagcuggcauaagaucagaaagagauggagcguagauggagaaugaaagagaccuuuagagauuaggaagaaaauuacugacugagaccaacaaaguagauugauacggagcagccagugauaucagagcaaaaccugggaggaagccaaaugaagagaaggcguagaggaggagggaucgagcagucauaucacuaucacaugcuaucgugggucaaguaaaauaaagaucauaaguguuaccgaaaguuucaaaguacagugacauuggccaggcgcgguggcuuaugucuguaaucccagcacuuugggaggccaagguggguggaucacuugagguuaugaguucaagaucagccuggcccacauggugaaacccugacucuaccaaaaaauauaaaaauuagccgggcguggugacgcaugucuguagucccagcuaugggagucugaggugggagaauugcuugaauccaggaggcagaaguugcagugagcugagaucgagccauugcacuccagccugggcaacagugagacccugucccccaaaaaaaaggccgggcguaguggcucaugccuguaaucccagcacuuugggaggccgagguaggcggauaacuugagguggguucaagacuagccuggccaacguggugaaacuccaucucuacuaaaaauacaaaaauuagcugggugugguggcaggugccuguaaucccagcuacucuggaggcugagacaggagaaucacuugaaccggggaggcagaguuugcacugagcugagaucgugccacuauacuccagccuggacgacaaagugagacucugucucaaaaaaaaaaaaaaaaaaaacaaaggcugggugcaguggcucaugccuguaauuccaacacuuugagaugccaaggcgggaggaucacuugugauccgggaggaguucaguucaagaccagccuggccaacauggugaaaacccaucucuacuaaaaauacaaaaauuaguugggugugguggcaugaaucuguagucccagcuacucuggaggcugaaguaggaggaucacuugagccuaggaggugguucagugaacugaggucacaccugcaccccagccuagugacagagcaagacucugucucaaaaaaaucaccuaccacccucuucauacaggggaacuuucuucuauucuuuuucuagucauuuucaugagaaucaugaucuuuauguaaauucguauuguauuuuucacuuauguuauuaaauauucuaugaaaacaugaguuuaaugacuagguaauacucaguugucugggugugcccuaauauauuuaaccauuccucuauuauugggcauugggccauuucugauuuuuuguuauuauaaauaacauugcagugaacagcucaguguuuuccuauaaggggaaguauagggucaaagaacgugaacgcuuuuaggugagacuugaacuugagaucccuggguucuccuggacagaccgaccaaucacagcuuaacugugggauuuuuccaugucuccucucucccugggaagguugagaagucucucugcccugcagaucccuauuccugccuccccgcugcaauugcacgucccauuucuccugggccagucagaguuucauugccucucauggggccugcuggccacccacucaguggcugcccuucuccuuaccaccagccuucguccccucaccuagagcauucacaggcgagcaagagccagucagagcuucccucagaguaggggguguagugauaaaugaaauagcccugccuucacucaucucacugggucgauuaagugaugugugauguaccugaaagcacuucaggaacuuaagagucucaugcucuaccaacugagcuagccaggugcccuuaaagggcuguccuagucuuaauuguuuguaaagaaauagguagcugggcaugguggcucacaccuguaaucucagcacuuugggaggcugaggcggguggauaaccugagcccaggaguucgagaccagccugggcaacauggcaaaaccccgucucuacaaaaaauacaaaaauuugccaggcgugguggugcacaccuguggucccagcuacucaggaggcugaagugggagaaucaccugauccuaggaaaucgaggcugcagugagcugugauugugccacugcacucuagccugggugacagggagaucuugucuuaaaaaaaaaaaaagaaaagaaaaagguauaaguggugguguccacauuguaaccacagagccccuaaagcagggcuguugaccuaugguuggcauccuggucacaagagcucugugucagaugugugaggggcuuggguguaguugucaagccugggaauguggcuguuaguaucgauuggccucaugccaagcagugccaagcgccacgucugcuccccagauaccuguguuuguaugugugugucauagucgggaaucacugagaccaggaccucugggaggcugaacccugggagggcagagcaggaacaggccuuggagaugaucuaauucugacauuuuacucagugaggacacagguggggcagccagagagguacucagcucugagucagggccccaucccucaacuccucagccugagucuucccaggaacacaacaggcagcugcuucccagaccuugcagggcuccagguggccuuccccuccugccgacucccuugccagguuugcuguaacuauugcuccuccgagccuggcugaaaucaucuucagucuguuaucaccuucagucuguucucaucuucagucuguucuccacagcagccugaaaagucuuuguaaaaaugcagcucuguuccuccccauccucuucauaacccccuuggcucucugcuccucccagaauaaauacccacauccucagcuuacccuucaagacgcugagugaccucuagccacagcccuucucucuacccacagacagcccagguccucauuccuugggccuuuucacaucacuguucccaucacccuggaaucccacucagccugccugggccagaggcuacguaagguccucaggaaagcgucuccuggccacucgcaccugacucaugugcucugagugccacaccuugcuuggcauuuguccuucauagcccuggucauugcuggcuaauguagccuggcacauggugguagguacuugacaaauauuuguugaacaagugaaugaaaccagcuggcagggaccagaagggcagaggggcagggacaguguccacaaccauagccccuguggucuuagcugagaagggcucuggcucggucucuggugagucucucugcuggccggcagaaccacccuacccuggaagcccucuccauguagugugaggggucucaggcccauucaggcuucaguaggagagaucugggucucuucugggaccugagcaggccuuuccuuuaccucguuggcaucucucagcauuuuauuugguuuuaaaaaugucucccccuucccccgaccaaccccagauuauaaagguaucccacgcucacugugaagaaauuggauaacauaggaaaauauaauuaagaaaaucgaaaucaccuacagcuccaccccucagagaaaaguacccuuaacauuuguggccaugucuuuucaguuuuguuuuuaugcauguguaugugcuuugacauugcugagcuucucuuugugaaaaccacagauuuuucgcagucuucaguggcugcggucagagguggucagcacguuagugcucccaguggagaggugaugcagggaucugggugccccuuucucccuacugcaggugggugggugggcacacccaaggcccccuucuguggcagcuuuccuaucccuggugaagaguacccuccugucucuggucucuucuccaggacauucuccagcccuggaggcuguuccuagggggcugccucuuggggcaaugggaagaauuguggaaugcguggguggccuccuggcugucuuuucucugguuccagcacucucugaacaaaaccagccccaggccacuccuggggauuggccucaggugacucucugggcugacucuggccagcuagaaggccacccgggcuucuccuguguccuuaagaggguggggugaccuggauuggcaaauaguaagcagagaacacggcagaguugcuggccuagaaaaccaggucacuaggucagcacuuggauuaaugauugauaagaaagguugggagagaaucagccagacccauucucccaugacaucccucacuucugaucccaaaagcaccugccacggagacggggcaaccucugucuuguauccagaggcugccccuuauuccguugcaguaugggaggaaggaggugacagcaacugggucaccugcauguggggcgagaaggggaggaagguuuaggcccuucucccugaaaaaagaagcaugugcccagaguagggggcucccugccgguucucuccccacaauugauggugaggcagggaacugggaaguucugucuguggaggucccuuggguuucagcaggcuagcacauuucuaggacuggaauaucaccauacaaucccuuaacacaagccaugggugauaauaauagcagcagccacugugguccuuauuuguaggacccuuacuaucuaccuggcacuguuaagcaguuacugcaucguuauuuauuccacacagcagccucucagguuaggugguaguauuccaguuuuaaugucuuccccaagucauaggaugggagggaugagccagggugugaacccaggccugacugaagccgguggaauucacuucuuuggaguauugcaucucgauggcaguaauauaugaaaacugauacaguggcaagugcuacaacucagaauaguguggcuaaggcucauguuuuuaguauauuuauucauccagcaaacguauguugaggacccacuaaaugccaggcaccgugccaggugcugggaccuaccucaguaagauacagggcauucucugggaaacugauaacauggugaggccagagcaguuagcagacauugcaguuugguguagugauugcagaucuggagggcccgggucaggguuguggugagaaggaacagaauggagcuaguccaggagagcuucccggaagaggaggugcagacaggucgcgaaggagagaagguuuuagcuaguggaggggauggcauucaaggcaggugccaguucaagccuccaugcucagggagugaugugggaucaugaggcacauaggcaggcagagcaggaggauaggccuggagagggaggcagggacgagagccuguggcugucuucagcacacaggagucauuuucuggcaguaauguccagaagggcuuugaccaagguguucuugacagaaacagcuggggacuggcagccagacagaggauucagaggugauggcuccagacugagacuaaggagccccagcugggcaaggacaugccagcuccugguccagucuuacccagcaccauauaugaggcacacaguagaguggcuaagacuugagccaaccugccuugacucaaauccugcuucucuaguuacugugugaccuugagccaauuacuuugccucucugugccauaauuuccacgucaguuaaauggagaugauaauaguaccugccucuuaggguuguugugaggauuacauuugccaacauacacagagcaugguguguaauaaguccuuggagaagggaagcuaguacuauugugauggagguggugauccagcuuaggcucugguacaguaagaagguccaucaggcuguaccauguggcagauggagcccauggaggauggaggccccuggcacacugacuguccccacucauccccuggguagggcagaaguguucccacaccguacagccugccagugggcaucagggaaacaccugagucaccacgaggaguacgaggcacuuggggguugcccagcugaccaggagcacagagggcugcccugaaagugagccccucccuacuccuagcagagacggggaagggagacaacuggacuuggugggaaggacugggccccagguggcuuaguugcucuggccccagaccaggucucucuagagcucugggccauuuggguuaagcuucuaacuaccacugcccaugaaauucaccugccaaugggcaauggauggagucaugccccucccugcaccuaaguucucugaagggcugaguuucuucuuggggccagacaguggguauuggaaugggagcaugggggcugcaugugcacugcaggcuuuguguguguguguguguguguguguguguguguguguguguguguguacacacauacauauaugucagaauuggaauaguccagggguuuguuuugcaagaaauccuuuuauuuuuauuuuuugagauggagucuugcucuguugccaggcuagagugcaguggugugauuuuggcucacugcaaccucugucucccuaguucaagcgauucucuugccucagccucccagguagcugggauuacaggugcgugccaccacacccggauaaccagggguuuugccauguuggccaggguagucuugaacuccugaccucaggugaucugccugccucagccucccaaagugcugggauuauaggugugagcccccuugcccuucccccaugccccaugcaagaaauuauuuugcuagggacuacuuuuuggugaggggcuacauugcugcauucgugcccccucauucuggcucagggcccuuguguugucugggggucugaagcuccagccucuuaaguggggcaaagcugugacaugaucagagggcuucuggcucuggcauagugcuggggcguggagaggggagauagccaacacugggagccagaccaaaaaaaaaaaaagccaggguuuuuugccggcauacaaauuaaacuuagugccuggcuguauugugguuguuguuguuguuuugagacagagucuccucugucacccaggcuggagugcaguggugcgaucucggcccacugcaaccucugucucccagguucaggcgauucucgugccucagccacccacguagcugggauuacaggcgugcgccaccaugccuggcuaauuuuuguauuuuuaguagagaugggguuucaccauguuggccaggcuggucucgaacaccugaccucaagugauccacccaccuuggccucccaaagugcugggauuacaggcaugaaccaccgcaccuggacuuuuuuuuuuguuuuugagacagggucucaaucuguccucaggcuggagugcagcagugcgaucuuggcucacugaaaccucuccccuccggguucaagugauucucgugccucagccuccgaguagcugggauuacaaaugugcaccaccgcaccuaucugauuuuuguguuuuuaguagagacaggguuuugccauguugcccaggcuggucucgaacuccuagccucaugugaucugccugccucagccucucaaagugcugggauuacaggcaugagccaugcccagcccagccugugcuaucuuuagugccagggcuuaagaaaggaagaggagaauaggguucauugcaggaauuguggugggugggguggcagcuaccugagaaaaucuagacagugggccuagguccagugggucaggggagagagccuaggggucaagguugcuccuggcugggcaagcugagaacagggagcaaccuuggcucaggguagaugacagaccucagcuguagauggagcaaggaggccauaugaaaauggcaggcuucuggcaaaaugcagggaugggcugcagcacagcaguucaaucuaaauaggagcagcccaagggacguggguagguuuuagaacagccaggcuacagcuccccuuccucuucacugguguccuugagaggccacagucagaagagacaauuccaggcuagggagagaugucagcgugggaacuagagacccuggucccaaauucagaacucuagccagaguccagaacugcaucugagucuaagaggcaaccacuuacuuacaccucccgaaacugagaacaguuuuaccgguucuggugaaaaaaacccacuaccagcucauaugugggagugggagcugaggcucugcugaguaacacggcccagugcacacagcugucagggccuggcccggcucgaguccugcuguguccgaagcucugccguuuucugcuucguccucuagcauguucugagaugcccuguugggauccucaggccugucacuuuugucaucugcaaggggggccuauaaggccuuaaugggggcuggcgaggcuugagugggagcgugacgcauagugggagcucagucagcucccuccccucccuccaggauuugguccugacagggagcuccaucaggucuuccccagggucaccagaggcucagaugcuguguugucaaguauauauaccaggcaguauuguagcuuuuccuccucuguuacugccugcuaagcggggaccccacaucuucacguccuccucuuccuggcucucaucaccacagccuggugugcauugccccguguccacugacacccacgccacauggguccaaaaacagaguguguucucauugccucaucccacucacccugggcucugccgccacugcgcuguggcucucgggggucccaccaucugacccuugucacccgugcugcuccuucucuugggacucaucccuucugaggccucccguggccccuucucacccuccccuaccuccuccaucuccaggcuuucaaucugguggagcauaaagaaucaguguuucugguacuuguuauuuggauaauggcaccuaaugcuaaaugacgaguuaaugggugcagcacaccagcaucgcacauguauauauagguaacuaaccugcacauugugcacauguacccuaaaacuuaaaguauaauaauaauaaaauaaauaaauaaauaaaauaaaauaaaauaaacuuugaaaaaaaagauuucagcuaaaauuaguuuccucuccaugccgagucugaauauauuauaaaaauaaaagaauaauugucuuucacacaauuaaaaaaaaaaaaagcugacuaaugccacuacagucacacacugcuguugguaauugcuaggguccuuuuuccaguauuguggccaacuuccaccccagaaccccacucuacucuugagcuaagugucuuuaugucuccuauuuuaaauuaggauugcguucaguugcaugcaacagaaauccggcaaucagugccugguaaaacaaguuugauuuuuucaccuaacaagcagucuggaggccggcauugcaggguggguccagcagcuuugggaggccacaguggccaggugcuuucggacuuuucacccacccuccuacccugucuucugcugcuccgaaggcagcugcuacaccucuaggcauaguauuccuguuccaggcaggaagaugggaggggcagaaguuugucucucuauuaggaaauaauagcuuuuucggaagcuccuccugguagauuucuguucacauauugcuggucagaauuaugccaaugaacacuguagcugcaagagagcuuggggaaauugaguguuuagguaggcacagauugcugauccagagaagacugagacucagaaggaaggagaauggagcuggggagaaguaggagugacugccccagcugccacuuggagaaagccacggggugagcaggacagcaccugugaacauuuccugugcucugggucuggugcuucucaaguuuaacacccaggggcgaguggucagggacugauccuugaggaacugauguacauuaaacaaacuaucaagucccugcaaugcaguguaaaugaguaaagagccugcaggggagaaacugccacuaguggagaccaugcgagugggcagccgauugcuuggcucugggggugggugccagaggcaugcaggugcccaagggccaggucugcccaauuuucaagagaagccagaaaaccaaaauuuuuaaagguuuuuucguucuaacucuauuuugaaaaaaguucgguguuacagaguaaguugcagagauuguacagaguccccacauauccuuuacccagcucacauuaaaucuuacauaaaggaacacugguacaauacuauuaaccaaagucaguguguuguucagaccuuaccaguuuuucugccacugcccccuuucugcuucggggaucugguccaggaucccacauucauuuaguugugucucuguggucugcuccugucugugaggcuuccucagucacaaagcuagagguuuacgugaccuuuuccagguuuucccacucuaaugauuuggaaaucauacaucggcaucuugagacaucuuuugagaaguaaagggacuugagcugauugaauguugaucacucccucucaucuuccacauuauuaaguuuugccuucuuauuuuauuauaauuuaaauuauuuuuaagccaggcacaguggcucaugccuguaauuccaauaccuugguaggccaaggugggcagauugcuugagcccaggaguccaaaaccagccggggcaacauagcaaaaccuuaucccuaaaaaaaaauacagaaauuagcuggugugguagugcacaccuguggucccagcuacuuggguggcugaggugggaggaucccuugagcacgggagauaaaggcugcagugagccaugauugcgccacugcacuccagccuaggcgacagagugagacugucucaaaaaacaauaacaacaacaacaaaaaaacccaucagaaaacagcuaagaguuuuguggugguguuuuauuuuagguucaggguacagaugcagguuuguuaugugggugaacuugugucacaggcguuuauuauacagauuauuucaucacccagguacuaagacuaguacccgauaguuauuuuuucugcuccucuccuccucccagccuccacccucaaguaggccccgagguuauuguuaaguccaagcaagggaaggccugguggaaaugaauguguagccuuaacauguuuuguacaaacuuggcuguacauuacaaucaccaggacaauuaaaaaauaagaaacccaauguccaagcugcuccccaaaccaaucaaaggagaaucucuggggaugggaccaggcaucugucuuuuuaaaaacuccccagugacuacaguguacagccgaguuggcaggucuagagcagggagagagagcagaaggagucucugaucacuccagguucugguucugaugaguggguagacaggcagguggguugcuaaaguaaagauuacuagaggacgaauggguuuggggaaaaugauggguucuguuuggauagauugaguuugagcugucgguaaaauaucugagaguuggggucccacagaugcuuaacaucuuaaagcagaucuuuucuucuccugauccuuccacaaggucuggugcagacauuuccccgcugggagacucuccacaguaccucaugaucuuaucaucucugacuguggcauuuguggauaauguuuuacuugcuaaggguuggaacugucuccuccugggugauguggacguggcaucaccacccaguaaguugucaccuuggaaagacuccaggauggagcacaucuuccuuuuucugaugucucugcuauugaggccaugguugcagaucugcugucaacaugagccaagaacagcagggcuuuaugucuuuuuuccacacccaaccacugaaaggaugggacucaccccuucaggaacaguagcacagcagagccgugauucuugggccugagugcugauagggacagggucggggaugggaggcgugaugcauaucuggaucuccaggugggcuggagaguugggaaaagccccucaagucauuccaaugugcuuccuggagacucagaacagaaggcagcagaggaggcagggaaggguggcacagugaugugucaccucucuaguuuauggagccugcuccgaaccccacaaacccacuacaagagccaggugggaagggugauagggcaggugacuugugauacaaggagcagagaccaugguauagcacugcaggaacuagggaaggagcaggagcagaagaacccccuccaugacagcagcccccaagcgugccccacucgcaccauccucuuccuugucacugccuccccugaccucuuccugucuucuccucugcccaggcugaugggaaccacccuguagagguccaucugcguucagacccagacgaugccagagcuaugacugggccugcagguguggcgccgaggggagaucagccauggagcagccacaggaggaagccccugagguccgggaagaggaggagaaagaggaaguggcagaggcagaaggagccccagagcucaaugggggaccacagcaugcacuuccuuccagcagcuacacaggugaggagaggacuggcaggggacacggggcagaggaggcacagcccagugcaguggggauccuggcccucugcaaacgccaucauguggggcgcagaguagcagagugcugaaggacuggagccggaagccuggguucacgcccagugcgguggggaucugcucugccacucaccagcaguggggccuggagcaagcugcaccacuuccuucuguaaaacaggccaaaggaugguaggugauguggauaugggcuuucgugagaauuaaaugagugggcaucuguaacacaugucaucaucauuauuaguauucccaccacuguuaacacaaggcaucugagaccaaucuccacuaacagcacacuagaaagaucagcuguaccugggauuguuaugaucagucgaaacacacaguucaauuggucugguaauaauuauacacaucaucauugagccguaucauaauuagauaaaaaugcuaagcaguuaguaugaauaacucaacuaauauuauuuuuaugcagccaagcaguuguagcuucuccugucucacuuauugguuccccuuuauuuaucagcagugcagacaguuuucucuaguacccuguacuguucugucaucuucaucaucaucauguuauguuuaccuucaaaagcacccagaauccaugcagccccuggcuuucccugcugcaguucccccugcuuuuuuguuuuugugguuuuugagacaaagucuccuucuguugcccagacuagagugcaguggcacagucucagcucacugcaaccucugccuccuggguucaagugauucuccugccucagccucccgaguagcugggauuauaggcgugcaccaccacgcccggcuaauuuuuguauuuuuuuaguaaagaugggguuucaccauguuggccaggcuggucucgaaccgcugggcucaagcaauccacccaccucagccucccaaagugcugggauuacaagcaggagccaccgcgccuggccugaucccucugcuucuugcuuucucccaccacuucucuccuuacccaagugcugcaggccugcacaugcagcucauccucgcuccuccccuuagagggaacucagggucauaaggauauacugcugggaguagacacccugcacucgcugcugcuuucagcugcaggagauccuagccacaggcggugacucaggcagaggagcaagcccaccccgcagaaaugggcucuggaccccugugacugcauggagcaggaggaggcaguuaguguccaagcuaaggcagggugaaggcuguggagguagcgcaggcuccuguuugggucugcagcuaagaugggucugaauccuggagccacaccaccuugaaccugcaaagcaagucccagaauuuugcagaaguucuuccucuucaguguauagaguuggguggagggaguauagagccaucauucaguccuucucaucucacccaggaucaccugggagugaccaaaguaggccaaaugugauucuagggccaaagugaagguguccgccauuccccgaguaagcaacuuccugucuauuggcugguaacugggauggcuuuggagacacagccugucucagaagagaggaacagcuaaccaggagugauaauucacucagugccaguagcacauacuguucuaaaucugaagaagguagggaggguuagaaagcaaagggaagacaguggggacuaagaaugagugugggaugucaugaggauucaggggagaaugcaaggagaagagacggccacaggguuuguggcuaugccgccugccguggcccaccucauccccacaucugagcccaggcagauggaaguccccugcagagcaguguucuguccuggaguuuccuccacaccccuucuugggaccagggcuguuucccaaauagcaucacuguucccgugcaggccaggugaggugccugggagcagggguagggugaggcaggcauggcggugaccucucaggcagcuucguugugggauuuagggcacagcgggaaacguccagggcagagguugccucaccagucacaugguacuauguaggcggugguguuuaauagauucuguuuaucaauaaguggaugaaguggagauagacuuccuuguucagucauugaaacaggagagaggguuacuugacauaaucacuuuguguuaaagcuguaguguaugaaaaguucccaaaaauucuacaagacaagcaaccuagcaggaaaaucagaacagguaacaguaagacaaauacgaauggccugaaaucccgacagguuuuucagucuaaccaacucaaagaaagcaccuuaaguugcaaugccauuucaccugucagauggguggggaggacuugguccucccaccaccaggggugaaaggguagugugggccaacacuucuuaaugugugauucuuuuuuuuuuuuuuugagacagagccuggcucugucgcucaggcuggagugcaguggcacacgaucucaacucacugaaaccucugccucccgggcucaagcgauucuccugccucagccucccaaguagcuggaauuacaggcgugcaccaccgugccuggcuaauuuuuguauuuuuaguagagaugggguuccacuguguuggccaggcuagucacgaacuccucaggugauccucccgccucggccucccaaaguguugggauuucaggugugagccaccacaccuggccaagugugcauuucuuuuacccugcauucccacuucuaggaacguguccuguguaaguacuugcucagcaugcucagagauucccaugccagcuuauuuacugcaggacugcucauaagagcaaaaauaggaacgugcccaucuguggggaacugguuauguaaacugugguagagccauaugguggaauacucuggagucauugaaaaggauaaggcugguuuauauauauauuaaauaaguuccugacaaguuggggaucccauuguuuaaaauccuuauguuucauagaaggcaccggaagagucuauaccgaaggacucaggggcuaacucugaggagcaggaucaugguuaaggaggcugugucauaagauccugcauacccuucuguguuuuucucaacaagucugcacuacuuccauaauuugaaaggcaacuguacuuuuuuuaaggguaaaauuaacuguuuaaaaggggggugaggaucuggcaggugaggggcccuggagacagagccugaucauguguccagagcagaagggcuuggagaucacagagaccagggcaggcaucccaggucugucacugugagcuguagcccucgccagugccaucacuucuccaagucucauucucuucaccuuuauaggcuguguccuacccagccugagggccagccaggugagagucaguggggguaugugacacaucgcaggucucagcaccugcuaguucucugccccauccccaugaguuauuacuuuggccucgggaguccccugagggacccauaaggacagcgcacagcuuugagcccugaaacagcaggaaggcuccacagucaccccugaccacccuccucagcaguucagcacugacucucagugcagauauugagcucaacaccugccaugcaccuucucacccuccccccagccaggcaggacagaccuucccaucaacaaggaaacugagguuaccagaaacccacuugccaggguccccugggcguguaggaguagagacagcuagagccaggauucaccucccauucccauucucaucccuccugcuucagugacauccaucccaaucacccuugagaaagaggaagauaaaguguccuuccuccuggccucagcaccuccucacuuggcaagcacuuggugggcaucaggcugggcccagcacugugcccagggcuggccauacagugguggacaaggcugagugccugucccaaggagcccacaguucaggcaaacaggacagcagaaguaaagaggcugcucaguaacccagccucaaaucccugcagaauuuggccugacuucagaagcugcugggugcuuguuugccugugagcucugccagcaaaguaaauagaccaaucgggcgccuccuggcugucuucacagccaugacaacggcauucucccagcauuggaggcuagauaugcaggagagcucucagccacaaaugaugugaauaaggucaauagugucuauuugcugaacuugucaucaaagauggugaaacugauacuuuacucucugggugagagggcuaguguuuacacugaauccaaacauuuggauaaugacauggugccuccucagcagugacugugucuucuuguucaucauaauaauguuauugauuagcgguacugaacauguagguaugcguaguagugagaugccgagguuaagagcucagcuccaggaauugcaugguucuagguuauaauucuugcucugucacuguauuagucaggguucuccagagaaggagaaccuguguguguguguguguguguguguugaaagaaagagauguguuuuaacgaauugguucacacaguuguuggaguggcaaguccaaauuuugaaaggcaggcaggcuggagagccggggaaguugauguugcagcucaaguccaaaggcagccuggaggcagaauuuccuguuccacaguggggccacgguaggcacucagucuuuuuucuuaaggccuucaguuguuggaugagggccacucacauuauggaggguaaucugcuuuacucaaagucuucugauuuaaauguuaauugcaucuaaaaaauaucuucuuaguggccgggcacaguggcucaugccuguaaucccagcacuuugggaggccaagguggguggaucaccugaggucaggaauucaagaccagcccagccaacauggugaaaccccaucucuacuaaaaauaccaaaaaaaacuagcugggcgccuguaaucccagcuacucggggggcugaggcaggagaaucgcuugaacccgggaggcagaaguugcagugagcugagaucgcgccauugcacuccagccuggggaacaaaagcgagacuucaucucaaaaaaaaaaaaaaaaaaaaaaaaaaaaaaaaaaaacaccuucuuagcacauuguuuggucaaacaacugggcaccguggccuaaucaaguugauauguaagaccaacauagccgcugccagcaaguuacuaacacuucugagccuuggagccucggcuuccuugccuguaaaguggggguaagaagaccaucuugaaagguuguuuugagguuuuacgugagaugaaauggguguccaauggagugccuuuagcaggacaccugcuuacccccaccucuacccaggacaucaugaugcgggggaagugguggaaccuucagaacccagccccuaguaugagaagaauucugccaucaccuuucuuucagcagagagggaagcaguccccuuccgugacagucacaugcgugagugauggcuccuuccaauauccugcacuucuuacugccccuuaccuggcguugcuccacucugucucauguucuaguuuucuuaucucuuucucuuuuuuuuucuauuuuauuuuuuuccuguaggcacaagugaguuacaguagguuaaguuacaccuuaccuuuccuuguuuuucuuguuuauuuauuuguuuauuuauuuuuuugagacaaggucuuguucugucaccacaggcuggaguacaguggugcaaucacagcucacugcaaccuggaccucccaggcucaagucaucuucccacauucaggcaauccucccaccucagccucccaaguaucugggacuacaggcaugugccaccacacccagcuaguuuuuaaaauuuuuuauagagauagagacagggucucacuauguugcccaggcuggucucaaacuccugggcucaagugauccucccgccucagccucccaaaguguugggaucacaggugugagccacugcaccuggccuuuuguuuuuuuuaaguagagacagucuugcuuuaucacccaggcugguauacgauggcacaaucacagcucuccuaggcucaaggauuuuccugccucagccuccucaguagcuggcacuauaggcaggugccacgacacccaacuauuuuuuuuuuuuuacuuuuuauagagacagggucucacuauguugcuccuggccucagguaauccuccugccuuggccucccaaaguacugcgauuacuggcgugagccaccacacucagccgagugcaauggcgcgaucucagcucacugcagccuccgccccccugcccccggguucaagugauucuccuuccuuagccucccgaguagcugggacuacaggcaugugccaccacgcccagcuaauuuuuguauuuuuaguagagaugggguuucaccauguuggccaggaugguuucaaucucuugaccucgugauccgcccgcgucggccucccaaagugcugggauuacaggcgugagccaccacacccagcccugcuguuaccucuuucuuaccucagcuauuugaggauagagucuagguccuguccugcauauagaaggugcuuaucaugugucuuuugagugaacacagagggugacauugucacgugcagugccaacagaaaccaaaugacuagacaccugcugaccuuccauggccacagggaggaugagaaaggcaccuccaggaggugugaauaaucugaggguauuggccacuguggacaagacucggugguggaagugagcucagagauccaaagggaacgugaguagagacaugcagagucucgcagaggaagcagacgugcaggccacaaagacaaaauuacaagaaaugccccaacacgagcauaugcucacggacugcacagauucaaggaggaagugccagaaacccugccugccccagcaucugcacaggcauccacaaaggguuucugucauguuaucucuuuuucuuccaacauccggugcugugaguuuuauugucccuguuauaaaugccuccaggaguggcagguccugcccagccccaucagccaguuggugcugcagucaggacacccaggcagccugaggacugccagaugugcagagagcuaucgcgugccugcugcgugcccagcaccucacacagcucucagugucugaccacgcuggugcccugguggacaaaguuccugcccuuguggcccuuuugucuaguggguggcuuccaacaaugaacacacacaggauaugucaggcggugacaaaggcuacugagaagaccaaagcggcuucacccucccagagcacagcuuuucccucccaggcccgagagauguagggagcccacugucccagucugggucaagaggaacaguuacaacaccuuggaaugacugaaguugggagcuaaggugccaggacaagacaggccauuuuaggaaccagagacuuguguuaccccuaaaccucaccagccaggaggggagcagcccacuggguccucucugccacaguugggugcuucuugugcucccccuccuguggucaggauaggggaagcaggcuuuccugcugccacuccuaggacccaaggggaagcugggggaguggggagaccaugugggaaggauggagugcacuuugauugguagcagguggauagguacucccaugguggggaaaucaaaguugcuuggccuguguaguagacagguauuaccacaggccuggaaaacauuagccuggguuuaucucuguggcuucggucccccaacauccccuucuacucaaaauggcugauucucugguuuggagguuuggcaccugcuuuuggggagguugcucagucauuagagaagagugcagagguuggacggucaucauggcagagguaggacagcugguauguggggccaugaaaccagcuuugggcuaggagucaggaagcugagacucaguucagguccccuuuccaagaugaagagaucauuuccgaguguccaaagggcacugggaagagaauccuagcaguucuuaugaaaucaucugacagcagauauauccugaagucauagccuuagcaaacugccuuucucgccaacacacucaacaccccgugguucaaacaucuauacgucugauagaaaaacuuggagaaauucaguguguugcuuaaucaauaugacugauaccuaagcuguucuacucaagaaguuuucaugggaaugaacuugagcuucuugaagagauuguuuacagcaucccuggagucuaugcaagaauagaacuuccugugggggaugguggggaggcuagcucugcagaggucuacaguccugcaguuucugcaaaacacguugcacacaucuccauaugggccacacgguggcaaccucugaaccaggagagcugcuuccuaagggcuaagacccucugucugcuuucucucucuugcuuuccucccaaaacacagccauccuccuccccacugcuaccccauggugaguucagcccaggaagccucugacccagcccugaugguaauagcugcuguguacuggacaucuucuguauguuaggcucugggagaaaugcuguggagacuuuuugcccauccucccagagaagcugucaguacccccuguucuaggugaagaaacugguccucagaaagguugacucccugaggccacacagcuguuaaguggcugaggcgagggcuguggggcuguucccacgcccuggcuuccaggccuggcagcauguggagcugccccuccaucguguguccgcagaccucucccggagcuccucgccacccucacugcuggaccaacugcagaugggcugugacggggccucaugcggcagccucaacauggagugccgggugugcggggacaaggcaucgggcuuccacuacgguguucaugcaugugaggggugcaagguacggacuggggggagcgguggcuggccacugaggcuguggucacauggugaauugacccuccacaaagcuuuccuugccuugggguggggcccugacuguaccuauugcagaauuccugcccaggaggcagccaggcccuugugcuccagaccucagcucugggcacugcaggagaagaggggguucccuugucaagccuacccugcugggcaccuguguugacccagcucugugggugauugugucccccuggggaccaggcagcuagggcagaaugagggucuugggcugagccaucgucuuaccugaggucuggguuucuuguuucucaaggcucaaagcgggcucugagaaaaaaggacagacauuuguuuuuccagugauauuuguggguccuuccuaacuucacacccaucaaaaucucacagauuauuuuauugaaucaccaccucacaaauacacagaaccagauacauuuaugaagaaaucaaguuagccgugagacaaucuuauguuaccaaacuaacaaagaagcuuuuuuuuuuuuuuuuuuuuuuuuugagauggaaucucgaucugucgcccaggcuggagugcaguggcgugaucucaguuaacugcaaccuccaccucccggguucaggagauucuccugccugagccuccagaguagcugggauuacagguacaugccaccaugccuggcuaauuuuuguauuuuuaguagagaugggguuucaccacauuggccaggcuggucucgaacuccugaccucaggugauccaccugccuuggccucccaaagugcuaggauuacaggugugaaccacugugccugacccaauuuuuguaguuuuaauagggacgggguuucaccauguuggcuaggcuggucuugaacuccugaccucaggugauccacccaccucggccucccaaagugcugggauuacaggcgugagccacuguguccagccccaacaaagaagcuuuaggacuucuuuagacauuuaaaauaguuguguuuuuuuuuuguuuuguuuuguuuuauuuuguuuuguuuuguuuugagauggaguuucacucuuguuguccaggcuggaguguaauggcgcgaucuuggcugacugcaaccuccaccucccggguucaagcgauuccccugccucagccuccugaguagcugggauuacaggggugugccacuacacccagcuaauuuuucuguauuuuuaguagagacgggguuucaccauguuggccaggcuggucucaaacuccugaccucaggugauccgcccaccucggccucucaaagugcugggauuacaggcgugagccacugugccugaacuaaaauaguuuuaauuaaaguuuuagaauuacuuuccuucuccaucuccccuccaaaaaaauuucuucucguuacuuccaaaugucaggaguguuuacaccuuauacauaaucgggcccuuuggcacagccucccucccaccuccugguggccuuuccucaccuguucuuggugcuucagggcuucuuccgucguacgauccgcaugaagcuggaguacgagaagugugagcgcagcugcaagauucagaagaagaaccgcaacaagugccaguacugccgcuuccagaagugccuggcacugggcaugucacacaacggugagagcugaccagggcaacucacgggcugcuggcuccacacagccugaaaccaagguccagggagcccuuggggcagccuagagggggcaccuguagagcagugccuggcgcacaguaagcaccauggcuguuggcuguuggcuuugcugaucuggaccuuggaucuuagagccuaagaccugccacuuccucagacugccagcaucuaccaugggucccaggcgugggguaguguuuaccucccuauaccugagguuuacgcauucuggcccagaagggaacugauaauugauaccagcuugaacaauuuggggaacaccagucccagaaacucaagccugucucagaugaccugacacagcaugaaagcuacugccaaggccagguggcccuucuugguuauagaaggcaggcaguaaccaguaaguaaccacauuugucaacugccaggagccaggcagaaguuucuuggaggucacccacucccaggagacagagccuucucugcccugugcuccaggccuccugcagagccuugucuucggaccccaggguaggauauugcaaagcccaccuguccccucaguaccucucugaguaagaccccuagaggacaggggagagccucuugugaucucuacaggcagguuagcugcuuggccagcuuuuacccagggaugcccuaacugccuugcaucuuagaggguagcaguaccugagcccuccauuugcggcucuccuggguaauggggucuggcaggucuggguuugacuccuuucuuaggaaaucucggaacugacugaaucccucuccuuacgcuaacuccaggagaagucgaauucguauccuacucaauuacuaaugacaacaauuuuugagugcuuacuaugugaggauucuuauuuaauugaucuaauaacucaguaaguuuuaaaaaguauuagccucauuuuucugauuaaaaaagaaaaguggccaggugcaguggcucacaccuguaaucccaucacuuugggaggccaagguaggaggauugcuugaguccaggaguuuaagaccagccugagcaacauagugagaccucaucucuacaaaaaaaaaaaaaaaaaaaaaaaaaauuuagccaggcuugguggcgugcaccuguagucccagcuacucagaaggcugaggcgggaggaucacuuuagcccaggaggucaaggcugcagugagccaugauugugccacuguacuccagccuggaugagagugagacccugucucaaaacaaaaaaagaaaaaggcugggcaugguggcacaugccuauaauccuagcacuuugggaggccaaggcgaguggaucaccugaggucagcaguucaagaccagccuggccaagauggugaaacucugucucuacuaaaaaaaaaauacaaaaauuagccaggcaugguggugggcgccuauaaucccagcuacucgggaggcugagacagagaauugcuugaacccgggaggcagagguugcagugagccgagaucgugccacugcacuccagccugggagacagagcgagacucugucucaaaaaaaaaaaaagaaaagaaaaagaaaagugaaggagucugccccaagucacaaagcuaguaaacugcugagcuggaacucaagcccaggccuuugucaccaaagucugucuuaccccagcuagcguagcucagucacucaguaaguuagaguccuugugugcugggcacugugaacaaaacagacaaaaucacugcucuugcaaagauacaccaaaaaaaaaaaaaaaucacaucuuguggagcuugcgaucuggaggggccaccccaucauuccuaccuugcugacucuagagcuucugggggccuuaggcuccaaaaggauuuggcccaugcaccuguaaagggauggggaugucagaggugcuggggccugccugggcuccuugcugacugcccccuucccugugcagcuauccguuuuggucggaugccggaggcugagaagaggaagcugguggcagggcugacugcaaacgaggggagccaguacaacccacagguggccgaccugaaggccuucuccaagcacaucuacaaugccuaccugaaaaacuucaacaugaccaaaaagaaggcccgcagcauccucaccggcaaagccagccacacggcggugaguguugcugcugcuuggccuggcagcauccugggcucugggucccacugccgccugccugacuccgggagagccaggccuucucccucccucaacuucauggugcaggcaagggacauggggagcacagggugggggucucccgaggccugaucucuaacggggccugguuuucagcccuuugugauccacgacaucgagacauuguggcaggcagagaaggggcugguguggaagcaguuggugaauggccugccucccuacaaggagaucagcgugcacgucuucuaccgcugccagugcaccacaguggagaccgugcgggagcucacugaguucgccaagagcauccccagcuucagcagccucuuccucaacgaccagguuacccuucucaaguauggcgugcacgaggccaucuucgccaugcuggccucuaucgucaacaaggacgggcugcugguagccaacggcaguggcuuugucacccgugaguuccugcgcagccuccgcaaacccuucagugauaucauugagccuaaguuugaauuugcugucaaguucaacgcccuggaacuugaugacagugaccuggcccuauucauugcggccaucauucuguguggaggugagugagaguggggcaggugggcuggccuggcacacccagucguccuggggguuggcccucacugcagggcacugugccugagcucugacaguguggggaagugucccugugaucuuggcaguggaacaugcaaggcacugacugagcaugcaggaucagcuccaucucauuauguacguagauagagguggagacaggaaaaagacuaagccagacgugguggcucacaccuguaaucccagcacuuuggcaggccgaggcggguggaucacuugaggucaggaguucgaaaccagccuggccaacauggugaaaccccgucucuacuaaaaauacaaaaaauuagccagaugugguggcacgcgccuguaaucccagcuacuugggaggcugagccaggagaaucgcuugaacccgagagguggagguugcagugagccaaaaucccaccacugcacuccagccugggugacagagugagacccugucucaaaaaaaaggaaaaggacuaacaggcaguaugcugucauguuaaugugggguggaaaaauugucugcauuuuuucugcauuuuuaaaauuccaacacaauaaauacaauaauaacuaugcuaa

SEQ ID NO: 61566 - RNA, 85634 nt, Homo sapiens; identical to SEQ ID NO: 61564

SEQ ID NO: 61567 - RNA, 85634 nt, Homo sapiens; identical to SEQ ID NO: 61564

SEQ ID NO: 61568 - RNA, 85634 nt, Homo sapiens; identical to SEQ ID NO: 61564

SEQ ID NO: 61569 - RNA, 7961 nt, Homo sapiens
cuaaaguucugaaagaccuguugcuuuucaccaggaaguuuuacugggcaucuccugagccuaggcaauagcuguagggugacuucuggagccauccccguuuccccgccccccaaaagaagcggagauuuaacggggacgugcggccagagcuggggaaaugggcccgcgagccaggccggcgcuucuccuccugaugcuuuugcagaccgcgguccugcaggggcgcuugcugcgugaguccgagggcugcgggcgaacuaggggcgcggcggggguggaaaaaucgaaacuagcuuuuucuuugcgcuugggaguuugcuaacuuuggaggaccugcucaacccuauccgcaagccccucucccuacuuucugcguccagaccccgugagggagugccuaccacugaacugcagauaggggucccucgccccaggaccugcccccucccccggcugucccggcucugcggagugacuuuuggaaccgcccacucccuucccccaacuagaaugcuuuuaaauaaaucucguaguuccucacuugagcugagcuaagccuggggcuccuugaaccuggaacucggguuuauuuccaaugucagcugugcaguuuuuuccccagucaucuccaaacaggaaguucuucccugagugcuugccgagaaggcugagcaaacccacagcaggauccgcacgggguuuccaccucagaacgaaugcguugggcggugggggcgcgaaagaguggcguuggggaucugaauucuucaccauuccacccacuuuuggugagaccugggguggaggucucuagggugggaggcuccugagagaggccuaccucgggccuuuccccacucuuggcaauuguucuuuugccuggaaaauuaaguauauguuaguuuugaacguuugaacugaacaauucucuuuucggcuaggcuuuauugauuugcaaugugcuguguaauuaagaggccucucuacaaaguacugauaaugaacauguaagcaaugcacucacuucuaaguuacauucauaucugaucuuauuugauuuucacuaggcauagggagguaggagcuaauaauacguuuauuuuacuagaaguuaacuggaauucagauuauauaacucuuuucagguuacaaagaacauaaauaaucugguuuucugauguuauuucaaguacuacagcugcuucuaaucuuaguugacagugauuuugcccuguaguguagcacaguguucugugggucacacgccggccucagcacagcacuuugaguuuugguacuacguguauccacauuuuacacaugacaagaaugaggcauggcacggccugcuuccuggcaaauuuauucaaugguacacugggcuuugguggcagagcucaugucuccacuucauagcuaugauucuuaaacaucacacugcauuagagguugaauaauaaaauuucauguugagcagaaauauucauuguuuacaaguguaaaugagucccagccauguguugcacuguucaagccccaagggagagagcagggaaacaagucuuuacccuuugauauuuugcauucuagugggagagaugacaauaagcaaaugagcagaaagauauacaacaucaggaaaucauggguguugugagaagcagagaagucagggcaagucacucuggggcugacacuugagcagagacaugaaggaaauaagaaugauauugacugggagcaguauuucccaggcaaacugagugggccuggcaaguuggauuaaaaagcggguuuucucagcacuacucauguguguguguguggggggggggggcggcgugggggugggaagggggacuaccaucugcauguaggaugucuagcaguauccuguccucccuacucacuaggugcuaggagcacucccccagucuugacaaccaaaaaugucucuaaacuuugccacaugucaccuaguagacaaacuccugguuaagaagcucggguugaaaaaaauaaacaaguagugcuggggaguagaggccaagaaguagguaaugggcucagaagaggagccacaaacaagguugugcaggcgccuguaggcuguggugugaauucuagccaaggaguaacagugaucugucacaggcuuuuaaaagauugcucuggcugcuauguggaaagcagaaugaagggagcaacaguaaaagcagggagcccagccaggaagcuguuacacaguccaggcaagagguaguggagugggcugggugggaacagaaaagggagugacaaaccauugucuccugaauauauucugaaggaaguugcugaaggauucuauguugugugagagaaagagaagaauuggcuggguguaguagcucaugccaaggaggaggccaaggagagcagauuccugagcucaggaguucaagaccagccugggcaacacagcaaaaccccuucucuacaaaaaauacaaaaauuagcugggugugguggcaugcaccugugauccuagcuacucgggaggcugagguggaggguauugcuugagcccaggaaguugaggcugcagugagccaugacugugccacuguacuucagccuaggugacagagcaagacccugucuccccugacccccugaaaaagagaagaguuaaaguugacuuuguucuuuauuuuaauuuuauuggccugagcagugggguaauuggcaaugccauuucugagauggugaaggcagaggaaagagcaguuugggguaaaucaaggaucugcauuuggacauguuaaguuugagauuccagucaggcuuccaaguggugaggccacauaggcaguucaguguaagaauucaggaccaaggcugggcacgguggcucacuucuguaaucccagcacuuugguggcugaggcagguagaucauuugaggucaggaguuugagacaagcuuggccaacauggugaaaccccaugucuacuaaaaauacaaaaauuagccuggugugguggcgcacgccuauagucccagguuuucaggaggcuuagguaggagaaucccuugaacccaggaggugcagguugcagugagcugagauugugccacugcacuccagccugggugauagagugagacucugucucaaaaaaaaaaaaaaaaaaaaaaaaaaaaacugaaggaauuauuccucaggauuugggucuaauuugcccugagcaccaacuccugaguucaacuaccauggcuagacacaccuuaacauuuucuagaauccaccagcuuuaguggagucugucuaaucaugaguauuggaauaggaucugggggcagugaggggguggcagccacguguggcagagaaaagcacacaaggaaagagcacccaggacugucauauggaagaaagacaggacugcaacucacccuucacaaaaugaggaccagacacagcugaugguaugaguugaugcagguguguggagccucaacauccugcuccccuccuacuacacaugguuaaggccuguugcucugucuccagguucacacucucugcacuaccucuucaugggugccucagagcaggaccuuggucuuuccuuguuugaagcuuugggcuacguggaugaccagcuguucguguucuaugaucaugagagucgccguguggagccccgaacuccauggguuuccaguagaauuucaagccagauguggcugcagcugagucagagucugaaagggugggaucacauguucacuguugacuucuggacuauuauggaaaaucacaaccacagcaaggguauguggagagggggccucaccuuccugagguugucagagcuuuucaucuuuucaugcaucuugaaggaaacagcuggaagucugaggucuugugggagcagggaagagggaaggaauuugcuuccugagaucauuugguccuuggggaugguggaaauagggaccuauuccuuugguugcaguuaacaaggcuggggauuuuuccagagucccacacccugcaggucauccugggcugugaaaugcaagaagacaacaguaccgagggcuacuggaaguacggguaugaugggcaggaccaccuugaauucugcccugacacacuggauuggagagcagcagaacccagggccuggcccaccaagcuggagugggaaaggcacaagauucgggccaggcagaacagggccuaccuggagagggacugcccugcacagcugcagcaguugcuggagcuggggagagguguuuuggaccaacaagguaugguggaaacacacuucugccccuauacucuaguggcagaguggaggagguugcagggcacggaaucccugguuggaguuucagagguggcugaggcugugugccucuccaaauucugggaagggacuuucucaauccuagagucucuaccuuauaauugagauguaugagacagccacaagucauggguuuaauuucuuuucuccaugcauauggcucaaagggaagugucuauggcccuugcuuuuuauuuaaccaauaaucuuuuguauauuuauaccuguuaaaaauucagaaaugucaaggccgggcacgguggcucaccccuguaaucccagcacuuugggaggccgaggcggguggucacaaggucaggaguuugagaccagccugaccaacauggugaaacccgucucuaaaaaaauacaaaaauuagcuggucacagucaugcgcaccuguagucccagcuaauuggaaggcugaggcaggagcaucgcuugaaccugggaagcggaaguugcacugagccaagaucgcgccacugcacuccagccuaggcagcagagugagacuccaucuuaaaaaaaaaaaaaaaaaaaaaaagagaauucagagaucucagcuaucauaugaauaccaggacaaaauaucaagugaggccacuuaucagaguagaagaauccuuuagguuaaaaguuucuuucauagaacauagcaauaaucacugaagcuaccuaucuuacaaguccgcuucuuauaacaaugccuccuagguugacccaggugaaacugaccaucuguauucaaucauuuucaaugcacauaaagggcaauuuuaucuaucagaacaaagaacauggguaacagauauguauauuuacaugugaggagaacaagcugaucugacugcucuccaagugacacuguguuagaguccaaucuuaggacacaaaauggugucucuccuguagcuuguuuuuuucugaaaaggguauuuccuuccuccaaccuauagaaggaagugaaaguuccagucuuccuggcaaggguaaacagauccccucuccucauccuuccucuuuccugucaagugccuccuuuggugaaggugacacaucaugugaccucuucagugaccacucuacggugucgggccuugaacuacuacccccagaacaucaccaugaaguggcugaaggauaagcagccaauggaugccaaggaguucgaaccuaaagacguauugcccaauggggaugggaccuaccagggcuggauaaccuuggcuguacccccuggggaagagcagagauauacgugccagguggagcacccaggccuggaucagccccucauugugaucugggguaugugacugaugagagccaggagcugagaaaaucuauuggggguugagaggagugccugaggagguaauuauggcagugagaugaggaucugcucuuuguuagggggugggcugaggguggcaaucaaaggcuuuaacuugcuuuuucuguuuuagagcccucaccgucuggcacccuagucauuggagucaucaguggaauugcuguuuuugucgucaucuuguucauuggaauuuuguucauaauauuaaggaagaggcaggguucaagugaguaggaacaagggggaagucucuuaguaccucugccccagggcacagugggaagaggggcagaggggaucuggcauccaugggaagcauuuuucucauuuauauucuuuggggacaccagcagcucccugggagacagaaaauaaugguucuccccagaaugaaagucucuaauucaacaaacaucuucagagcaccuacuauuuugcaagagcuguuuaagguaguacaggggcuuugagguugagaagucacuguggcuauucucagaacccaaaucugguagggaaugaaauugauagcaaguaaauguaguuaaagaagaccccaugagguccuaaagcaggcaggaagcaaaugcuuagggugucaaaggaaagaaugaucacauucagcuggggaucaagauagccuucuggaucuugaaggagaagcuggauuccauuaggugagguugaagaugaugggaggucuacacagacggagcaaccaugccaaguaggagaguauaaggcauacugggagauuagaaauaauuacuguaccuuaacccugaguuugcguagcuaucacucaccaauuaugcauuucuacccccugaacaucugugguguagggaaaagagaaucagaaagaagccagcucauacagaguccaagggucuuuugggauauuggguuaugaucacuggggugucauugaaggauccuaagaaaggaggaccacgaucucccuuauauggugaauguguuguuaagaaguuagaugagaggugaggagaccaguuagaaagccaauaagcauuuccagaugagagauaaugguucuugaaauccaauagugcccaggucuaaauugagaugggugaaugaggaaaauaaggaagagagaagaggcaagauggugccuagguuugugaugccucuuuccugggucucuugucuccacaggaggagccauggggcacuacgucuuagcugaacgugagugacacgcagccugcagacucacugugggaaggagacaaaacuagagacucaaagagggagugcauuuaugagcucuucauguuucaggagagaguugaaccuaaacauagaaauugccugacgaacuccuugauuuuagccuucucuguucauuuccucaaaaagauuuccccauuuagguuucugaguuccugcaugccggugaucccuagcugugaccucuccccuggaacugucucucaugaaccucaagcugcaucuagaggcuuccuucauuuccuccgucaccucagagacauacaccuaugucauuucauuuccuauuuuuggaagaggacuccuuaaauuugggggacuuacaugauucauuuuaacaucugagaaaagcuuugaacccugggacguggcuagucauaaccuuaccagauuuuuacacauguaucuaugcauuuucuggacccguucaacuuuuccuuugaauccucucucuguguuacccaguaacucaucugucaccaagccuuggggauucuuccaucugauugugaugugaguugcacagcuaugaaggcuguacacugcacgaauggaagaggcaccugucccagaaaaagcaucauggcuaucuguggguaguaugauggguguuuuuagcagguaggaggcaaauaucuugaaagggguugugaagagguguuuuuucuaauuggcaugaaggugucauacagauuugcaaaguuuaauggugccuucauuugggaugcuacucuaguauuccagaccugaagaaucacaauaauuuucuaccuggucucuccuuguucugauaaugaaaauuaugauaaggaugauaaaagcacuuacuucguguccgacucuucugagcaccuacuuacaugcauuacugcaugcacuucuuacaauaauucuaugagauagguacuauuauccccauuucuuuuuuaaaugaagaaagugaaguaggccgggcacgguggcucacgccuguaaucccag

SEQ ID NO: 61570 - RNA, 7961 nt, Homo sapiens; identical to SEQ ID NO: 61569

SEQ ID NO: 61571 - RNA, 7961 nt, Homo sapiens; identical to SEQ ID NO: 61569

SEQ ID NO: 61572 - RNA, 7961 nt, Homo sapiens; identical to SEQ ID NO: 61569

SEQ ID NO: 61573 - RNA, 7961 nt, Homo sapiens; identical to SEQ ID NO: 61569

SEQ ID NO: 61574 - RNA, 7961 nt, Homo sapiens; identical to SEQ ID NO: 61569

SEQ ID NO: 61575 - RNA, 7961 nt, Homo sapiens; identical to SEQ ID NO: 61569

SEQ ID NO: 61576 - RNA, 7961 nt, Homo sapiens; identical to SEQ ID NO: 61569

SEQ ID NO: 61577 - RNA, 4861 nt, Homo sapiens
gucucaauauuagagucucaacccccaauaaauauaggacuggagaugucugaggcucauucugcccucgagcccaccgggaacgaaagagaagcucuaucuccccuccaggagcccagcuaugaacuccuucuccacaaguaagugcaggaaauccuuagcccuggaacugccagcggcggucgagcccugugugagggagggguguguggcccagggagggcuggcgggcggccagcagcagaggcaggcucccagcugugcugucagcucaccccugcgcucgcuccccuccggcacaggcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagguggguaggcuuggcgaugggguugaagggcccggugcgcaugcguuccccuugccccugcguguggccgggggcugccugcauuaggaggucuuugcuggguucuagagcacuguagauuugaggccaacggggccgacuagacugacuucuguauuuauccuuugcuggugucaggaaguuccuuuccuuucuggaaaaugcagaaugggucugaaauccaugcccaccuuuggcaugagcugaggguuauugcuucucagggcuuccuuuucccuuuccaaaaaauuaggucugugaagcuccuuuuugucccccgggcuuuggaaggacuagaaaagugccaccugaaaggcauguucagcuucucagagcaguugcaguacuuuuugguuauguaaacucaauggcuaggauuccucaaagccauuccagcuaagauucauaccucagagcccaccaaaguggcaaaucauaaauagguuaaagcaucuccccacuuucaaugcaagguauuuugguccuguuugguagaaagaaaagaacacaggaggggagauugggagcccacacucgaauucugguucugccaaaccagccuugugaucuuggguaaauucccuaccaccucuggacuccaucaguaaaauugggcguggacuaggugaucucauagauccuuccugcuggaacauucuauggcuugaauuauauucuccuaauuauugucaaaauugcuguuauuaaguaucuacugugugccaggcacuuuaaauaaauauugugucuaaucuucaaaacaaauuugcaaggaagguuuuuggagauaaggaaacugagacucaggauuaaguaacacaccuaaagucacaggugagcuuggaacugaacccaagugugcccccacuccacuggaauuugcuugccaggaugccaaugaguuguagcuucauuuuucuuagagacuuuccuggcugugguugaacaaugaaaaggcccucuagugguguuuguuuuagggacacuuaggugauaacaauucugguauucuuucccagacauguaacaagaguaacaugugugaaagcagcaaagaggcacuggcagaaaacaaccugaaccuuccaaagauggcugaaaaagauggaugcuuccaaucuggauucaaugagguaccaacuugucgcacucacuuuucacuauuccuuaggcaaaacuucucccucuugcaugcagugccuguauacauauagauccaggcagcaacaaaaaguggguaaauguaaagaauguuauguaaauuucaugaggaggccaacuucaagcuuuuuuaaaggcaguuuauucuuggacagguauggccagagauggugccacuguggugagauuuuaacaacugucaaauguuuaaaacucccacagguuuaauuaguucauccugggaaagguacucucagggccuuuucccucucuggcugccccuggcaggguccaggucugcccucccucccugcccagcucauucuccacagugagauaaccugcacugucuucugauuauuuuauaaaaggagguuccagcccagcauuaacaagggcaagagugcaggaagaacaucaagggggacaaucagagaaggauccccauugccacauucuagcaucuguugggcuuuggauaaaacuaauuacauggggccucugauuguccaguuauuuaaaauggugcuguccaaugucccaaaacaugcugccuaagagguacuugaaguucucuagaggagcagagggaaaagaugucgaacuguggcaauuuuaacuuuucaaauugauucuaucuccuggcgauaaccaauuuucccaccaucuuuccucuuaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaagguggguguguccucauucccucaacuuggugugggggaagacaggcucaaagacaguguccuggacaacucagggaugcaaugccacuuccaaaagagaaggcuacacguaaacaaaagagucugagaaauaguuucugauuguuauuguuaaaucuuuuuuuguuuguuugguugguuggcucucuucugcaaaggacaucaauaacuguauuuuaaacuauauauuaacugagguggauuuuaacaucaauuuuuaauagugcaagagauuuaaaaccaaaggcgggggggcgggcagaaaaaagugcauccaacuccagccagugauccacagaaacaaagaccaaggagcacaaaaugauuuuaagauuuuagucauugccaagugacauucuucucacugugguuguuucaauucuuuuuccuaccuuuuaccagagaguuaguucagagaaauggucagagacucaaggguggaaagagguaccaaaggcuuuggccaccaguagcuggcuauucagacagcagggaguagacuugcuggcuagcauguggaggagccaaagcucaauaagaaggggccuagaaugaaacccuuggugcugauccugccucugccauuucuacuuaagccaggguuucucauauguuaacaugcaugggaauucccugggcaucuucuugugguguggagucugacuuagcaagccucggguggguuugagggucaaauuucuaccaggcuuauaucccuggugaugcugcagaauuccaggaccacacuuggagguuuaaggccuuccacaaguuacuuaucccauauggugggucuauggaaagguguuucccaguccucuuuacaccaccggaucaguggucuuucaacagauccuaaagggauggugagagggaaacuggagaaaaguaucagauuuagaggccacugaagaacccauauuaaaaugccuuuaaguaugggcucuucauucauauacuaaauaugaacuaugugccaggcauuauuucauaugacagaauacaaacaaauaagauagugaugcuggucaggcuugguggcucaugccuguauucccuaaacuuugggagccuaaggugagaacuccuugaacuccuaaggccaggaguucaagaccagccuggauaacauagcaagaccccaucucuacaaaaaaccaaaaccaaacaaacaaaaaugauaguggugcuucccucaggaugcuuguggucuaaugggagacagaacagcaaagggaugauuagaaguugguugcugugagccaggcacagugcugauauaaucccagcgcuaugggaggcugagguggguggaucauuugaggccaggaguuuaagaccagccuggucaacaugguaaaaccccaucucuacuuaaaaauacaaaaaaguuagccaggcaugguggcauacaccuguaacccagcuacucaggaggcugaggcacaugaaucacuugaacccaggaggcagagguugcugugcaccacugcacuccagccugggugacagaacgagaccuugacucaaaaaaaaaaaaaagaaguuuguugcuauggaaggguccuacucagagcaggcaccccaguuaaucucauucaccccacauuucacauuugaacaucaucccauagcccagagcaucccuccacugcaaaggauuuauucaacauuuaaacaauccuuuuuacuuucauuuuccuucaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucuucggcaaauguagcaugggcaccucagauuguuguuguuaaugggcauuccuucuucuggucagaaaccuguccacugggcacagaacuuauguuguucucuauggagaacuaaaaguaugagcguuaggacacuauuuuaauuauuuuuaauuuauuaauauuuaaauaugugaagcugaguuaauuuauguaagucauauuuauauuuuuaagaaguaccacuugaaacauuuuauguauuaguuuugaaauaauaauggaaaguggcuaugcaguuugaauauccuuuguuucagagccagaucauuucuuggaaaguguaggcuuaccucaaauaaauggcuaacuuauacauauuuuuaaagaaauauuuauauuguauuuauauaauguauaaaugguuuuuauaccaauaaauggcauuuuaaaaaauucagcaa

SEQ ID NO: 61578 - RNA, 4861 nt, Homo sapiens; identical to SEQ ID NO: 61577

SEQ ID NO: 61579 - RNA, 15018 nt, Homo sapiens
ccuuucagugcagaagcccugggcugccagccucaggcagcucuccauccaagcagccguugcugccacaggcgggccuuacgcuccaaggcuacagcaugugcuaggccucagcaggcaggagcaucucugccucccaaagcaucuaccucuuagccccucggagagauggcgauggaugucacaaggagccaggcccagacagccuugacucugguaagggucacaccaaaguuagggacuuugcacugggagagcagcacccagggcagggcccuugguuuugcagauuaccaaaacuaaggcugggggcagggaaggcgagcaggcuuggggcaccuuggaaggaggcacaugggccuuggggguccuggcuagggcagcugugccugccacuggcccucugcccaccaccccuccucacuguggcuauccaguguccagccucucgagggguucuaggguacuuauuccuggagcuaacggugacccaggacaccaguguccggggccuggccuggggcuuuuauggggggagcuggcuggcugcccagggcugucuggcucucugggggcucugcauggcauuuccagggguugguggaucagggauucugucccucaggagaaugugggcacuagcccaaggccacucacuucuguguacauagccaccugagggcccaggaauggagggggccaggcuacagcuggacaucuggcacucggaugggcucuggagcccccaggccugcagcaucugcccagggacugcccuggcccuuggccauuuccucagggacccacagcuccaccagccggccccucccagugcuggaauagacaguuccucaguccacaucugccaaaggcggcacuagaaggcauccugccuuuuuuacugcguucuggagguggggucacaaagcacugcucacugcauaaaagggacagcauccugccccuggcagcccugccugaccagcuccgccucucccacugcuauccaaccuguacacccuggugaccauguccaggccaguggccuuaaggacugucucuguacugauggcuccacaucuaccucuccagccagacucuccucugaacucgggccucacauggccaacugcuacuuggaacaaaucgccccuuggcuggcagauguguuaacaugcccagaccaagaucccaacucccacaacccaacucccaggucagauggaaccucuucuucccaggcccuucuguuccucuccucagccccucccaccucccuucagaauaagucuagacucuuaucgcuuucaccaagccugcgcccagcaucccugcacagggauuguuaggacagccugacgcccugcuuccacccugccccaagaugccccugcucugcagcccggcgccuccaggcuucucaccuccugcugcucacagcucagccucacucccucccuccccgccucugcuccagccucagugcagguccccugcucccaucuucuggcagcagcugcccgaccuggucccucuucaucuguccccauuccuucaccccccagccuguccccaacuugacugagguucuuuccugcagauccccgcccuugagagggguuggucccacugucaacucugcuucugugcccugugccgcaccuggcauucagugagcaucugcugaagagaugagggucagaugcccugcagggagugugggggcguccucaggcaagaaaaguuguacguuuggcugugggcccugauuauguguccugugaccucuugggugaggucagcaagagaaaccucugcaagcuggcuggggcugccucccagaggcugccagggggagggacaggcucugucugugcucuucuuccgaggcuacaccuggggcgccaggcucucagggcuccccagguaccaccacauuuccuacacugcuugggaaagcccuguaaguuugcacagacacccagcaugaggcucgccagagagauacuuguagcuggggucugggcaccaggaacagcuuggugcugggccugaagucgggcaggaugcagccuggccaggugagaggaaagcuuggagccagugccuggguucaaacuccucuguggccuaugguucugugggcuuggggaaggguuuguaccucuguguccaguuuccucacuuauaaaaaaaggagauaauaaaaguacccaugucccaggguggcuguagcaauaauagggaggggugcccagagcaggucuggcacacaggaagugugcaucagccucagucccugccauugggcuuguccugggagucugugaagccaaccucugcuccacaaugugacccccaggcuugugagaccaagcugggucagagcuuccuccucugggguugcaccaggaggggaacuucugcaggcccagaugcacccugaggaaagggcuuguucccaccaagaacaaggcucaccuuuggaggaugcuccccacaugagaggugaacccccaggucuacuggugacugcagccucggaagcugacagcaucuauccuccaacccaugcccacugggaagugugugagggguccucauaggcccugcgguguggacaaugcagagacccuguagcaucuggcuagggcggggcccagauaagagcccugugccaggagagccuggccgguucugccacuguggggagacaggcucccccaccccauguccccugcuucccugcagcccacagagaauacagaccuacuuuuacagaaauccagauuuuuguguaaaagugucucuauuuuaaguagauuuuaagugguggcagcaaauuuaagcuuuugagaauauuauacagaacaaaucagauucacaggccagaugcaacuuuauuuacagaaaugggaucagguccuaccucaggucccaucucacguuuucacuuaugccuauacgucuccuucacgggaaaggccacaagaggcccugcgguaagugucccgguguugauuuaaaguccccaacagugaauaugaggguccucacuguugcagcaagaggauaccccccuguguaucuuggaaaugccugcagcccucuugcugcagaacagauucuuaggagagaaacugucagaucaaaguuaaacuuagagaaacuccaaauugcccucugaacagacgguaucaguuugacaucauccaauaccgggauuccucggggagaacuuucuggccuagaaggcaguagagccaggacuucacccagucaguggcagggccacacgugggccuugauacagagggggaagacuugagccuccucgacacccuacagggcccagccucccaacaugugauaagagaaacaacagccaacuuguaccuagcucuccuuauucuccaagggcugggccaguucuccccacagcccugcaagggaggaucacucaagggccccaacugucugacaauacagccacacucugaucagccaccugggcauaggcuccaugccauuguccuccgccaagaccucagacugaaauguuggcuccucccaugaagaaccuggggccaaaggaccagaguccagguccguggcugccaggaugggccacuuggagagaggcacaaggguggugccaggcaggugugagggcuggaccuuugcaagagcagcaucacuuuuguugagagcccacagguaucuuauaauuggguccuaggacuuccugccaguagccauugugugcauggauuugggugcuggccucaccauggugugcuggcugcccaugccugcaauaaugacuucuguaagccuuucuucaucugcaagaugggugcugcuggcaccuccuccccggugcuguggugacagggcauagugugugaggcugcuaugugaagcaccuaaugcagggccuggcauauggaggaauucagcaaaugacagaugccuucacaguuaguuccuggcauccucuacauugguggguguaggaaagaaagacagaggaggcaaaaguuguagcuguggggcauugaggacagccuggauuguuccacagagcccugaggacaucuccaggggugugcucugcaggggcagcuggauuggaggguuaggggucggggagggcgugcacucccacccaugcucacagccucggaacagugccugcucagccaacauggguguuugauucugugucuuuugucacagacuuuaucagccccaucccuuucugaccuugccucaguuuaaauuuuacauguggggccucauuaagagacaugguucuuaacuaaagaucuguauccauuaggaaugcuuugggcugcaggaagacaaacaccugacucacuguggcauaagugguuugcgucugcucccauaagcugcacguggaggguggaucuggcauuacucucucuucccuacauuugcaguaugcuaacagcuuuaaccuccagccuuguuucuucaugguugcaggguggcuaucacagcgcuggccaucacauccuuacacagcuguguuuacaaauuuagggggacauugaagcuccuccccugcuaaaaucaggcuucccuucaccugucauuggccagaacugggugaaaugcccaacucuagaccgaucaucaguaagaggaguauagaauugcugugcccaccuuagauuaaucauggcgcaaugugcuccccauaccaacaaaaucugaguucuagaaacugaggaagaagaggaaaauggccgucuugccuccuggcugggauucagagcaucuccaacccucugagcuuauguguaagacugugggcaaaagugugugaguuuuuguggaauggauccacggcuuuuaucagagcaucuuuccuuuuucuuuuugauucaagaugaaaauauucuuaugauuauuuuucucaccacugcccagagauaaccagcacauuaacauggccuuuucuccaugaauagcacuagggugcccaguggacagacacauagcuguccacacaccagcuugcuggggaugcauaggcagagucacaucugcacucacggccuguccucacacugccauguggagagccagcagccacaccaugggccguccaugcucacgggaguggcaguaucagaucugagcuucgugugcccaggcgucucucacaucagugcauagggacccucuuuguucuguggcccagugugcccaugccacagauggcuucagucagcagacaccuccuucuagacacucacacucacuccuggcuggcccuuagcacaccugugcagacaggcccauuuauuuucuuguguaaaucccaaguaggaggacugggucucucugacagcaaugccagcugccuggcacccuccagacagguggcucaagccccaccucgccagcucucccaguuagccccuccuuucccuggcucugaccugagggacgaagcagggugcuacaggacgcugugccacagggauaucgucagggacagaagcuacucugcccucugcugcucaccccuccaacacgcugugggcugcauuuguugaguggcugguaccagacucugcucuucugacuuuccagcugguuuuaccuguaguaaaguuugagaagaugggucauccugaccccggggucagaagacagaaggaggcccauggcgugugggggagaugccccgugaggcccucggugugcagaugccuggugacagccccacccugagguccccagccuacccccuccccagcccgacugcucccaucccccucccugugcagguagagcagauccuggcagaguuccagcugcaggaggaggaccugaagaaggugaugagacggaugcagaaggagauggaccgcggccugaggcuggagacccaugaagaggccagugugaagaugcugcccaccuacgugcgcuccaccccagaaggcucagguaccacaugguaaccggcuccucauccagaagcagcugugggcucagcccuagcugggagaagcaccccaggcacucccagacucacagccagcccgagacagaaucuccuggggagcaaugaaguccucgacuugggccaguucucacccuuggcuccucugguccggcccuggggcacucgggcucacccuggagcuggcaaaccucaggaaaacuggcguuuuaaaucucacuccuggccaggugcaguggcucaccccuguaacuucaacacuuugggaggccaaagcaggcggaucucuugaggccaggaguuugagaccagccugcccaacauggugaaaccccgucucuacuaaaaauacaaaaauuauccaggcaugguggcacauuccuguaguuccagcuacucgggaggcugaggcauaagaauugcuugaacccgggaggccgagguugcagugagccaaaaucgcgccacugcacuccagccuggggugacagggugagacaccaucucaaaaaaaaaaaaaaaaaaagaccucacugcuccccaugggcacuuagggaacucucccagcccaguucugcagcugggccauugcacuagauccucaguuggucccugggcucucggugacuguccagggcaggaguuucccauugacuuuucccugguugaccuuugaccccuuccacaguugacacugguguccccaggugucugguggccccuuguccagcucccuuagucccuugugccuucccuccuccucuuuguaauauccgggcucagucaccuggggcccacccagcccaaggccagccugugggugucccugaggcugacacacuucucucugugccuuuagaagucggggacuuccucucccuggaccuggguggcacuaacuucagggugaugcuggugaaggugggagaaggugaggaggggcaguggagcgugaagaccaaacaccagauguacuccauccccgaggacgccaugaccggcacugcugagauggugagcagcgcaggggccggggcagggggccaaggccaugcaggaucucagggcccagcuaguccugacgggaggugccaccugucuaccagggguggggagagcgggggcuggaggaccacccagccucagaggcagcuggaggccugggugaacaggacuggccaacauguccccaagucccacagucaccaucuggccagcauugagaggggaacgggcugaggaagaguuaguggcaagaggaaccccagccagucacaccuuguccaguuuaccagaggaaaaaccaauguguaagaacagaaaugugacccggcagccagugcacugccccccucuccaaaggccaccccucacccuccaccagcaugcacagaaaguggggugacagcaaucacaaugucuacccaggcagcaaggaccccugaccauggggaggacuggggugcagggaacauagaagcagaaugaggccuagggggaguugggcaaggccagagcccuagcugcagccaagcacauggccaaggccagcuccuggaagggcagggcuccgaggcaggaggcaggaggcugcccguggcuacccguccucacaccccugcagcuugcuagucugucugugggcugggugugaaucaaggcagugggaugguguggggaccucccuggccccagcagccagugaggagccuggucagucagcagagcauucagcaguauccaguuccauggagaggcccgugugaggggagucggggcuggucuucaguaaggauggguggccagggccccuagaaguagaaaaggagacuccgggugcuggagacagaaaucaaggaugugccuccauguggagccucaggaauagcuggccaggccugaggcugaaccucacaagguucagcugggagggcuaggcugacagagcacagccgggccagggaccagccugcccuguguugccuugucccgagggccacugucagcaggucucuggcaugggggaggcuuagggccugagcccaacaagcagcagcggaagaggagagggaaacuguggacaggccuggcauucaguggccagguguugcagugucccugaggaauagcuuggcuugaggccguggggagggcugccggccagcgcacccccccaugccagauggucaccauggcgugcaucuuccagcucuucgacuacaucucugagugcaucuccgacuuccuggacaagcaucagaugaaacacaagaagcugccccugggcuucaccuucuccuuuccugugaggcacgaagacaucgauaaggugggccggguggaggggcagaaggcagaugaggggaggcacaggcaccccagaggaacucugccuucaaauguagcccccauaccaugugcucagaagggagaucuggauucaaauuguggccaugucaccugccaccucuaaugcuguggaaaagaagcaucacauuagcuaauucuggcugugcgccuugugaggcaccagcuaugaucaccccacuccaguggaaagagcagcuggcaguaggguggggcucaaacucaggcagccgggcucugggucaccugcaggccacggucaugucacacugccucuagcugagucagaaaugugaaggaacugagauucuacccuuccugcaagcuagcaaaguggccugccaguuacaucugugcaugcacacacacacacaguuauauaugcacacacauaaaacacgagaccuuugggucagggagaaagccagauccucacucacggcagaagcagcagccaaagcaacaucucaugugguuuuccaagccccagucccuacagagacagagagggccagguggcaccugugcaugcagcgggguaccuugcaggagggaaauccugauuuuacacaaagcugcuccccccacgcccugccuugacucugggaugacgucucagagcugugcaguacaacauucuuaaauuggcugggacucagcccugcagaaauaugauaucuucaaggagaaucguucccaaaaccucucaaagcuauggggcugcucugagccuguuuccucagcuguaaaguagggugcauacuuuuauggcccugugcaggagguagugacaggcccuagcacccugccuccaguauauguuagcagccacgaggccuaucucuccccacagggcauccuucucaacuggaccaagggcuucaaggccucaggagcagaagggaacaaugucguggggcuucugcgagacgcuaucaaacggagaggggugagggggcaccuguaccugccgggggggcugcccugggccacccaccccagcacugccugccuuucuccuuggcuuccagcacugcagcuucugugcuucuuggcaggacuuugaaauggaugugguggcaauggugaaugacacgguggccacgaugaucuccugcuacuacgaagaccaucagugcgaggucggcaugaucguggguaagggcuccuugcaccccugccccuuccagacugcugaggcucccuguguacaacaggcuucaagggcccuguggggugaggaccaaacuacuuaacaaccggugaugucagagcagagccuggugcuacagccuggguggucuugggguaucaagauggaagcaccguguacaguaggaagcauuucaacgccaugaugccacauuccugcaucagaugguaugccagcugcauauccaccucacccaucaggauuauaauuaaaacacuuaucugguaaauugaccaacuggacagauugguccaaguggaagaggauaagcaaaagugguaccaucuccacccgaauggucuuuccacgggccugccccugccccugcccccacccaaagugaaggcagguaccaggaaagggagcagcaguccgccccucccagcagaggggucuuccacaccaacucggaccuuucucagaaguuccggaggucauuauaaccagccuucacugaggagcaauccaaucagaucaguuaucugcugugcgcacagccgugugguucuauacuucucuuacuuccauuuucaccuuucagaaggaacguugucuuuaaauccagcaucuaaacgugagccccagccaucccuggcugugauccccccagcccuuuccacccuauccucuggaacugccuggggcuccccaagacacuuccacaugaauucccaccaagccaagcugcagcugcugggcccaggcauaaccccuccuggggcagagguggcaaggagugacccaccacucacaucugccccacauccacucuugacucugcucaguguuuaaaaacauguuuauaacaauuaccaagaucugaaaauuaggagaauucacaucaaagucuggauuucuguuuguucauaaaaaacuagaaggcagccaggcaagguggcucacgccaguaaucccaacacuuugggaggcuaaggcaggcgggucacuugaggucaggauuugaagacuagcuggccaacaagguguaaccucgucucuacuaaaaauacaaaaauuagcugggugugauggcgcaugccuguaaucccagguacucaggagacugaggcaggagaauugcuuaaacccuggaggcagagguugcagugagccaagaucacgccacugcacuccagccugggugauggagugagugagacucugucuccaaauaaauaaauaaauaaauaaaaacuggaagucuaagcaucacugagcccugauuccuauguggcagcucgacugaccagcauuugaguugcugucccugacagcuuugggggugugcagcccacacagucaugcuagcuugaggcucugcugucagcaguuugaaacucuuaauaacuugugaacaaaagacuccauguugucacucugcacaggggccagcaaauuacaaaauuccauauccggaauugucuacaggagccucugggcugcucccaagggcccacaccaugccuuacucacuuuggguugccauccaaacaugucucaugacaaagaagcucaaacaugugcauggacagugccagaaaacaagggucguacauagacaaaauaaaaugauaacgucccacaaccauuucuuugauacacacuguuucucucaguccucccaaccaccuagguaacaggcagggaagguguuacuguugccuguuaggaaagaggacagcccugaaagcugucccuggccacugaagcaacccaggucuuccagccccagggagagccgccuuuccauuguuccagacaaagcagagacaggcaugggggagcgggagagggacuccugugggcaggaaccaggcccuacuccggggcagugcagcucucgcugacaguccccccgaccuccaccccaggcacgggcugcaaugccugcuacauggaggagaugcagaauguggagcugguggagggggacgagggccgcaugugcgucaauaccgaguggggcgccuucggggacuccggcgagcuggacgaguuccugcuggaguaugaccgccugguggacgagagcucugcaaaccccggucagcagcuguaaggaugccccccucccccacaacccaggcccugggccgcucuggugcagcggcagaugggagccgggccauugcagauaaugggcuuguuuuuaaacaacucuggggaaaagcaaacugacaauccguucguaagcuccaucccuucugcucagucaugaccugccccugugagagaugaaggguuagucccaguugugaugugauaagcccagaccucuuuccuuccgacaggugaucgugcaugcagaggaggcucugagacgcccccagcaagguuccuggguuuaacccaacauuccccaaaguauguauuuggccacauucacagaaagaauauuagucuuuuguggaaugcugcggguugacagucacagcuuggaaaccaacccacagagagcucaucauuaaucauggcuaucacuuguuuaccaccuacugugccaggccuaugcuaauuacuuuauuagcguccucucugccgcucgcaggccucuauuauuauaggucaguaguauucgauuuauuuaaauuaaauacggaaggucauagauuaagcaagaaagugccagcaacauggugcgugccucugacugggcacuaacccuccaagucuuaguuuucccaaccauaacuggccaaugaacagcagcucuggaugcagcuaaaggaagacugaagcuguaggucccgugcucggcgcagggcccccugcaaggaagguuucggagggacuggauggggucuuugaacuaucugucuuucccuuuacugcagugggcccaggggcaggccaaaguugcucccgugauugacuugaacgugcacguuccuaaucccugacauuucuaaagcucuggcucauuaacgagggaaagacgugaaccagcugggggaguggggaucgcagugccccacguggccgccucgugaccucaguggggagcaguggggccggcucccggcuuccaccugcaugaggggcccucccucgugccugcugauguaauggaccugcccuauguccagguaugagaagcucauagguggcaaguacaugggcgagcuggugcggcuugugcugcucaggcucguggacgaaaaccugcucuuccacggggaggccuccgagcagcugcgcacacgcggagccuucgagacgcgcuucgugucgcagguggagaggugugcggaggaggagggugggugcaaagggcaggggcuggggacgcccgggcacugcagacuuggucucagggcgacgcugagucccaggcccggggcgcagggaugggaaacuagggccuggggcgggauuccgggcgugggcggggcccggggcggggcacagggggcgggggagugggcggggcccgaggccgggcgcuggaggcgagggcggggcagggacggguccaagggcaggaggcugggacaggacggggaugcaaagggaggggcggggcccgagacggggaggagggggagggcccaaggggaggaggcgggguccggacggggaugccaagagcagggaugggagcgagccugcguccgggcacugguccccauccgugaguccccucggugcucccugcccgccguggccauccucucacaucacucacaaccccaaggcgcggcaugguugacacccccacguuaggacggagacccugggcuuaguuagagggggcaguacuaaccagucccuggcggaaacgcuuuggcugggugaggugagcgggaucgcccccauuucuccagagaggggucccggcucagcgagggaaagaggccgccgcuggggggacggcuggccggggccccucccuggagaacgagaggccgccgcuggagggggauggacugucggagcgacacucagcgaccgcccuaccuccucccgccccgcagcgacacgggcgaccgcaagcagaucuacaacauccugagcacgcuggggcugcgacccucgaccaccgacugcgacaucgugcgccgcgccugcgagagcgugucuacgcgcgcugcgcacaugugcucggcggggcuggcgggcgucaucaaccgcaugcgcgagagccgcagcgaggacguaaugcgcaucacugugggcguggauggcuccguguacaagcugcaccccaggugagcccgccccgcucucucccugguaaaguggggcccaaaaagcgcgcgcuccaagguuccuugcgguucccaagcuccaagauuucguaguccucuucucgucccccuuggccuagauuugggggaagggucgacugcgugcagggcgcccgguaaugaauguggaggaugaggugggaggagggacggcagcccugcuucucuucugcccagcuucaaggagcgguuccaugccagcgugcgcaggcugacgcccagcugcgagaucaccuucaucgagucggaggagggcaguggccggggcgcggcccuggucucggcgguggccuguaagaaggccuguaugcugggccagugagagcaguggccgcaagcgcagggaggaugccacagccccacagcacccaggcuccauggggaagugcuccccacacgugcucgcagccuggcggggcaggaggccuggccuugucaggacccaggccgccugccauaccgcuggggaacagagcgggccucuucccucaguuuuucggugggacagccccagggcccuaacgggggugcggcaggagcaggaacagagacucuggaagccccccaccuuucucgcuggaaucaauuucccagaagggaguugcucacucaggacuuugaugcauuuccacacugucagagcuguuggccucgccugggcccaggcucugggaaggggugcccucuggauccugcuguggccucacuucccugggaacucauccuguguggggaggcagcuccaacagcuugaccagaccuagaccugggccaaaagggcagccaggggcugcucaucacccaguccuggccauuuucuugccugaggcucaagaggcccagggagcaaugggagggggcuccauggaggaggugucccaagcuuugaauacccccagagaccuuuucucucccauaccaucacugaguggcuugugauucugggauggacccucgcagcaggugcaagagacagagcccccaagccucugccccaaggggcccacaaaggggagaagggccagcccuacaucuucagcucccauagcgcuggcucaggaagaaaccccaagcagcauucagcacaccccaagggacaaccccaucauaugacaugccacccucuccaugcccaaccuaagauuguguggguuuuuuaauuaaaaauguuaaaaguuuuaaacaug

SEQ ID NO: 61580 - RNA, 45153 nt, Homo sapiens
gagcaggaaaugccgagcggcgccugagccccagggaagcaggcuaggaugugagagacacagucaccugcagccuaauuacucaaaagcuguccccaggucacagaagggagaggacauuucccacugaaucugucugaaggacacuaagccccacagcucaacacaaccaggagagaaagcgcugaggacgccacccaagcgcccagcaauggcccugccuggagaacauccaggcucagugaggaaggguccagaagggaaugcuugccgacucguuggagaacaaugaaaaggaggaaacugugacugaaccucaaaccccaaaccagcccgaggagaaccacauucucccagggacccagggcgggccgugaccccugcggcggagaagccuuggauauuuccacuucagaagccuacuggggaaggcugaggggucccagcuccccacgcuggcugcugugcagaugcuggacgacagagccaggauggaggccgccaagaaggagaagguaucucgcccuccauugggcauucugggaguguuugcuugccuguccccaacauuccaugguuuguuugagccucagaaucugauuuuaugcacaggcucuuugagaagggucuugccaggggugccuucuggggcaggaaggccccuacugccuggcagacccauccagcuuuggacucugguccugcgacccggaagucaggcugccaagagguccaggcaguggccuccacuggggaggggcucuggagaguuuagagcccuagauguggggguuagggacaugaggucuuguggacaaagcccacuaccugauuuugagacaacacucacuagacauggugacaagucaaagaugccuugccuccuaccaggaaucacuucgcagggagcccgagggcugcuguggccugcugaggagugcagggcaguuacuuuuuccaaaaacaaagagaaauccaggcaugcucugagccagcccugagcccagcagugagcaaggagagagcuggagacaggggacuuugcugugaaacacuggggggaaugugccugcaucaccccagcugggggcccaggcagagugggggagaagggguaagugggcagagccagucacuuugggcaugcuucccucucgccucugugugaaaugaccaggucagcauaaaccccgggcuggcugugcuucuggcagagcuaaugauguuaggaggaaaacaaccaacccaagugagagggugcgcagccagacagcuggaccggccgaggccccaaccaagucccagaucugccugucacuggugcuauggcagcaauuuggaugagaaauccugcccaaagggccccuucaggccacccggggagaaggaagcggcugucuuuggcaugaccagaaagauggcucggagcuagggagagguggacaugugggcuguggagaucuggcacuuuccccaaacaaggagagaaagcauagugugccuaugugugaaugugcuaugugugcauguuugugccugugcauaccugcauguguacaugcaugugcacauaugugugcacagggaaucacuuuaauaaaggccacagcagagcugucccugagccccuugcauucacaguggcaugugagugaaccaccuucuuaggcugggcauccagucucagacucuggggcugcccaugccccauccuuuaucugcuccacgugugagggguugcugguccugaccagggccagcugugaaccccagaauccugggaagucacugacauucuugucagggccaagaguggagcaaggcaaugccucgggcacaaacuuuaaggggucaccagaaacaucaaucaucaagauauaugcuauuuuaaauaaucaaaaugaaugcaaaaaaaauuuaugauggacaacauaccaaauucuaaacaaaggcaggaugaguaucacuggcuucugcacuuuucuccacccagucuaccccucuucuagugccuggaucgcagggugccaaggccuggaugagggaagcguggagcugcaauggccacuccugucugccuguucuggcugcacagaggacucaguccuugucuugggggaaccuaucuugguuuuagggucauccuaaggaucugauguuuuccaagugagcuggcuguccaggcccacccagguucaguccaguccugugucucugggaagugcugccccuaccccaagccaguguuugaccuuggagcaaugagcaaugcccuccuuccacuuucaaaguuguccccaagacgucagcugugguugucucugugcagacaccgaggaggaacugucuucuuucuccuuuugguugcuuuggaggaaaguaaaguguugcugguuucccucuuucuacuucuuugauugagagcagccgucuugccgguaccaaccuuccagaucuuaccugugguugcaggagccuguggccucaguccugugcccagugacuucuccauguggaugucagcuccuuaggggcaagccugauuccacugacacuacucccaccccucauaagccccuucuuaccagcugcaguugccugguaccccaccaucgcugacucauuccuuuggcaucaagguucaucccuuacugggccaccacuucuggguggccugaaauagggcccugggcaucccucuuggggaccuuuuggucuauauuuucacucucaccucacuaaggacagaugaguaaaucugguuaacuuugccugauagauuuggugaccuuuuuucaggaaggagccuggaaagaugagauucagguguauuggucagcuuagacugccauaagagaauaccauccacugauggcuuagaaacaacagaaaucuauuucucacuauucuagaggcuggacguccaagaucagaugccagcauggucagguugcagggagggcucucuuccugacuugcagaccgccaccuucuugcuguguccucacaucguggagagagagugaaaacaagcucucuggugucucuucuuauaagaaugcuaauccuaugaugggggcucccccuccuuaccucaucuaaaccuaauuaucucccaaaggucucaucuccagauaccaucacacugggguuagggcuuugacauaugaaucuggggggacacaauucaaucuguaacaccaggagggcaugccgggaggaacugaccuuccucccuccagcugcccuggacaccuuugccccauugaaggagcaggcucagaaguggaaugaggauggaauaaggugcacuccaucaugcuuacccacaucccuggcaggaauuguccugggccccagcaggagagaugcccccccauacugccauggcaccugcucugagacaggugugcagagugcaaagcuccagguggcccccaagcaggugugcugggaggaggggcccgugugggaggagcaggcagcgccaaggccuagcggagcagugacaggucccugacuucagggaaugggcacgcugugggcaggcagcuggugugggggugagggcuggggcugcaucugugggaccagggcugggccauccaucauaugccgugucacaaccccagugccccugcuguagccaggacaggaggcugggccaggcugggaggugacaagagugggggcuguccccaggagaagcacucugcugccugugcccaggccucuggggaugaggaccccucagaaggaguagcuaugucuaggaagccccagggcaggagcaagccaaaggggacaucauuagugagauccaggggaucagugggccacagaagccccagcgugagccccucugacugaugcagcuaggcccacaccugcaccugcccacagcaagacccccaggaggagaggggacagauggagagaggcacaaagugccccuggccucugccuugaagccaccccaaggcaagagagauuugagccccuguuuagugaccuccaggggaacauucuggcccaucugaugugggaagccccuuguggagucugucauuccucagcugagccaggccuuuggaggcagcccaggcauguccccugugugcuccuaucccuguguugggacaccuggcccagccccuccuucugccuuucucuucccuucccuucucaggaguggacacuuccuccuuuagcccccucacagcugugugaacuucucuguaucucucucuuucugucucuuucucccccucucucucugucucauugucucucugugugucugucuguaguauucucucucugucucugucacucugucucucucucucucugugucuaccuuucuguauuucgcuuuguuucuuuuucucuguguguguguguguguaucuguuuuucucacucucucucugugucuaucuuucuguauuucgcuuuguuucuuuuucuguguguguguguguguauaucuguuuuucucacucucucaaucucucucucucuuucugucucucuuuugcuggccugagcaaagagggagccccauccugaugcuacauaaccgugaaccagcacagacagaauuguaggaaaguccugcaaguagaaggauagaaggaugagggaagaaacgccaugugagucaugacagaucccuuuccaggagccacugacucacccugccuccugcccucccacugugacacuauuacucacagacaggcccggauuaaaccuauguuccaggugcccugugguucccacaguguggcucccugggucuggccucaggcuccacaggugcccagcccugccaaagucuccagagcagcuguccagcuggggagcugcggggccccuucacagagcgcaugggaagaaguuccauccuacacauuacaucgagagggacgugccugagaaggggagcuggagcccgugcagcccccugcuugcgugcagaacauaguguacccugagcaugccaugaaaaacacaaacgcacaaaguuguaaagaaaaaagaaaugacagguggcuguaaaaucaguuauagcccacgagaggcccacuaaugaguggugauuucagcugauuacaaagaaaugaugguguuucuguaaugaacuaaacaugcacucgugcgugcacacacgcgcacguauagucacauaacugaccagcccuaugcaucacuuguuaauuacuuaguaacuguaacaauaauaguuuccaauaagugagccuuagucucugcgcaagggucaguuuauugagcacacgggggccuugcagugggggcaggugaucugcuccugggagccgccagccucuccucuccugcucuucaucuuccuccguggugggaaauugucucacugcuucuacaccugaggcugaacaucucccuuuauuucagucugaaacacauguaaaaauauacuggaaugaauuaagguugcaauuauugauaucaggcagugaguacaucaggguuuauuauacuaucuccuuuacuuacuucgaaguucucuauuaccaaaaaauuaaaaacuauaaaagaaagaaaaaggaaaugaggcuagauucaacacagauuacucuuaccaaacccuucguagucccaggaguccccuaacacaagcacuugugaccuggagugauauucacagcauuccuuaccuggcaauaccugaguauuagcccccccagugggaucuuuguuguagacaaccagcaacuaucagcccagccaauaaacaaguaggaaaggggagugcuggagaggccaagaagugggauuuuccaugcuccugggcugugauccagagggcacggcugugaggcugaucucaaugaacacucugucuuggaaguacagggauccucugcuaccugaaaacguucugaguauucacuuucauggauugcaaagucauuuacccaaaauucacucuccaaaugaaaagugaguaugaugaaucaguauucaaguuccaccuggguccugggagagggcauggacaucauaucccagcuguuccgacaggaggacccaaucugagucucacugccugccugcaucguuugucugcugccagccugcacaguaggaagggaaaacaugauuuguaucuguuuuaggucagguucccaagaaguagagccugagauuggaauucuuggaaaaugguguuugcgggagcgcugucagcagaagcuauaaggaaguuggggggacagaaaacgagagguaagaagccagucaaaaaggcagguccagcuuaaguccgccucagucugguuccacaagggcucugaugcaugaagaauaucacaggguugucccuccugggagaggggccagccuauuguaccuguaucaaagccaccagcugagggccaguggggagggaagaucuuccaggcauuuccaggaaacucucaggagaaggguguagcugugagcagucugcagcugcugcucacugcggcuaaaggcugggugugcaggccagucagccagugaggugccaacagcaggcacuacaguccaccccuugacugcucagaccuacugcuuuccacuuuaagcucucuccauccaggcacagcuucagggaaaacuuacaauuggagaaacagagggaugaacuacaaugcccacuucugcaugugauuguaagacugucacugauacucaccaucaugccccauccccaccauccauucuaguguccccuuccccuuggcuaacacugcuggucuaggugacuucccuagagcaggagccaaacccuuaucccugaggcaucugaauccuggauuccuuuaucaggcuauuguuguuguaaguuguccauucccaauuacaacuggacaugagacuaccaagaaacacccuggcaaaucaucugagugcaagccauauucuuccugcuccauuauguagcgguaguccuaccuccuaaugacaaggguaaauugccacauuuugcuccuugugccaggaugguaauaccuuucucuaccugcuuggcuacuggcacaaggaagcacagcaugaccaggaggcaauuguagcuguacauuuagugaauguguuaauguaucaccugguggaaggacccccucugagaaccaggacuucuagacccacaaaaccuaaaguugugaauggcggaagcacaaauuucccaaguggaucauggagagugaugaagaguucuugguucccaaacccacauauuuuaccuuucaggaacauggccucaucccauagccauuagagugcauauugcauucuggaggagacugggcccuccucaugggugucaucuucaagaugacagcuccacugugccuccaagaggaugcuccaccacccuaucugugauuccuugguuagcaggacaggcugcugcacugaggguaggaaaggcaaguccauugauggcuggaauacaugucaauccaagucaagagaaaaugccgcccuuuccagguuggaaggggcccgauuuagccaacuugucacccaguaguggcugguuggucuccuccaggagcaguguuauaccaggaauucagcaccagucgcuauugcuggcaguucuuacauucaacagcagcaaaacuaggucagccuugaugagagggaauguaugcuucugggcacaggcauggcuuccuucucugacuccaugacuaucuauuucugagugcaugguggccgacauucagcugccugcccauccuauccacuugguuauuauugccucuuccacaagaagugguuucuggcugucauuaaugucucauacuuugugcccacucacacagguuuagcucuacaacuuuuccccaugccaccacuuuuccacaaucuucuaauguugcuccuuccaagcuacugaagaacgagcuaagcuauucaccaauguccaugagucuauauuuaccuuaggccacaucucucuccacacaaagugaauaagcaggugcacccuccaaaacucuacuaagaggauuucuucuccccagugucuuucagggccaccuugaguggggcugaaguacagcagaaguccauuuccagcuugcaucaacauuccaaacuaaccuauccaugaucaaugcauagauggguuuuucccuccuccagcagcuagacaaaagacaccccccaccaggaggccauauuugcaugugggugaaagagaggcacaggggccaauauucgugcaacagugguagauggcaggugggucugggccaccugucccugcagcuuaucugugccaucuggaccugcucaagccugauuccagauauaccauuuccaucuuaugauggauggcuuaugaccuagugggucugacagcaccaaacucauaaugggcaguuauggccacauggucacuuaauguccuauggucagacacucugcugaguggcaugccaggaaaugcuuuacaagugguguuugguucucugcugcagauggcaugaccuugguccggagcccuagggguuuggacagugacuccuguuggggccuaaucucacauuccaugcagaguaucaucagauuugccaaucacauagccuaagggucaggacugauccaaccaguuuuugcagagaucaaacuggagaaugaaagguugauaugaugugaccaucauaucacguuuuucucucuugaaaaguaugcagaugucugaaagagacaagugccccaggagaaaaugcaugccuuccucaggaucggcccccaccuccccuccuggccacaaggagggucaaaucucagcauggcccaacuuggaccugucaaggaagaagaaaaaaauuguaugccaaaggaacucagucuuuggcuaacaaguacuagacauccuuuaagucuuugagaaugguaauaauuucugccaucccuccagauuuguguuuuucuguuuuggcugggugggaaugcagcauuuucacuuugccuuuguuauuacaaauguugcuuauucuauaaaucaaggaaccauuguaagggcucuucugaugguuaaguauauccauuccaaugauuuauucgggauccaaggaaaugauuucugggugaauacacagaacuaguggauccaauuugagacauaccugggccagaacuauauuugucgucuuaccccaauaagccugcacucuacuaggacagccaugacagcacuuugggacccuagauauaagugugaauugcuggcugggcaugguggcucacgccuguaaucccagcauuuugggaggcugaggcagguagaucaccugaggucaggaguugaagaccagccuggccaacacggugaaaccccaucucuacuaaaaaauacaaaaauuagcugggcgugguggugggugccuguaaucccagcuacucgggaggcugaggcagggagaauugcuugaacccaggaggcggagguugcagugagccaaaaucacaccacugcacuccagccugggugacagagcgagauuccaucucaaaaaaagaaaaaaaaaagugugaauugcuaugaaaucacuaucaaaagaucugaguguuacccuuacucaguguggucgaauauaaauagccauagguuccuguuauacacacuugcuguggugcuacagagucuuuccucaugggaacccagucccucuuucagucaauggguucugguucgagaacuggcugagguuuggaaacugugccuuuccaucauaacuuuccacuggggugacugaccuuggccuucuguucauccuuucuagccccuaagaauccaacacucuauuagccuucuccuuagaccccuauaagcuaaucccuucuaguuguuagucugaccuuggugcccaauaugauaauuauucccacuuugcuucugauaugcuucuaagugcugccccuggucucugcccuuaagugaucuaucauccccacugccauuagggggagaagcucugaaaaagaguugucucccaucaacucuggucuacaaaggacagcccuacugagccucagccaugugcccgacaccagcagauucuuuacagccugggaagcagagugucuucccugccuuuccagggaacauagccagcuuacaggcuuuuugaucuuauagaguaggucaguuauauuuugccccauuucuuuuauccuuuugaucacuuccucuuggcccaccauguaaacucaagcaucccugcuucauuuaaucgagcuguugcuuuuucuaagcuaccaagagcaaccccagcaauauaucagagcccucucuugggacccuugcuaggguguuaaauccugcaucauaggagaaugcccccacaucagcaaaguccccuuauccucuugauaucccaccugccccaguccagcaccuucaggaucuggucucaaucacaggauccagcaccuuugggacuguugcaagcauaagauccagcacuuuugggaucuagucucccacuuccugcuaguacuuguuagccaaagacugaguuccuuuggcauacaauuuuuuucuucuuccuugacagguccaaguugggccaugcugagauuugacccuccuuguggccaggaggggagguaggggccgauccugaggaaggcacucauuuucuccuggggcacuugucucuuucagacaucugcauacuuuucaagagagaaaaggccuccuucucacagcaagacuacuucuguagaugcagguggcucgugggaaucuggcaauucaaaauucucaaguguacucacuagcacauuagaaaaccaguaguacacaucucuuuccaaaucuucauucagugacacuaugucaguagcuggaaaugggccaugguggguguauuuaaaccaugaaaaucagaaaaugcuacaaaccagggcaucccgcaucucuagacagcagauuguuggccauuucccagcauaccauuguguauacuccuucccaucagggccguggcuugccuugguggaggacucagcccuugcugaaguucugcuacugcucuuacaauugaguccuaugccuggucuccagcucugccugccucacuacaggagacaagcaucucuuugaacacugccgagaagacccucuggcucucaggcuuggcuuuaaaucgauagaccugagccugccauuuucucuuuuccaugcaucacuccacugauccacaggucucaguggcauaguccuucggguuagcaucucccccacacccucggugccagagacacugaguaagaaaguaccucccugucuacccccauccccgcuccccacaggcagggccuuggcgauccacugcugcaaugugccagagacugucaguacuccuaccaccagugagguggcaaccagcugggaagugauccaacuccagagucccgcccucauaggcugauuucuaggaccaccccugguauacuguguuagguucuugaagcagagccugagauaaggauucuggcaccugugauugagugggagggugcucucaggaugagaugggguagaaauaggcaaagguacagauucagcagcaguugagccucagucugacccagcagggagcucucaaaugugaaugacaucacagaguugucccucugaggcaggggccagccuuugugcuccuacaugagucagucacuggcuggaggccccuggggaaaggcuagggcugccagcuuuagcaaauaaaaaauuagggcacucaguuaaauugaauuucagauaaacaacaaauuauuuuuuaguauaugucccaaauugugcauaacauaauguguuuucuccgccagcccugggaagggcguaacuucccagguauuucuaggugaaguaacuuuguagaucaggaguaagucccaggaaagaaguccagcucuucucuucagcccugggcagcuggggguaggcacaggggcccagcaggcacccauagcaucuccuacagcaucugaaaugaacagggucaucacguacuacauacaaauguacccacugcugaguucuucagggauuauaucauuagguacuugguauuuuaaauacauuacauuaugcagaaguccuuuguggauugcuauauuuggagaguuuugugauauuggggggauuagauggaguuuucagaugggcaucauacgguuuuucauuuaaaacccuagaguauuguaauccuagggagugauccugcgauuaguaaauuagcucuccaauagauuuucaaugugguugcaaaggacaugcaugugguucacccucccaggaaauccagaagggcagcauuggccugaguggccugaguuuggcugguugggcugguaaugcuggacaaagacaauggguggaaugguuugcuucccucaguccuuucagacacagcccagcccaccacgucaagccagugggugcaucugcaaccaauccccaugagaacugcagccucucagaggugggcaaguuggcccgggugggucaggaggaucagauguugaggaaaucuuuggauuggaggcaggcagagcagggaagcaucgggugauucuaugacagacccagggcuccaagcugcaguucaggaggggcacuggcacggccucugcucaacucccccuugagugacaucaggugaagugccgacaacacagaaggcagcaaaugcugccagucaggucugcuucccaggacagccaguugcuaacccuucuccagcacagcacuggauuuuggucaccuggcugggagcuccaccuccccagcugcugccucaccugcuuuuccaaaccccacccuguaaacgguaacuacauuuugugcccacuacgccucguuuccaucucuuuggagcaccucucacguggagcugaacagaacgaccuguuaagcccaccgugucuguuaggguugucuaggcuguaucagauacccaacuaaaacuggauucaccaacagguauugucaaagcacauaagaaagaguccagaggcaggcagcucucagccuggugucaggcucugggucagcuuuccagauucucuuaaccuuccccacaucugccagaugccgccacaggcacaggagguacaaacaaacccaaaaauguucuggaaacaagaagggaaggggauccccaccauaucuccccagaggccuuccuucucacaucucacuguacugaagccagcucuagcagaagacagcagggugaauuuguccaggguauucagcccccagugcuggguccauuacuacuugaccccugaauaaaacagagguuccaugagcaagaaggaaggggaacuggauguuagagggcaagaauguauccaucccaccccuaggagcacgcauggacaacugccccauuuuugcuccuauugcagcccaggggcuagcccagagaccuugccagugcugagucacaagaugcugggaaagugagaccagagccuggucuuggggaacagcucaaggccgcauuggucugcaggucauagagcagcugcugagcagugagagcccacgaugggccaggcccugggucuuggagaccugaaugagauagacuggguuccuguucuccugggcauugccucuuagagggcaaagacaauuaacaauaaacaaauagaacaugaaguguuuuccgauagugacugauauacuuuggauauuuguccucuccaaaucucauguugaaauguaauuccuuauguuggagguggggccuggaaggaggugucugggucaugggggcagaucccucaugaaugguuuagugccauccccuuggugaugagugaguucacgugagagcugguuguuugaaagagccuggcccccucucauucuccugcucccacucuugcaugagacaccugcucccccuucuccuucugccaugauuuuaagauuccagggacuucacaagaagcaaaugcuaacgccaugcuucuuguucugucugcaaaacuguaagccaauuaaaccucuuuucuuuguaauuuauccagucuuggguauuucuuuauaacagcacaagaacagccuaauacagugaugcucuccaagugaccuuugggcugagaccugaagaagaaggggaagcaguuaggucugauagcucaugccuguaaucccagcucuuuaggaggcugaagugggaggacugcuugagccuaggaguugaagaccagcuuggaaaacauagcaagacccuggcucuacaaaaauauuuuuuaauuggccaggugugguggugcacaccuguagucccaccuacuuggaaggcugaggcaggagcaucucuugagcccaggagguugagacugcagugagucauguucacaccacugcacuccagcuugggugacagagcaagaccugucucgaaaaagaagaaagaagaaaguaggaagaagaagaagaagaagaagaagaagaagaagaagaagaagaagaagaagaagaagaagaagaagaggaagaggaacaagaacaagaagaagaacaagaagaacaagaagaagaacaaggagaacaagaagaagaauaagaagaagaaggagaagaagaagaaggagaggaagaagaagaagaggaagaggaggaagaggaggaggaggaagaugaggaggaggaagcagaagcagaagaaaaagaaagaaaagaaagaaagagaaagaaagaaaagggaaggagggaaggaaggaaggaaggaaaaagggaaggaaagggaaggagagggagagggagaaggaagaacaaagaagaaagaaggagaagcagaggcuugugcuggauagccuugcuuuugccaaugaccuugcugauuuucaggggguccuggugucuuaguccauuuguguugcuguaaaggcauaccugaggcuggauaauuuacagagaaaagagguuuauuuggcugagaguucugcaggcucuacaagaagcauggcaccaaugccuacuucugaugagggccucagucugcuuccacucauggcagaaggugaagcagagccugcaugugcagauaucacauggugagagaggaagcacgagggggcagggaggugccagccucuuccuaauaguaagcugucuugagaacuaauagaguaagaaauaacucacacccugcccccaaggaagggcauuaaucuauucaugaaguaucugcccccaugacccaaacaucucccauuaggccccccaccuccaacauugaggaucaaauuucaacaugagguuccggugggcaaacauccagcuauaauacugggcaaugcugaccagacucuuccccucucaggcccagagcuccuuggcccuguaacaacagaaaauugcguuugagugucaagauuuuuccuuuaguccccaugcagcuccuuagaaugagguggcaucuucucccuuuucauaggugaagaaacagaagcucuggaggaacgaaucauucauccaaggucagguagcuaguaagcgucccaccagcuccccagaucuccuguuuccugucccaagucccacugagugagcuggaacaauggcuucacuggcaccugccgggaaugguggcaggugccuauaaucccagcuacucgggaggcugaggcaugagaaucacuugaacccgggaggcagagguugcagcgagccaagaucacaccacugcacuccagccuggauaacaaacggagauuccauuuaaaaaaauuaacauauaauauacauacaguaacauucacuuuuuaaguguacaguuugaugaguuuuaucaaauguauaugguuauauaaccaccaucaccauuaaggcagaaucuucccaucacucaaauaauucccucagccccaccucuugcugucaaucacuucucccacccuagccacuggaaaucauucaucuguuuucuguccccuugguuuugccuuuucuagaauguucuauacaugagaccacugagaauauagucuucugugucuggcuucuuucacuuaacauaaugccuagcucagcagugugucaauccucccucccuugccauugcugagcagugaguauuccacuguauggcugugcuacgguguguucauccauuuauucauucaccagcuaaugggcauuuggauuguuuccaggcuuuggcuaugaugagugaagcugcugugaauguucaaguacaagucuuuguguagacagggguuuucaauuggcgggauaaauaccuaggaguaguaucgugugguuaagcguacguuuaaacuuagaaaaacugucaaacuguuuuccaauguggccuguaccauguugcauuuccaucagcaguguuugagaauuccaauugcuccacauccuccucccgacacuugguuucacccaucuuuuaaauauuagccacucuggugacuguguagugauaugucagugugguuguaauuugcauuucuaugauugacuaauaauaauguugcagauauuucuguaugcuuagugggcauuuuuggugaguuuuuaaaaauuggguuguugucaccgucuuauugaguuggaagaauucuuuauauguucuggauguuuauucaugugugugucugcuaagaggugagacugguucuacccugguccuaacaagcacccugggccugcaucccuuuuugugucugugagcugggucugcagcccucuccucccacuaccuacugcccagcaguaccccucacccaucacuguggcuccugcaaugacaucucagccugucucucccucccuccagcuagccagaggcaggauggcucagugacacagggugggcccugaagacagagugccaggguuuggaccuuguauuagcaagagucacaagggaaacuuacuuuaucucuccauagcucuguugugaggauccaauaaauuaauccauagaagagcuuaggacagcaccuggcacaaaguauacaugagcuauuaugauguuauucuuccaacccauuguuucuguguugucauaaacaugaaugcaggacucagugucccagcucugugucccucgcauacauucccuaacagcccacaggucuugccugucaccgccucauucaauaagugaugacucugccucuuccuuggcuggggccuugcauuggacauuucuguauccauauuuguuuuuuaaaaacuagcuguuggccgggcgcgguggcucacaucucuaaucccagcacuugggaggcagagacagguggaucaugaggucaggaguucaaggccagccuggccaacauggugaaaccccaucuguacaaaaaauacgaaaauuagcugggcgugguggcaugcaccuguaaucccagcuacuugggaggcugaagcaggagaaucgcuugaaccugggaggcagagguuguagugagccaauauagcgccacugcacuccagccugggcaacacagcaaaacuccaucucaaaaaaaaaaaaaacaaaaaacaaccuagcuggacuugacacucuuguuagaggaagauuuuuccacaucuguuaacuuuucuucuauuguuauccaucugugcagguuuuucuguccuccugagucauuuugauaauuuauauuauauuuugaaaaucauccauuuccuauaguuguuuauuagugucuucucuguuauauuugaucagauuaccaaaucuugcucauugauugcccauuuauuuuauuguguuuauuuuuuugagacagggucucacucgacagcccaggcugaagugcaguggugcaaucauggcucacugcagccuugaccuccugggcucaagcaauucucccaccucagccuccugaguagcugggaccucaggcacacgccaccacagcuggcuaauauuuuauuuauuuauuuauuuauuuauuuuuguagagauggggucucacuauguugcccaggcugguuucaaacuccuugguucaagugauccuccugccucagcuucccaaaguacugggauuacaggagugagccaccaugcccagccccuauuuacuuuauaguaagugccuucaugggcauaaauguuccucugagacagcuuuggcuauuagccauacuuuuaauauuuuguacauucaugguuauucauuuauaaauggucuguaaugcaaugcagauuuccccuuuggcccaaaugccauuuacagcagcacuuuucucuuucugagcagacagaauauuuugguuuccccucuguuguuuauuucucgucugccucgccucauuugcuagguguucccuuggugugccuuaaguaugagccacucaaauauuuguguuucucuaaacaccccugacacuguccugcugguuucucuaucuggaauauccuucccuucuuggccaguucccccuagugcaucaaagaaauccugcucuuuugccuucagaaaacaaaacaaaacgaaaccuaucagucuccuuauguccccaaagacauagcuuugcugguaucugguuguauugagcuguucauuugucucuucugcuagaugguaagcuccuuggaaacuaaaaacuaaucacuuuucuaacuucagacugagcacaaauuagguucucaagaaacauugaauaaugagugauccgguauccccuuccaacauauuuuuggucauugauaccaucauucugaguaguuacuagggaacacuucacugcaguaaccaauacagcaaaacgugaaauacaguuacauaguagaauuguauuucuugcccauauaauagucaagugcaguucuucaucagcugggagguucuccuccacacagucauuuaggaauccagggaacauagcagagguugcuagcucuagacccaaacccauguccucuuuguccacagugaggacaaugccagcaacagcuggccagcuguucuguaguucucagccucccucgcagugagaugucuccaugcaauuucaguggagcaacauauaccauuuccauuuccagguguaggcuccuaagaagaggguggcuucuucauguucuuucucaccuuuccguaggcuagcugcagauaaugaugaggcuuuagggaguggguggagccauaaaguagaagccuggauuccuaaaugacggugugaaguguucccuaauuucacguaauuguuucuuaauuuccuguuuggguuauuuguugcuaagguauaaaaaaacccugauuuuuguguguugauauuugugugcugcaacuuugcugaauuagcuuauuagcucaauuugaucucagauauuagcucaaauauuuugggagauuauuuaugguuaucuacauaagaucaugucaucugaaauaaagauaguucuauuuccuucuuucuaucuuaguccauuugggcugcuguaacaaaaugccauaaauuggaggcugagaaguccaagaucaaggcccaagcuaauucacugucugaugaaggccugcuuucugguucauacauggcaccuucuagcuguguccucacaugguggaaaaggcaagguagcucucugggauuccuuuuuguuuguuuguuuguuuuguuguuuuuguuugauuuuuugagacagagucucacucugucaccaggcuggagugcaguggcacaaucucggcucauugcaaccucugacucccugguucaaacgauucuccugccucagccuccugaguagcugggauuacagguacccaucaccauguccagcuacuuuuuguauuuuuaguagagacaggguuucaccauguuggccaggauggucucgaucucuugaccucgugaucugcccaccuuggccucccaaagugcugggauuacaggcaugagccaccgugccuguccuccgguauucuuuuuauaagggcucuuuuucuuuuuaugugggcucuacccucaugaccuagcaccuucuaaggccccaccucuuaauaucaucacacagcagauuuaauauaugaauuuugaggggacacauucuuuccauagcacuuuccaguauggauaccuuuuauuuauuuuucuucccuaauugcuuugguuagaaaugucuucccuaauugcuccacuacuauguugaaaagaaguggcaaaaguggguauucuugucuugcuccucucuuaggaagaaaguuuaagucuuuugccauuaaauaugacguuagcuaugggguuuucauauaugacauuuaucauguugaggaaauuuucuucuuguuucaaugaugacaggguguugaguuuugucagaugcuuuuucugcaucaaucaauaugaccauguaguuucuuuguuuuauuccauuauuguaguacauuacauuaauuuuugcauguugaacuauucuuguguuccugggauaaauuucacuugguuaugguguauaauccauaaccauaaccugaagauaugcugaagaggcuaagugccauggcucaugccuguaauuccaacacuuugggaggcuggugugggaggaucaccugaaaucaggaguuuuagaagagccugggcaaguaaacaagaucccaucucuacaaaaaauugaaaauuaccgcugggcaugguggcucacgccuguaaucccagcacuuuggguggccgaggcaggcagaucaccugaggucgggaguucuagaccagccugaccaacauagaaaaaccccgucucuacugaaaauacagaauuagccaggcgugguggcacaugccuguaaucccagcuacucaggaggcugaggcaggaaaaucacuugaaccugggagacggagguugcagcgagccaagaucaugccauugcacuccagccugggcaacaagagcaaaucuccgucucaaaaaaaaaaaaaagaaaagaaagaaagaaagaaaagaaaagaaagaaaauuagcuugauguggugguugugcaccuuuaguccuagcuacucaggaggcugaggcaggaggauuguuugagcccaggagguugaggcugcagugagccaugauugcaccacugcacuccagccugagcaacaaaguaagaccucaucacuaaaaacaaauuuuuuaauacugaagaauuuuauuugcugguauuuuguugaggauuuugcaucuauauucacaagaaauauuacucuguaguuuuucuucuuguaguaucuuugucugguuucaguaucaaggcaaugcuggccucaugagaucaaucaggaaguguuacuuccucuuuuauuuuuuggaagaauuugagagaauugguguuaauucuucuuuaaaugguugguagaauuaccaguguagacaucugguccugggauuuucuuuguugggagguuuuuuaguacuaauuccauuuccuuacuuguuauuagucuaaugagauuuucuguuucuucuugagcuaguuguaguagcucauguguggaauuuuucuauuucaucuaaguuauccaaguuuaccuaaguuaaaguuccauuuuaucuaacuuggguaagccaacaaacaauacuaaauuguucauaguauucucucauaguccuuuuuuucucuaaagucaguaauaacguucacucuuucauuuuuucauuccugauuuuaauaaucugaguucuuucucucccccucccugcaauugagagucauuuaaaagugucuugauuaaauuuuauauaucugugaguuuuccaguuuucccucuguuauucucuucuaguuuuauuucaugugauccaaaaagauacuuuauaugauuucaauuuuuuuacauuuacuaagacuuguuuugugacuaaaauauccuugagaauuuccaugcacauuugagaaaaaugcacauucugcuguuguuggacagaguguucuguauaugucuguuaggucuaauugguuuagaguauuguucuaguccucucuuuccuuauugaucuucugucuaguuguuuaauccauuauucaaaguaguggccgggcacgguggcucacaccuguaaucccagcacuuugggaggccgaggaggguggaucacaaugucaggagguugagaccagccuggccaacauggugaaacuccgucucuacugaaaauacaaaaaauuugcuggacaugguggcacacgccuguaaucccagcuacucaggaggccaaggcaggagaaucacuugaacccaggaggcagaaguugcagugagcugagaucgcaccauugcacugcagccugggcaacagagcaagacucugucucgagaaacaacaaaaacaaaaacaaaaaacaaaguaguguacuaaagucuccaacuacuauuguagaacucuauuucucccuucaauguugcaaaauuuuguuucauguauuuugguguucuguucuuuauaauuuuuauaucuucuuaauggaugaaaacuuuuaucaacauauaauguucuuugucucuugagacuuuuuuuuuuaacuuaaaaucuauuugggcugauaauacagccaccacaacucucauauugguuguuauuuucauagaauaucuucuuccauccuucuacuuuaaaauucuucuaucuuuauaucuaaagugagccucuuguagauagcauauagguggauaauguucucuuuauucacucugccaauaucugccuuuuaacuggaguuuaaucuauuuauauauaaaauaauuacugauuaggaaggacuuacuucuaccacucagcuauuuuuuuucugugugucuuauacauuuuuaaguuucucaauuccuccauuacuggauuuuuuuuuuuacuucuugauuuugugucuguguuguuacauuuugauuauuuucuccuuuugauagcggcaggaggcagccaaaugccuggcagauagaagcuugucccccaugaaaccccaccuucaagccaaaaaauagccugaaggcugaaagaccggacugcuggucccagaugaaacccaugauccagagugagaacuuccauuccuguuugccugcccucuaaauaaucccuuuuaaccaaucgaauguugccuuuuccaauacuaccuauggccugccccucccccauucugagcccauaaaagcccuggaaucagccacauugggggcacuuugccaacuucagguagggggaccaccucuguaucccuucucugcugaaagcuguuuucaucacucaaugaaacucucaccuugcucccucuuugauugucagcguauccucauuuuucuugggugugguacaagaacucgggaaccagugcacaagccagacuuggucugggcagcacggguuagugggccaucucccacagcagguagcauggccaagugaggccugggcagggcaucaccaaggucccuggcuugcaaagugaccaaggaaaaaauccugugucacuuuccuuuucucauauuuuuuaguuauuuuccuaaugauugccuugaggauggcaauuaacaucuuacacuuauaagaagcuaguuugaauaauaguuccaauaguacaugaacacucuacuccuauauaucuccauccuucuuccuuuauauuguuauucccacaaauuauguuuuuauacauuauauccucacuaacauaaacuuauuauuauuuucugcauuugccuuuuaaaucauacaggaaaacaagaaucacaaagaaaaacuacauuaauauuugcuguuauauuuaccuauauagugacauuuaacaguguauuuuuaugucuucagaugucuuugaauuacuacuuagugucuuuucauuuuagccucaauguuucccuuuagcauuuccuauagggcaggccugccgguaauuaauucccuuugguuuucuuuaucugaaaugucuaauuucuuuuuuauucuugaagaauaguuuugcuggcuauaagauucuuaguuaauaguuuuuuucccagcacuucaauuauuauuaaaguguuauuauuauuauuauuauuauuuugagauggagucucccucugucacucaggcuggagugcaguggcgcaaucucugcucacugcaaccuccgccucccagguucaagcaauucuccugccucagccucccgaguuagcugggauuacaggugcccgccaccaugcccagcuaauuuuuguauuuuuaguagagacgggguuucaccauguuggucaggcugaucuugaacuccugaccucaagugauacacccaccuuggccucccaaagugcugggauuagaggcaugagccaccaugccuggucuaaaguguaauuauuauuacagcugccauuuggccuccuugguuucuaaugagaaaucaucuguuaaacuuauugcaaauccuugguauguaugcuaugugucauuucucucuugcugcuuccaagauucucucucugucuuugucuuuugacaauuugacuauaauguguuucagugugaauuucuuagaguuuaucccacuuggauuucauugagcuucuuggauguguacguuugucuuucaccaaaucugggaaauuauuucaccauuucucaaauaucuuuuucuuccccuuuccaucucucuucuucuggagcucccguauacuuaguuggcaugacugaugguauccuacuggucccucagguucuguucauuuuucuucuuucuuuuuuucugcucugcagacuggauaacuucaaucgccuuuucuucaaguucaaugauuauuucuucugccugcucaaauuggccauuuaaccccuccagugacuuuuucauuucaguauuguacuuuucagauccagaauuucuauuugguuccucuuuaauaaauucuuuuuauugucauuccccaucuguucauacauugcucucccaauuuccuguaguucuuuguccaugguuuucuuuaguuaauuaagcauauuuaagacaguugacuuaaugucuuugacuaguaauuccaaugucuaaaauuccuuauggauagcuucuuuuaaauuauuuuuguccuguuagagagucauaucuuccucuuuauuugcuuuguaauacuuuguugaaaacuuaacauuuugaguaguaaaaugugguaauucugaagccagauucucccccuccuuugagauugguuuuguuguuuguugagggcugcaguuguccauuuguauagugacuuuuccaaacgauuuuugcaaaguauguauucucucuugugucuggucacugacguuucuguucuggugccucugcagucagccuaugaccuggaagagcauuccuuaaaugcauagauuuuuuuaaaacccaagaaacaaaaaaccuagcauguauguaccuuuuuaaaaaucuucugauagaugccaccuggaaggcugcugcugccugaaggggcagaaacaaaggcaagcucuacucugagcccucagggaaccaccagauaaacaaaagaaauuugauucuccaaauuucuggaagacaagguccuuucugcccacuccugcuccagccagcugcucuaggaacacaauuacuguccacauggccacaggaauguugaagaaugcaggaugguagcugguuugcccacaccacucacuuaugagccaucagcaugccucucccuucaucgagcacucccaugguugcuguaaguguccaaucagguuccagaauucugaaagaguugacucuuacaggauuuuuuucuuuucuaacuugcugguuguuuagauagaggaaccaauuccugaaguuuccuacguugccagcuucaugaggaucauucccuaguaacucuuuucagacaaaaagcuucauugauuuacuguaggacuagcaucaaagagucuaugccaccuagucugucuccuuaaaacacagaaauaaucaguaugcauugggguaggaguuuggcauuagaucugccguaaaucaagagcuggggacagcccaugucuuaaacucugacccaagggcuaaaauauccuuugguagcaacaacagcuacaaacuauugaacaacuuguaugugccaagagccuuaccugcauuaucccauugaauccucucaacagcccugugagguaguagaauuguugccugccccuuacugaggccuagaaacauuaaggaauuugcccgaggcccuagagccagugaguggcaaagccagucuccagacucaggcuggagauccuacaguucuguguuaccccaguguuauccugccucucagcacagagucuuggaugauucuccuaaccccucccuaggcaaugcacagggcugcucccugcacccuuacucaugcucugcucuucaaccccaacagugcuggccuuaggcuuuaucccugacacccagccccaggcuccauuccaucuguugacagaggcaaacacuggggcaaaacugaccucuguggauaccacuguguccaccuccaccagcuucagcugaagccucugaacaucuccagcauggaagaagccccaaaggauauuuccugucccccagcauaugcuugacccugaagcccuccccaucuagucaagaagaccaaacuguuaacaauccuggagucagagugacccaugggugaaucuuagccaagucacucauagcuguugcauccuaguaaaucccuuaacucccauaggcuucaguuucccugcauauaaaaugacagccuucagcucaucggccaguuucaauccaucuaaagggucuagcacauccccuggcauguggaagccacagggcacacacuaguuguggucauuugauccuggcaugcucugcugucucucggcucuccccuugccucuuucccugauguccuggccaucagccacugccuaacacccucccacucaccaggcccuuagccugccccuuagcacaagagcacagccggucucaagucuacccugcuguaagcaaacacuugcaacaucaugcugaccuccaggcccuguugcaucagcgugcccacacuuggugcccagcugguacugaggguaucagggaacaggccagugguggaagggcggacacuuuggguucccugguuuccuggcucccaauaucuuucccaauggcauauggggucuagcagcuuggcucauuuaacugugaaccucuacccuuuagaaucugggccuccaggcuugcuucugugcaaaauggcagauaaggcucaaccuuucuuuuuuuaacuucauuguuaaauauuacuccauuaauacccauuuacugcagaaaagguaggaaauacagauaagcaaaaaggaaaauaaauuaaaauccucauaccaccaucaucaagauaauuacugucaccauuuugguauauuuccucccaauacauauauuaucuauaucguauauacgacaaaaauggaucauacuauguuuccuguucuuccccuguguuagucaucuauugcuguauaacaaacugccucaaaacuuaguggcuucaccuuuccguguauuaugaugacaagaaugugguaugacacugucuuauaucuggaucauaugcuaaaagauagaaaaugguuucuaaacuuauuuguucuguaauaacaaaauuuuauuucauaaaguguuuuuaaaaaaaaccauaguagcuugaaacaacaaaccuuuguuaucucacacaguuucuguaggucaagaauucagaagcagcuuagcuggguggucuggcuuggugucucuccugaggucaggguuuuggcuggggcugcaucaccugaaggcuugacuggggccagaggagcugcuuccaaagugguccacucacauggcuggcaaguuggaguugcguauuggcaagagacuucgcuucuucucaauggaucuucccagaguucuuguaggcaaccucauagcauagcaguuggcuucccccagagggaacaguccaggagagaacaaggcagaaaccacagggucuuuucuggcuuaggcuccaaagucauacuccaccauuucugcauuaucauauuaguuacacaggcuagaccuauucugcauggaagagacuauaccauggggugaauaccagaagcagggcuaauugaaggccagcuucaagggcggcuacacauucccuuucaacaguaugucaugaacaucuuuccaugccaauagagcagaugaaucuuaccauuuuuaaugacuacauguaaguguagcauaauuuauuuaaccaaccuccuguaguuggguauguggguugugucucguuuuuugauaguagaauuaaucaucuugaauauccaucaccaaacuugucauauuauuuucuuuugaugaaugaaaaagaaaaucaagucaugucugucaaucagaacccugagcaacuaagaaauggggguaccacugggacauagagcaaggucccuucugauucugcucuugucuuucucuccccaugaaauggggaguucacuaucuacugagacauccuagcccacagcugcacaguucugucuuuuuagaaagcucuaagcagaaacaauguucauccauccuccucgggacagcccuugagcuacugaagacucuaagcauguccuggucauccuccaugagccaucaucucugaggcccuccccuucuuggccccucuucucuggacagguucuggacagucuugcccuuccaaaauuccuggaaagcaggaacuguuccugcuacaaugacucucaacuccagugcaguacagacuguuggugucaccccuuauccugaagaagaggcacugagacaggacaagggugggugcccaggagggcuggcaugagucaugagaaucuggucccggagaauuagacgguguggggaaguagggguguugggccgcuuucuggccucauggaugccaaugaauaucagcagguggcucccagaaaggaacucuaggggaugccuguugcucuaaauagaggcuagagagggcacuggcaguucagucaaccaagaaagggggcccacuugccucagcuucaggcuuuguacacauccucagccuuucuugagaacugaauuuagauucuccuccccugugcugugugcuuggcccagaagaagggcaagucucgcuggguggcugcuucuuggccuggcugaaccagaaggccccagugccacuccaaaccugggugugagcccugcccccaugagcaaacaguagcucagagcugggggcugugggggucaguggccugucacaugagaucugaugaggccaucucugcucuauauugggaaagggaucaauuguaucaagggcuuucuugggagugaucacucuggccauuggcgagagaccuggcauucugacaaggcacccuccauacccugacccacuugccagcuccagcuaauuuuagcaggcuuuggcaggugccagcaaguacauagcauguggaugucacucccaggugagcccaaggagaggccugggccagagccuggaagucauggucuaugcccauggaggcacccaaagcaagccugaggccuggacuuugcagucacaaaauuaagaaugauaccccuguuuuuuguuuguuuuugaucaguuggccaccuuccuccaccaccccuuccccaaguuccauacagaccccuggauuguaugaaaugcaaaucgaaccucucugcagaugaaaauccacuggggauccccuugccuccaagagcaaguccagaccugcaccagcgcgggccaggcccccuuaggacccccucccuguccaagggcauuucaguaaguguucuguggccaaggcagccuggugacuuucugcccgcacaaggcugaggaauggaagauggguaggcuggcucugcacacccccuccugcugggcagcaaucccuaccccauguucacagaguguggccggcugccccauggcucuguccccguggcccugucaacuguuacccacauggccuacccucccuuucugcccugccucugaccccauggcagggggcagaguauuugagcagccgccaggcugagcccuuucagugcagaagcccugggcugccagccucaggcagcucuccauccaagcagccguugcugccacaggcgggccuuacgcuccaaggcuacagcaugugcuaggccucagcaggcaggagcaucucugccucccaaagcaucuaccucuuagccccucggagagauggcgauggaugucacaaggagccaggcccagacagccuugacucugguaagggucacaccaaaguuagggacuuugcacugggagagcagcacccagggcagggcccuugguuuugcagauuaccaaaacuaaggcugggggcagggaaggcgagcaggcuuggggcaccuuggaaggaggcacaugggccuuggggguccuggcuagggcagcugugccugccacuggcccucugcccaccaccccuccucacuguggcuauccaguguccagccucucgagggguucuaggguacuuauuccuggagcuaacggugacccaggacaccaguguccggggccuggccuggggcuuuuauggggggagcuggcuggcugcccagggcugucuggcucucugggggcucugcauggcauuuccagggguugguggaucagggauucugucccucaggagaaugugggcacuagcccaaggccacucacuucuguguacauagccaccugagggcccaggaauggagggggccaggcuacagcuggacaucuggcacucggaugggcucuggagcccccaggccugcagcaucugcccagggacugcccuggcccuuggccauuuccucagggacccacagcuccaccagccggccccucccagugcuggaauagacaguuccucaguccacaucugccaaaggcggcacuagaaggcauccugccuuuuuuacugcguucuggagguggggucacaaagcacugcucacugcauaaaagggacagcauccugccccuggcagcccugccugaccagcuccgccucucccacugcuauccaaccuguacacccuggugaccauguccaggccaguggccuuaaggacugucucuguacugauggcuccacaucuaccucuccagccagacucuccucugaacucgggccucacauggccaacugcuacuuggaacaaaucgccccuuggcuggcagauguguuaacaugcccagaccaagaucccaacucccacaacccaacucccaggucagauggaaccucuucuucccaggcccuucuguuccucuccucagccccucccaccucccuucagaauaagucuagacucuuaucgcuuucaccaagccugcgcccagcaucccugcacagggauuguuaggacagccugacgcccugcuuccacccugccccaagaugccccugcucugcagcccggcgccuccaggcuucucaccuccugcugcucacagcucagccucacucccucccuccccgccucugcuccagccucagugcagguccccugcucccaucuucuggcagcagcugcccgaccuggucccucuucaucuguccccauuccuucaccccccagccuguccccaacuugacugagguucuuuccugcagauccccgcccuugagagggguuggucccacugucaacucugcuucugugcccugugccgcaccuggcauucagugagcaucugcugaagagaugagggucagaugcccugcagggagugugggggcguccucaggcaagaaaaguuguacguuuggcugugggcccugauuauguguccugugaccucuugggugaggucagcaagagaaaccucugcaagcuggcuggggcugccucccagaggcugccagggggagggacaggcucugucugugcucuucuuccgaggcuacaccuggggcgccaggcucucagggcuccccagguaccaccacauuuccuacacugcuugggaaagcccuguaaguuugcacagacacccagcaugaggcucgccagagagauacuuguagcuggggucugggcaccaggaacagcuuggugcugggccugaagucgggcaggaugcagccuggccaggugagaggaaagcuuggagccagugccuggguucaaacuccucuguggccuaugguucugugggcuuggggaaggguuuguaccucuguguccaguuuccucacuuauaaaaaaaggagauaauaaaaguacccaugucccaggguggcuguagcaauaauagggaggggugcccagagcaggucuggcacacaggaagugugcaucagccucagucccugccauugggcuuguccugggagucugugaagccaaccucugcuccacaaugugacccccaggcuugugagaccaagcugggucagagcuuccuccucugggguugcaccaggaggggaacuucugcaggcccagaugcacccugaggaaagggcuuguucccaccaagaacaaggcucaccuuuggaggaugcuccccacaugagaggugaacccccaggucuacuggugacugcagccucggaagcugacagcaucuauccuccaacccaugcccacugggaagugugugagggguccucauaggcccugcgguguggacaaugcagagacccuguagcaucuggcuagggcggggcccagauaagagcccugugccaggagagccuggccgguucugccacuguggggagacaggcucccccaccccauguccccugcuucccugcagcccacagagaauacagaccuacuuuuacagaaauccagauuuuuguguaaaagugucucuauuuuaaguagauuuuaagugguggcagcaaauuuaagcuuuugagaauauuauacagaacaaaucagauucacaggccagaugcaacuuuauuuacagaaaugggaucagguccuaccucaggucccaucucacguuuucacuuaugccuauacgucuccuucacgggaaaggccacaagaggcccugcgguaagugucccgguguugauuuaaaguccccaacagugaauaugaggguccucacuguugcagcaagaggauaccccccuguguaucuuggaaaugccugcagcccucuugcugcagaacagauucuuaggagagaaacugucagaucaaaguuaaacuuagagaaacuccaaauugcccucugaacagacgguaucaguuugacaucauccaauaccgggauuccucggggagaacuuucuggccuagaaggcaguagagccaggacuucacccagucaguggcagggccacacgugggccuugauacagagggggaagacuugagccuccucgacacccuacagggcccagccucccaacaugugauaagagaaacaacagccaacuuguaccuagcucuccuuauucuccaagggcugggccaguucuccccacagcccugcaagggaggaucacucaagggccccaacugucugacaauacagccacacucugaucagccaccugggcauaggcuccaugccauuguccuccgccaagaccucagacugaaauguuggcuccucccaugaagaaccuggggccaaaggaccagaguccagguccguggcugccaggaugggccacuuggagagaggcacaaggguggugccaggcaggugugagggcuggaccuuugcaagagcagcaucacuuuuguugagagcccacagguaucuuauaauuggguccuaggacuuccugccaguagccauugugugcauggauuugggugcuggccucaccauggugugcuggcugcccaugccugcaauaaugacuucuguaagccuuucuucaucugcaagaugggugcugcuggcaccuccuccccggugcuguggugacagggcauagugugugaggcugcuaugugaagcaccuaaugcagggccuggcauauggaggaauucagcaaaugacagaugccuucacaguuaguuccuggcauccucuacauugguggguguaggaaagaaagacagaggaggcaaaaguuguagcuguggggcauugaggacagccuggauuguuccacagagcccugaggacaucuccaggggugugcucugcaggggcagcuggauuggaggguuaggggucggggagggcgugcacucccacccaugcucacagccucggaacagugccugcucagccaacauggguguuugauucugugucuuuugucacagacuuuaucagccccaucccuuucugaccuugccucaguuuaaauuuuacauguggggccucauuaagagacaugguucuuaacuaaagaucuguauccauuaggaaugcuuugggcugcaggaagacaaacaccugacucacuguggcauaagugguuugcgucugcucccauaagcugcacguggaggguggaucuggcauuacucucucuucccuacauuugcaguaugcuaacagcuuuaaccuccagccuuguuucuucaugguugcaggguggcuaucacagcgcuggccaucacauccuuacacagcuguguuuacaaauuuagggggacauugaagcuccuccccugcuaaaaucaggcuucccuucaccugucauuggccagaacugggugaaaugcccaacucuagaccgaucaucaguaagaggaguauagaauugcugugcccaccuuagauuaaucauggcgcaaugugcuccccauaccaacaaaaucugaguucuagaaacugaggaagaagaggaaaauggccgucuugccuccuggcugggauucagagcaucuccaacccucugagcuuauguguaagacugugggcaaaagugugugaguuuuuguggaauggauccacggcuuuuaucagagcaucuuuccuuuuucuuuuugauucaagaugaaaauauucuuaugauuauuuuucucaccacugcccagagauaaccagcacauuaacauggccuuuucuccaugaauagcacuagggugcccaguggacagacacauagcuguccacacaccagcuugcuggggaugcauaggcagagucacaucugcacucacggccuguccucacacugccauguggagagccagcagccacaccaugggccguccaugcucacgggaguggcaguaucagaucugagcuucgugugcccaggcgucucucacaucagugcauagggacccucuuuguucuguggcccagugugcccaugccacagauggcuucagucagcagacaccuccuucuagacacucacacucacuccuggcuggcccuuagcacaccugugcagacaggcccauuuauuuucuuguguaaaucccaaguaggaggacugggucucucugacagcaaugccagcugccuggcacccuccagacagguggcucaagccccaccucgccagcucucccaguuagccccuccuuucccuggcucugaccugagggacgaagcagggugcuacaggacgcugugccacagggauaucgucagggacagaagcuacucugcccucugcugcucaccccuccaacacgcugugggcugcauuuguugaguggcugguaccagacucugcucuucugacuuuccagcugguuuuaccuguaguaaaguuugagaagaugggucauccugaccccggggucagaagacagaaggaggcccauggcgugugggggagaugccccgugaggcccucggugugcagaugccuggugacagccccacccugagguccccagccuacccccuccccagcccgacugcucccaucccccucccugugcagguagagcagauccuggcagaguuccagcugcaggaggaggaccugaagaaggugaugagacggaugcagaaggagauggaccgcggccugaggcuggagacccaugaagaggccagugugaagaugcugcccaccuacgugcgcuccaccccagaaggcucagguaccacaugguaaccggcuccucauccagaagcagcugugggcucagcccuagcugggagaagcaccccaggcacucccagacucacagccagcccgagacagaaucuccuggggagcaaugaaguccucgacuugggccaguucucacccuuggcuccucugguccggcccuggggcacucgggcucacccuggagcuggcaaaccucaggaaaacuggcguuuuaaaucucacuccuggccaggugcaguggcucaccccuguaacuucaacacuuugggaggccaaagcaggcggaucucuugaggccaggaguuugagaccagccugcccaacauggugaaaccccgucucuacuaaaaauacaaaaauuauccaggcaugguggcacauuccuguaguuccagcuacucgggaggcugaggcauaagaauugcuugaacccgggaggccgagguugcagugagccaaaaucgcgccacugcacuccagccuggggugacagggugagacaccaucucaaaaaaaaaaaaaaaaaaagaccucacugcuccccaugggcacuuagggaacucucccagcccaguucugcagcugggccauugcacuagauccucaguuggucccugggcucucggugacuguccagggcaggaguuucccauugacuuuucccugguugaccuuugaccccuuccacaguugacacugguguccccaggugucugguggccccuuguccagcucccuuagucccuugugccuucccuccuccucuuuguaauauccgggcucagucaccuggggcccacccagcccaaggccagccugugggugucccugaggcugacacacuucucucugugccuuuagaagucggggacuuccucucccuggaccuggguggcacuaacuucagggugaugcuggugaaggugggagaaggugaggaggggcaguggagcgugaagaccaaacaccagauguacuccauccccgaggacgccaugaccggcacugcugagauggugagcagcgcaggggccggggcagggggccaaggccaugcaggaucucagggcccagcuaguccugacgggaggugccaccugucuaccagggguggggagagcgggggcuggaggaccacccagccucagaggcagcuggaggccugggugaacaggacuggccaacauguccccaagucccacagucaccaucuggccagcauugagaggggaacgggcugaggaagaguuaguggcaagaggaaccccagccagucacaccuuguccaguuuaccagaggaaaaaccaauguguaagaacagaaaugugacccggcagccagugcacugccccccucuccaaaggccaccccucacccuccaccagcaugcacagaaaguggggugacagcaaucacaaugucuacccaggcagcaaggaccccugaccauggggaggacuggggugcagggaacauagaagcagaaugaggccuagggggaguugggcaaggccagagcccuagcugcagccaagcacauggccaaggccagcuccuggaagggcagggcuccgaggcaggaggcaggaggcugcccguggcuacccguccucacaccccugcagcuugcuagucugucugugggcugggugugaaucaaggcagugggaugguguggggaccucccuggccccagcagccagugaggagccuggucagucagcagagcauucagcaguauccaguuccauggagaggcccgugugaggggagucggggcuggucuucaguaaggauggguggccagggccccuagaaguagaaaaggagacuccgggugcuggagacagaaaucaaggaugugccuccauguggagccucaggaauagcuggccaggccugaggcugaaccucacaagguucagcugggagggcuaggcugacagagcacagccgggccagggaccagccugcccuguguugccuugucccgagggccacugucagcaggucucuggcaugggggaggcuuagggccugagcccaacaagcagcagcggaagaggagagggaaacuguggacaggccuggcauucaguggccagguguugcagugucccugaggaauagcuuggcuugaggccguggggagggcugccggccagcgcacccccccaugccagauggucaccauggcgugcaucuuccagcucuucgacuacaucucugagugcaucuccgacuuccuggacaagcaucagaugaaacacaagaagcugccccugggcuucaccuucuccuuuccugugaggcacgaagacaucgauaaggugggccggguggaggggcagaaggcagaugaggggaggcacaggcaccccagaggaacucugccuucaaauguagcccccauaccaugugcucagaagggagaucuggauucaaauuguggccaugucaccugccaccucuaaugcuguggaaaagaagcaucacauuagcuaauucuggcugugcgccuugugaggcaccagcuaugaucaccccacuccaguggaaagagcagcuggcaguaggguggggcucaaacucaggcagccgggcucugggucaccugcaggccacggucaugucacacugccucuagcugagucagaaaugugaaggaacugagauucuacccuuccugcaagcuagcaaaguggccugccaguuacaucugugcaugcacacacacacacaguuauauaugcacacacauaaaacacgagaccuuugggucagggagaaagccagauccucacucacggcagaagcagcagccaaagcaacaucucaugugguuuuccaagccccagucccuacagagacagagagggccagguggcaccugugcaugcagcgggguaccuugcaggagggaaauccugauuuuacacaaagcugcuccccccacgcccugccuugacucugggaugacgucucagagcugugcaguacaacauucuuaaauuggcugggacucagcccugcagaaauaugauaucuucaaggagaaucguucccaaaaccucucaaagcuauggggcugcucugagccuguuuccucagcuguaaaguagggugcauacuuuuauggcccugugcaggagguagugacaggcccuagcacccugccuccaguauauguuagcagccacgaggccuaucucuccccacagggcauccuucucaacuggaccaagggcuucaaggccucaggagcagaagggaacaaugucguggggcuucugcgagacgcuaucaaacggagaggggugagggggcaccuguaccugccgggggggcugcccugggccacccaccccagcacugccugccuuucuccuuggcuuccagcacugcagcuucugugcuucuuggcaggacuuugaaauggaugugguggcaauggugaaugacacgguggccacgaugaucuccugcuacuacgaagaccaucagugcgaggucggcaugaucguggguaagggcuccuugcaccccugccccuuccagacugcugaggcucccuguguacaacaggcuucaagggcccuguggggugaggaccaaacuacuuaacaaccggugaugucagagcagagccuggugcuacagccuggguggucuugggguaucaagauggaagcaccguguacaguaggaagcauuucaacgccaugaugccacauuccugcaucagaugguaugccagcugcauauccaccucacccaucaggauuauaauuaaaacacuuaucugguaaauugaccaacuggacagauugguccaaguggaagaggauaagcaaaagugguaccaucuccacccgaauggucuuuccacgggccugccccugccccugcccccacccaaagugaaggcagguaccaggaaagggagcagcaguccgccccucccagcagaggggucuuccacaccaacucggaccuuucucagaaguuccggaggucauuauaaccagccuucacugaggagcaauccaaucagaucaguuaucugcugugcgcacagccgugugguucuauacuucucuuacuuccauuuucaccuuucagaaggaacguugucuuuaaauccagcaucuaaacgugagccccagccaucccuggcugugauccccccagcccuuuccacccuauccucuggaacugccuggggcuccccaagacacuuccacaugaauucccaccaagccaagcugcagcugcugggcccaggcauaaccccuccuggggcagagguggcaaggagugacccaccacucacaucugccccacauccacucuugacucugcucaguguuuaaaaacauguuuauaacaauuaccaagaucugaaaauuaggagaauucacaucaaagucuggauuucuguuuguucauaaaaaacuagaaggcagccaggcaagguggcucacgccaguaaucccaacacuuugggaggcuaaggcaggcgggucacuugaggucaggauuugaagacuagcuggccaacaagguguaaccucgucucuacuaaaaauacaaaaauuagcugggugugauggcgcaugccuguaaucccagguacucaggagacugaggcaggagaauugcuuaaacccuggaggcagagguugcagugagccaagaucacgccacugcacuccagccugggugauggagugagugagacucugucuccaaauaaauaaauaaauaaauaaaaacuggaagucuaagcaucacugagcccugauuccuauguggcagcucgacugaccagcauuugaguugcugucccugacagcuuugggggugugcagcccacacagucaugcuagcuugaggcucugcugucagcaguuugaaacucuuaauaacuugugaacaaaagacuccauguugucacucugcacaggggccagcaaauuacaaaauuccauauccggaauugucuacaggagccucugggcugcucccaagggcccacaccaugccuuacucacuuuggguugccauccaaacaugucucaugacaaagaagcucaaacaugugcauggacagugccagaaaacaagggucguacauagacaaaauaaaaugauaacgucccacaaccauuucuuugauacacacuguuucucucaguccucccaaccaccuagguaacaggcagggaagguguuacuguugccuguuaggaaagaggacagcccugaaagcugucccuggccacugaagcaacccaggucuuccagccccagggagagccgccuuuccauuguuccagacaaagcagagacaggcaugggggagcgggagagggacuccugugggcaggaaccaggcccuacuccggggcagugcagcucucgcugacaguccccccgaccuccaccccaggcacgggcugcaaugccugcuacauggaggagaugcagaauguggagcugguggagggggacgagggccgcaugugcgucaauaccgaguggggcgccuucggggacuccggcgagcuggacgaguuccugcuggaguaugaccgccugguggacgagagcucugcaaaccccggucagcagcuguaaggaugccccccucccccacaacccaggcccugggccgcucuggugcagcggcagaugggagccgggccauugcagauaaugggcuuguuuuuaaacaacucuggggaaaagcaaacugacaauccguucguaagcuccaucccuucugcucagucaugaccugccccugugagagaugaaggguuagucccaguugugaugugauaagcccagaccucuuuccuuccgacaggugaucgugcaugcagaggaggcucugagacgcccccagcaagguuccuggguuuaacccaacauuccccaaaguauguauuuggccacauucacagaaagaauauuagucuuuuguggaaugcugcggguugacagucacagcuuggaaaccaacccacagagagcucaucauuaaucauggcuaucacuuguuuaccaccuacugugccaggccuaugcuaauuacuuuauuagcguccucucugccgcucgcaggccucuauuauuauaggucaguaguauucgauuuauuuaaauuaaauacggaaggucauagauuaagcaagaaagugccagcaacauggugcgugccucugacugggcacuaacccuccaagucuuaguuuucccaaccauaacuggccaaugaacagcagcucuggaugcagcuaaaggaagacugaagcuguaggucccgugcucggcgcagggcccccugcaaggaagguuucggagggacuggauggggucuuugaacuaucugucuuucccuuuacugcagugggcccaggggcaggccaaaguugcucccgugauugacuugaacgugcacguuccuaaucccugacauuucuaaagcucuggcucauuaacgagggaaagacgugaaccagcugggggaguggggaucgcagugccccacguggccgccucgugaccucaguggggagcaguggggccggcucccggcuuccaccugcaugaggggcccucccucgugccugcugauguaauggaccugcccuauguccagguaugagaagcucauagguggcaaguacaugggcgagcuggugcggcuugugcugcucaggcucguggacgaaaaccugcucuuccacggggaggccuccgagcagcugcgcacacgcggagccuucgagacgcgcuucgugucgcagguggagaggugugcggaggaggagggugggugcaaagggcaggggcuggggacgcccgggcacugcagacuuggucucagggcgacgcugagucccaggcccggggcgcagggaugggaaacuagggccuggggcgggauuccgggcgugggcggggcccggggcggggcacagggggcgggggagugggcggggcccgaggccgggcgcuggaggcgagggcggggcagggacggguccaagggcaggaggcugggacaggacggggaugcaaagggaggggcggggcccgagacggggaggagggggagggcccaaggggaggaggcgggguccggacggggaugccaagagcagggaugggagcgagccugcguccgggcacugguccccauccgugaguccccucggugcucccugcccgccguggccauccucucacaucacucacaaccccaaggcgcggcaugguugacacccccacguuaggacggagacccugggcuuaguuagagggggcaguacuaaccagucccuggcggaaacgcuuuggcugggugaggugagcgggaucgcccccauuucuccagagaggggucccggcucagcgagggaaagaggccgccgcuggggggacggcuggccggggccccucccuggagaacgagaggccgccgcuggagggggauggacugucggagcgacacucagcgaccgcccuaccuccucccgccccgcagcgacacgggcgaccgcaagcagaucuacaacauccugagcacgcuggggcugcgacccucgaccaccgacugcgacaucgugcgccgcgccugcgagagcgugucuacgcgcgcugcgcacaugugcucggcggggcuggcgggcgucaucaaccgcaugcgcgagagccgcagcgaggacguaaugcgcaucacugugggcguggauggcuccguguacaagcugcaccccaggugagcccgccccgcucucucccugguaaaguggggcccaaaaagcgcgcgcuccaagguuccuugcgguucccaagcuccaagauuucguaguccucuucucgucccccuuggccuagauuugggggaagggucgacugcgugcagggcgcccgguaaugaauguggaggaugaggugggaggagggacggcagcccugcuucucuucugcccagcuucaaggagcgguuccaugccagcgugcgcaggcugacgcccagcugcgagaucaccuucaucgagucggaggagggcaguggccggggcgcggcccuggucucggcgguggccuguaagaaggccuguaugcugggccagugagagcaguggccgcaagcgcagggaggaugccacagccccacagcacccaggcuccauggggaagugcuccccacacgugcucgcagccuggcggggcaggaggccuggccuugucaggacccaggccgccugccauaccgcuggggaacagagcgggccucuucccucaguuuuucggugggacagccccagggcccuaacgggggugcggcaggagcaggaacagagacucuggaagccccccaccuuucucgcuggaaucaauuucccagaagggaguugcucacucaggacuuugaugcauuuccacacugucagagcuguuggccucgccugggcccaggcucugggaaggggugcccucuggauccugcuguggccucacuucccugggaacucauccuguguggggaggcagcuccaacagcuugaccagaccuagaccugggccaaaagggcagccaggggcugcucaucacccaguccuggccauuuucuugccugaggcucaagaggcccagggagcaaugggagggggcuccauggaggaggugucccaagcuuugaauacccccagagaccuuuucucucccauaccaucacugaguggcuugugauucugggauggacccucgcagcaggugcaagagacagagcccccaagccucugccccaaggggcccacaaaggggagaagggccagcccuacaucuucagcucccauagcgcuggcucaggaagaaaccccaagcagcauucagcacaccccaagggacaaccccaucauaugacaugccacccucuccaugcccaaccuaagauuguguggguuuuuuaauuaaaaauguuaaaaguuuuaaacaug

SEQ ID NO: 61581 - RNA, 15018 nt, Homo sapiens; identical to SEQ ID NO: 61579

SEQ ID NO: 61582 - RNA, 17554 nt, Homo sapiens
gacgccaucccggccagaaaagcccuggccaguggcgggcgcgacacuauccgugcggccaggcggaggugagugcgcggcggccggaugggcgggacgggcguggaggacgccgagcaccguggcgcgcgcucacguccgcguccccaagggcugcgcucccucaagcgcagugcccagaacucggagccagcccggcccgggggacccugcuggccaaggaggucgucaguccggucuugucuuccagacccggaggaccgaagcuuccggacgacgaggaaccgcccaacauggccucggaggugagugggaccucggggacuccgguccuccuagccuccaaaggagagagugggggcgccagaccugccucgggccacccugcugggaaucgcccuccaggaagcaauuuugaaaauuaccuaggaagccugcacccccagcccucccgggcgcaucaucuggagcccagcagucaccuuuaccaggacucaccaguauccgcaggcagcccuuguggcaaacccaccaacccacacuacuagggguagaguggcucugcccucaccucacagugaugccugccuggccaggaaaaguggcucccaagccuucagccuuccaacucuuccuuccuucuuaccacguguccuccugucaggucccaccccacaccacaucccuucuccugcuagagcaauugucccuguuuauagaauaaagcucagccccuaaguguucuuguccuugacuguggcauguggaaagagccaggaaaaaggggacgucgccucguggcuccagcaacccuggugccuggucccuuccugucucacuggacccugccucuuagggucaguggcuccuggccucuccuccugaccacugagaugcuggauucccaggcagagguuuuccuuccuugggccauaguugauuuaucuggcaauggggguaauaauagcugucggccucacucuguaaggcacuagauuaugaggccauugcuuuggacccuucaggugagaggggcuguucgccugaugcuugaugaagggaacuccgggaagcaggaggucuggguuccaggcccuuuuggccuucauuagcuagcaauucacuuccucuuucucaaugcccugcaagcucagugcccugcaagcuucugggucauggcagggggguagggccuggacuuuggagccaaacagacuugguuucuguaccagucacuugagcccuuuaaaccucuuuccucauuugugaaauagggguaauauugcccaccucauaaaaggccguaauaacauaugugaaaucccuagcacagggcugagcaacaguaggugcucaauaaaugguggcuaaccacaacaauacugauauuucuacuuugggaggccgaggcgggaggacugcugaagcccaggaauuccagaccagccagggcaauguaaugagacccugucucuacaaaaagauuuugaaaauuacccaggugugguggcguacaccuguagucucacaggaggcggaggcaugaggauugcuugagcccaggaguuugagacugcagugagcaugaucucaccacugcacuccagcccaggcaacagagugagauccaguuucaaaaaaauaaaaauaaaaaaaccuggcaggcaugguggcucacaccuguaaucccagcacuuugggaggucgaggugggcagaucaccugaggucaggaguuugagaccagccuggccaacauggugaaaccccgucucuacuaaaaaugcaaaaauuagcuggguguaguggugggugccuguagucccagcuauucgggaggcugaggcaggagaaucgcuugaacucgggaggcggagguugcagugagcugagaucgcaccacugcacuccagccugggcgacaaagcaagacuccaccucaaaaaaagaaaaaaaacccacaagucccaaaaccaaaacugguauuucccauguacauucgaccuuaacuguugcucauucaacccagcccaacucagugccccauccccuggcccugaagagaccauucuggcccagauguguccuggcuuggaguagcaccuucugcuaccacacuaggccuccacucuccucagugcccaaggggaggcaccucacucugaucucccugugggguccucuuaugccugccaguaaggauaggaguuugguucuagagcagaguggucuggcuuccaacaagcccaguguucuaggugaccucagguugccccaggccuuccuguagguuggcacuaauugguuuggcugcagcuccacuuauuaaguaguuauuuuuauuacuaacaaccuaggcaggguggcccaggagcccgcugggggaggcggugccaggcuccuggcugaggggcaggcuggccccaauucugacuggcuggcuccagugaucaggaccagggccccacguggugcuuugcuggagaucuaggcuugguggggcagcugugggguaaggggcaggaccagcucaaagauggggugggggcggaggcugccucugcagggcagaguccuuuggcagucgggacuguugggcauagaggagucagcucacagcucagggccagagcacuggagaggucucuggggugcauacaggaaccaggaguggagcugaagcauguccuauccccugccagcccucccuuaguaacagcuggcauuucucgaguccuuccugagcaccaggcaccguguuauguaugcaauuugcaaauauuaucugauuaaaugcucacaauaaggcuaucagagagguacuauuauuauccuuaucuuauuauuauuauuauuauuauuuuuaagaaggagucuugcucugucgcccaagcuggaguacaauggcgccaucucugcucaccgcaaccucuaccuccaggauucaagugauucuccugcuucagacucccaaguggcugggacuacagcuuccugccaccgcgccuggcuaauguuuauauuuuuaguacagaugagguuucaccauguuggccaggcugaucucgaacuccugaccucaagcgauccaccugccugggccucccaacccugaggguuuuuguuuuuguuuuuguuuugagacagagucuugcucugucgcccaggcuggagugcaguggcacgaucucagcucacugcaagcuccgccucccggguucacgccauucuccugccucagccucccaaguagcugggacuacaggcgcccaacacccccaugccuggcuaauuuuuuuguguguguuuucaguagagacggaguuucaccauguuagccaggauggucuccaucuccugaccucgugaucugcccaccucagccucccaaagugcuaggauuauaggugugagccaccacgcccagccccugagguuuaauaauaggugccaggccaggugguuaauagaagucuggggcauuguagggggacagaggaggauauauguccccauuggccauuguagacucccuuccacaaaaaggacgucagugaagugacaugcccaccucuaccccacccuccucccaguccugggcacuagggcugcuccccagguguucuguacccccuccccacucugucccaugcccuggccucugcccucuuucaaaacauagauguggcuggcgccuaggcucaugccuauaaucucagcacuuugggaagcugaggcuggaggacagcuugagcccaggaauucaagaccagccugggcaacauagugagacccugucucuaccaauuauuuuauuuuauuuuauuuuguucauuuauuuauuuauuuugagacagaguuuugcucugucaccuaggcuggagugcaguggcgugaucuuggcucacugcaaccuccgccucccggguucaagcgauucuccugccucagccuccuaaguagcuggaacuacaggcgagugccaccacgccuggcuaauuuuuguauuuuuaguagagaccagguuucaccauguugaccaggauggucucugucuccugaccucaugauccacccaccuuagccuuccaaaaugcugggauuacaggcaugagccaccacucccaguccuauaaaauuuuaaaaaaaugucugggugugguggcgcaugcuuguagucccaacuauuggggaggcugaggcaagaggauugguugagaccaggaguuugaggcugcagugagcuaugauggugccaccgcacuccaaccuggguaacaaagugagacccugugucuaaaaaagaauuuaaaggccgggugugguggcucacacccguaaucccaggacuuugggaggccgaggugggcagaucacgaggucagauuaagaccauccuggcuaacaaggugaaaccacgucucuacugaaaaaaaaaaauacaaaaaauuagccaggcaugguggugggcaccuguagucccagcuacucaggaggcugaggcaggagaauggcgugaaucugggagguggagcuugcagugagccaagauccugccacugcacuccagccugggugacaaagagagacuccaucucaaaaaaaaaaaaaaaaaaaaagaauuaaaaaagauuuuuuuaaugaacaaaacaggcucggcacaguggcucaugccuguaaucccaagcacuucgggaugccaaggucaggggaucaccugagaucaggaguucgagaccagccugaccaacauggugaaaccccgucucuacuaaaaauauaaaacucagccaggugugguggcacacgccugaaauuccagcuacucgggaggcugaggcaggaaaauuggcuugaagccgggagguggagguugcagugagccgagaucacgccacugcacuccagccuaggcaacagagugagacucuaucucaaagaaaacgaacaaaacauagaugccuacauaccauuccucugcccuuggcuccuggggaguaagggaucacccagugaccuccuagaaggccagugacaauggggggugucagggugcuuuucagagccaagggagugguaggaauugggaucuuaguccagcuccaagcugugagggagagaguugcagggcacuuaagcuugguggagacccucaaggccucuuugccugucccugcagcaaagguucuggacaccagagccaaguccagaagcccugguggaacaggggugaaaagcauagguucugacuucagacugcugggccgcagcccuggcuaucccaccccaggugagagcaggcugcucugugccucaguuuccccaucuucauaguggaauuguauuggugccuacccagaggguugugucaacaauuaggauggcaccuagcaccuuggucaguggugggaaagguuccagaaguucugcuguggucccaggggugucucaggcccugccaucaucuccuuggaggggugccauguggugggaaagaaccccaacuucaaggccacacacaguggcucaugccuguaauccuagcacuuucagaggccaagaugggaggaucaccugaggucaggaguucaagaccagccuggccaacauggugaaaccccaucucuacuaaugauacaaaaauuagcugggugugguggcacgugccuguaaucccagcuacuugggagucugaggcaggagaaucucuugaaccugggaggcagaguuugcagugagcugagauggcaccacuguacuccagccuggccgacaaagugagacucugucucaaaaaaaaaaaaaaagaacccaaacuuuugguguucagccauguucccaugcucacucccaggguggugacucugggaaggucucagccuccuugucugcccaguuagaaugaucugaugccccugcuaccaucagacuugauaaguuucccaaagacucuuugcaagaagcacuguucuggaggguggaggagagacuaauuguucuugcucuccuggccagagugggaagcuuugggguggccgguuugugggugcaguggaccccaucauggagaaguucaacgcguccauugccuacgaccggcaccuuugggagguggauguucaaggcagcaaagccuacagcaggggccuggagaaggcagggcuccucaccaaggccgagauggaccagauacuccauggccuagacaagguacuugccguggcccaagccccacccaaggccccuucccuguggccccaggcucccaccaaaucccugagcaaacagugcaguguugcccaucugugguuucacauugaacuaauuauauacucaagugcuguuuaacugugugccuugaugacugccucucuccauccuuuaaugaccccuguggcccacauggcucauggguaaaggugugcugggccugagaugcccccucccagggugcgcuuccaggacucagcuccugggcagggacagucagucaccagggauagggugggaccaaggcaggggcucucuuggcugcugaugccugcucaccugaccccggcauugcugcuacccacuacagguggcugaggagugggcccagggcaccuucaaacugaacuccaaugaugaggacauccacacagccaaugagcgccgccugaagguacgaccccuggagccccaccgcuuuccuugccuccccucuccaccuugcccagggccacuuugagcauuagcaccauucuguuuacuucgccauuggcagacagcaugugagaccucaggacaugagccaggcacccuggcucaugccuauaauccuagcacuuugggaggcugaggugggaggauugcuugagaccaggaguucgagaccagccugggcaacauaaugaggucccacagcuacaaaaauuaaaaaaagaaaagaaaaaaagaacaggccucagcagaaauggcgagagauuuggggaggacccggagcccugggguauggagguagguuggcagggcugaugaggaaaacugcccugccuggguugacuccucuggggguauagaccgugacccugggucucccuucaccuccaggagcucauuggugcaacggcagggaagcugcacacgggacggagccggaaugaccaggugcuuuagccccuccacccccugcuccguguugucccaaccuugaggagcccagggggcaguuagaguucugcagcgguccuggcuccucagggaagcaacacaucggccucccugagcaccaucuccuccuugcacagguggucacagaccucaggcuguggaugcggcagaccugcuccacgcucucgggccuccucugggagcucauuaggaccaugguggaucgggcagaggcgugaguccuacagggacacccagggggcagacagaggugugauggaagccugaacaggagaccuagggggcaggggugaacagcgugggggugccaggcccugggggacaggggcaucccagaacuccaggaucgaggcagagcagccaggagugggccauuuccugcaggccccaauacucccaugccagucuagcucagcaggcagagaagacuaacccuucguggggcugggugcgguggcucacgccuguaaucucagcacuuugggaggccgagguggguggaucaccugaggucaggaguucgagaccagccuggccaacaugggaaaacucugucucuacuaaaaauacaaaaauuaggcaaugugguggugugcgccuguaaucccagcuacucgggagccugaggcagaagaacugcuugaacccgggaggaggagguugcaaugagccgagaucgcgccauugcacuccagccugggcuacagagcgagacuccugucucaaaaaaaaagaaaaaaaaaaaagaaaacucaccauuugcagauuugaaggcaggaagcuaagccaagcacagcuagcuuggcugugccuggagcagccagagucacuccccacacugccugucccccagaucccccauccuaagcuucgccuccccauccagcccaucuggcaaaagacagagccaaaggcugccuccugcuggccucauuucaggcuuuggcuucugggaccuggugucuuugggacuggauuuguuccuugcagaccuggacgaagagcugcugagaagucuccauguguugucagagaccccuccucuuccucaacucccugugaccccuguugugcagacuugggggaaaacaagggcacaagaauugucacccagcaggugguguggggcugcuaggaggaacagggagugucugcuacugaguucaggguuucuuuaauuuuuuguuguuguuguuuguuguuguuuuuuuuuuuuugagacaggguuuugcucugucaccuagucuggaguguaguggcgcuaucugagcuaacugcaaacucugccuccuggguucaagugauucuagugccucagccucccaaguagcugagauuacaggugugcaccaccauguccagcuaauuuuuguauuuuuuucaguagagauggguuuugccauguugaccaggcuggucuugaacuccugagcucaggugaucugcccgcgucggccugccaaagugcuaggauuacacccauaagccacugcgcucagcuuaauuuuuaaauuuuuaacuuuuuaaauugucuuuagagaugagauccugcucugucaccuaggcuggagugcaauggcuugguaauagcucacugcagucucaaacuccuggacucaaaugauccucccaccucagcuuucugaguagcuaggaccacaggugugcaccaccugugagacagagucuugcucuguugcccaggcuggagugcaguggcgugaucuccacucacugcaaccucugccucccagguucacgccauucuccugccucagccucccgaguagcugggaguacaggugcccaccaccacgcccggcuaauuuuuuguauuuuuaguagagacgggguuucaccauguuagccaggauggucucaaucucccgaccucaugauccacccaccucggacucucaaagugcugggauuacaggugugagccaccgugcccagccgcgaauucuuuaaauuuuuuguagaaacagggucucacuauguggcucaggcuggucucaaacucccggccuuaagugauccuucccucuuggccucccaaagugcugggauuaaagacuugagccaccgugccuggccuugaguacagaauuucuucauggggugaugaaaauguucuaaaauugguuguggugaugguuguacaguaaaguguaaacuuuaaaugaguaaauugugaaugauaucucaguaaagcugguuuauuuaaaacaacaggccaggugcuguggcucacgccuguaaucccagcacuuuggaaggcugaggcgggugaaucaccugaggucaagaguucgagaccagccuggccaacauggugaaaccccaucucuacuaaaaauacacaaaauuagcugggugugauggugggcaccuguagucccagcuacuugggaggcaggagaaucucuuggaccugggagguggagguuguagugagccgagaucacgccacugcauuccagccugggcaacaagagcgaaacucuuucucaaaaacaacaacaacaaaaaaacaggccagguaugguggcucauaucuguaaucccagcccuuugggaggccaaggcaggaggacugccugaaaccaggaguuucagaccacucugggcaacauagcaagaccccaucuuuuuuuuuuuuuuugagacggagucucgcucugucgcccaggcugaagugcaauggugcaaucucaacucacugcaagcucugccuccuggguucaugccauucuccugccucagcccuccugaguagcuggaacuacaggcgcccaccacuacgcccggcuaauuuuuuguauuuuuaguauagaugggguuucaccguguuagccaggauggucucgaucuccugaccuugugaucugcccgccucggccucccaaagugcugggauuacaggcgugaguuaccgcgccuggccacaagaccccaucuuuacaaaaaacuaaaaauuagcugggcaugguggcaugucccuuuagucccagcuacucaggaggcugagacaggaggaucgcuugagcccaggagaucgaggcagcagugagcuaugaucaugccacugcacuccagucugggcaacagaacgagaccuugucucuaaaaauaaaaacaaaacaaaacaacaagaaaacaggaccaucacucacagcaccucugccucugcccugccuacuugaaugaggugcagggcaucucaccugcucagagcagcccuugaaugagccccagcuauuucuaggguccucaaacgaaaccucccacggccaagucauacccaacaugggccuccuccccuauucuggccccugcucggagaugcugagugacagaggcuggacuugggguguuucuggcaaagccucacugcaggaagccccacagcucaggcccaguccuugguucacacggucccacuuccagcuucuuuugcccuuaagacugauuugucccugggagaucaccagaucccucauucagguggagugcugcagcgugacacuuuuuccaggggugacccaggccugcaggguuccagugucacaggcaggccuugcaugagccuccacccgagcuucugcuccuccucucccacagggaacgugauguucucuucccgggguacacccauuugcagagggcccagcccauccgcuggagccacuggauucugaggugagccaggugaggugcaggggcugugcuagaggggaggaccccggcugcccugacccuccugccccuggcuucccacagccacgccguggcacugacccgagacucugagcggcugcuggaggugcggaagcggaucaauguccugccccuggggaggugggugaggcuccagugccccgagggccugguggggguggcugcugcauagccuuagggauugacagagcugggaagugcagagugggacagaaaaccgccuuaucugcucagcgggggacucugcauggagccccagcucucgcuaaggugacgaccaagccauugaaugugucugagcagggccagagcccuccagcaaggcuccuggcaagcccagccugcugcccucagccugacaugugggaacaugugucaggagacaaguguccugcacccagggugacuuagugcuuggggacaaguguuuuguggacacuuggggacaaguauucuguacccaaggagacugggccagggaagaggcuaagcgccaggugguugcccuggcaaccaggacuugguucucugugugugcguucgugugugugugugugugugugugugugugugugugugugucagggcugccugccaggagcccuggucaccaugaaucccugucccugcaguggggccauugcaggcaauccccuggguguggaccgagagcugcuccgagcaggugagacguccugccccuccuccccagggagaaucacccucagcacccgccaagaccugcagacacaccugaaaccagagggcaggggccuguggcuccuggugaaaccuucauucauugccuaugggcacugaggucaucaaguucaggggucacucauggcagggaugccugguacugagagacucagggcuccugccucccuccugggacugugcaaaagaucccuccccccagcuguugccccacccugaucaggggagggggcugggcaaccuaguugggggagagggggccacucccuguccuccagcuuagcccugcuuccucccacccccccagaacucaacuuuggggccaucacucucaacagcauggaugccacuagugagcgggacuuugugggugaguccuggggagccaguccccugcccugugccucacuuuaguccuucagcccagcuucucuccaguuuccucccacaccuccacggacaggcugguuguggugauauuguacacugaaguauaaaccuuaaauggguaaaguggguggggcauggugguucaccaugcccagcacuggccaacauggugaaaccccaucucuacuaagaauacaaaauuuagcugggugugugguggcaggugccuguaaucccagcuacucaggaguucugaggccagagaaucacuugaacccaggaggcggaggcugcagugagccaagaucacgccagugcacuccagccugggcaacaagagcgaaacuccaucucaaaaaauaaaauaaaauaaaauaaaaauaaauaggccaggcaugguggcucacgcccguaauccuagcacuuugggaguccgaggcagguggaucacaugaggucaggaguuuaagaccagccuggccaacauggugaaaccccaucucuacuaaaagcacaaaaauuagcugggcaugguggugcaugccuguaaucccagcuacucgggaggcuaaggaaggagauucgcuggaaccugggagguagagguugcagugagccaagauugugccacuguacuccagccugugcauugggagcgagacuccaucucaauaaauaaauaaauaaauaaauggauaaauuguaugugagugauaacucaguaaagcugguuuauuuaaaacaacaacaauaacaaaaaacacgcuaggugcaauggcuuacguuuguaauccuagcacuuugggaggccaaagcagaaggauugcuugagcccacaaguuucagaacagcuugggcgacauagcacgaccccaucuuugcgaaaaaugaaaauuuagccggguccccccaccgccuaaccuccuccugcccccuguauggucaggcuggguggggaugggagaggccuggugacugggaaccuuuucucccagccgaguuccuguucugggcuucgcugugcaugacccaucucagcaggauggccgaggaccucauccucuacugcaccaaggaauucagcuucgugcagcucucagaugccuacagguaagcccugaacugccaccuccaucugccgcugccggccucuguaucccccgccgcccgcggacguggcugccuuccuccccgucccaccccuccgccagaccuggccauugcggcgcuggaccagccaaggguccagccccuucagcgccagcaccucuguccccagcacgggaagcagccugaugccccagaagaaaaaccccgacaguuuggagcugauccggagcaaggcugggcguguguuugggcgggugagcaaggcagggggaggggcggggccucugggcugaugguggguggccaggggggcaggaucccggguccagccccugugccucccucuucccgcagugugccgggcuccugaugacccucaagggacuucccagcaccuacaacaaagacuuacaggugcgaggccgggggaggccuggcuaguacgugccaguucucagggcucuggcacacucaggcagggccccaccccgggauugccauacauccucccauccugugcacacagcuccauccguggcugcccuugaacucucugcccuuccuuuguugggguauugaguguucuucccauggaaggcaguggggaugccucaguggggggguggggcuguggggacccugggugccagggggcugcuaggcccucaccuccugccaugugccucccaggaggacaaggaagcuguguuugaagugucagacacuaugagugccgugcuccagguggccacuggcgucaucucuacgcugcaggcaagacaucaccccccugcuucuccuccccuaggucccaggcacuggggugggcaugcggggaggguggccuugggaggaggugagguggggcuggaggaccuggggcagggaaggagaggugugcucgcuccugcuccuggggaacagggaaaggacagaaacugcugccaugcaguggaaguagaugagacucagggggccuggggccugucaaauggccugaccagaacucuuuaaaaaaagaaaaucuaaacaaaaggccaggugcaguggcucaugccuggaaucucacacuuugggaggccgaggcagauggagcacuugaggucagggguuugagaccagccuggccaacauggcguaaccacgucucuacuaaaaauacaaaaauuagccaggcgugauggcccacaccuguaaucccagcuacucaggaggcggaggcagaagaauagcuugaacccaggagauggaaguuguagugagccaagaucaugccgcugcacuccagccuggaccacagaguaaaacuccaucuacaaauauauaaauuaaauuaaauuaaauuaaauaucuuuaaaaaacauuuuuuagagacagggucacucucugucgcccaggcuggagugcaguggugcggucguagcucacugcagccucaaacucuugggcucaagugaucuucccaccucagucuccagaguagcugggacuacaaacaugcgccaccacgccuggcuaauuuuuuuauuuuuuguagagacagggucucccuauguuucccaggcuggucucaaauuccuggccccaagccauccucccaccuuggucucccaaggugcugggauuauaggcaugagccacuuugccuggcugauuucuuuuaaaaucaauuauuaugggaaauuuauguauauaacagcuagagaaugcauaaugaacccuauguaccgacacccagcuucaaugauaaucaacucacggacauccuggcuccagcugucuuuacccacagcucucucccacucccuuacccccuuauuuugaagcaaauucccaucaucacaucauuucauuccuaaauaguucaggauaugucuugaaaucaguguuucuuggcugggugcagagccucaugccuguaaucccaucaauuugcgagacuaaggugggcagaucacucgaggucaggaguucgagaccagccuggccaacauggcgaaaccccgucuuuacuaaaaauauaaaaauuagcuggguguggugguacacgccuguaaucccagcuacucaggaggcugaggcaggagaauugcuugaacccgggagauggagacugcagugagcagagaucacgccacugcgcuccagccugugugacagugcaagacuccaucucaaaaaaaaaaaaaaaaaaaaaaggcaguguuucuggaggcuagucccccaacuagcagcaccagcaucaccucagaaguccugagaaaugugaugugaggccccacuccagauggcugaaucagagacucugggggugcuccccagcaauuuguauuuuucuuaguaaauucuccaguggcuaggccugguggcucaugcuuguaaucccagcacuuugagaagcugaggcaggagaagcgcuugagcccaggaguucaaaaccagccugagcaacauagcgagaccuugucuguaaaauuaaaaaaauuaaauuagccagucgugauggcguguaccuguggucccagccacuuaggagacugaugugggaggaucccuugagcccaggagcucaaggaugcagagagccaggauugugccauugcacuccaacaugggcgacccugucucaaaaaagcccaaaacaacaacaacaaauuagcuaggcacgguggugugcauggcuguagucccagcuacuugggaggcugaggcuggaagaucccuugaguccaggcugcagagggcuauaauggccacugcacuccagccuggacaacagagcaagacccugucuccuaaaacagaaaacaaauccuccaggaacaucugaugcaugcugaagauaaggacucuuugaaaacauaaaggccaguaaaacauacaggccaguaaguguucauagcacauguaaauauuaucgauaauuaugagaagaugguucaaguugagagugagacagagccgaguggguaagagaguaucugcccaaggcagggauguccuggcagaggggcagguccugggccuggcagcuucagaucccaggguccccagggcucaccacucgcccaccugugcccccagauucaccaagagaacaugggacaggcucucagccccgacaugcuggccacugaccuugccuauuaccugguccgcaaagggguaaguguguagcagccagggggagggugaggagauggggugccccccccagagggugggggagcucaggaaugggugcaagcggcccagccugguggcucaccccuguaaucccagcacuuugggaagccgaggugggcgggucacuugaggccaggaguucgagaccagccuggucaacauggugaaaccccgucucuuuugauguaaaaauacaacaauuagcugggugugguggcacacuccuguaaucccaguuacucgggaggcugaggcaggagaauugauugaacugggagguggaguuugcggugaggugagaucgcgccacugcacuccagccugggcaacagagcgagacuuugugucaaaaagaaaaaaaaaaaaaaaaggaagggggugcaggcaauggaggcagaucagggcauggagaaaccugccucagcgccaucuuccucccuggcacccagaugccauuccgccaggcccacgaggccuccgggaaagcuguguucauggccgagaccaagggggucgcccucaaccagcugucacugcaggagcugcagaccaucagguacggcccauccccuuccccaugcugccuccuaggaagugagccugggugccuggagcccaggguggccuggcgcccuggcccaccucuuccucucuccccagcccccuguucucgggcgacgugaucugcgugugggacuacgggcacaguguggagcaguauggugcccugggcggcacugcgcgcuccagcgucgacuggcagauccgccaggugcgggcgcuacugcaggcacagcaggccuagguccucccacaccugcccccuaauaaagugggcgcgagaggaggcugcuguguguuuccugccccagccuggcucccucguugcugggcuuucggggcuggccaguggggacagucagggacuggagaggcagggcaggguggccuguaaucccagcacuuuggaagggcaaggugcgaggaugcuugaggccaggaguuugacacagccugggcaacacagggagacccccaucucuacucaauaauaaaacaaauagccuggcgugguggcccaugcauauagucccagcuacuuguaaggcugaggugagaggacacuugugcccaggaguggaggcugcagugagcuaugaucacgccacugcauuccagccuggauaacagagugagaaccuaucucuaaaaauaaauaaauaaacgaaaaauaa

SEQ ID NO: 61583 - RNA, 17496 nt, Homo sapiens
ccaggcggaggugagugcgcggcggccggaugggcgggacgggcguggaggacgccgagcaccguggcgcgcgcucacguccgcguccccaagggcugcgcucccucaagcgcagugcccagaacucggagccagcccggcccgggggacccugcuggccaaggaggucgucaguccggucuugucuuccagacccggaggaccgaagcuuccggacgacgaggaaccgcccaacauggccucggaggugagugggaccucggggacuccgguccuccuagccuccaaaggagagagugggggcgccagaccugccucgggccacccugcugggaaucgcccuccaggaagcaauuuugaaaauuaccuaggaagccugcacccccagcccucccgggcgcaucaucuggagcccagcagucaccuuuaccaggacucaccaguauccgcaggcagcccuuguggcaaacccaccaacccacacuacuagggguagaguggcucugcccucaccucacagugaugccugccuggccaggaaaaguggcucccaagccuucagccuuccaacucuuccuuccuucuuaccacguguccuccugucaggucccaccccacaccacaucccuucuccugcuagagcaauugucccuguuuauagaauaaagcucagccccuaaguguucuuguccuugacuguggcauguggaaagagccaggaaaaaggggacgucgccucguggcuccagcaacccuggugccuggucccuuccugucucacuggacccugccucuuagggucaguggcuccuggccucuccuccugaccacugagaugcuggauucccaggcagagguuuuccuuccuugggccauaguugauuuaucuggcaauggggguaauaauagcugucggccucacucuguaaggcacuagauuaugaggccauugcuuuggacccuucaggugagaggggcuguucgccugaugcuugaugaagggaacuccgggaagcaggaggucuggguuccaggcccuuuuggccuucauuagcuagcaauucacuuccucuuucucaaugcccugcaagcucagugcccugcaagcuucugggucauggcagggggguagggccuggacuuuggagccaaacagacuugguuucuguaccagucacuugagcccuuuaaaccucuuuccucauuugugaaauagggguaauauugcccaccucauaaaaggccguaauaacauaugugaaaucccuagcacagggcugagcaacaguaggugcucaauaaaugguggcuaaccacaacaauacugauauuucuacuuugggaggccgaggcgggaggacugcugaagcccaggaauuccagaccagccagggcaauguaaugagacccugucucuacaaaaagauuuugaaaauuacccaggugugguggcguacaccuguagucucacaggaggcggaggcaugaggauugcuugagcccaggaguuugagacugcagugagcaugaucucaccacugcacuccagcccaggcaacagagugagauccaguuucaaaaaaauaaaaauaaaaaaaccuggcaggcaugguggcucacaccuguaaucccagcacuuugggaggucgaggugggcagaucaccugaggucaggaguuugagaccagccuggccaacauggugaaaccccgucucuacuaaaaaugcaaaaauuagcuggguguaguggugggugccuguagucccagcuauucgggaggcugaggcaggagaaucgcuugaacucgggaggcggagguugcagugagcugagaucgcaccacugcacuccagccugggcgacaaagcaagacuccaccucaaaaaaagaaaaaaaacccacaagucccaaaaccaaaacugguauuucccauguacauucgaccuuaacuguugcucauucaacccagcccaacucagugccccauccccuggcccugaagagaccauucuggcccagauguguccuggcuuggaguagcaccuucugcuaccacacuaggccuccacucuccucagugcccaaggggaggcaccucacucugaucucccugugggguccucuuaugccugccaguaaggauaggaguuugguucuagagcagaguggucuggcuuccaacaagcccaguguucuaggugaccucagguugccccaggccuuccuguagguuggcacuaauugguuuggcugcagcuccacuuauuaaguaguuauuuuuauuacuaacaaccuaggcaggguggcccaggagcccgcugggggaggcggugccaggcuccuggcugaggggcaggcuggccccaauucugacuggcuggcuccagugaucaggaccagggccccacguggugcuuugcuggagaucuaggcuugguggggcagcugugggguaaggggcaggaccagcucaaagauggggugggggcggaggcugccucugcagggcagaguccuuuggcagucgggacuguugggcauagaggagucagcucacagcucagggccagagcacuggagaggucucuggggugcauacaggaaccaggaguggagcugaagcauguccuauccccugccagcccucccuuaguaacagcuggcauuucucgaguccuuccugagcaccaggcaccguguuauguaugcaauuugcaaauauuaucugauuaaaugcucacaauaaggcuaucagagagguacuauuauuauccuuaucuuauuauuauuauuauuauuauuuuuaagaaggagucuugcucugucgcccaagcuggaguacaauggcgccaucucugcucaccgcaaccucuaccuccaggauucaagugauucuccugcuucagacucccaaguggcugggacuacagcuuccugccaccgcgccuggcuaauguuuauauuuuuaguacagaugagguuucaccauguuggccaggcugaucucgaacuccugaccucaagcgauccaccugccugggccucccaacccugaggguuuuuguuuuuguuuuuguuuugagacagagucuugcucugucgcccaggcuggagugcaguggcacgaucucagcucacugcaagcuccgccucccggguucacgccauucuccugccucagccucccaaguagcugggacuacaggcgcccaacacccccaugccuggcuaauuuuuuuguguguguuuucaguagagacggaguuucaccauguuagccaggauggucuccaucuccugaccucgugaucugcccaccucagccucccaaagugcuaggauuauaggugugagccaccacgcccagccccugagguuuaauaauaggugccaggccaggugguuaauagaagucuggggcauuguagggggacagaggaggauauauguccccauuggccauuguagacucccuuccacaaaaaggacgucagugaagugacaugcccaccucuaccccacccuccucccaguccugggcacuagggcugcuccccagguguucuguacccccuccccacucugucccaugcccuggccucugcccucuuucaaaacauagauguggcuggcgccuaggcucaugccuauaaucucagcacuuugggaagcugaggcuggaggacagcuugagcccaggaauucaagaccagccugggcaacauagugagacccugucucuaccaauuauuuuauuuuauuuuauuuuguucauuuauuuauuuauuuugagacagaguuuugcucugucaccuaggcuggagugcaguggcgugaucuuggcucacugcaaccuccgccucccggguucaagcgauucuccugccucagccuccuaaguagcuggaacuacaggcgagugccaccacgccuggcuaauuuuuguauuuuuaguagagaccagguuucaccauguugaccaggauggucucugucuccugaccucaugauccacccaccuuagccuuccaaaaugcugggauuacaggcaugagccaccacucccaguccuauaaaauuuuaaaaaaaugucugggugugguggcgcaugcuuguagucccaacuauuggggaggcugaggcaagaggauugguugagaccaggaguuugaggcugcagugagcuaugauggugccaccgcacuccaaccuggguaacaaagugagacccugugucuaaaaaagaauuuaaaggccgggugugguggcucacacccguaaucccaggacuuugggaggccgaggugggcagaucacgaggucagauuaagaccauccuggcuaacaaggugaaaccacgucucuacugaaaaaaaaaaauacaaaaaauuagccaggcaugguggugggcaccuguagucccagcuacucaggaggcugaggcaggagaauggcgugaaucugggagguggagcuugcagugagccaagauccugccacugcacuccagccugggugacaaagagagacuccaucucaaaaaaaaaaaaaaaaaaaaagaauuaaaaaagauuuuuuuaaugaacaaaacaggcucggcacaguggcucaugccuguaaucccaagcacuucgggaugccaaggucaggggaucaccugagaucaggaguucgagaccagccugaccaacauggugaaaccccgucucuacuaaaaauauaaaacucagccaggugugguggcacacgccugaaauuccagcuacucgggaggcugaggcaggaaaauuggcuugaagccgggagguggagguugcagugagccgagaucacgccacugcacuccagccuaggcaacagagugagacucuaucucaaagaaaacgaacaaaacauagaugccuacauaccauuccucugcccuuggcuccuggggaguaagggaucacccagugaccuccuagaaggccagugacaauggggggugucagggugcuuuucagagccaagggagugguaggaauugggaucuuaguccagcuccaagcugugagggagagaguugcagggcacuuaagcuugguggagacccucaaggccucuuugccugucccugcagcaaagguucuggacaccagagccaaguccagaagcccugguggaacaggggugaaaagcauagguucugacuucagacugcugggccgcagcccuggcuaucccaccccaggugagagcaggcugcucugugccucaguuuccccaucuucauaguggaauuguauuggugccuacccagaggguugugucaacaauuaggauggcaccuagcaccuuggucaguggugggaaagguuccagaaguucugcuguggucccaggggugucucaggcccugccaucaucuccuuggaggggugccauguggugggaaagaaccccaacuucaaggccacacacaguggcucaugccuguaauccuagcacuuucagaggccaagaugggaggaucaccugaggucaggaguucaagaccagccuggccaacauggugaaaccccaucucuacuaaugauacaaaaauuagcugggugugguggcacgugccuguaaucccagcuacuugggagucugaggcaggagaaucucuugaaccugggaggcagaguuugcagugagcugagauggcaccacuguacuccagccuggccgacaaagugagacucugucucaaaaaaaaaaaaaaagaacccaaacuuuugguguucagccauguucccaugcucacucccaggguggugacucugggaaggucucagccuccuugucugcccaguuagaaugaucugaugccccugcuaccaucagacuugauaaguuucccaaagacucuuugcaagaagcacuguucuggaggguggaggagagacuaauuguucuugcucuccuggccagagugggaagcuuugggguggccgguuugugggugcaguggaccccaucauggagaaguucaacgcguccauugccuacgaccggcaccuuugggagguggauguucaaggcagcaaagccuacagcaggggccuggagaaggcagggcuccucaccaaggccgagauggaccagauacuccauggccuagacaagguacuugccguggcccaagccccacccaaggccccuucccuguggccccaggcucccaccaaaucccugagcaaacagugcaguguugcccaucugugguuucacauugaacuaauuauauacucaagugcuguuuaacugugugccuugaugacugccucucuccauccuuuaaugaccccuguggcccacauggcucauggguaaaggugugcugggccugagaugcccccucccagggugcgcuuccaggacucagcuccugggcagggacagucagucaccagggauagggugggaccaaggcaggggcucucuuggcugcugaugccugcucaccugaccccggcauugcugcuacccacuacagguggcugaggagugggcccagggcaccuucaaacugaacuccaaugaugaggacauccacacagccaaugagcgccgccugaagguacgaccccuggagccccaccgcuuuccuugccuccccucuccaccuugcccagggccacuuugagcauuagcaccauucuguuuacuucgccauuggcagacagcaugugagaccucaggacaugagccaggcacccuggcucaugccuauaauccuagcacuuugggaggcugaggugggaggauugcuugagaccaggaguucgagaccagccugggcaacauaaugaggucccacagcuacaaaaauuaaaaaaagaaaagaaaaaaagaacaggccucagcagaaauggcgagagauuuggggaggacccggagcccugggguauggagguagguuggcagggcugaugaggaaaacugcccugccuggguugacuccucuggggguauagaccgugacccugggucucccuucaccuccaggagcucauuggugcaacggcagggaagcugcacacgggacggagccggaaugaccaggugcuuuagccccuccacccccugcuccguguugucccaaccuugaggagcccagggggcaguuagaguucugcagcgguccuggcuccucagggaagcaacacaucggccucccugagcaccaucuccuccuugcacagguggucacagaccucaggcuguggaugcggcagaccugcuccacgcucucgggccuccucugggagcucauuaggaccaugguggaucgggcagaggcgugaguccuacagggacacccagggggcagacagaggugugauggaagccugaacaggagaccuagggggcaggggugaacagcgugggggugccaggcccugggggacaggggcaucccagaacuccaggaucgaggcagagcagccaggagugggccauuuccugcaggccccaauacucccaugccagucuagcucagcaggcagagaagacuaacccuucguggggcugggugcgguggcucacgccuguaaucucagcacuuugggaggccgagguggguggaucaccugaggucaggaguucgagaccagccuggccaacaugggaaaacucugucucuacuaaaaauacaaaaauuaggcaaugugguggugugcgccuguaaucccagcuacucgggagccugaggcagaagaacugcuugaacccgggaggaggagguugcaaugagccgagaucgcgccauugcacuccagccugggcuacagagcgagacuccugucucaaaaaaaaagaaaaaaaaaaaagaaaacucaccauuugcagauuugaaggcaggaagcuaagccaagcacagcuagcuuggcugugccuggagcagccagagucacuccccacacugccugucccccagaucccccauccuaagcuucgccuccccauccagcccaucuggcaaaagacagagccaaaggcugccuccugcuggccucauuucaggcuuuggcuucugggaccuggugucuuugggacuggauuuguuccuugcagaccuggacgaagagcugcugagaagucuccauguguugucagagaccccuccucuuccucaacucccugugaccccuguugugcagacuugggggaaaacaagggcacaagaauugucacccagcaggugguguggggcugcuaggaggaacagggagugucugcuacugaguucaggguuucuuuaauuuuuuguuguuguuguuuguuguuguuuuuuuuuuuuugagacaggguuuugcucugucaccuagucuggaguguaguggcgcuaucugagcuaacugcaaacucugccuccuggguucaagugauucuagugccucagccucccaaguagcugagauuacaggugugcaccaccauguccagcuaauuuuuguauuuuuuucaguagagauggguuuugccauguugaccaggcuggucuugaacuccugagcucaggugaucugcccgcgucggccugccaaagugcuaggauuacacccauaagccacugcgcucagcuuaauuuuuaaauuuuuaacuuuuuaaauugucuuuagagaugagauccugcucugucaccuaggcuggagugcaauggcuugguaauagcucacugcagucucaaacuccuggacucaaaugauccucccaccucagcuuucugaguagcuaggaccacaggugugcaccaccugugagacagagucuugcucuguugcccaggcuggagugcaguggcgugaucuccacucacugcaaccucugccucccagguucacgccauucuccugccucagccucccgaguagcugggaguacaggugcccaccaccacgcccggcuaauuuuuuguauuuuuaguagagacgggguuucaccauguuagccaggauggucucaaucucccgaccucaugauccacccaccucggacucucaaagugcugggauuacaggugugagccaccgugcccagccgcgaauucuuuaaauuuuuuguagaaacagggucucacuauguggcucaggcuggucucaaacucccggccuuaagugauccuucccucuuggccucccaaagugcugggauuaaagacuugagccaccgugccuggccuugaguacagaauuucuucauggggugaugaaaauguucuaaaauugguuguggugaugguuguacaguaaaguguaaacuuuaaaugaguaaauugugaaugauaucucaguaaagcugguuuauuuaaaacaacaggccaggugcuguggcucacgccuguaaucccagcacuuuggaaggcugaggcgggugaaucaccugaggucaagaguucgagaccagccuggccaacauggugaaaccccaucucuacuaaaaauacacaaaauuagcugggugugauggugggcaccuguagucccagcuacuugggaggcaggagaaucucuuggaccugggagguggagguuguagugagccgagaucacgccacugcauuccagccugggcaacaagagcgaaacucuuucucaaaaacaacaacaacaaaaaaacaggccagguaugguggcucauaucuguaaucccagcccuuugggaggccaaggcaggaggacugccugaaaccaggaguuucagaccacucugggcaacauagcaagaccccaucuuuuuuuuuuuuuuugagacggagucucgcucugucgcccaggcugaagugcaauggugcaaucucaacucacugcaagcucugccuccuggguucaugccauucuccugccucagcccuccugaguagcuggaacuacaggcgcccaccacuacgcccggcuaauuuuuuguauuuuuaguauagaugggguuucaccguguuagccaggauggucucgaucuccugaccuugugaucugcccgccucggccucccaaagugcugggauuacaggcgugaguuaccgcgccuggccacaagaccccaucuuuacaaaaaacuaaaaauuagcugggcaugguggcaugucccuuuagucccagcuacucaggaggcugagacaggaggaucgcuugagcccaggagaucgaggcagcagugagcuaugaucaugccacugcacuccagucugggcaacagaacgagaccuugucucuaaaaauaaaaacaaaacaaaacaacaagaaaacaggaccaucacucacagcaccucugccucugcccugccuacuugaaugaggugcagggcaucucaccugcucagagcagcccuugaaugagccccagcuauuucuaggguccucaaacgaaaccucccacggccaagucauacccaacaugggccuccuccccuauucuggccccugcucggagaugcugagugacagaggcuggacuugggguguuucuggcaaagccucacugcaggaagccccacagcucaggcccaguccuugguucacacggucccacuuccagcuucuuuugcccuuaagacugauuugucccugggagaucaccagaucccucauucagguggagugcugcagcgugacacuuuuuccaggggugacccaggccugcaggguuccagugucacaggcaggccuugcaugagccuccacccgagcuucugcuccuccucucccacagggaacgugauguucucuucccgggguacacccauuugcagagggcccagcccauccgcuggagccacuggauucugaggugagccaggugaggugcaggggcugugcuagaggggaggaccccggcugcccugacccuccugccccuggcuucccacagccacgccguggcacugacccgagacucugagcggcugcuggaggugcggaagcggaucaauguccugccccuggggaggugggugaggcuccagugccccgagggccugguggggguggcugcugcauagccuuagggauugacagagcugggaagugcagagugggacagaaaaccgccuuaucugcucagcgggggacucugcauggagccccagcucucgcuaaggugacgaccaagccauugaaugugucugagcagggccagagcccuccagcaaggcuccuggcaagcccagccugcugcccucagccugacaugugggaacaugugucaggagacaaguguccugcacccagggugacuuagugcuuggggacaaguguuuuguggacacuuggggacaaguauucuguacccaaggagacugggccagggaagaggcuaagcgccaggugguugcccuggcaaccaggacuugguucucugugugugcguucgugugugugugugugugugugugugugugugugugugugucagggcugccugccaggagcccuggucaccaugaaucccugucccugcaguggggccauugcaggcaauccccuggguguggaccgagagcugcuccgagcaggugagacguccugccccuccuccccagggagaaucacccucagcacccgccaagaccugcagacacaccugaaaccagagggcaggggccuguggcuccuggugaaaccuucauucauugccuaugggcacugaggucaucaaguucaggggucacucauggcagggaugccugguacugagagacucagggcuccugccucccuccugggacugugcaaaagaucccuccccccagcuguugccccacccugaucaggggagggggcugggcaaccuaguugggggagagggggccacucccuguccuccagcuuagcccugcuuccucccacccccccagaacucaacuuuggggccaucacucucaacagcauggaugccacuagugagcgggacuuugugggugaguccuggggagccaguccccugcccugugccucacuuuaguccuucagcccagcuucucuccaguuuccucccacaccuccacggacaggcugguuguggugauauuguacacugaaguauaaaccuuaaauggguaaaguggguggggcauggugguucaccaugcccagcacuggccaacauggugaaaccccaucucuacuaagaauacaaaauuuagcugggugugugguggcaggugccuguaaucccagcuacucaggaguucugaggccagagaaucacuugaacccaggaggcggaggcugcagugagccaagaucacgccagugcacuccagccugggcaacaagagcgaaacuccaucucaaaaaauaaaauaaaauaaaauaaaaauaaauaggccaggcaugguggcucacgcccguaauccuagcacuuugggaguccgaggcagguggaucacaugaggucaggaguuuaagaccagccuggccaacauggugaaaccccaucucuacuaaaagcacaaaaauuagcugggcaugguggugcaugccuguaaucccagcuacucgggaggcuaaggaaggagauucgcuggaaccugggagguagagguugcagugagccaagauugugccacuguacuccagccugugcauugggagcgagacuccaucucaauaaauaaauaaauaaauaaauggauaaauuguaugugagugauaacucaguaaagcugguuuauuuaaaacaacaacaauaacaaaaaacacgcuaggugcaauggcuuacguuuguaauccuagcacuuugggaggccaaagcagaaggauugcuugagcccacaaguuucagaacagcuugggcgacauagcacgaccccaucuuugcgaaaaaugaaaauuuagccggguccccccaccgccuaaccuccuccugcccccuguauggucaggcuggguggggaugggagaggccuggugacugggaaccuuuucucccagccgaguuccuguucugggcuucgcugugcaugacccaucucagcaggauggccgaggaccucauccucuacugcaccaaggaauucagcuucgugcagcucucagaugccuacagguaagcccugaacugccaccuccaucugccgcugccggccucuguaucccccgccgcccgcggacguggcugccuuccuccccgucccaccccuccgccagaccuggccauugcggcgcuggaccagccaaggguccagccccuucagcgccagcaccucuguccccagcacgggaagcagccugaugccccagaagaaaaaccccgacaguuuggagcugauccggagcaaggcugggcguguguuugggcgggugagcaaggcagggggaggggcggggccucugggcugaugguggguggccaggggggcaggaucccggguccagccccugugccucccucuucccgcagugugccgggcuccugaugacccucaagggacuucccagcaccuacaacaaagacuuacaggugcgaggccgggggaggccuggcuaguacgugccaguucucagggcucuggcacacucaggcagggccccaccccgggauugccauacauccucccauccugugcacacagcuccauccguggcugcccuugaacucucugcccuuccuuuguugggguauugaguguucuucccauggaaggcaguggggaugccucaguggggggguggggcuguggggacccugggugccagggggcugcuaggcccucaccuccugccaugugccucccaggaggacaaggaagcuguguuugaagugucagacacuaugagugccgugcuccagguggccacuggcgucaucucuacgcugcaggcaagacaucaccccccugcuucuccuccccuaggucccaggcacuggggugggcaugcggggaggguggccuugggaggaggugagguggggcuggaggaccuggggcagggaaggagaggugugcucgcuccugcuccuggggaacagggaaaggacagaaacugcugccaugcaguggaaguagaugagacucagggggccuggggccugucaaauggccugaccagaacucuuuaaaaaaagaaaaucuaaacaaaaggccaggugcaguggcucaugccuggaaucucacacuuugggaggccgaggcagauggagcacuugaggucagggguuugagaccagccuggccaacauggcguaaccacgucucuacuaaaaauacaaaaauuagccaggcgugauggcccacaccuguaaucccagcuacucaggaggcggaggcagaagaauagcuugaacccaggagauggaaguuguagugagccaagaucaugccgcugcacuccagccuggaccacagaguaaaacuccaucuacaaauauauaaauuaaauuaaauuaaauuaaauaucuuuaaaaaacauuuuuuagagacagggucacucucugucgcccaggcuggagugcaguggugcggucguagcucacugcagccucaaacucuugggcucaagugaucuucccaccucagucuccagaguagcugggacuacaaacaugcgccaccacgccuggcuaauuuuuuuauuuuuuguagagacagggucucccuauguuucccaggcuggucucaaauuccuggccccaagccauccucccaccuuggucucccaaggugcugggauuauaggcaugagccacuuugccuggcugauuucuuuuaaaaucaauuauuaugggaaauuuauguauauaacagcuagagaaugcauaaugaacccuauguaccgacacccagcuucaaugauaaucaacucacggacauccuggcuccagcugucuuuacccacagcucucucccacucccuuacccccuuauuuugaagcaaauucccaucaucacaucauuucauuccuaaauaguucaggauaugucuugaaaucaguguuucuuggcugggugcagagccucaugccuguaaucccaucaauuugcgagacuaaggugggcagaucacucgaggucaggaguucgagaccagccuggccaacauggcgaaaccccgucuuuacuaaaaauauaaaaauuagcuggguguggugguacacgccuguaaucccagcuacucaggaggcugaggcaggagaauugcuugaacccgggagauggagacugcagugagcagagaucacgccacugcgcuccagccugugugacagugcaagacuccaucucaaaaaaaaaaaaaaaaaaaaaaggcaguguuucuggaggcuagucccccaacuagcagcaccagcaucaccucagaaguccugagaaaugugaugugaggccccacuccagauggcugaaucagagacucugggggugcuccccagcaauuuguauuuuucuuaguaaauucuccaguggcuaggccugguggcucaugcuuguaaucccagcacuuugagaagcugaggcaggagaagcgcuugagcccaggaguucaaaaccagccugagcaacauagcgagaccuugucuguaaaauuaaaaaaauuaaauuagccagucgugauggcguguaccuguggucccagccacuuaggagacugaugugggaggaucccuugagcccaggagcucaaggaugcagagagccaggauugugccauugcacuccaacaugggcgacccugucucaaaaaagcccaaaacaacaacaacaaauuagcuaggcacgguggugugcauggcuguagucccagcuacuugggaggcugaggcuggaagaucccuugaguccaggcugcagagggcuauaauggccacugcacuccagccuggacaacagagcaagacccugucuccuaaaacagaaaacaaauccuccaggaacaucugaugcaugcugaagauaaggacucuuugaaaacauaaaggccaguaaaacauacaggccaguaaguguucauagcacauguaaauauuaucgauaauuaugagaagaugguucaaguugagagugagacagagccgaguggguaagagaguaucugcccaaggcagggauguccuggcagaggggcagguccugggccuggcagcuucagaucccaggguccccagggcucaccacucgcccaccugugcccccagauucaccaagagaacaugggacaggcucucagccccgacaugcuggccacugaccuugccuauuaccugguccgcaaagggguaaguguguagcagccagggggagggugaggagauggggugccccccccagagggugggggagcucaggaaugggugcaagcggcccagccugguggcucaccccuguaaucccagcacuuugggaagccgaggugggcgggucacuugaggccaggaguucgagaccagccuggucaacauggugaaaccccgucucuuuugauguaaaaauacaacaauuagcugggugugguggcacacuccuguaaucccaguuacucgggaggcugaggcaggagaauugauugaacugggagguggaguuugcggugaggugagaucgcgccacugcacuccagccugggcaacagagcgagacuuugugucaaaaagaaaaaaaaaaaaaaaaggaagggggugcaggcaauggaggcagaucagggcauggagaaaccugccucagcgccaucuuccucccuggcacccagaugccauuccgccaggcccacgaggccuccgggaaagcuguguucauggccgagaccaagggggucgcccucaaccagcugucacugcaggagcugcagaccaucagguacggcccauccccuuccccaugcugccuccuaggaagugagccugggugccuggagcccaggguggccuggcgcccuggcccaccucuuccucucuccccagcccccuguucucgggcgacgugaucugcgugugggacuacgggcacaguguggagcaguauggugcccugggcggcacugcgcgcuccagcgucgacuggcagauccgccaggugcgggcgcuacugcaggcacagcaggccuagguccucccacaccugcccccuaauaaagugggcgcgagaggaggcugcuguguguuuccugccccagccuggcucccucguugcugggcuuucggggcuggccaguggggacagucagggacuggagaggcagggcaggguggccuguaaucccagcacuuuggaagggcaaggugcgaggaugcuugaggccaggaguuugacacagccugggcaacacagggagacccccaucucuacucaauaauaaaacaaauagccuggcgugguggcccaugcauauagucccagcuacuuguaaggcugaggugagaggacacuugugcccaggaguggaggcugcagugagcuaugaucacgccacugcauuccagccuggauaacagagugagaaccuaucucuaaaaauaaauaaauaaacgaaaaauaa

SEQ ID NO: 61584 - RNA, 17496 nt, Homo sapiens; identical to SEQ ID NO: 61583

SEQ ID NO: 61585 - RNA, 17496 nt, Homo sapiens; identical to SEQ ID NO: 61583

SEQ ID NO: 61586 - RNA, 8085 nt, Homo sapiens
aaggaggagugcacuggccgggaucggugcagcgcucacacucacucacagucacucucucugagcgcgucucgcucgcucucauacacgcccggagcccaggagcgcucaggaucccgagcgccgcgaaaaaguucccccggcuuuugcuggagacucaucgcuuugggaagugcauuugcuucguggcuccgccgagccugcugaauccuguccucgcggcucgggaccccgggaucgcugaccgcugccgccgccgccucugccucccggacuaucggcagccucggcaacaauaguggcggccgcccccagcgaggcuccgggagcccuugccugcggggguccggggacucgagccggccuccgccucccggacgcacagccagcgugguccccgcgugcaacgcgagcgccggggaguggcuccugcuuugccccucgugggggccgagccaagaccagucugcaaacuccaucccgccggcuggaagaagucgcggagccggcaccaaacccgcagcgucuucccgcgcggaucccgggacuuaaaaagccggggccaccccggcccaggacgggaugcgggucgguccggugcgcucugccaugagcggcgccucgcagccccgcggcccggcccugcucuucccagccacccgaggcgucccggccaaacgccugcuggacgccgacgacgcggcggcuguggcggccaagugcccgcgccucuccgagugcuccagccccccggacuaccucagcccccccggcucgcccugcagcccgcagcccccgccugccgcuccgggggccggcggaggcuccgggagcgcgccggggcccagccgcaucgccgacuaccugcugcugccccuagccgagcgcgagcaugugucccgggcgcugugcauccacacuggacgcgagcugcgcugcaagguaggcgcucccgggccaggacccggcuggggucgggggcgcgggacggggugguaggcaaaggugcuugggguccggccaacgcuugggcugggcacagggcggaucaguagauugggucagauaagacgccauuugaccagguucacguuuuuguggaucgagggguuucccauggagugauauaaugggggcgccuagaggaagugcaguguucaguggcuuucucuaucuguuccuuuccucagcgcccaguguagcgcguggcguuccauauaaguuguggaauugaaauggauuccagggccaugccauuccccuucucucauucuccucgcucuccacccccccucccccgccaauguccuggaaggacgcccuuuagugggugccuccuaggagcuuggagcagcuggcagcucucuugccgggcuugcacggcacccgggcucaguuguaggugguaagggggcuggaagacuguguccggcuccugccuuggggauuccgaauugaauccgcgcugagacuagaacacgcccucccaagggagcagucccagagucauccacccgaggcggaggaaucugcucggaguagaaauguugaaaagcccacaccggccaggaacccucgcuucgauucacuuuauuuuccagccagcgauuuuccuuugaacauagggaucccauccaggaggaggagacacagcuccuagaaacaggauccgccggguccuccuccugcgcggguagacgcagaacguucccacagucuacuuuaugcgagcguggcaccccugcuugaggcaccccagagcacccucgggccgcuccuuuucacccgaaagauaggaucaccccccaguuaagucgcuucuggguuuuccgcaacucaccugacacucccaacaccccgaccccgucccggggcucgcugcugccaccuacugcccaacccgaaugaaauuucagacgcaugaucaagcccaguuuaauagggaggaaaaaaaaaccuuuucuucuccaugacuggggcuaagagcuguucugggacaagcauguauguguguguggugggaugggaugggauggggugggaggagggggcagcaggggauuuuucuagcuggugccagagcagccaggccucuuagagguggggugagucuggccauugugcaaccccuuccaguuccucugagcagauaauagcugaauccagauggugacagcccgugugucaccguuuccaguugagucuaggauaugaguaacuggacugaacaaaaggccuuuaaagagaccagccagcuuccuagaagagaggagaugcuacucauuucuagggguggggucggguguggggggauaaacaaacaaguggaaaacccauucgcaggauuccauacccuuccugugagaauuguaacucaaggcugcuuacacuugagucggacuguaggcagguugcuuaaggcugcauugucccagccucccccuccaagucaucuguuccuucugauuaaugacagcucugcauguucucuggccccugcuuccccuuggaggcugcagagucaccacauucugugcccuuucuguguugagcacuuugggucugcaggaggcacaugcacguccagggacugcuuuucagcuccuggacaggccaggggcuuccuucuaucagccacucaacuaguguggccugcaaacaggaaagggccacagagggugggggguuugcuuagcucucaggagcugacagaagaugggaacauguacaggagacaguucuuucaaaucaucugugugaaagcggguaacccuuuggguauuugcaagucuagagcuuuagguguuacugguuuuaaaggugucaggggcagcuggggcugcguaagguaagguggcagaggaaaggaguaggugaauggaacuuacucacauccuaagcccacagguugagaacuucuguucagcucccucagggguuugggaggcugccuuugcuuuucuagcccccuaaacgggccccccuucucucuacagguguuucccauuaaacacuaccaggacaaaaucaggccuuacauccagcugccaucgcacagcaacauuacuggcauuguggaagugauccuuggggaaaccaaggccuaugucuucuuugagaaggacuuuggggacaugcacuccuaugugcgaagccggaagaggcugcgggaagaggaagccgcccggcucuucaagcagauugucuccgccgucgcccacugccaccagucagccaucgugcugggggaccugaagcuuaggaaguucgucuucuccacggaggagaggugagcggccgccacagcuucuccuguggccuuuuggaaccaaagcggaggugcaggucauguaguuaggugcuguguguuggugcaaaacaaagucaagggcucauaugucccagauuuaguauuuagagcuucuguuccugaggagucacagccaagguugguuuauucugcauucucuuggacggggccuggggacaccguggcgcuucuaugggauggcaaguguugacagggugcucuuccucuccuaccccaggaucagguucauuccccauuguugucagaaaggucaguugucugggguacaaauauuaaacugcccuuuacgauauugccuucugaaggaaguguucaaaucuuugcuuaugccaagugcuguuuuguaccuggaagguuucacagagcuagugagacugucauauaugcagaauuccacccucuuguuucacacagcauuccucucccaucccaguccagguucucuguaacaucacauucucuggugacuuuuuagacagcuuguuuggauccgucuucagaaaauagccacauugaauaguaaauggaaguugguuaggauggauugcuaaauauagaucauagcuuaccucauaaagaacaagaugagcuugauaagagaguaaugaggcauuaagauucaaagcugagguuucagcuagagaauucaggaagccgcaugagauagaccacacuugauuuuaagagccagccacaucccuuguggaaagauuacaagcaguaaggcuguaacauuguagaggugagagugaguuaguuuguuguaagaagugggcuuaucucaccugugcauuuuuaccuuugacuccagagcauaugaaacaguacaggguugagcugucauaaagcaugacuuuguaucugaccucgcaauaauuauuggaacacacugauuagcaaagaaaagcaaacuguuggcaaugaagaaguuucuaauuccuggaacaugcuccuuugauauggugaugcauuuucugaaacaugccuuacacaccuccuuacuagcuuuugaaaucugcauugcacaggcgaauaucaugggcaugggguuuggcaacccggggguuaagcaaugucaggcugacgcuauucguguaaccagcacaggugcaggguuuuagugcuguagcagccaaucaggggcagacaguguggguugagucauauuuuccguuuacagaaccaauggguauuuuacauaacgacagggaggucacgcugaggacauacugaaguuagcacauguauacuacacuccagggaacaggaaggcagaaaaaaaaaaaaacagaccuuugagaggaaaaggaauugacccaucagccaguaccaaauguuugcauuuaacuucacaagugacuuacugaaacggguauuucagagaagcaggcagagacagggugucacuggauaucagagcuuccccaccacauggcuuugagcuuugggggauccaggagacuuggguggcugguucugaauaaggaggcaccugcagcuucauaagagagccuuugacugaagguguuuuagacuuucguuguuaccugaacagagacccccccuguagaauacauaugcucacauguugaugugccaucccagggggagugugugucccuguguaagaauuucagggucccugcgucccugaaauccaucagccacuuuuguuugcucgcauaaccucucuguccaggcaaaguguucuuugcaguuaaacaccccaauaaauguaauuaacauuccuugcaacuuucccauccuaauuguugcagccugggcccaggaggacaaaguuugcucugugugcauguaucagugugggcaccagcgcugaugaccuguguguaauagcagugacuuugggcuccguguucuguaaugcaguguggguccagguagcccuggcagucauaagagggaagauggguucguaggaugcucaggcccucucugaagaaguaggauaugcugcucuucccugcuagcuuuuguagagaaugcagcauucugagacaggcucccaguucugcaaugggaacuuaguaaauugcguaacuccuauuaggauaucucuuguaagcuccagcauuaugaauacuauuuggggcuuugccucauacccuccaccccaggcgcucugccgauacuuugcaaacauuuauugcaguucguguuaguuugugaaaucaggagcccucgguaguugcagggcacugcuuacuggacgaagggguaaauagcauuccuggagccuuugcuguuagugccugugggcgcuguuauugggaaggcuuuguuuuucauagcagcugguguggaaauaauggcuugguuccucucucuugcagaacccagcuuagacuagaaagucuagaagacacacacauaaugaagggggaagaugaugcuuugucagacaaacauggcugcccagccuacgugagcccugagauccucaacaccacugggaccuacuccggaaaggcugcggacguuuggagccugggggugaugcucuacacccuucugguuggacgauaccccuuccaugacucagaccccagugcccuuuucuccaaaauucggcguggacaguucugcauuccugagcacauuucccccaaagccaggugccucauucgcagccucuugagacgggagcccuccgagagacucacugcccccgagauccuacugcaccccugguuugaguccgucuuggaacccggguacaucgacucagaaauaggaacuucagaccagauuguuccagaguaccaggaggacagugacauuaguuccuucuucugcuaauccccaaaaccucagaaaccucauaauucuuaacaccuggcauuuccauuucuaaagauggacaggcccuuuggcgugguaccaaccagauaaugacugcaucaggaugaaagcugcugaacucggcauggcgccuccucuucucuguugggaugagugacuuuauugauuugagcagcauaugcugugauuggcugcccugcaaauuuguuucccuuaaggaacccucaccaacuaucucugcuggauuugggaguuccgcaucuuuuguggagggcagaguauggacaucuuacacccgguggucaaguguguaauaaacuugagcauucgaaugggagaaaaagcaaaucgcacaaugacauauuuugaguaauaaccguauuuuucacagggugacaaauugggccaauaaaucugccaucuuugaacucaucuuugguggcuagacugcuacggcagcuucucugaugggaaaguuccuuuuuuggcuuaacacucacccuuucuucacacucacauuuaccaaugacucugcuccguuuuuggagcagacuguuuuaaguugcucaggagccugauggaaccaugaaccgagacucuucucuguuuccugccaagaccucaucugcacuaaugccuucucccugaccuugacacuucccccuuuagcuauaaaagcacuuaccagccgaacguggaacaguaucacaaaagauuccaucucccaacgauuucagaacucugagcucagagagacuccagauuuuaaaaaauaauuugagugcuuggaaacuauuagcuuuuuaaguuccuuccaaauauguuaguaccuacccuuuacuuuuuccccaagaccaucucaggguggagcauucugucuaagagaagaaagauaaggaggcucccacccaccucucccaagagcagacauuaaacaucuuugugcuuugaagagagugaauuuuggauagucuugugauucucagacuaacuuccagaauuauacuuuaaccccucccagauaugguccgccuuuggcauuguguguacaucugcaguuuugcaugguggguuguuaauauuucaaaugugugguuuaugaauacgucuguauaaucggcuucuggagugaaacagcaaaccccaaaucuucaaaguuggaaggaacuuuaaaaaucauccgguccaaucucuuuccucuuucugccaccucccaaggcagaaauccccucuucagcuucuuuuguaggugggaauccagccucuguuagauauguccagagauggaaacucacuccccuacaaaagauggagcuuaauggagaaauugcaacuuucauuaaaaaacaaauucagaugaaauaucaguaacugucuuggacagugcugaaaucaggugguuaaacggguaaacaaaauauacuguauuuugagaaauggcacaaaaacaggcagucaucuuuaagggcuaugccuaggcaaacuacuaacaugcauugugagaaugccguguauaccucacguacuguguacuuuguacauauauuuuaccuuuuauaccuauguucgauuuuguuuuguuuuguuuuguucuggcuuugaggcuuguuuuguugucugugucugucugaauaaccugcgugucuaaaaccacgugaaaugugaaugauuauuggcaauauuaccuugacagaaucaugggacuuugagaagagggaggacagaggccucugucgcacuaacgcucucgugguugcucgacuguuguaucugugauacauuauccgacuaaggacucugggcuggcagggccuucugccgggaaagcuagaaacacuagguucuuccuguacauacguguauauaugugaacagugagauggccguuucugacuuguagagaaauuuuaauaaaccugguuucguaaaua

SEQ ID NO: 61587 - RNA, 6197 nt, Homo sapiens
cuacugcccaacccgaaugaaauuucagacgcaugaucaagcccaguuuaauagggaggaaaaaaaaaccuuuucuucuccaugacuggggcuaagagcuguucugggacaagcauguauguguguguggugggaugggaugggauggggugggaggagggggcagcaggggauuuuucuagcuggugccagagcagccaggccucuuagagguggggugagucuggccauugugcaaccccuuccaguuccucugagcagauaauagcugaauccagauggugacagcccgugugucaccguuuccaguugagucuaggauaugaguaacuggacugaacaaaaggccuuuaaagagaccagccagcuuccuagaagagaggagaugcuacucauuucuagggguggggucggguguggggggauaaacaaacaaguggaaaacccauucgcaggauuccauacccuuccugugagaauuguaacucaaggcugcuuacacuugagucggacuguaggcagguugcuuaaggcugcauugucccagccucccccuccaagucaucuguuccuucugauuaaugacagcucugcauguucucuggccccugcuuccccuuggaggcugcagagucaccacauucugugcccuuucuguguugagcacuuugggucugcaggaggcacaugcacguccagggacugcuuuucagcuccuggacaggccaggggcuuccuucuaucagccacucaacuaguguggccugcaaacaggaaagggccacagagggugggggguuugcuuagcucucaggagcugacagaagaugggaacauguacaggagacaguucuuucaaaucaucugugugaaagcggguaacccuuuggguauuugcaagucuagagcuuuagguguuacugguuuuaaaggugucaggggcagcuggggcugcguaagguaagguggcagaggaaaggaguaggugaauggaacuuacucacauccuaagcccacagguugagaacuucuguucagcucccucagggguuugggaggcugccuuugcuuuucuagcccccuaaacgggccccccuucucucuacagguguuucccauuaaacacuaccaggacaaaaucaggccuuacauccagcugccaucgcacagcaacauuacuggcauuguggaagugauccuuggggaaaccaaggccuaugucuucuuugagaaggacuuuggggacaugcacuccuaugugcgaagccggaagaggcugcgggaagaggaagccgcccggcucuucaagcagauugucuccgccgucgcccacugccaccagucagccaucgugcugggggaccugaagcuuaggaaguucgucuucuccacggaggagaggugagcggccgccacagcuucuccuguggccuuuuggaaccaaagcggaggugcaggucauguaguuaggugcuguguguuggugcaaaacaaagucaagggcucauaugucccagauuuaguauuuagagcuucuguuccugaggagucacagccaagguugguuuauucugcauucucuuggacggggccuggggacaccguggcgcuucuaugggauggcaaguguugacagggugcucuuccucuccuaccccaggaucagguucauuccccauuguugucagaaaggucaguugucugggguacaaauauuaaacugcccuuuacgauauugccuucugaaggaaguguucaaaucuuugcuuaugccaagugcuguuuuguaccuggaagguuucacagagcuagugagacugucauauaugcagaauuccacccucuuguuucacacagcauuccucucccaucccaguccagguucucuguaacaucacauucucuggugacuuuuuagacagcuuguuuggauccgucuucagaaaauagccacauugaauaguaaauggaaguugguuaggauggauugcuaaauauagaucauagcuuaccucauaaagaacaagaugagcuugauaagagaguaaugaggcauuaagauucaaagcugagguuucagcuagagaauucaggaagccgcaugagauagaccacacuugauuuuaagagccagccacaucccuuguggaaagauuacaagcaguaaggcuguaacauuguagaggugagagugaguuaguuuguuguaagaagugggcuuaucucaccugugcauuuuuaccuuugacuccagagcauaugaaacaguacaggguugagcugucauaaagcaugacuuuguaucugaccucgcaauaauuauuggaacacacugauuagcaaagaaaagcaaacuguuggcaaugaagaaguuucuaauuccuggaacaugcuccuuugauauggugaugcauuuucugaaacaugccuuacacaccuccuuacuagcuuuugaaaucugcauugcacaggcgaauaucaugggcaugggguuuggcaacccggggguuaagcaaugucaggcugacgcuauucguguaaccagcacaggugcaggguuuuagugcuguagcagccaaucaggggcagacaguguggguugagucauauuuuccguuuacagaaccaauggguauuuuacauaacgacagggaggucacgcugaggacauacugaaguuagcacauguauacuacacuccagggaacaggaaggcagaaaaaaaaaaaaacagaccuuugagaggaaaaggaauugacccaucagccaguaccaaauguuugcauuuaacuucacaagugacuuacugaaacggguauuucagagaagcaggcagagacagggugucacuggauaucagagcuuccccaccacauggcuuugagcuuugggggauccaggagacuuggguggcugguucugaauaaggaggcaccugcagcuucauaagagagccuuugacugaagguguuuuagacuuucguuguuaccugaacagagacccccccuguagaauacauaugcucacauguugaugugccaucccagggggagugugugucccuguguaagaauuucagggucccugcgucccugaaauccaucagccacuuuuguuugcucgcauaaccucucuguccaggcaaaguguucuuugcaguuaaacaccccaauaaauguaauuaacauuccuugcaacuuucccauccuaauuguugcagccugggcccaggaggacaaaguuugcucugugugcauguaucagugugggcaccagcgcugaugaccuguguguaauagcagugacuuugggcuccguguucuguaaugcaguguggguccagguagcccuggcagucauaagagggaagauggguucguaggaugcucaggcccucucugaagaaguaggauaugcugcucuucccugcuagcuuuuguagagaaugcagcauucugagacaggcucccaguucugcaaugggaacuuaguaaauugcguaacuccuauuaggauaucucuuguaagcuccagcauuaugaauacuauuuggggcuuugccucauacccuccaccccaggcgcucugccgauacuuugcaaacauuuauugcaguucguguuaguuugugaaaucaggagcccucgguaguugcagggcacugcuuacuggacgaagggguaaauagcauuccuggagccuuugcuguuagugccugugggcgcuguuauugggaaggcuuuguuuuucauagcagcugguguggaaauaauggcuugguuccucucucuugcagaacccagcuuagacuagaaagucuagaagacacacacauaaugaagggggaagaugaugcuuugucagacaaacauggcugcccagccuacgugagcccugagauccucaacaccacugggaccuacuccggaaaggcugcggacguuuggagccugggggugaugcucuacacccuucugguuggacgauaccccuuccaugacucagaccccagugcccuuuucuccaaaauucggcguggacaguucugcauuccugagcacauuucccccaaagccaggugccucauucgcagccucuugagacgggagcccuccgagagacucacugcccccgagauccuacugcaccccugguuugaguccgucuuggaacccggguacaucgacucagaaauaggaacuucagaccagauuguuccagaguaccaggaggacagugacauuaguuccuucuucugcuaauccccaaaaccucagaaaccucauaauucuuaacaccuggcauuuccauuucuaaagauggacaggcccuuuggcgugguaccaaccagauaaugacugcaucaggaugaaagcugcugaacucggcauggcgccuccucuucucuguugggaugagugacuuuauugauuugagcagcauaugcugugauuggcugcccugcaaauuuguuucccuuaaggaacccucaccaacuaucucugcuggauuugggaguuccgcaucuuuuguggagggcagaguauggacaucuuacacccgguggucaaguguguaauaaacuugagcauucgaaugggagaaaaagcaaaucgcacaaugacauauuuugaguaauaaccguauuuuucacagggugacaaauugggccaauaaaucugccaucuuugaacucaucuuugguggcuagacugcuacggcagcuucucugaugggaaaguuccuuuuuuggcuuaacacucacccuuucuucacacucacauuuaccaaugacucugcuccguuuuuggagcagacuguuuuaaguugcucaggagccugauggaaccaugaaccgagacucuucucuguuuccugccaagaccucaucugcacuaaugccuucucccugaccuugacacuucccccuuuagcuauaaaagcacuuaccagccgaacguggaacaguaucacaaaagauuccaucucccaacgauuucagaacucugagcucagagagacuccagauuuuaaaaaauaauuugagugcuuggaaacuauuagcuuuuuaaguuccuuccaaauauguuaguaccuacccuuuacuuuuuccccaagaccaucucaggguggagcauucugucuaagagaagaaagauaaggaggcucccacccaccucucccaagagcagacauuaaacaucuuugugcuuugaagagagugaauuuuggauagucuugugauucucagacuaacuuccagaauuauacuuuaaccccucccagauaugguccgccuuuggcauuguguguacaucugcaguuuugcaugguggguuguuaauauuucaaaugugugguuuaugaauacgucuguauaaucggcuucuggagugaaacagcaaaccccaaaucuucaaaguuggaaggaacuuuaaaaaucauccgguccaaucucuuuccucuuucugccaccucccaaggcagaaauccccucuucagcuucuuuuguaggugggaauccagccucuguuagauauguccagagauggaaacucacuccccuacaaaagauggagcuuaauggagaaauugcaacuuucauuaaaaaacaaauucagaugaaauaucaguaacugucuuggacagugcugaaaucaggugguuaaacggguaaacaaaauauacuguauuuugagaaauggcacaaaaacaggcagucaucuuuaagggcuaugccuaggcaaacuacuaacaugcauugugagaaugccguguauaccucacguacuguguacuuuguacauauauuuuaccuuuuauaccuauguucgauuuuguuuuguuuuguuuuguucuggcuuugaggcuuguuuuguugucugugucugucugaauaaccugcgugucuaaaaccacgugaaaugugaaugauuauuggcaauauuaccuugacagaaucaugggacuuugagaagagggaggacagaggccucugucgcacuaacgcucucgugguugcucgacuguuguaucugugauacauuauccgacuaaggacucugggcuggcagggccuucugccgggaaagcuagaaacacuagguucuuccuguacauacguguauauaugugaacagugagauggccguuucugacuuguagagaaauuuuaauaaaccugguuucguaaaua

SEQ ID NO: 61588 - RNA, 4010 nt, Homo sapiens
acgugcuggcggcuggccaaucaucgggggcggcgcggggaggggugguguggacggagaaagugaaaggugaggcacggcccugcagauuuuccagcggaucccccgguggccucaugucgcgcaguggaaccgauccucagcaacgccagcaggcgucagaggcggacgccgcagcagcaaccuuccgggcaaacgguaacugcaccgcggcagggacucgcuggggcgcggagccgagcccuccccuuccuuaggaagcuuucguccccuccgaagguuggaacgcucaucccgagccagaccgacaaggcguacagucugcaggccuguacgagcagcaggccaauuggcgcugggaaaguccaauccugggccucuagcuccugagcgggacagggccgagagggcgcucccgagcuugggccugcuggugggugagacccaggagagagggagcuagagagcucugaggacugaucuugacugucugcccccagaccaucagcauauccgcuacaacccgcugcaggaugagugggugcuggugucagcucaccgcaugaagcggcccuggcagggucaaguggagccccagcuucugaagacagugccccgccaugacccucucaacccucuguguccuggggccauccgagccaacggagagguaagccuguagagcccugcaucugcaggcugggccacggggaguaguucccucuuagaacuguccuccacccacagggauagugaaccuccuucugggucauaucccaccaagcuuuuugguccccuagggugggccuucccuacucccuuguagccuguccagucuuugaagcccaccagguaacuggugguauggggcagugagugcuucuagccuauccuugucgguaggugaauccccaguacgauagcaccuuccuguuugacaacgacuucccagcucugcagccugaugcccccaguccagguaaccuggcuccaacugcugcuggggaggaggguggcuagaccucuugagggacuucugcugcagagagugauacuccuuuaccucaggacccagugaucauccccuuuuccaagcaaagucugcucgaggagucugguaacuauggauuuccccucuuacaacuuucaaaccagaguuggagacucagcauugggguucggcccugcccguagcacagccaagcccuaccucucgguuaucuuuucucccgucaccacccaguaaggucaugugcuuccaccccuggucggauguaacgcugccacucaugucggucccugagauccgggcuguuguugaugcaugggccucagucacagaggagcugggugcccaguacccuugggugcagguuugugaggucgccccuuccccuggaugggcagggagggggugaugaagcuuugguucuggggaguaacauuucuguuuccacaggguguggucaggagggaguugacuuggugucuuuuggcuaacagagcuccguaucccuaucugauagaucuuugaaaacaaaggugccaugaugggcuguucuaacccccacccccacugccagguaagggugucaggggcuccaguggguuucuuggcugagucugagccagcacuguggacaugggaacaggauuaauggaugggacagaggaaauaugccaaugauguggaggcuuggagguaaaggaccugccuguucuucucugcuuuugccccuugacagguaugggccagcaguuuccugccagauauugcccagcgugaggagcgaucucagcaggccuauaagagucagcauggagagccccugcuaauggaguacagccgccaggagcuacucaggaaggugggagagagccaagcccuguguccccaaggagucccuaacuuucuuaucccaugagagagguguguaaaggagaaagcuagaggugaacuaguagagagagacuugcuaggaggccuuagcaauaauccaguaaucuaaaggaaagaugauggugacuuagacucgggugguuagugguagagguggugagaagacaucagauccugggcacauucuuuucuucugcuucccuugccuauuugcugaccacacuccggcuccuaugucaccuugaugacuuccuauccauucugucuuccuaggaacgucugguccuaaccagugagcacugguuaguacugguccccuucugggcaacauggcccuaccagacacugcugcugccccgucggcaugugcggcggcuaccugagcugaccccugcugagcgugauggucagucucccaaguaggauccuggggcuaggcacuggauggagguugcucccaguagggucagcaucuggaccccaggcugagagucaggcucugauuccagaucuagccuccaucaugaagaagcucuugaccaaguaugacaaccucuuugagacguccuuucccuacuccaugggcuggcauggugaggcuuuucaaguaccuauauuuagccccaacaccauuucugggcuccuggggcucagccuagugaacugcaaccucaaaggagcaagccuugaaacaguugcugggggaaguggccagaguagagaugcugggacugaggguggagcagcaaacuuggugaaacuacaucuccaaugugcuuucuaaucuccugccagcucuucucaagcaggggauccugggagauguaguuuucagauaccugguuggguuugggaguaggugcuaaccuggauaacuguaaaagggcucucucuccccacugucucucuucuuucugucaggggcucccacaggaucagaggcuggggccaacuggaaccauuggcagcugcacgcucauuacuacccuccgcuccugcgcucugccacuguccggaaauucaugguuggcuacgaaaugcuugcucaggcucagagggaccucaccccugagcaggucaggacucagaacagucuggcgucuccagacucucacaugcaguaugugcaggcaccugauacuucuguugcccuugugcuccagucauugcacaaggcagaaaacagcucuggcaggaagggacugccaaaguuaggagcccuagggccuggaaggagaguaugguccucagaucccccuucucuccugcuuccuccagggaacccaacagucaugacccugauaguuucccauaacaaccugggcauuccuugggacucaggagcugcuaaacucuuucauccccugguggcuucagcaguccuuaucaccagccucacaaucccacaggcccacccccagugggccuguggcauucauauuucauauucauauuucaaaccacaauauccagcaaaaugucuccugagcacccagaacuccauaccaucggccgggugugguggcucaugccuuaaucccagcacuuugggaggucaagaugggaggauugcuugagcccagaaguucgagacuagccugggaaacauaggaagcccucgucucuacaaaaaaaauuuaaaaaguuagccagguaugguggcauauacuuguggucccagauacuugggaggcugagauaggaucacuugggcccaggaguuugaggcugcagugagccaucaucauggcaucauugcauuccagccugggcaacagagcaagaccucgucucaaaaaaaaaaaaaaaaugaaguccaugccaccauucuuggcagcccagcccuuauccuccuuaauugcucccugucccuuuuccaggcugcagagagacuaagggcacuuccugagguucauuaccaccuggggcagaaggacagggagacagcaaccaucgccugaccacgccgaccacagggccuugaauccuuuuuuguuuucaacagucuugcugaauuaagcagaaagggccuugaauccuggccuggaauuugggcagauauagcauuaauaaaacugugcaucucaaacuuuuaucacauacucuaaua

SEQ ID NO: 61589 - RNA, 4010 nt, Homo sapiens; identical to SEQ ID NO: 61588

SEQ ID NO: 61590 - RNA, 109851 nt, Homo sapiens
gucaguggaggcagcagcgguagaggcggcggcgaggacuggcgacggcgaggaggugaguguccgccgcgcuccgcacgguccucuucccgcggcgggucggagcggguggacgugcgccggcaccgcugcgagggacgcuuauguaagggucgcgcgcgcaaaggcggcgcgggcuccgcgagugacggcuggaggagacagcgacgggcugugcgcggugcgcgacgcgacgcagcggacggcgccccucccccucgcgcgggggcucggccggcuggacccgcccccggacccgcccccggcugcagcccccgagcgccccuccgcagcguccgccugcgggcugccucauucuugcucucgggcccauuuugcagauggagaaacugacuaaagcgccucgcgcgaggucccugaggguucgaacccaagucugucaggaucgggagcccaaguuguccccaucguacuggauguggcucagcucugcaggaagccgcggcguguaaggcgagggcuuuccuuguuccuugcucucgcacuccgccucccguaggauccucuacuuuguuucagacggggaagcuccaggcgcccagacgcagugauucgcccaaggccgcucauucaggagguggggcugggcucagccccuuauuucuccagcuuuuaguaguuuacaaagcgcaucagagucggaagccaagucccuaggucccuggcaacuuugagauucuuuuguuuucuuuucuuuuuuagacagggucuugcugucacccacccaggcuggagugcaguggcgcgaucucggcucacugcagucucgaccucccgggcucaagcgacccuccugccacagucccccagugcugggacuacaggcgggcgccaccacgccuagcuaauuuuuguauuuuuugguagagacgagguuccgucauguugcccaggcuggucucgaacuccuacgcucaagcgagcggccugcccuggcuucccaaagugcugagauuacaggcgugccucgucugaaauucuaaaaaaucagauugugucuuuauuuugugagaagagguaggccugggcuccuuacccguucuccagcugagaaaacaggcucagagaaguaccaacacuugcugaugacaaccagaaccuccagagugccugccaucugccucccuauugcucccguacccacugccaccaucagcccuggcuggccucccccaaggcacccuuucccuguaugugaugcaaacacuugugcuggggguggaugugcucagcauuucucucacuugcagcuacagcuuccugccugcaggcucuccuuaacuguugaacucuuaaucacauucuuuugcacaccuacaguguuccuaucccuacacugggccgagagacagcgugggcgaugaggucaauccuuguccugcaacugcugacaaacccauugggggagagagaaaauaaacaaaaccuaagcagcaaggcagccugcugcagauguuuguagagagccuagugggugagguauuggcccuaggaggacauggaagaggaaguucaguagaggccaguaaaucacagcaaaccacacacuaaagcgagagagaggagaaauggccuggaaggggaugggcuugggaaggcuucguggaggaggugaguuguggaccucuuuuugaugccgcugcaguggagaaacagugauuggauuucagcagcuagaaaguuuuauucuggagagguuuuguuaaagagguuuuuuuguuuuuguuuuuugagauggaguuucgcucuugucgcccaggcuggagugcagcggugugaucucagcucaccacaaccuccgccucccgaguucaagcgauucuccugccucagcauccugaguagcugggauuacaggcgcaugccaccacaccuggcuauuuuuuguauuuuuaguagagaugggguuucaccauguuggccaggcuggucuugaacuccugaccucaggugauccgcccaccucgaccucccaaagugcugggauuauaggcaugagccaucaugccuggccaguuacagagguuucaagcaauuagaacuggaagaggaaggcugaggaagguggaaggagaaugugggggaaacagcuucacuguuggguguaagaaacuugauuggucacugggaagaggccucuacaggagauguaaccaggugagggcacuaggauuugcuaaggugcagguaagucagugacuggaaaccaaacugaggaagcaagauuagaugcaaagguagacggggcugggcgcggugcucaugccuguaaucccagcacuuugggaggccgaggcggguggaucaccugaggucaggaguucgagaccagccuggccaacauggugaaaccccuucucugcuaaaaauacaaaaacuagccaggccugguggcgggcaccuguaaucccagcuacucaggaggcugaggcaggagaauugcuugaaccugggaguugaagguugcaguaagcugagaucacgccccugcacuccagccugggcgacagcaugaaacucccugucaaaaaaaaagaaaaaaaaaagcccaaaaggcagacagggcucugagggcccagcugcaggccugagcugcagauugugucccaugguguucugguaagcucccugaaagcagccgucauuuguuuacuaauggcuccuucacccugcugugcccugcucuuagggaaggggcuuuguucacuacaguugcucaguaucugcuuuuugaauuaauuaggcugucauccaaaguuuccucaguuuaccccaauguacccucaugugucauaacgccuucugucuuucuacugaagcccgcugcagccuggcugacucgguucccugugccaguccucaccuccaagaucuccccuagaagguugucccugguagcccacaguaggucccccaggcccuuuucccuuuuuuguccugcuccuugcuuucacccggucucacuuccagugccccaggcacugugauagguaccuguccucccaccaccacucaugggggcucugggaccaguggcagggcaggaccucagauucacuacucuuaucccaagccacaguucccugugucccucuucccucuguccucucaguaccuaauagugccaggaacaaguaggugccuaaugaguguuuugggugaauuaguugaaaaggggucaaacugggaaccagugaggagagaagggugcaagauggggaauacggaaaggaguuacuuuuggagguggcagggauggccagcaccaaggucaguauggcaguaaaucuggcaauccacauuucucacuggcaccuucugcaugggcuggaggccucguucaggucaacguuuucuguguuuuuuuuuuuuuggagacggagucuuguuuuguugcccaggcugcaguacaguggcaccaucuuggcucacugcagccucugccucccggauucaagugauucuccugccucagccuccugaguagcugggauuacaggcaccaacccuuugccuggcuaauuuuuguaucuuuaguagagaugggguuucacuauguugggcaggcuggucucgaacuccugacuucaggugaucaccugccuuggccucccaaagugcugggauuacaggcgugagccacugcacccggccucuggucaacauuuucauugaggaugagcauggccuucucuuuggcugccucccaauaucguccugcccccaucugaaugggccccguuucuuguauccugaaaguuccugcuuuggggcagguuucucacccagaggccuccuucacagcagcagggcauuuugccugcucacucugaaaccucaccugggccugacugaccgugccuuccucucuuucucuuagcugccuucuagucucaccuguggacacuuugccaaaggagucgggccugacgguggaagaugggaaauggccaaaagaauaaaccauuuccucuuacuuaccgaaugaaaagcuugcuucaucuuggcguucaagacucucuaauaugauuccaccuguugggcucuuucuuccauuugccuccgcagguacccucuucugugucagcccccauagugagauuagucacuguuaccccaaacucacuucucacgguccccccucugcucuuguucuuguugacuuuguuuucugcagggccuugcuucuuaucuuguccugucaaaauuaaauuauucuucgagacacaggacuuuauuaaggcuugccaaaucuauucaguuggacugggcucucuuuucauaacgaugaugauaaguaaugauuuauuguuauuaauaauaaaagucaacuacugugugguggugacggccuugcuaagccccuuacauacacauaaugugauuaucacaacaauccuauuacgaagguccuauuagauccaucucuuacaaaugacggacucucauaggugaaacucagagaggugaaauaacgcccagaguaacacagccaggcaggcuagguggcucacugcuggagucccucucacgugccaucccauuuuugcuucuuuuaaccagccccuaacaacuugcuuuuuggcacuuugugggcagggccugaguguacauacaguuccuugugcaaggcaugugcucaauaaauauuuuauugacuugagugccccagacauugaauuucagccuugacguuaucugucaaggcagcugguuuucucugaacagggauuugagcuugcuggccuguuuuuccauuuugcuguucauugacuaguggcuaggguagguguggcuuuuucggaaauaagcagucaauaaaacuccgaaaagugauuacacaauaccaacugugggcucccaugggcauaaacacgaggugggcucuuacuuauggcagagaggggucucugcaggaaaggauuugaggaaauagccaggaaauagaguacacaucucaggucacguaagacagcuccuuauuaguuucaaguuguggagugagagaagaaccagacucccaguauucagagggagcuccugaaggauuagagacagcucugcggagaugcagagaaagcgggccugaggcuggacggagugggcaggaagagaaagcacuucagauaaaacgaacuguuucuagaacuucuuguucauguguaguggguggcagaaaaggguuuuacuuaagcgcuucccaccuagccugucgguuaacgucccaguguguccucugugccaggcauggugccacugcugugcgugugcugccucauuggguauucccuaguacgcugugagaugggcauuguuauuauucccauuuuacagaugaggaaacagacuuugagugauuacagagcggcugucagaguaacaagaggugcaguccaggcagugggacagcacagcuggcgcuuccagcucuguacccuccuggugcccucaguggaagcaaagaaacaguucuuggccgggugcgguggcucacaccuguaaucccagcacuuugggaggccgagguggguggaucaccugaggucgggaguucgagaccagccugaccaacauggagaaacccccaucucuacuaaaaauaccaaauuagcugggcgugguggcacaugccuguaaucccaacuaccucaggaggcugaggcaggagaaucgcuugaauccgggaagcagagguugcagugagccgggauugcgccauugcacuccagcccggguaacaagacugaaaaaguucucuggguucuaaaaucgguguucuugccacuccuguuuucucugggaaguuccuggagcaaugaggguaaugcuguuuuuucuuuugcuuuagauagugucugccuucuggagagcugaccaaacacuaaggguaaguccugugccugaauccaggcuggcgggaugcaugggggucuucaccaggagcagcuguggaugccagcaguuuggcaugucaggucuuaagcucaaucaauaaaaaaaggcugcgcucugauuuguggauaauauccguuuaagcagucuugucuguuuccaguugcuccugauuuuuacaggaaagugacaucuggcucccugcuggccccauuuggcagcuggccagccucagcagaaggcccugguucuggaaggguauggucagcuugggaagcugggcaggaagaaucccuggggcugggccgucucugagaagaccccuugagucagcauggagagcaggcagcuguggugugaggugguucugccagcugguuguaaagucacuugacacggguuuccagagggugacgcucaaccuuugccagucacgguaacaacggggaaaaagggaccugcccuucuuccccugcacauuuuacaggcaugugccaccacaccuggcuaaguuuuuuuuuuucuuuuuuuuuuuugagacggagucuugcucuguugccaggcuggagugcaguggcgcaagcucggcuuacugcaaccucugccuccuggguucaagcaauucuccugccucagccucccgaguagcugggacuacaggugugugcugccaugcccagcuaauuuuuguauuuuuaguagagacgggguuuuaccauguuggccaggauggucucaaucucuugaucuugugauccacccaccucagccccucaaagugcugggauuacaggcaugaaccacugugcccggccuaauuuuuguauuuuuaguagagaugggauuuuaccauguuggucaggcuggucucgaacuccugaccucaggugauccgcccucuucggccuccccagaugcugggauuacaggugugagccagcgcguccggccucuacugcuuuuacaguucccccaacauggauuuccaugguggcaggugccugggagauucaguggccuccccucagccuaaauuccacagcccucccgccgguccccugcuaguccaguccccucucccccugcuggucugcaggagcagccgagccagggaaccaggugcucucccagcauuugugacaacaauaaugcucuucccuucaggcccgcuguggccuuggggacuuuguggcucagggacaacuuucuccagagcucauauccagugcugaguggggauuccuugguauaggaguuuuucucgguuuuccacccauuauguggggguuuuccucugacgacccuucaugacgcaggagcugguuuccugugugagauuucccgcaguccucccuuggagcuaggucuugggccagcaggugccgucugcgugcuaccauugaguaagggcaaugggcucauggugggaauggccguaacguggaagaacuccacccuccacgaguuucacccccuuguucucucucugcuugcucuguccucuuauucuuggcugcuagaguuggauguuauuucucuuacuugcaucccuacaaugagaggugggcauguuggggaagguuccccccaaaccacuugucuuauggaacugaagaaacugaagccuagagaaggcugcuuagcagaauccaagaugcugaucccauuguuuauucuucuuuuaaaauugccauauuuuauugaugucuucccuuagauccaucaauagagagggaaaaucagucaccaagaagggaccucuucuuccagguuauguaauuugucaaagcuuguuuggcuccucaguucccaaggcacugcugacuugagcuuugccuagggacuaaggcucuguagucuaagcuugucacccuccccuccucuucagcuuucuccuggggggacauggauguggcccuuuguuguguuguuaaguguuaugccugaaggcguuaccccagguacucccagcacuaccucggguuuccuacucuuguguuaccuccuuguccugauaugccucgaggccagagaaagagguggggccgggagggcacgggacagcugggaguacauuuccacugccuguguguggaagggccugacugcuucuguggcagcuccuuuccugaugacauccaccaugacaucacaacgaggcuuugggaaaauuccacgaccuggccaugcugagucauacuuagucucuggggaugugugucaccuuucucuugucugucacugagugcugcaguuacuaugaagugacacaugcugcccauuuauuacguuugcacaucacuuuaugcugcuuuggagccucuucucauguacaugcuguguaucaaugugaaauguauuaauauuaaaucauuaauaauaaguauauuauuuauucuggaaaauauuugucucuugcaaugugugaggaaccagagguucagagagacuagagacuaagcgacuuggugaguuucgggugacuggugcguggcaugucugagggagguuuggaugccacacccacuccuaccccuggauuuuuauguaaugcaaagauuauucagaaauuacuuuggucgaaaacaauugauuuucaauuuguuaaaauuaugaauucagaaaccuaguuauuuuaagggccagucuuuuaaguuuagcuuauaaguguagccuauaaaucuuucugaucuauuuacgauucuaggacauuuuaacagucacuuucagggggcuuuuauuuauuuauuuuuuuugcgauggagucucgcucugucgcgaucucggcucacugcaaccuccgccuccugguucaagcgauucuucugccucagccuccugaguagcugggauuacaggcgcccgccaccaugcuggcuaauuuguauuuuuaguagaggcgggguuucuucauguuggucaggcuggucucgaacuccugacucaagugaucugcccgccucggccucccaaagugcugggauuacaggcgugagccgccgccccggccuuagggggcuuuuugauuaaugcuuggucccauuugcaaauuugaugaaacuucugaaauguuucaauugaacuuauaaaucauauucaacuucaguuaacuauuuuaauaauucuucuggccgggcaugguggguggcucacgccuguaauccuagcacuuugggaggccaaggcgggcagaucacgaggucaagagauugagaccauccuggccaacauggugaaacccugucgcuacuaaaaauacaaaaauuagcugggugugguggucacgcgccuguaaucccagcuacuugggaggcugaggcaggagaaucgcuugaacccgggaggcggagguugcagugagcugagauuaugccacugcacuccagccuggcgacacagcaagacuccaucucaaaaaaauaauaauaauaauaaauaauaauaauaauucuuccauuuuucugauuaaaaaaacccucuaauaccuaaaugacucuuguaaaucuaauaaaugaagcugaauauuacacuuuucuuaaacuuuccuauaccguuuuauguuuuguuuguuuauuuuuguuuauuuugagacggucugauucugucacucaggcuggaguacaguggcacagucucagcucacugcaaccucuaccuccuaggcucaggugaucuucccuuuucagacuccugaguagcugggacuacagguucaagccaccacacccggcuaauuuuuguacuuuuuguggagacgggguuucaccacauugcccaggcucaucucgaacuccugagcucaagcaaucagcccgccuuggccucccaaagugcugggauuacaggcgugauacauuuuaguuuuuacaauagcuuuauuggaguauuacugagauauaauaaguugcacauauuuaaaguauacaguuuaguaaguuuuaacauauguguacccuugugaaaccaucacugcaguccagagagugaacacauucaucaccuuuggaauuccucccucugccuccucacucuucaggaaaccauggaacugcuuucuguuacuauagguuaguuuccauuuucuggaauuucacauaaauugacucauacaguauauauucuuuuuucucugccuucuuuuacucagcauaauuauguugagauauguccauguuguugcuuguauugauaguucauuuccuucuuuuuuuuuuuuuuaagacagagucuugcucugucacccaagcuggaauauagcggcgugaucauagcucacugcagccuugaucuucugggcucaagugaucucccaucucacugaguagcuggaacuacaggugugugccacuacgccuggcauaucuaucuaucuaucuaucuaucuaucuaucuaucuaucuaucuaucuaucuuuaguagagaugagaucucgguauguugcuuaggcuuuuuuuuuuuuuuugagacggaaucucacucugucgcccaggcuggagugcaguggcaugaucucggcucacugcaaccucugccucccggguucaagcgauucuucugccuuagccucccaaguagcugggacuagaggcgcccaccaccacgcccagcuaauuuuuguauuuuuaguagagaggggguuucaccauguuggccaggcuggucucgacuccugaccucaaaugauccaccccaccucagccucgaaaaguguugggauuaccugcgugagcuaccgcaccuggcccuuaggcuugucuugaacuccugaacucaagcaguccuucccacuuuccaccuuggccucccaaagugcugggguuacaggcaugagccacuguuccuggucaguucuuuuuuuuuuuuugagacugagucuugcucugucgcacaggcuggagugcaguggcacgaucucggcucacugcaagcuccgccucaaccucccgaguagcugggacuacaggcacccaccaccacacccagcuaauuuuguuuuuguauuuuuaguagagacgggguuucacuguguuagccagaauggucuugaucuccugaccuugugauccucccgccucggccucccaaagugcuggaauuacaggcaugagccaccgcacccagcuuuuuuuuuuugcugauuucauuauauggguauuacaguuuauccagucaccuuuguuggucaucucaggugcuucuacuuuuuggcaucuacaaauaaagcuacugugaacauuuguguauaagucuuugugugaacauauauuuccuuuucucuuggguaaaugccuaggaguggaguggcuggauccugugguagcuguauguauguuuaacuugaacugccaaauuuucugacgugguuguaguauuuuacauuccuaccagcuguguaugagaguuccaguuucucuucauccuccccaacacuggcuaugguuagucuuuuaaauuuuagccauuuaaaaagguauauggugguaucucaugguuucaauuugaauuuuccuaaugauaaugauguugagcaucuugucauguguuugucaucugccaguacugauuuuaaacuuaguaaaauuucuauguaaaaucacacgucuaaacuaacuacucaguuacauguuuuuuguuuugagacagggucuugcucugugccccaggcuggcuugcacugaugcgaucguggcucacugcagccucgaccucccaugcucaagcgauccucccaucucagccucuugaguagcugggaccauggcaugcacgucaugccuggcugauuuaaaaaaaauuuuuuuuuugagauggagucucacucuguugcccaggcuggaaugcgguuucaugaucuuggccuacuugcaaccuccgccugcuggguucaagcaauucuucugccucagccucccgaguagcugggauuacaggcguggcccagcuaauuuuuguauuuuuaguagagacgggguuucaccauauuggccaggcugaucucgaacucccgaccuugugaucugcccgccuuggucucccaaagugcugggauuacaggcaugagccacugcaccuggccuuuuaaaaaauuuucuuuguagaggugggauuucacuguguugccagggcuggucucaaacugcuaucaugcgauccaccugccucagccucccaaaaucaugugguuacagaugugagucaccacgccuggccucaguuacauguuuuaauuggaaucucaagacugauuuguuauucuaaacagaccauauucucuuagaguacauaaaguaacagacaacacacagauuucuuuuuuuuuuuuuuuuuuuuuugagacggagucucgcucugucgcccaggccggacugcggacugcaguggcgcaaucuuggcucacugcaagcuucgcuucccggguucacgccauucuccugccucagccucccgaguagcugggacuacaggcgcccgccaccgcgcccugcuaauuuuuuguauuuuuaguagagacgggguuucaccuuguuagccaggauggucucgaucuccugaccucaugauccacccgccucggccucccaaagugcugggauuacaggcgugagccaccgcgcccggccagauuucuuaacacaaaaauauaaauacuaugguuuuuauuuuccuagccuugucuauauuuaaucuaauauuuuccuggaauuagagaagcuuaccuaauaaggaauuaaauacaugauuuuaaaguauaguaaauuauuuuucuaauuaacuuuuggccuuucuuucucaacuggaugacauuuucuuuauaauuaaagagaccccuggcagggaugaaacuggacuuugaaucuaacugcuaagcagagccugcuccacugccaccauuuugccuccaaauggggauggucucacagcccaugugccucaaauagaaguaucacauuacuaaugucuuccucuucucaucucauguaacucugcaguuccgacccgcccccccaaaccauuugaauucaguuaaucuauuuaaggcuuccuuuuuguuaugcaguauggccacaaaaauagguggaacuaaauacaaaauagauacaguuuagauucuuuagauucucuguaucucccaaggcuuucucugaccaaggacuaguaaaaucaugucugacccaccagggcuagaauuugagucccagucuucugaguccaugucuggcauuuccuuccaucucuuaaaccuuuucaaauaaagagaaagagggugguacuuaagaguucuuacuuucugaucacgccugguuaccaauaaauuauagcaucuggaaccagugccaccuuuuucauguucuucaguucacgccccuggaaauggugagaauuuuggccucucccuaaccucccgguggagagcuaccaaucuuuggagagcccauugccaucaaauucuuguuagaaaucugcgucuuggaugauaacuagaugcagaauugcauuccuguccuggucacuggguauggccccaggaagcuuguagguggugaguggaccugguugagaauuauuaaugcaguuugaccucuccguugaugucugaugcacauguggcccaaugugaguaagagcagagguuuguagagugacaagaaaaggacauuugggggagaaauuggcaggaggcugacuuagguuuuugcgcugcaagaguuuuucgucccccauuuuaaaaaauuguggcaaaauacauugucuucaucccuuugggcugcuauaacaaaauaaccuuauucuagguaauuuauaaacaauagaaauuuauuuauuuauuauuuuuauuuauuuauuuuuugagacagucuugcugugucacccaggauggaugcaguggugcaaucucggcucacugcaaccccugccucccagguucaagcgauucuccugccucagacuccugaguagcugggauuauaggugugugccaccaugcccaacuaauuuuuguacucuuaguagagaugggguuucaccauguugggcaggcuggucucgaacuccugaccucaagugauccgccugccuuggccucccaaagugcugggauuacaggugugagccauugcggccggccugaaguuguuuuuucugagacggagucuugcucugucacccaggcuggagugcaguggugcaaucucggcucacugcaagcuucuccuccugaguucaugccauucucuugccucagccucccaaguagcugggacuacaggcgcccaccaucacacccggcuaauuuuuuguauuuuuauuggagacggaguuucaccguguuagccaggauggucucgaucuccugaccuuguguuccgcccgccucgggcucccaaagugcugggauuacaggcgugagccacugugcccggccuuuuguucuuuucuuuuuuuuuuuuuuuugagacaguuucgcuauuaucacucaggcuggagggcaguggcucacugcaaccucugucuccuggguucaagagauucucugccucagccucucuauuagcugggaauacacgcgccugccacgacgcccggcuaauuuuugcauuuuuuaguagaaacgggguuucaccauguugagaaauuucuuuuuuuuuuuuuuuuuuuuuuuuuuuuuugagccggagucuugcucuauagcccaggcuggagagcaguggcgcgaucucugcucaccacaagcuccgcugcuucccggguucaugccauucuccugccucagccucccaaguagcugggggacuacaggcgccugccaccacgcccggcaaauuuuuuuuuuuugcauuuuuaguagagacaggguuccaucguguuagccaggauggucucaaucuccugaccucaugauccucaugauccgggccucggccucccaaaguguugggauuacaggcgugagccaccgcacccggccgagaaguuuauuucuuaacgguuuuggaagcugagaaguccaagaucaaggcagcagcagauucgguaucuggugagggcuuguuccucacaaaucaugcugucuucaggcugcguccucacaggguggaagggacaaggcagcuccuuuugaccgugaccccuuuuuuuuuuuuccuccgacuccugggcucaacaucuucccaccucagccuccugacuagcugggauuauaggcgccagccaccauggccagcucgaccucuuuuauuaggaugcuaauccuacucauagaacaggacccucaugacaaccuccucaaggccccaccucuuaauacgauugcauugggaguuagguugaacaugugaauuuugaggggauguccauauaacacauguauuauguacaccugauauuaaacuuacuuuuuuuuuuuuugagauggaguuucgcucucguugcccaggcuggagugugauggcaugaucuuggcucaccgcaaccuccgccucccggguucaagcaauucuccugccucagccucccgaguagcugggacuacagacgcccgccaccagacccagcuaauuuuguauuucuuuuuaguagagacggguuuucuccauguuggucaggaugaucucaaacucccgacuucaggugauccgcccgccucggccucccaaagugcugggauuacaggugugagccaucgcacccagccgaaacuuucuuaaccauuuuccagcguacaguucagugguauuaaguauauuuauauugagcaaccaucaccacuaucugcagacuuuuuuucaucuuguaaaacugaagcucuguaacccuuaaauccugacuccucauucuccacucacccaagccccuggcacccaccauucuacuuucugucucugaauuggacugcucuaggcaccucauauaaauggaaucauacgguauuugucuuuuugugacuggcauauuucacauagcauaauguccucaagguucauccauguuguagcaugugucagaauuucuuuuuuuuuuuuuuugagauggagucucgcucugucgcccaggcuggagugcaguggugcgaucucggcucacugcaagcuccaccucccggguucacaccauucuccugccucagccucccgaggagcugggacuacaggcgccugccaccaugcccagcuaauuuuuuuuguauauuuaguagagacgggguuucaccguguuagccaggauggucucgaucuccugacuucgugauccguccaccucggccucccaaagugcugggauuacaggcaugagccaccgcgcccagcauuuuuuuuuuuuuugagauggaguuucacucuuguugcccaggcuggagugcaauggugcgaucucggcucacuacaaccucugccucccgaguucaagcgacucuccugccucagccucccgaguaguugggauuacaggcaugugccaccacacccggcuaauuuuauauuuuuauuagagacgggguuuccccauguuggucaggcugaucucaaacuccugaguucaggugaucugcccgccucagccucccaaaguguugugauuacaggcgugagccacugcgccuggccggaauuucuuuuuaaggcugaaugaugggggccaggcaugauggcucacaccuguaaucccagcacuuugggaggccgaggcaggcagaucacgaggucaggagaucgauaccauccuggcuaacacggugaaaccccgucucuacuaaaaaauacaaaaaauuagcugggcaugguggcgggcaccuguagucucagcuacucggaagguugaggcagcagaauggugugaacccgggaggcggagcuugcagugagccgagauggcgccacugcacuccagccugggcgacagagcaagacucugccucaaaaaaaaagaaaaggcugaaugauauuccguuguauggauuuuacuuauccauucauauaucuguggacacuuggcuugguuccauguuugagcuauuaugaauaaugcuuccaugaauauggguguacaaauaucucuuugagacuuugcuuucaguucuuuuggauauauaccugauugcugggucaauggcaauucuauuuuuaauuucucaagagccugcuaugcuauuuuccacaucagcuacagcauuuuacauuuccauuaacagugcaugaggguuccaguuuuuccacauccucaccaacacuuuguuguuuugauaguagccaucccaauggguaugaggugauaucucauuguaguuuggauuugcauuuccuuaaugauuagugauguugagcaccuuuuuuuuuuuuuuuuuuuuuuagauggagucuugcuugcucuguugcccaggcuggagugcaguggcaccaugucagcucacugcaaccucugccuccuggguucaagcuauccucuugccucagccucccaaguagcuuggauuguaaacaugcaccaccaugccuggcuaauuuuuguauuuuuaguagagacguguuagccaggcuggucucgaucuccugaccucaagugaccaccugccucagccucccaaaguacugggauuacaggcgugagccacugugccuggccuugagcaucuugugaugugcuuauuggccauuuguauaucuucuaucuucuuuggggaaaugucuguucaaguccuuugccuuuuuaaauuuuuauuauuuauuuauuuauuuauuuugagacagggucuuguucuguugcccaggcuggaguacaguggcacagucuuggcucacugcagccucgaccuccugggcugcagugauccucccaccucagccucccuuguagcuguauuuuuuuguauuuuguauuuuguagcuguaguuuuuguauuuuuuguggagacagcguuucaccaugaugcccaggcuggucuugaacuccugagcucaagugaucugccugcuucagccucccaaagugcugggauuacagacaugagccacugcaccuggcaaacucccaaaauucaacacacacacacaaaaaaccaccugauucaaaaugggcagaggggccggguguggucccaacuaccagggagacugaagugggaggaucacuugagcaugagaagucgaggcugcagugagucgagauuguacgacugcauuccagccuggacaacagagugagacccugucucaaaaaaaaaaaaaaaaaguuuugggaacuuucuauguauucucgauauuaaucccuuaucagauacaugauuuguaaauauuuucuuccauacuguggauugccuuuuuaccccaugauaaugucuuuugaugcacaaaauuuuuacauuuucuugaaguccaacuugucuaucuuugcuuuuuguugccugugccugccuuugguguuguauccaagaaaucauuguuaaaucuaauauaaagcuuuuccccuauguuuuuuccaagaguuuugucauuuuaggucuuauguuuaggucauggauauggugucagguaaggguccaauuucauucuuucucaugugucucugcaggaguuguuuuuuuuuuguuuuuucuuguuuuugguuuuuuuuuuuuuuuuuuuuuugagacggaguuuugcucuuguugcccaggcuggagugcaauggcacgaucucggcuugcugcaaccucugccucccggguucaagugauucuccugccucagccuuccgaguagcugggauuacaggcaugcgccaccacaccuggcuaauuuuguauuuuuaguagagacgggguuucuccguauuggucaggcuggucucaaacuccugaccucaggugauccacccgccuuggccucccaaaguauuaggauuacaggcgugaaccacuguguccagccucugcaggaguuuuaaguacagucuguccucaccuguggcuguguuccccuuuaaggugguaaaggagcacugugagauacaguauuucauagcacaguuguuucuugcuauccccuggggacugguuccaagaccccccuauggaugccagaauccuccaagaugcucaagugcuugauagaaaauggcauaguauuugcauauaaccuaugcauaucaucuuguguacuuuaaaucaucucuggauaacuuaaaauacccaauccaauguaaaugccauguaaauaguucuuauacuguauuguuuuuauuuguauuauuuuuuauuguuguauugucauuuuuuauuuugcuuuuucgaauauuuuugauccccaguugguugaaugaguggauguggaacccacagauacagagggcugaccauauaguaaacgaaggcagugaugucacugagugacgacucugcucucaaagaggagggaaaaugugcuucaccauagggccaguauuaaaugacuggggggugcagagaagaugaaaccuaaaaugucaagucauuuaacacagcaauuccaguucuagaaauguaaccugugguaucaugggacaggcgugcaaacauaugaggugauagcagaaaaugggaaaucaccaaaacguacaucagaaaaugauugcuacauaugaagucuguucugugucauaugauguagccuuuaaaaauagcucauguauccuaaucaagcugucacucuaaauuuauuaccauaggacgagagcuaugaugccuuuacacaaaaaauauauauuauaaaacagaauguauaauaucucauuuuuuguuauuuuggaaugcuauaccaacaauuuguucagguugcuggaguuacaaaauuauguguuuaaaaaauuuucuauauaguauuuuuuucuuuauaggauguuuuaauuuuaaguuaucaauuuaaaaaaucuaauuagagaagggugcaauucauaacacuacuuggggcuuacggucgaguacuagguacuuaaauaucagaguuugacucuuuuaccccucuuuuccaaaaaauuguuuugggggaugaaaaccucuuucuaaaugccauaugagauauagauugcuggggagugguggagugaggacuucauaaaugcuguuccuccauuuaaaggaaugagaaaacuggcaaaaaugauuaaaaccaacuuuuucagaacucgagaaauuaaccaaaggcuugcaacaaucuaagacacauuuauucaggaaaaaucgcagaaaaaaguuauucuuguuuucaacaaaaaguuaugaggcaugcaaagaaacaagaaaguaugguucauacacaggaaagacacagucuuuuccagccuagauguuggacuucauagacaaugauguuaaaucaacuauuuuaaauuugucuaaagaacuuaaggaaaaugugagaagagugucucaccaaauagagggaggccaaggcagguggaucacgaggucgagagaucgagaccauccuggcuaacacagugaaaccccgucucuacuaaaaauacaaaaaauuagcugagugugguggcacgcaccuguagucccagcuacucaggaggcugaggcaggagaaucgcuugaaccugggagguggagauugcagugagcugagauggcaucacuguacuccagccuaggcaacagagcaagacucagucucaaaaaaaaaaaaaacaaaaaaaacccagaaauucuggaguugaacuguguaguuacugacaugaaaaauucacuagaggcugaacagcagauuugagcaggcagaaaaaaaucagcaagcuugaagaugguaccuugagauuuuucaggcuaaugaaaaaagaaugaaggaaaauuaacagccucagagacccauggugcaccgucacacaaaucaacauaugcaucaugagagucccagaaggagaggagagaaagggucagaaagaauggccacaagcugaugaaaaacaguaaccuacccacucaggaagcucagugaacuccaaugaggaugaauaucagagauccacaccuagauauuucauaaucaaagugucaaaugacaaagaaucuugaaagcagcaagagaugagcaacuuaucuuguucaaaggaucuuugaucagauuaacagcucauuucuccucagaaaucaugggagccaggagauagugggaugaacacuguugaaggcaaaaccuucaacuguaauuauuggacuuuugagucuuagaugguccugaccucuuugucuucagggacaguuuuucaauuuaaucccuaauaacaauuagucaagcuuccuugaccuguaggaaggccugucuuuaggccgggcacaguggcuuacaccuguaaucccagcacuuugggaggcccagacggguggaucauuugaggucagaaguucgagaccagccugaccaacauggcgaaacccccaucucuaccaaaaauacaaaaauuagccaggcgugguggugcauaccuguagucccagcuacuuagggggcugaggcacgagaaucguugcuugaacuugggaggcggagguugcagugagccaagaucgcgccacugcauuccagccugggagccugggugacagagcaagacuccaucuuaaaaaaaaaagaagaccuaucuuuuauagaguucccuuccccaaguuuuucuacaaauacccagggaugcuuauguguuccaccaaguuuggaacauaguuagggagugaaaaacauagguuaaaugaaugucaucugucuggcuugguuauuuccuuggccagcuguucucuucuguauguugccuaguucucccugccucagggcuguugcuucacccuucauaccauauugccuuaaauacacaaacgaccugucaggcauuucacaacauuuuacugaaugcuuggagauagcagaauggaauuacaauacagaaaaagauguuuugcucacaaaggggaauuuacccuuuaccucaagaaaaauagagcaauugccaauaacaauauugguggccucuccccugcccauuaaccaucaagacgucagcaaauacuggggucuaaucucaacuaguguuacuccaggacaccauauggagcugacugcugauguucuguucuugauaauaucccuuauguguguguagcacuuuauaguuuuuuuauuucauuuuuuucuuuuuuucucuccccccccaccuuuuuuuugugugugugugugacagggucuugcucugucacgaggcuggaguacaguggcaccauccaagcucacuguagccuccaccuccugggcucaagcaaugcucccaccucagccucccaaguagcugagacuacaggcaugugccaccacacccagcugauuuuuuuuuuuuuuuuuuuugagacagggucucacucugucacucaugcuggagugcaguggugcaaucacagcucacugcagccucaacuuccaaggcucaaaugauccucccaccugagccuccugaguagcugggacuacaggcaugugccaccaugccuggcuaguuuuuguauuuuuuguaaagacuguguugcccaggcuggucucaaacuucugagcucaagcgauccuccugccucggccuccugaagugcugggauuacaggcaugagcuacagcacuuggcuaguuuuauuuuaucaaccaguuuucccuggaacugguuaugguugugguuuugcugcuuauggaugacagacccgagguucagagagguucagugucucucucagcuucacuaggaagaguuauagccaagcucugacagcagcaaaccagauucuggccugagguucucagaauaugcugccguuccacaggauguugcaauaugguguggcaggguguuacagugcacagggcugaaaagaccaaccugagacccuccccuuuccuucugaaguuaucacuucauggacguuugcagcuuuuaucauaagagccauuuguugucgcauggcuuguggccaacugggagucuaccuccaucuaaggcagggcucuucucccugccauguugcccaaggcuguuucaguaagacuguaagguuuucuucagcccuccuggcuuuugacugccccauuccaacugguugcaaaauagcuauuuguguuuuugcugaccugagccaucuuucuguccauuuauacuucugauauucuuacguggcaaucaguaucuagcagaaugaaugccccauuuucuaauccugcguuuucucaguugacugaguggcuuaaggaggacaaguuauuacugggcaguacuccaagaaaugguucuuuccuucagcauuuacugugcaucugugcuaugcacagcuccuuacuggaugcugugaggccacaggaggaucugacaagguggccuugcccugaguuguuuauccgugguugggagagagggaaugcacgugcuggacaaaauacaugcuugcauagugacuggcuagcguggaagaguaguaaugaccucauugauccugcuucugugccaggugagaugcuaaaugcauaaacauacacagggggcugggcgcgguuguucacaccuguaaucccagcacuuugggaggccgaggcggguggaucaccugaggucaagaguucgagaccagccugaccaacauggugaaaccucaucucuacuaaaauacaaaaaauuagcuggguguggugggaggcugagguaggaaaaucacuugaacccaggagguagagguugcagugagccaagaucgugccauugcaccccagccugggcaacagagugagacuguaucucaaaaacaaaaacaaaacacacauagggaauuaccggggaguggcauagcagaguugagagcauggacccuggagucaggcggacaggauggaguucaggcuuagcccugaucagcaaguuccuuagcuucuucaagccuugguuuccucaucuauaaaaugagggcaguaagaccuuccuuccuugucuuacuacccccauuuuauagaugaggaaaccaaccagugggggcuguuggguagagaucaaaugcaauaacuuuuguacaaaugaaauaacacacguucauucuguacaaaugaaauaacacauaaacaaaugaaaucacacagucaugugccugacacuuggacacaccguaaugguggcucuguuaaugggaccagugaugaacaguuagaagugaaccccuugaggguagaauaugugaauccgaggcccugcaagaugaggggacucucucagguggguggaggagcugguccucgcaugugugauauuugaguucguaggaggcgggugcccccggacaguggcaaugggagugaggccaggugaugagacagagggugaugccccagccucgcuggcguggaggaaggcagugggaagccggcaaggguggagguugugccugcauugaucacuguggaauccucagggccuagcacuugggaagcaauguuggagugugcugguggggcguagugagcauuagggcuggaaguucauucugugaaccccagcugcguguugggauuugagacaauaagaagccccugagaugcuugagccaggacuacccagaggugaaugggauuuuuggaaaaccucugggcggaguggguggcugccugggaauggggagaggcagagguuggguggggacuagcucagcagggaauguaacucagacauuccggaaugaugcaaguggagguuagggaagugguugcaaugggaaggagguggcaaauauaaagugucacagaagaaaaguugucauggggccaaguggagggagggauuggagagcucuaaauugcagcucaaucuucaucuugaaaugcaggauggaaaaagccaccccauuuauuuagcuaaagggagcugacuccaagaccugaggucggggaaaaguggagagacaaauagaaaagaaauagggaauugggacagggcaccaucuuucgggauggugggcuuuuaagcccaacucagcauuuccugagaaaauugagauagcuugagaccagagcaauaagcguugagacuuacccggagaaaauguuacccagagaggagaaagggcugguagggccugaagauucuugagcugauuuuccccaguucuugccucuuagugccucccauuucuccucaucugacgguuucugggugagacaguugcaucucaucugugguaggcugccuacugcuuggugagccugggcugaagggcugaggccucuggaagagcugucaggagagagacaccuucaggguacuuggagcuuucgccuugcuuccagggcgggauagguggaagcugaaacugccuccuagcaaacagauuuacacugaucaaaacaaaguauuuguagguguuagaguuaagagguugagguuuuccguuggauuuuuuaggugcaugguggaagagguauuuuagacgaaggauucuccuagcagacacaaaauaugaauuaagaacacuuguuucuguuuuucucccaacuacuucuugauauucauaguuccuggugcugggacuuuggaauggguuuuggugugcagaaaagacagggcauuugcugccaacaggggacauaauugagacuaaauucacaagauaagggaugguaugauuuaccuuccaagaaaagaucugugucugguccuguaucuggcuucuuucuuuauugcuuuugcaguucugaaucaguuuucuuuccccgauggcuagcuucuccagcuggagagaacacacaguuuaaagaggcuuuccccccagggccagauuaaggauacuucugggcuaaagggcaaaugcagccauuccuagcagauuuauggccccgaaaggacauuucggccacugcaucugcgagauuuuugucccacaucagcuagcccagcagcguaagcccaaggguuuagucauugacagaguccaaccaaggggucucuguggaacccugggcuugaaugggcuggaguucuacccucccauugaaaucauuugagaugguagagugccuuccaugcugaaaacaggucucauguaacaguuacugauggggccaaggaagcccagguaugaccuagguaacuccucagagaugcuacuguugaaccuaauagucuucuagcagguuaccaagcgguaauccaaagaguuaguguuuaacuuaaaaaaaaagguauucaguuuagcuauguaauacuugcaccuuguacaaacauugaaauguaugagucuccuuuuuccucucuccccaguaacccaguccccucccaggaggccacuuccgguuaaauuaucuugucuguccucuuggagguggucugcccuuugaaauagaaacauauuuccuuuuuucuuuuucuuuuucuuuuuuuuuuuuuuuugagacagagucucgcucugucgcccaggcuggagugcaguggcgugaucuugucucacugcaagcuccgccucccggguucacgccauucuccugccucagccuccugaguagcugggacuacaggcaacugccacuaugcccggcuaauguuuuuuguauuuuuaguagagaugggguuucaccguguuagccaggauggucucuaucuccugaucuugugauccaccugccuuggccucccaaagugcugggauuacaggcgugagccacugcgcccggcuacagaaacauauaucuauuguuuguuucuccugugcccuuucugcuccaugcccuuuucauuuaucaguguaucuuggaaaucguccgaugucagcacaaauaaaaagucugcaguacucugugugccauugcauguuuuuuuuucuucauuuugccauuuguuuauugcaaaaucccacacuuaacagaagacauguuuaaaacauaugaguauguuaaaacaaaauaguaaaaugaacaucuauguucccaucccuagguuaagguuaggaccauauaagcccccuauguucccuccccgguugaagucccuucccucagcuauuccuuuuuuuuuuuuuuuuuuuuuucuugagauggaaucuugccacucugcuguccaggguggagugcaguggugccaucucggcccacugcaaccccugccuccuggguucaagugauucuccugccucagccuccugaguagcugggacuacaggugugugccaccaugcccggcuaauuuuuguauuuuuaguagagacgaaguuucaccauguuggccaggcuggucuugaaccccugaccucaggugauccgcccaccucagccucccaaagugcugggaugacagauguaagccaccacaccuggcaccccagcuauucugaauuuugugauauuuauucucuuguucuuguuaguuuucccaccgauagccaaccucugaauaacuuauuguugaauuuugccugguuuugaacaccuggacauggaauccuacaguagauuucugugacuugcucagcauuacauuugugauucguccauguggaugcacauggcucuguucauguucacugccguagagcuuuccauugaaugaauauccacaguguguugauccuuucuguugcccuguugccaagaaggccuuggucugccuuuuguuuuuuuuccucucucaggaauaacccugcugggaacuuuuuuuuuuuuuuuuuuuuuuuuaagacagagucuugcucugucgcccaggcugaagugcaguggugugaucuuggcucacuacaaccucugacucccgaguucaaaugauucuccugucucaaccucccaaguagcugggauuacaggggugugccaccaugcccaaccaauuuuuguaucuuuaauagagacaggguuucgccauguuggccaggcuggucuugaacuccugaacucaggugauccgccugccucaggcucccaaagugcugggauuacaggcaugagccaccacguccagcaggaacauucuuacauauggcuccuggaacacaugagcaagaauuucugugggguauaaacuaggaguggaguugcuggcaugucuaacucuucuagguuauccgaaaccaaagauuugagguuuugaaaacuaauuugcccuucuccugccaucaguaggagcacugaguauuuucugaucgcccagguaguacaacuuuggacugcaagucugugugagggcuguuuugugauugcagcuucuuggggggaguuuuuuguuuuucuaccugcuuuuguuuuucuaccugccaaggauuuagacaguugauuuuucuugcagguagcucuuggggacagggaaggguacaucaaguuucuuggugguucacuguuacguuaagggaguauccuuuggaagucccaacuucacuggggguaagaucucuuuagauuucccaccguggcugggcucugggccgugcuucugugaccuuuugaggcuuugaaaacugaagcucagguuugccuaguucugcaaaugccaucuagauaaaagcuucaguguuaacuuaccucccuguuucuccuccuuaggguuuuagccugaauguuccuuauuuucuugccagcuugccuaugcuuuuaagacaaaauuuaaucuggccaggcgugguggcucaugccuguauuccuaacacuuugggaggacaagguggaaagaucacuugagcccaggaguuugaaaccagccugggcaacauagugagaccuccaucucuguuucaaaaaaauauguaaaaaauaaaaagaaggccaggcaccguggcucacaccuguaaucccagcacuuugggaggccgaggugggugggucacuugaguucaggaguucgagaccacccuggucaacauggugaaaccuugucucuacuaaaaauacaaaaauuagccgggcaugguggcauacaccuguggucccagcuacuugggaggcugaggcaagagaauugcuugaaccugggagagagaaguugcagugagcugagauugggccacugcacuccagccugggggacagagcgagacucugucucaaaaaaacaaaacaaaaauaaaguagcacuuucaagaugagccuuugcaucccuaggguuauggcuuccauucucagggguugcuggauuucacauuugagaaguaaggcugccagcaccacagcgaugagacagaagugguuucggccacucccccagaauuuuaguacuaugccugggccuggaaaucugacucauauuucaaacucacaugacacugauuugucccagaaggcuacuuuauggauuuauaaugggagauagaaucucuggggucagccucuucugguuuaaagauccuugguugaccugucgguacuagguaagucuuagaugguggcuaaguccauucuagcauucaauaaauaguacagauaggguugcuuacagagcaggaaucauacacaggcccuuuuaaaaaaugguaugacccuauuuuagacccugacccuccuugucccugguugcagauucccacuuucauguaguguuucuuucccaaauauuuugcuauuuuagccuuuugauuucugaaauugcccauaauaaguaaugcucauggccaggcacgguggcucaugcuuguaaucccagcacuuugggagucggagguagguggaucacuugagguugggaguucaagaccagccugaccaacauggagaaaccccgucuauacuaaaaauacaaaauuagccaggcaagguuacacaugcuuguaaucccagcaacucaggaggcugagaccagagaaucgcuugaaccugggaggcggagguugcagugagcugagaucgcuccauugcacuuuagccugggcaacaagagcgagacucugucucaaaaauaauaauaauaauaauaauuaaugcucacauuauuuuuuuuuuugcacuacuagguagacugaacaccccauggucauucugcugcugccaaguucaucuugguaggugcuaauuucaggcuggccugauucuuguuuuuuuuuuuuuuuuugagauggagucucacucugucgcccaggcuggagugcaguggcacaaucucagcucacugcgauccugccuccugggcucaagcaauucuucugccucagccucccagguagcugggacuacagguguccaccaccgcgccuggcuaauuuuuuuguauuuuuaggagagaugggguuucaccguguuagccaggauggucucgaucuccugaccuugugauccgcccgccuuaggcucccaaagugcuggauuacaggugugagacaccauacccggccugccacaggugggcuucugaaggugguagacccuggagccaagcaguggcacaacauaggcaucugaaauccacacgucccuuuguggcuucaugucuguggccgaaaccaacaagcagauguauaguguuauguuugcuuguauuguucaucuuagaacuuaguucccucucugucucuucauguaaauuucuccuuuacauuauuuucuucuuucucuuagucccaauucgacaaaccuuucuuguuucccaugaucuagucuccaggcuuccuuacuacccucuccccuugaguaggcuugacaccauccagcccuuucuaguggggaaagcagaacccaaaguuggcaucccagauucuaucuuuuuuuuuuuuuuuugagacggacuuucgcucuuguugcccaggcuggagugccguggcacgaucucagcucacugcaaccacugccucccggguucaagcgauucuccuaccucagccucccuaguagcugagacuacaggcaccugccaccaggcccagcuaauuuuuuguauuuuuaguagagaugggguuucacuguguuggccaggcuggucuugaacuccugaccucaggcaauccacccaccucagccucccaaagugcugggauuacaggcaugagccacugcgcccagcuugccuggcugauuuuuaacagugacuuuuaaauuucuacugccauccagcgcauuccugggcugcuguguguguuuccuaucagagaaugaaaaccagaggaguacgggaguacacugguguggcugggagucgagcucuagagucauacugcugaguucaaguccuugacuaauuaaagcaugacuaggggaggccagccuggauaguuaaaaauuacauauuuaaaauguaauauaugugugagcguucacagcagcguuauucaaauacaaaaaaaaauuagcugggcaugauggugcaugccuguaaucccagcuacucaggagacugagggugggagaaucgcuugaaccugcgaggcagagguugcagugagccgagaucaugccauugcacuccagccugggcgacgagagcaaaacuccgucucaaaacacaaaaaaagagccaaaagguggaaacaacccagauguucaucaaccaaugaauggcuaaacaaaauguggccuacccauccaguggaauguuguucagccauaaaaaggagugaaguucugacacaugcuacgacauggaugaaccaugaaaacauugugcuaagcaaaagaagccagacacaaaaggucacauacuauaugacauuucuaggaaauauccagaauaggccauagagauggaaagcagauuacugguugccaggggcugggggugggugggaauggggaaugacagcuagugguaccagguuucuuuuuggagugaugaaaagguucuggaauuggauaguugguuaccaacauuauaaauaugcuaaaaaccacugaacuguauaguacugguaaccagaauaugugcaucauuaggccuauauauuaaacaauucuaguuggucaugucccuagaccccgguuguguugacuugccaugauuuguuuaacuguuugccuacuguugaauacuuggcuuauuuccaggauuuugugaucauugauaaugguaagccuuacuuucaaagucugauaagcuuuuuaaaaaauucugcuuccuaugugaugccaagcacuuaagaaguacucuauaaauauuuauugaauuaucuuugcuugcuauuccuguuucauuaguguagauaauuacuuucuguuccagauuauuucaaaagaaaauauuccuuaaacuguuagccuuucaguaagagcuguacauuuuauauuuguaagugguauauuucagauagaaauaguuugcuugccuuuucugaucacaaggguaauaucugcuaauuauaagagauucagauaauggccuugccuggacaguggccuuuaucacaguccuccaagcaauuccacaucugcaaagaaacaugcuucuuaucuuuuugccauaucauuucauuaucuucucugcaucuugaguuugacucauuuucuucuaaaaaacuucuuagauaccuucugcuagacaguagccuacgauguaugaugccauugccuucuuuuuuuuuuuuuuuuaacuccccucccuguugcgggaagucaggaacccugaacggagggacccgcugaagccauggcagaagaacauaaauugugaagauuucauggacauuuauuaguuccccaaauuaauacuuuuauuucuuaugucuaucuuuacugcaaucucugaacauaaauugugaagauuucagggacacuuaucacuuccccaaucaauacccuugugauuuccuaugccugccuuuaaucuuucaaucuuaucaucuuuguaagcugaggaggauguaugucgccucaggacccugugaugauuguguuaacugcacaaauuguuuguagagcauguguguuugaacaauaugaaaucugggcaccuugaaaaaagaacaggauaacagcgauguucagggaacaagagagagaaccuuaagcucugacugccggugagcugggcggagcagagccauauuucucuucuuucaaaagcaaaugggagaaauauugcugaauucuuuuucucagcaaggaacaucccugagaaagagaugcgucccugaggguaggccucugaaauggccgcuucgggggcagccgucuuuuauggucuaagccguagggaugaaauaagccccagucucccguagagcucccaggcuuauuaggacgaggaaauucccgccuaauaaauuuugaucagaccaguugucugcucucaaaccaugucuccugauaagauguuaucaaugacaaugcgugcccgaaacuucauuagcaauuuuaauuucaccccgguccugugguccugugaucucgcccugccuccauuugccuugugauauucuauuaccuugugaagcacaugaucucugugacccacacccuauuaguacacucccucccuuuuugaaaaucacuaauaaaaacuugcugguuuuauggcuggggggcaucacggaaccugccaacaugugaugucuccccuggacacccagcuuuaaaauuucucucuuuuguacucugucccuuuauuucucagacuggcugacacuuagggaaaauagaaaagaaccuaccugacuaucaggggcuguuucccccgauaccuccccuccuucauuguccuuuuguccaaagaucaugucugucuuguuugcaaauaagaaggaauaauaggcuaggcucaguggcucacaaggccuguaauccuaucacuuuggaaggcuaagauggguggauugcuugagcugaggaguucaagaccagccugggcaacauggugaaacccugacacaugcuaauuuuuuguaucuauaagaaauuagccaggcauuguggugcgcaccuguagucucagcuacucaggaggcugaggugggaagaucacuugaaccugggaagcagagauuauagugagcugagauggugccaaaagaaggaagaauagugugccauuuguuuugcuaagucagcauccuuaauuucuaacuuuuuuccuuucuuucuuucuuuuuuuuuaauugaggugugcacugucaugccuagcuaauuuuuuuuuuuuuuuuuuuugguagagauggggucuugcuauguuacccaggcugaucuugaucuccuggccucaagcaauccugcuaucuuagccucacaaagcauugggauuacaggugugagccaccaugccuggcucaacuuuuccuuucuuuucuuucuuucuuucuuuuuuuuuuuuuuucugagauagagucuugcucugucgcccaggcuagaguacaguggcgcaaucucagcucacugcagccucugccuccuggguucaagcgauucuugugucucagccucccaaguagcugggauuacaggugugugccaccacaccuggcuaauuuuuguauuuuaguagagacaugguuuugccauguuggccaggcuugucuugaacucuuggccucaugugauccacuggcccuagccucccaaagugcugguauuauaggugugagccacuuuucuuggccacuuuuuuucuuuuucucuuuuuuuuuuuuuuuuuugccuugaggucuugugacauucugaagcuaugugcuuuucugugaccuuuuaaacccuuuguauuggccgggcaugguggcucacaucuguaauccuagcacuuugggaggccaaggugggcagaucacuugaggccaggaguuugagaccagccuggccaauguggugaaaccccaucucuacuaaaaauacaaaaauuaguugagugugguggugcaccugcacauguguaaucccagcuacuugggugacugaagcgggagaaucacuugcaucugggaggcggagguugcagugagccgagaucgcgccacuacuacgcuccagccugggcgacggagcaaaacucugucucaaaaacaaaaacaacaaaaacaaacccaaauccuauguauuccauagcugucuuguaaggaaggaaugaaccgaugggucucuuuucucuuucccugugucaugugguggagcugugccuagcacgacuucuuuuuuuuuuuuuuuuugagacggagucucgcucuaucucccaggcuagacucugucucccaggcuagagugcaguggcgcaaucuuggcucacugcaaccuccgccucccagguucaagcgauucuccugccucagccucccuaguagcugggacuacaguugcaugccaccccgcccagcuaauuuuuuguauuuuuaguagagacaggguuucaucguguuaggauggucucgaucuccugaccucgugauccacccgccucagccucccaaagugcugggauuacaggcgugagccaccgcgcccggugccuagcccgacuucuugccccacauuauuguguguucgccuuucccugcugcgccaucauugcucagcacgccucaagaugggauguggcagcaauggugggccauucuguccuuaugaagcuaguguuauugacuaugccuugcuuuuuuucuucagagucauuuuucuaggaacaaggacaaucucauaccuuugccucccugucugagaccccuguuuuagcuaacagcaagcuuggacaagaugguuuaucagagucaggguuaaagccuaagaagugaagugaaacuaaugagccaucucagugaugcagaagccucaucuucuccagcugucuguggcucugggcuuccuuguguugcuguguugcuggcagccauguggggaucugggccagagacagaaaugaaagaguggaggaagaccagguacuuaucccugaugcaccucuggaagugcuggaguuguggaugcaccucuggaagugcuagcuaggcucauugcuuuuuuuuuuuuuuuuuuuuuuuuuaagacaaagucuugcucuuucgaucucggcucacuacaagcaaccuccaccuucuggguucaagcgauucuccugcuucagccuuccaaguagcugggauuacaggcgcgcaccaccacgcccagcuaauuuuguauuuuuaguagagaugggguuucaccauguuggccaagcuggucccgaacugcugaccucaagugauucgcccgccccagccucccaaaguguugggauuacaggucucagccacugugcccggucuaggcucauugcuuuuuccagccaaugcugaugacugaaagacuguuuuaaucuuagaauggugcaguuauuuauugagugaaaguucaacugucuguagcugucuccucaucuuucuugucguuauucuguuuagauuuccagccccacacucuccucucugacuuaagacucucugaaaccccuuuacuucgucaguaaaucuauucugggauuguaggugcugguugggcuuuauggggacaaagggaccccuacccucauucacaagcacaggggaauugucaugaggaagauggggugagggagagaacuccuugcgagugaugucacagugggcagcuuucucuuuguagauccuugacagucagaucucagggacaguuccaaaguguggggaaaacgagauuagaacucuugggugguuuuggaucugcuguuugguuuuuccucaucuagaacuaaauuuauauaaaagaauacaacaguagaauaaucauggcaacuaaguuuguucugcuguccuggggccucuucauguauuaucucuacuuacugcaacagcucuggagguaaaaggcguuaccuugaagaaacugaggcuccaaggggugaacugcuuguccagggccauccagcucgggaguggcagagcucagaucuaggcuccugucucccaccccaccgcccaugccccugccuuccccugcaccagaacaaagccaccacccccagagggccguguguuugugcuuuuauuucccugaauggcuccagguuuuugcuuugucauuucugugcuuguguccuuugcagagucuuuggcuuccuuuuauuuuuccuaccccaguagcaucugacgcaaugccuggggucugggaggaagcaggguucuuugcuuagacaucuugguuuucaucuguuuuacaaaauuauccuuggccucuguucucuuuuuccuuuuauuuccucccugaaauacugguucuuuaaggcuaucgggaaaagaaagauaauccuacccaagaguuugaagaaauguaaaggagaaguguuuuuagcaagcagcuggguuuuuagcggggucguuuccacgcuccguguugcccuagugaaagugguuugucuuccucacgacuccaagggaacuggcacauaaauggaugcagucagguggccguugagccaagggccaaguaaggcauuucguccucagccacguugcccuugccucaugccuguauuucuguucuuuuuuuuuuuuuuugagacggagucucgcuccgccacccagccuggagaucucggcucacugcaaccucugccuccuggguuuaagcaauucuccugucucagccuccugaguggcugggacuacaggcaccuaccaccaugccuggcuaauuuuuguauuuuuaauagagacgggguuucaccuuguuggucagucuggucucaaaccucaggugauccaccugccucggccucccaaaguguugggauuacaggcgugagccaccacgcccagccucaugccuguauuuccauguccugaacauguuacauuugcauccaggcccagcucuguucccugaggagguuggaguucugauaccccacagaaggaaggagucaaggcggggaggcugcuuggaggagggugcggcgaagacaaagaaauggcucuacgauucuugggauugcugggaagcuguugcuuauaggguuggcucucuguccucucugaugcuccaaacagguccccaggggacaggccuucccggggcugccacuuucuccaguguuagguccauauccauuuuccugucccccuccgcuugucccagcuuuaucauccgagauauggggcuucuuuccaaaggugaauuuaaguuucagguuuuccuaacaguuucagcuguuaggcaggggcuuguggcaggaaaaagaagacagaaauuucuguugcccauaggagggugacggggugcuggguaaauaccaguuacagggaaguucccuccaaugaguagccuggcaccuuucugcagggugucuucugagccagcuggauucaucguguuggccugugaagucugagaacaccaucucucucgucuuuccccuccuccccuccucugugccacagcaagaggcgugguauacucuggguccucccucaucacuuacacagccuucucucuguguuugauuaccagaaugagccagccuuguucugaguccguucauucauuuauucauucaacaaccguuuugugcuaggcaccaugguaaccuacauuucaaggcuguaacugcuauuaucaagccauuugcagaaguuugggucacugaugugccuuugaccugaugcccauuuucuaaacccaggcauuccucuugagugauacagcaucucuguaccucuucuccaggacuuauggcuuagguuuuuguuuuuauuuuuaauggggcuuucuggcaaagaccugaaagccugcuagacaaauucuaaaagugcuguaacacuaacgccuagguuucaguucugacuucaugcaaagaggaugccugaaccaagcuccucacuaccaggccucauucuuuucucagugacuuagaucccucuccccaaccuugguaucuguuugcuguuccuagcacagauccucagcacugguguauucacugccucuggcuggagcccauuugacuguugucacuaccucgucccccugcccuuccucgccagccaaugacuucucaucucuucccagcuugucaagcuccuggagaucucagagucacaggccccacccagggcucugcaaaaauauucuuuaagggugugggcgaagggauaauuguuuuauuuuugagacagagucucacucuguugcccaggcuggaguacgguggcucaaucuuggcucauggcaacuucugccucccagguucaagugauucucaugccucagccucccgaguagcugggauuacaggcaugugccaccacgccuggcuaauuuuuguauuuuuaguagagacaggguuucauccuguuggccaggcuggucuggaacuccuggccucaagugaugcaccucccuuggccucccgaagugccgggauuacaagccugagccaccgcaccuggcuugaagagagaauuugaaaauagaaaguuuuuuccauucauuucaccuuuugaggcuaaccuagacagcuugagguaauccaccugggcccacagucccaggauuaugugagucuucagggacucuccagaaacccucuuguugauaugggugcuggaaacuugacggggcuugguuuaguuccucucugagcugcccuauuagaggaacuucuggauagaugaaaucuuccagggagaaguucugaauguucugaauguugcugcucccuccuccugggccuucuucacugggcuggggcucugcuuugaggccagagugggaagacuauuuggaggucacacguguuuggcguggcuuagggggugaggaagccuuuuauuuauucuucugccucuuaucucccuacuuaucucuauacccacaccccuaaaaagagaauggcagaaguagauuuuguugggcugggcaugguggcucacgucuguaaucccagcacuuugggaggcugaggugggcggauuacuugagcucaggaguucgagaccauccuggccaacauggugaaaccccaucucuacaaaaauacaaaaaauuagcuggacuugguggcgcgugcauguaaucccagcugcucaggaucucuugaacccaggaggcggaggcugcagugagccaagauugcgccacugcacuccagccugggcaauagagcgagacucuguuuuaaaaaaaaaaaaaaaaguagauuuuguauauguuuuuugaaauaaggucucacucuguugcccaggcuggucuugaacuccugggcucaagcaauccuccugccucagccucccaaagugcugguauuauaggcaugagccaccacgcccuaccuagaaguauaauguuaauugcagaguugguucuaguggacucaaaacauuauaguuuguguaccucccuucuacaggacuugggaauggaaagaggaauuuuaauugccuugcaugugaauuuuucuuuaaugcaaaauucuuuaagaggaggaaaaaggauucuauuugcuguuucuaucaccaccuagagggcucacaggcugcugugggggaaaggacuugggcauuugacuaaagauuuugcaauugauggugggugcucuaucagguaugugcuaacuuaggggaaagcuaaccagcuuccaguuuguccccuuccugcagcaggagguccuccuggaccaucccaggcucuaggcugcccauggaggucuuucccugcagcucaccccaggguaugagugccguaauccuagaaggcugaggcugggcucaggugccucuugccccagguaacccaaguucaggccagauaaauuucuccguuauuauacagaaugccaggaguuuuccagacccuuuccccuuaucaguaauuucauguccaccagagcaguggacaggcaucauguagguguuagacauucugaagcuuacgucuagcuaaggcaacacacauacacaagacaagauugaggacagcguccaaagcaacaaacgcagccuucagaauagcaucaguccucccggccugguucuaguuuuccuuggagcuuaguucuagaauuucagacuugaccucuuagcuuaucaauucucuaugcucuugaacuccauccuagguaggaaaaagugaagggugaucucuggaaaccuacgccaauuugcauagacccuucugauaaguagagugcuuuaauauacauuucuaaguggggaccagguacaguggcucacaguuugggcccccagcacuuugggaggccaaggcgggguggaucacuugaggccagguguuugagaccagucucaccaacacgaugaaaccccgucucuacuaaaaauacaaaaauuagccgggugugauggcgcgccccuguaaucccagcuacucaggaagcugaggcaggagaaucccuugagccugugaggcugagguugcagugagcugagauggugccacugcacuccagccugggcaacagaguaagacucugucucaaaggaacaaaaacaaaaacauuccugcauggggugagggcucuugguuuguagaugauuugcucagggucaugacgaacuagggcuggaaucuagguuuugugcucccaaauauuuuauuuuauuuuauuuuuuugagacagagucucacucugucacccaggcuggagugcaguggcacggucucggcucacuacaaacucugccucccggguucacgccauucuccugccuuagccuccugaguagcugagacuauaggugccugccaccacgcccggauaauuuuuuguauuuuuaguagagacgggguuucaccguguuagccaggauggucucaaucuccugaccucgugauccgcacgccucggccucccgaagugcugggauuacaggcaugagccaccacacccggccuuucugcucccaaaucuuuuguacuuucuguagugucaugcuuuucucccuuccacguuuauugguucccuaucuuuacccagugccuucuuggaucacugcucuguuagccuuuggggagacuaaggugacuaaacuguggucucaggacuggcagcuccuaggaacucaggucccccagaaauugaggugaguaauuugcugccuauaagccagaucugcuuagacggugaaguccuccuuaacccuguucagagcacagacugcacauacaaaacugcuuggcaggucggucacaguggcucacgccuguaaucccagcacugugggaggccgaggucggaggaucaccugcgcccaggaggugaagaccagccugggcaacacaguaagaacucaucucuacaaaacaauaguaauaguaaaauaaaacugcuuggcaacgagcaggacaggcuugcugucuacagcugugggccuggccugaccuacgcuaagggaaagaccacaggggcugggccaaguguggugagugagagcuggggaacagacguggccccugcacagagcgcauuuguuccugcugauccccuccagcaauaggggaguuccagcagaagcaguggcugaaagaaacacaguugguguguuuguuuuggaggguaaggaggaggaaggaccaaagcagagggaguggaggcuguaaagagcguuguaggaaagacugagacuaugggagggguaguuaguacugagcucaaagugccgaaagaggcaguggcuauugccuguaaaggacgaagaaagaagggagacagaaccaaaucuggggccucagaggauugggaccaggcuucccccaacaccaugugcuugucagcaccaggauuuuuugccugacugcccucucuguuacguuagcgugagacuuuaggauaaaucgaggaagucucggaaccuggcaugccaccucugaggccuguggucccuccccugguagcucccccugcgggcagggcccugguacaccccuccauggauggagcagaaucaccccuggagcccuugcucccugcaggaucacagggcacggagugguccacagcuggcccucagcuccaggggcugccguguggcuuagggagacuugccuuugcucuacaacuguuuaccgagcaggacuguguucuaggccgcaugcuucaugcuggagacacagcagggagaaggccucagccaucuccugucaucaggggggacuggcagaaggccauucccuguucaauuauagcugugaucauugcugcacaggcagcggguaaugagagugcccuaacccugcuggcccaucaggggaagccucccucccacugugguuaucugccucucgcagcaggcagugccuugcuguggagcuuggcagaacauggggaaccuuaggcagguuucagagacuccaccgugcucucugugaaauggaguggagggcgggaggagcuuauggcagcagcacccucccucccucccucccuggcuggagucugguugcuggagcugucuguuugccuugugagcccuccccauuggcgcacccuaggacccugcugacacuaguuuuuuuguuguuguuguuuuguuuuugagacagggucuugcucugucacccaggcuggagugcaguggcaccaucauagcucacugcagccuugaacucccccaggcucaagugacuuucccaccucagccucuggaguagcugggaucauaggcacguaccaccacacccagcuaauuuuuuuuucuagacguggagucuugcuauguugcccaggcuggucuugaacuccuggacucaagccauccucccacuuuggccucccagagugcuaggauuacagguaugagccaccacaaccugccuggcacuacuacuaaacagucccugguaguguaauuggaggcgacggcagaaaugccucgaggggacaaggccuguuuggaguugaauuaaaugccuccuugccuggcagugaauuaucaguuuguagauuaucuguguuuguucuuuacuuaccuuuuuugagcauuuacuaugggccagacucaguccuucccucaaagggauccuggcaaagucuuucuuucuuucuuuuuuuuuuuugagacagaguuucacccuuguugcccagacuggagugcaguggcgccaucucggcucacugcaaacucugccucccagguucaagcgauuuccugccucagccucccuaguagcuggcauuacaggugccugccaccacgcccagcuaauuuuuguauuuuuaguagagacgggguuucaccauauuggccaggcuggucucgaacuccugaccucaggugauccgcccaccucggccucccaaagugcugggauuacaggcguuagccaccgcacccagcugcaaagccuuucuuuuuuccuggcuucuuaccuguugaccuuauggagagagaggggcaggaauacauuguaaaaaucaaaacagaccacccuguuuuauccaguagggagaaagagaaagaccugcugacuuaccgaaguguuuggauugcccagguagcuugauaaccccagagaggaggaaacgagacguaccugggcuuugaguuccuagauuucuuuuuugagggcaacauucuuaauccuucaaacccaucuuuguggcuguguguccucagggucaguagcagccuuaggccugggcacauguggccccuguucagacucuacaccugagggguaccuuccuccaaauuuuccagguccuccuccagugccuggggcuggcuggggcucccaguaccauucuggccacggguguugcaaacccacccugggauccuuugggguacucuccaucccucuacguugcacagggacaacagcuguucuguggagucguccuggggcccaguuccgggagauggcugcaguauuucuuucuuucuuucuuuuuuuuuuuuuuuugagacagaguuucucucuuguugccuaggcugaagugcaguggcgugaccuugacucacugcaaccuccgccucccagguucaagagauucuccugccucagccuccugaguaucugggauuacaggcacgcccggcuaauuuuuguauuuuuuuaguagagauguuggucaggcuggucucaaacuccugaccuuguguuccgcccaccucagccucccaaagugcugggauuacaagcgugagccacugcgcccagccugcaguauuucuuuagugggaaucaugugagauugggcugccagaauggugcugaugcacuaauuuugagugacucaaguuuuuauauagacgaguccccauaauguauuugucuggggccccaugcauccuagaucugcccaggggccacccauugggcccucuagcucugcuuagcagcucugcgccugaaccagaaaagagcauaagggccuauuguguguccccagggccugaaugguacuuuguuuucugccuuuggcgccacaggccaagcggcuuuacuacugcugcugccguucuaacagucucgucuccaaugagaaauucauucccacccggguuucacguuguuuuacugaauauccugugaggaaugggcuuugagccagcuuggggucucguguggguugcugggugggggcuuaucacugcgguaaugagagaaggagccuucccuacccagugaccucagcuguggcaggaggaagcccuucguuaacauugaacuagggggcuaaauggcaggaagggaauguggugggaauuguugggagaccccuccccaccccagggugaacugaggcugggggcagcugggcagaggcaggagcugauaguauuugccguccucuucccuugcugcuucuugcccuccuuccccaaccauccccauucccucuuggcccacucuaguggggaagcaggaaaaggauccugugaaucaaagcugccuauuuuguguugaggucaaaggaauggaaaggguggagaggaaaccagcggagagcagguuguuagauuuggaagugcccacaggaagcggcugcucagcugaacuccacccuuuacggcugucagucacacagcgcugaggucagccaucccaccuacucagugcaggaaucacgccgcucaccucgcugccucuucuugugucccaaggugaagaagcuuguuuguuuuauuccaaaacuggcauuacuuucucccaggccagcaaggagugucuuccuagacuggugguucucaaacuaggguccccaggcccuuacaccuccucaagucuguuccaggggggucugugagucaaaaggauuuccauaacaauaccaagagguucuuugacuuuuccaguguguugacauuugcacccauggugcaaaggcaguggugggcaaaacuguugggacaucuaggauugcgauggggauuguaggucaguguggcgaguauucccaucuuagcaacaggaagucucugacccaugaacaugugguaucuuuccuuuccuuuagauuuuuaauuucuuuugagggucuuuuauaguuuucaguguauaagguuugcuuuucuuuucuuuucuuucuuuuuucuugucuugcucuguugcccaggcuggagugcaauggcgcgauuuuggcucaccacaaccucugccuccuggguucgagggauucuccugccucagccuuccgaguagcuggaauuuacaggcaugugccaccacacccggcuaauuuuuguauuuuuaguagagauggggguuucacuauauuggucaggcuggucucgaacuccugaccuuaugaucugccugccucggccucccaaagugcugggauuacaggugugagccgccaugcccagccuaagguuuggauuucuuuugcuaaauuuguuccugaguuuguauucuuuucaaugcuugucuuucuauuaauuuaacuuuauauuguuuaaucucuuccucuuuacgccuuccuucuuaacuagacuaaagacagggaugugucuuauuuauuauuacuuuuuuaaagaggcaagcucuggcuguguugcccaggcuguagugcaguggcuauuuacaagugugaucauagcucacugcagccucgaacuccugccucaguauccagaguagcugggacuacaggcaucugccauugcaccuggguuaugguguuuuuuuuuuuuuuuuguccaggcugcuccuguaaagaaggcugguaauuauuaucccuggucuagugggggaagaaacugaagcccaggauggcggggugacuugccucuuggcacagcacugguaacaguagcagagauagggccaugacugucugauucacaucucgcagcuccuuccaguugccauccuacaagggacugacauucuguucuuagccucccugagcuugugucuaggucucuaccucucuuguauugaggcccuagggcaugauggaagagagaaggacuaaggcuauuauuacaagggcugaccauuggggucauuuuuuuggacaucucuaccgugcuagacucucguagguauuucaaaaauacguuaccucauuggguucucauagcaacuccacaagauggcucagaucauucugcauuuuauagaucaggaaacuaaaguucagaagguuacguaaauucccaaguugaagagcgacuuaaguguuggaguugcaauuaaacacaguucccagagcucaaacugcagugcugggaggggacaacaguggguuuaugugacuuguguggaggaggaaggacacuggggcauucugggacacugugagacugucagcacuagcguuggguugggucaauccagagccuuugcucucuggccuggagcugguaucacaaagugguugguuuguugcaucuuucuaggggucauggacaguagaggccuggaaaccuuagccccugugaccccugcccugcagccuuauucuuugacaauuaacucuggggguggaugcuaauuugccacaugcagaucuugcuuccaccggccguauggugaguucuuaaaguguggggccaucacgcucucucugcuucccuauagcaccuaguaucuuuuguguuacauaguggacaguccucacaagcuuuccgaauaaaugaaagaaacucuacuugcuugucuugcuccauagaagucauacgacaucaauguauguguggcuagauuugggguggcagaggagaaugggggaccaaggccauuagaaggguccauccagcugcccugauggcacaaggagcuuucugcaggauggaccaugagccaagacaaggacgagacagauguaagcacuacccagagcugagcacagagcgacucguucuccaccuggaaccuccagcuggaagccugguucuguuugucacccaggacuaacaguguuguugagcaugugagcgacucguucgccagggcagcagcgcauaaccuugcuaccguuuaagccagacacuuacuccccccgcuuguguuuuucucagaugaagaaaacaccuauaaagucgucauaauuguugguuucaggguauuuuacaauugcauggaagguuaauuguugaauuuuucaacaccgggcuuucuguguaaauugaagacagcauggaucaugcuguguugcucugccgcagugaguggucaggccccugcguccccuucugcucauacccgguguuccagccauaccaaacugcaugguuugugaccauacaauggcccguguccuggccacaccacucucuucccuuuucccuucccgccgguccucugucacucaccuugucugugagucucaacucccaugguuuccugauaccugaguccccuccucccaucacuaguucagcacuggcauuugcuuccuuuggcucccaccacacuugguuucuccucuuuguuuacgugucuagugccuucccugacgugagcuccuggagggcagggacugugucuucuuguccgcuccggcuccccagugcugauggagacucaggcaggcugcgcuggaccaaauaggacacgugguggugaugacauuuuugguccaauccaguagcagccugugaagugcucauugcaggcagagcugaguaagcugugaccccacucucaggcagcuucucuucgggggggagcggcagggacaccuguuccgaagaucauguccugcaugaucucugugugcugaggaaugaagcaugaguggagauggcugggguccaugacgaguaugaccuugggcaagucacugugaauggcacuccugggugaggcuuaggcugagugcaggcuccaugcagauacuuccuccagcucuggccccacaccagcagcacaccagccagaaggcaaaucucaaggcgaguacgggaguugguggcaccucucugccuccagcuguggaagaggcacccggugccugucugggugcuaggauaaggacaagaauugucacaaccagcagcuguagcacuggacacggggaacagggacuuucugccauuucccacuuuggcauuccagcugauccucuacucuuuauucccagauagggccccugguuugagucucauucugagcucaccuuccggguagcccccuuccuucaugggcuggaagggaagcagaaagcugcuuauugucaucuugggaaaagauagagaagaggcggaaacagaggugccagugcuggucaggauccuggaccugaaggaaugugcaggaucccuccacccugacuuuucaguuaacgcguguucucggggacaucgggguguucagaccucugccuggcuuggaucagggcgcacuuacguucccguagcaggcucagccuacccgcucucuucagaugccagcuucugucacacagugagcgcgccgaaccaugcaagaccuccgaccaauuagccucggguucgggaggccaagcaaaagaucuaacagugagcuauugacugugccuccuccaaggagcuggucagagcucagccugguguuuugcuuccuugcgaugguggggugguacccaguaggugggaacucuguucuggcuucuuacuggggugcccuuuaggauaacacuuuguuaaaugaacugagcugggugguuucauaguauguucaagcaugugaacaucugcuugcugauaaaucguacugggucaccagcucacacuaaucaccagguaacaugugcccuggugagggauccagucuucuggcccuguggggagacaggcccaugaugucaccaguucccagguggacaacccaaggcauagugaggucucggcaggaaggaggaagacauuagacuccuucuuuuuucuucuccccauugaaucuucugcuccuuuccuuaggccagaugcccugucucucuccuggcuggcuuucccagcccuggcccuggcccucccuucuuugugaaacucgaacaccacugcccuuucaucuuuccaccagaacuugugagcaguggcuuuugaccgccgcucuuccagcucaccccugaccuaguguuuguuuuuuuauccuucccucagucuacucaaggcccaccccuaagccagagauuggcucccaagcagccucucucuccugggagcgguaaaggaggggacaguucuggaaagucauugacaggggauuaaccuagaacaucaauuauaaacaggcagcaggccucaggcccagacuuggguguuacaggaacaguguggccucucuggaacucugcagaccaacugccgugguaagagaaccgacuuucagaggccucuaggcacuuuguccuggguaggggugcccacacauccuggccauuguugcucuucccucuggaacuuggcagcuuucuagcaguuagaagagcagaggguagaaggaugggaacaguccuuagagaacaggaaucuaggggaggguuggacuagaucauuucucaagagcuguggggacuguucuggucaggcaugggcaagcugaggggcaggagguaggcaaacccuacuugaccugagaacagauuuguuguuguuuuguuuuuguuuuugagucucgcuuugucauccaggcuggagugcggugguaugaucucggcucacugcaaccccugccucccggguucaagcgauucuucugccucagccucccgaguagcugggauuacacgugugugccaccacacccggcuaauuuuguauuuuucguagagacgggguuucaccaugcuggccaggauggucuugaacuccugaccucaggugaucugcccgccucggccucccaaagugcugggauuacaggcgugaaccacuguuccuggccgagaacagguuuugccugagaccuuggacagaagaccuuggccauggauccaagagcucugggccagaacacccuugcaugauggugacaguugagggaaaggccacaugguuccuuguguaaauggcauggcugccaguggucauggggaggcccugcucauaguucagcaccagccggcccuucgugugcugugcuccagcuccccagccggcucaguccuucacaaaaugcccuggaguuacagaacagaaaggcccggcuuuccuuuaggaaucugggaaauaggagggcugaggucaugcucuguucaacaugugagaccucccagacagcagugcaggaaaaacauguuacuacccguauuuugggagaccagaccucuggcguuugaguaggacucacugcucagaucuaaggggagagaacaucucccauuuugaagaaaaccuuuuccucaguuuaggaggaggagaaacugaucagguuccaaauggccucuuguucuuuaacugcaaacgggccaggcucccugccaggucaugggauaacaauccaaggagaggggagaaaugcagugugcauguguguguacaugggcaugcucguagggggaaagacuggggggauggaggugacguggacaucuguguaugcuucagcucuauuucccucugcuuagucccaaacugcucgggauuagcaauuguuaagaacaugccuuucuccccaccccgggaguucuaggccagggguggagggauugagcaccguggcuuuguucucugucagguggugccuuucucugugacaccgagggagaccugccaucaggagggagucugaggccaggagacaguacuuaccgaucaggauggaucuuuggucuuguuugugugcuugguuuccuggcuggaaugaaaugucaguuucaugaggacagggaccuguucucuccugcacaacuuucucucugaugaccgacagugccuggcauguuguaaaggcucguucagaagugacugaaugaaugaaugcauacuuuuuaggcggggcugcauaucguucccuuaaaccuccugauucaucuuccguugcuuccgugucagcuucucacugggucauugucugcuuuggugcugcccuuccccacaacuuugagaguucauguuacugcaggcuccccgcccgcccaccucugccugaaacuucucuuuugggcuccugugcugugacauacuagcaguauuuguuugccccucuuaagaccaucccuucaguuucauuccugccucaguuucuccuccucacauuucugcuguuccaccucugcuccugugcucuucucaggaaagcaggugaguggugaugcccugggcuaagcucgccagggccugggcagcccaggcacccgugguucggguggggagggagcaugcugguggccggagcugggcuugugggcagcagcccuccccaccuugcugaggccaagcucuuucucauggcuuuggcugucacuucuaugcugaucacccccaaaucauugugucuauauuucucuauuggugcuucugaccuuccaaaaucugaucccacccuggcagucagaccuuauuugaugucaaggauuauuaauuuguagcauguauuacaucccuaauauggaccaguucacaugcauucucauauuucauccucccaaugaacauacaaagucaaauaauuauucuuauuuuacagagucucagacaacuuaguuccucuagguaaccagauuaauuagcauuaggggguugugaucaggauuugaacuggcuccacuggccccugacccugaacagagucagcuuggaguccgcccuuggagacgaggacagccgguccuguuucucccucucaccccagugcacucacacagcaggcguuggcacccuugcuaagggccaggccaagcgucuccucugugagccuucacuuagcucuccuaagcugcucggccugccuccucucccuuuucucuaacagcagugccuuugcacacacuauguguuuguuauauguuggcugugccagucuugccucgucagcagauagugauuuucuuaaaggcagaggccauguuuuauaugauccuccaucccucaaguguguguuacaggcaguuuguugcucaguaaacacuugauaccucugaugaggugaaaucuaaucacaguccuuugcauauguauugugguuuacaguuucugaaaccgaagagccaauuugaaguuuccuguaaaacagaucccuuaauugucagcgcucugugcugagagggauaaaucuguuuuguagacggacuaacagguccagagguagagugaauuccccaaggucauaugauggaugauagcaaagccagaacuugaacccaagguuuaacucuuaaugccguuccucuuaaugccguucccuucccacagaaucacagcagccugugguccagacuuggccaggugaccccugccaggccuuccaucccacuuagucauacaguuccuuauuuguauuuguccuuucucuuucauuagaacucgugucuuuuuguguguguguguguuuugagacagggucucgcucugucacccaugcuggagugugguggcacaaucacagcucacugcagccuugaccucccaggcucaggugauucucccaccucagccuccugaguagcugggacuacaggcgcaugccaccaugcaaggcuaauuuuuguauuuuuuuagaggcagaguuucaccguauugcccaggcuggugucaaacuccugggcucaagugaucugcuugcuuuggccucccaaagugcugagauuacagacaugagccaccgcgcccagccuuagaaugcuugucucuugagggcagggacccuggcugcuuuucccauuauccuuccaaagcuccagcucuggggccaugaaccagaaaucauuccuucaaggauguugacacagugagucaccugagaaggggcagggugcaggagggguggggcaggagaucaggaacuggugugggacauuaggggugggagauaggccagaaagccccaugcucuguguaaaagcuucugucaaaugaagaugugcuuguccuaccuaccaggcgagguuacucuuaguagcaagugagagugucugcuaaagcgccuucuaaacugcagagcacuagcaauauuguuguuaaauauaauuauagucuguagcugggcauggugcugggugucuguaaucccagcuacccgggaggcugaggcaggaguauugcuugggccuaggaggcggagguugcagugagcugagaucgugccguuguacuccagccugggugacgaagugagacucugucucuaaauaaaaaaaaaaaaaauguauauauguguguggguguguguggguguguguauauauauauauauauauuuuuuuuuuuuuuuuuuuuuuccugagauggagucucucacucuguugcccaggcuggagugcaauggcaccaucuuggcucacugcaaccuccgccucccagguugaagugauucuccugccucagccuccccaguagcugggauuacaggugccugccaccacgccuggcuaauuuuuuuuuuuuuguauuuuuaguagagacaggguuucgccaaguuggccaggcugguuuugaacuccugaccucaggugauccaccugccucggcuucccaaagugcaaggauuacaggcgugagccaccacgcccagccaaaaaauauauuuuuuaaaauaauaauaauuauaguccguagggaugagcucaacaacaugguuggauagaaucauacuggccuugugaguauugaggagacaaucaggauggugccucacccaaggccuggcacuccagcuauuaugaauuauucuuguuuucauaauuauuauaagacaugcccucuuccuucagauuggggaaaggaguuggcagugcugagaaugcaucgcuucuggauugggacuaagaagaugggaaaggcagucuggcccuagggcuuucguagauccacucaccaccgcagguccccgacucugaauaccuccuuccucccaguggggguuuucagcaagcuaauuucucaccccugaggaggaacuguuauauucggaugaacaccccccugcuaauguggagcagaaaaguaaggccuggcgagucagcagcugcucagcagguggaugggcugcggugguguagcggguaggcgccugacagcccggcuugccgcagccgcugugcuucccucccaucccuggggugugcauuuuaggguaaaggcaaacuggaagcucuugcuauuugcagaacuccaaaacaacaaaacaaaauguccacucagcuggggguuggcugggcagcaccacugugauuacacaguuagccugggggaagggcuguggucagaguuugggggacacacaggugugacugugaugugauacagcuggaggaggaagaggagggugugaucacaggcccgggaguggccagggcaagagugaugguggaggagaguggcugagguuggcaggcagggaggagagauugguaacuacuaaucacuagcaugaucagucuugacaaucuaucuacaagggacucccagguggcagggcaggaccugaggcacagcucggcaugacgggcagacaggggucuacguggcuuugagcucugagaccauaggcaagcuguucaucugggugucuuuccaugcuuacaauaauauuccccuuacaagcccucugaugauugagaucauagaaaucacucagugcaguggcuggcacucaguagcagcucacacaaaugaucagcaauuccgacacuugcuauguggccaucacaguaaaaucagcaauaguggaugcccagagcugcaucuccgggaagccucugagccagucaguguuugugcucaaacuccaaagcauaggaugaaaggucagaucauggggcuaugaagauauguucuccuaggagucacgaauagggagagaaaacagcagcaaacacagucaaggccauguccugccuggguugcuguuuacuuuccucuuccaggaacugaagcuguuucccauuggauuucuuuacuaucgccuuggcucauggacuggguacuuugguaaucaguucgcccagagaaccaggcuuucacauugaccuagguuccacagugacuuccuccacgggaugucggggugugucaucuagcagaauagcagucaagacuacccaggaaugguugaggguugcacacuauuuuuaauaaauugaauuaaauagccaagaaaagucagacacccaacaagggaaguugaggcaccaagcgacaguggaaagucauuacuaccacuaggcuugaaggggucaggagaagaaauagcauuuccuggcugggcgugguggcucacgccuguaauccuagcacuuugggaggcugaggcgggcggaucaccugaagucaagaguucaagaccagccuggccaacauggcaaaaccccaucucuacuaaaaauacaaaaaaauuagccaggcaugguggcaggugccuguaaucccagcuacuccagaggcugaagcagaagaauugguuaaacccagggagguggagguugcagugagccaagaucgcgccauuguacugcagccugggugacagagcgggacucugucuccaaaaaaaaauaaauaaauagccuuuccugcaaacaccagugagggcugaauaguggacacugggaugccagcaggaacugucauagcgacaagacacagccugggucaggaugguggcaucaaagcugguagagagugaggaaggcacaccccacguucucucuccaccgccuccuaccuacccuugucucccgccugugccucugucucaucggcuggaccuacaggaaaccagccaggaagggagcccaggugccuccacccagagggcucagccccgcuggguccagagaagggcauacagggaggccgccaaccagguagccuuuccccaaaaggcaaagcuguggaggaggcauccacucagcagguguggaaagcaggggggaugagagcucuggcauccuagggucugagcggcugcugcugcuacuuuuugggaaggggcugccaaaucaaaacuaguuacuaguucaaaauuugaucauaaagggcaauuaggaaagauaaggaaauaaagaacauccagauuggaaaggaagagguaaaaguauuuuuauuuucaguugacaugaucuuguauagaaaaaccuagggaacucauuaaaaaucuauuugaauuaaaugaguucagcaagguugcaggacauaagaucaguaugccaaaaucaauuguauuucaguagcagugggcaaauugaaaaugaagaaaacaauuccauuuaagauagcaucaaaauaaaauauuugggaauaaauuuaauaaaagugcaagacuuauacucugaaaacuaugaaacauuguugaaaacaauuaaagaagacccaaauaaauggaaagauaccccaugaucauggaucagagacuuaauauuguuaagauggcaauacuuccugaauugaucugcaaucccuaucacaauccaagaugccuucauuagcggaaauugacaagaugauccuaaaauucacagagaaauguaagggaaccagaacaaccaaaagaaucuuaagaaagaagaacaggcugggugcaguggcucgcaccuguaaucccagcacuuugggaggccaaggcgggcggaucaugaggucaggagaucaagaccauccuggcuaacaucucuacuaaaaauacaaaaaaauuagucgggcgugguggugggcgccuguagucccagcuaguugggaggcuggagaaugacgugaacccgggagucagagcuugcagugagccgagaucgugccacugcacuccagccugggcaacagagcaagacuccgucucaaaaaaaaaaaaaaaaaaaacaacguuggaggacucacacuuccugauuucagaauuuaacugcagugugguacugguguaaggauagacauauagauauauagaucaauggaauagaacugagagcccagaauaaacccucacauuaacaguuaauugauuuucaguaagagcgccaagacaauuuaaugggggaaagaauagucuuuucaacaaguggcgcuaaaacaacuguauaucugcaugcacaggaaugaacuggaccccaccucauaccauauacaaaaauuaauucaaaauggaccaaagaccuaaauguaagaagagcuauaaggagaaaaauaaguguaauucuuugugaccuuagguuaggcaaugauuuuuuagauacgacgccaaagcacaagcaauaaaagaaaaugaacuguacgucaucagaaucaaccuuuguacaucaaagaacacuaucaagaaagggaaaagacaacccacaaagugggagaacauuuuggaaaucaucuauguaacaaggaacuuguaucuagacuaccucaagaacucuuggcuggguacgguggcucacaugggaggauggcuugagguugggaguucaagaccagccugggcaaugucauaagacccugucucugcaaaaaguaaaaaggaaaaaaaaacuagcuacuugggaggcugaagcaggaggauggcuucaggagcccaggaguuugaggcugcagugaacuauggucgugccacugcccuccagccugggcgacagagugagacucugucaaguaaaaucaauaauauuaugggaccaccaucguauaugcauuucaucauugacugcaacaucguguggcacauaccuguagucauaugaugggauauuauuuagccauacaaagaagugaaguacuggcacacaccacaacacggaugaaccuugagagcaauaugcuaagugaaagaagccagacccaaaacccacauaauuuaugauucuguugauaugaaauguccagaauuggcugggcacgguggcucaccccuguaaucccagcacuuugggaggccaaggcagguggaucacuugaggucgggaguucaagaccagccugaccaauauggagaaaccccgucucuacuaaaaauacaaaauuagccgggcaugguggcgcaugccuguaaucccagcuacucaggaggcugaggcaggagaaucgcuugaacccgggaggcagagguuguggugagccaagaucguugccauagcacuccagcccgggcaacaagagcgaaacuccaucuuaaaaaagaaaagaaaagaaauguccagaauaggcaaauccauagagacugagaguagaugagugguugccaagggcugagggagcuaaggggguuggagcaugacagcuaggggauaggaaauguucuaaaagcggauuauggcgguagaugcacauaucugugaauauauuuaaaaagccauugaauugcacuuuauuuguuucuugagacagagucuugcucugucgcccaggcuggaaugcaguggcgcaaucucggcuuacugcgaccuccaccuccuggguucaagcgauucuccugucucagccuccuaaguaucugggauuacaggugccugccaccacgcccagcgaauuuuuguauuuuuaguagagaugggguuuugccauguuggccaggcuggucuuaaacuccugacuucaagugaucugcccaccucagccuuccaaagugcugggauuauaggugugagccacuacacccggccauugaauugcacuuuaugugucucaucuauaugguaugugaauuguaucucaguaaagcuguuaaaaaacaaaacccuggcccugaagggcagcgcagucggcuaaaagacugugauuuaaugaggaaacuuucccaccgggcugugaccgcuggcccuggcucccuuuggccggguggaggugcugucugccacugagggcccucagcugcuuuuucaggaucucagaacaugggaggaccccagcuccagaagaaaaucuuaauuccaguuuaaucuuaauuccaauuuaauuugguugaguuaaacauuuuuggaacuguacugugagcuaggcaccaggcuagcugcucucaugaaaaaacaggggcccuggagcugggcagccuuaauuauucuugaguuugcuacuuccuguggguccuucccagccucaauuuucuuuucaguaaaaugaggguugauaauaccccaugagauuguggugacaauucagugggcuaaaaggaagaugccuggaauauuguaggcagaaaaugaaaguuucuuuccagugcuccuggagcaaguuaucucuaccaaguggacauaacaaagaugaguuaguuaugucugcccccguagagcucaaggcuggauacaugaccuguacucgcuaaccagggccuggggagaagcaggccaggaggagggucccugucuuacucugguccuggguugggaaccggggaaggcuuccucagggagggggcaaugaagugaggcuuugaaggaggauagcuuuucgcauguuguauuuuauucgcuuuuuguuuauuuauuuuuuguaggcaggucucucucugucgcccaggcuggagugcaguggcauaaucucugcuuacugcaaccucugccucccggguuuaagcaauucuccugcuucagccucccgaguaacugggacuacaggugugugccaccacauccagauaauuuauuauauuuuuaguagaaacgggguuuugccauguuggccagacuggugacgaacucuuggccucagguaaucugccugcuucggccucccaaagugcugggauuauaggugugagccacugcaccccgacuuagucacuuuuugaauagauaaucaaguacauggugccaauucaaaagggucaaggcugggcgcgguggcucaugccuguaauuccagcacuuugggacgccuaggcagguggaucaccugaggucaggagcucgagaccagccuggccaacauggugaaaccccaucucuacuaaaaauacaaaaaaaucagccaggcaugguggugcgcgccuguaaucccagcuacucuggaggcugaggcaugagaaucucuugaaucccgggggcagagguugcagugagccgagauugcaccacugcacuccagccugggcgacaagagugagacuccaucucaaaaaacaaacaaacaaacaaacaaaaaacaaaaggaucagcagugaaagagaaaccuuucccagaggcagccacuguuaccagcuccugaagugucauucuagaaauacucuauguuuaugaguguaugugcguauauauaggcggacgcuucucaucuaggcagauuuucacagcauccacauugugguccguggggaucaggggccuccugcuaagguguggguuaggcuucagguguuauguucuugcugcuuucgugucuugcggucagguucggcauaggcccucucaucaguaagagugaggcuucauuuuccuuuaguuccccuugaagggagccagcggcgcuguccauccuccuugccccucugcucccuuggcgugcccucucccagggauuuccucugucuuucuccuuuguuccccgcuccucuuucucguuugcuugcucccuuguuugggugcagcauauugacagcagcuuccuaacaaagaccuuugccuuuucuuguuauuuuacuuucauacaugguugauaguuuagcuggauagagaauuucagguuggggccaggagccauggcucaugccuguaaucccagcacuuugggaggccgaggcagguggaucacuugaggccaggaguucaagaccaucuuggccaacauggugaaaccccaucccuacugaaaauacaaaaauuagcuaggcaugguggcacaugucuguaaucccagcuacucgagaggcugaggcagaggauugcuugaacccaagagguggagguugcagugagcugagauugugccacugcacuccagacuggaugacagagccagacugucuccggaaagaaaaaaaaaagagaauuucagguuggaaacaauuuuuccuugacaaguuugaaggauugcuuugcacuuuucuaacuucugaaacugcuaagaaguccaaaaccuuucugauuucugauacuuuugucuuuuuuuucuuuuuacccuccuuugggaaagcuuacaggaucugaaauuggacacagugccuugguguaggccuguguucaucuguuucgugaggcucucagcaaguccuuccaguguggaaacucauguccuauccugggaguuucuugaaacauuccuuuucuugcccucuguuuuuuacuguucugucuuucugaaacuccuauuauuuaguuuuuggaucucuuggacugacccucuaauuuuuuucccuuuuucaccuauuuuccaucucuuugucucuuuucuucaguuucuagaagauuuccuuuuaucuuucaaccuuucuauugcuuugucuuauuguauuuuuuaauuuccaagagcuuuuuugcuccccaaaugguucuuuaaaaauguguguagcauccuauguuuucacugauguaaucguuucuuauuucugugagaaugugaaugccauguuugucucuaaguuuucuucucccugcauaguugguuuccuccaaauugcuuucucugcucuuuccuuuggucuccauccucuuugaaugaaucugcccagggaccuuugguugcccacucauaauuauuaggagggucuaaaaugcugccugggagcuggagcagguggggguccaguucugaguuuaccaguacaugaucugggcaggcuguuuguuggggaaccucagugucaacaccugggagcucaguuggggaaggggguagcaugcaaagagucacguaaccugccacccccauuuuuggcaagguccccaggcccucaacugugccucgaauuucccaguccagagaccccacacuuuucccuccccagaaaguaaaccucuguucuuccagggcuggagaggggaggucucuggcaugagaugggggagguaggggucuaacugcuauuuuuuuuuuuuuuuuuccugagacggaguuuuaacucuugucacccaggcuggagugcaauggcacaaucucggcucacuucagcuuccgccuccuggguucaagugauucuccugccucagcguccugaguagcugggacuacaggugcaugccaccacgcccaacugauuuuuguauuuuuaguagauacgggguuucaccauguuggccaggcuggucucgaacuccugaccucaggugauccacccgccuuggccucccaaaguguuggcauuacaggugcgagccacugugcccagcccugauugcuuuuugaaagcuuucagccugcccucuuuauacacggcagcccguucagcccauuguggaggugggaggccuggagcugcaguucccuggccuuuggaggauuccugguggauggugggaacccggguguucucagccugcuccagacccaggcugugaggucagcugacgcgagcugcgcuccagcuucugcagucauguugcuguugucuccucuccuguucugcccuuggggguucauagcuuuaaaaauauauauauauuugcugaagucuuagugggauuucauaagggagggagaaaaauuagaugcauaccugagacaggagcaggacuugcaugggcaaaagcugggacgggaaggguguucuaaugguagagggagugcucugagggagaggggcaggugcuaggauuucugagaacaaagaggaggcagcugggcugcagcuggagaauccgggaggcuggggcauggggggacaaggcuggacaggcagggugcacuaauuuugggggagguccccaaggagacuugaguuucccaccuacagacaguggggagucagagaauuaccccacuuuucaggaagagugccgucaugccuguauuuggggaugcuagcuaucccuaguaccuaauguggauugguagcuagagcugugguaaugaguaggagguuuuuacgauaguuaaguaguaagaagaggacauuucaggguccucuucuuagaaaugaaaagagggaaggaugugagggauuaaagagguaaaacugcccagacuucuugaccagaugguaggugagggaggggaagagcuaaagaagacccuaagcuuaacccuuggugaccagggagaggguggugaggaaggaaggaggaggugucugguuggguuugguguaugugugcaguuugggagggggagugaggggguagggggcgggggcuaaguucugcuauagaauaggcauuugccauguccaccaaaaagcgugauuuuacacccccacgcuucaaccuccaagugccuguguugauggagagagagaaagaagguguugagagcagggguaaagaaaucagucccuuagaagacaaaagaauaauuuuccaguuguuaaaugagauucucaaaagaauuuuuauguugauauccucaaagauuaauucauguugcagaaugucauuggaacuaccuuaagacauugauagagugccugucugcugucuuccuuagcucauccucauguuuugaucaaauuaaguacuuggacaccaggucuguaaaaaagaaaagagccuucuuuauuuggguucuguaggcaaaagggagaguggagaagcgacucugucuacgcugcuccccucacuccccgucucugggcccuucugggauuugcaugccacccacugcucugucaggaguggcucuuagggaagugaggaaagggccuugauuauaguguuugccaauuucuguggcauaaauaugcccacuguggcccgugucaggcuaccaacgugaugucauagcacagagcuggagucaggcaagcccgugggagugagucgugcccuggggucacaguggggguccucacugacacggugcagcuggacagcagaaucucaucuuucaggucgucugacuuguucuaagggucugucaggguugaaucaugcuugccaaguagcaucuuaaaagauauuuccacugcagcagccccagcccuucaaccugggcuucuguggccuucuaauucuuccuucucugccuccccuccacccacccccacaucaucagcagcagauccaacaugaauaccaaacacucacaguuaauacuaaaagccaacaauuuuuuuuuuuuugagauggagucuugcucugucacccaggcuagaaugcaguggcgccaucuuggcucacugcaaccuccacguccuggguucaagcgauucuccugccucagccucccgaguagcugggaagcugggauuauaggcgcccgccaccgugccuggcuaauuuuuuuguauuuuuaguagagacgggguuucaccaucuuggccaggcuggucuugaacuccugaccucaugauccacccaccuuggccucccaaagugcugggacuacaggcgugagccaccgcgcccggcgacauuuuucuuaaaguucaaucucucaucucugaugcagcucgcacucauuauugccauccuuggagcagcuguggcaaacgaguagcuuggaugucaguaggaagucuugucucuacaggcugaccugccuggacuguugcuuugcccuuuugguugugcguucuggaacgugaugccugugcuugucagccuugaugagucacauugaaaaagcucuuagucaucccaggcccuggcugagucaguguauugggugacaccuguggccaagcacuggcuguuuuacaacugagacugucccagaacucuuaggcacucuggucucaggggaaguguucuucaucuaguucaaggccagucuuucacccgagccucgcagccuuguucccggacucgccccaccuuuuauucucauccuuccuucuucaacuugucauucccucucaacuccuuccccuuccucuuccuauaacuugcuaaacauccucccaagcgucugccauggguauaacagagaauggauucaugccuagaauacauaaagauuuauuacagcucaguaagaaaaagacaaccagcccagcagaaaagugggcaaaugaugugaacaggcaguucacaaaaggaaaaaccuaaaaauauauccacaaucauaagaaaauagccaacuucaguaauaaucaggggacugaaaauuaaaaugauaccauuuuauacuacaagguugacagaaaucaaagucuaacaauauaacaguugguaaagauguggggagauagacauucuguuguauuucuaguggcuguguaaauuauuaggauaacuaccuugagacuuauuuggcaauauugauauuaaaaacuugccuauuggcugggugcgguggcucacgccuguaaucccagcacuuugggaggcugagguggguggaucaccugaggucaggaguucacgaccagccugaccaacguggugaaacccgucucuacuaaaaauacaaaauuagucgggcaugguggugcauuccuguaaucccagcuacucgggaggcugaggcuggagaaucgcucgaacccgggaggcggagguuguggugagcugagaucgcgccauuguacuccagccugggcaacaagagcaaaacucugucucaaaaaaacaaaacaaaacaaaacaaacaaaaaacaaaaaaacuugccuauuaggugggcacaguggcucaugccuguaaucccagcacuuugggaggccaaggugggcagaucaccugaggucaggagguaaagaccagccuggccaacauggugaaacccugucucuacuaaaaauacaaaaaaaauuaguugggcauguuggcgcacaucuguaaucccagcuacucaggaggcugagccaggagaaucacuugaaccugggaggcggaaguugcagugagccgagaucgcgccacugcacucaagcuugggcgacagagcgagacucugaaaacaaaaacaaaaacaaaaaaaaaccccaugccuauugucugacgcagcaauuccaauucuagguauauguccuagagaaauuuuugcacauuuucuauauggggucaaaguuauucauuuuuuaacacuuuuaaucgacuacuuuuauauagacacaaaaauagagcaaauaguauaaugaacucuauguaccugucgcccagcuucaacaaugaucauuuugucagccuauacaacacaguucuuaauugcuaaaaauuggaaacaaccgcggcgggggagguggcucaugccuguaaucccagcgcuuugggaggcugagguggguggaucgccugagguugggaguggaguucgagaucagccugaccaacauggagaaaacccaucucuccuaaaaauacaaaauuagccgggcaugguggcacaugccuguagucccagcuacucgggaggcugaggcaggagaaucgcuugaaccugggaggcagagguugcacugagccaagaucacgccauugcacuccagccugggugauagagugagacuccaucucaaaaaaaaaaaaaaaaagaugaaacugccuuauuuauuuauuuauuuuuugagauggagucucgcucugucacuccagcccaggcaacaagagugaaacuccaucucaaaaaaaaaaaaaaaaaugggaaacaaucuauuugucacugccuuagucugggcugcuauaacacaauaccauagguucauuaaacagcagaaaugcauuucucacaguccuaaagaccagaaagugcaagaucaagugucagcagauucagcgucuggugagggcccacugcccgguucauagaucacuguguucucacggacaaaggggaaacagaguugucugaucucuucugugaggcuucuaaucccauucaggaaggcucugcuaccagccgcuaaucuucuccccgaggccccaccuucugacacugccacauugguuaggguuucagcauaggaauuugguguggacacaaacauucaggcaauagcagucccucauucggcauguacagauugcgauaugucuaauagaacauugugcagucauucgugaaguaggucuacuguauuaacauggagagauuucaaauauauauuggguaaaacaaguuaaaaugauuauaucauuuaugaaaaaaauuagaacauaugguuaugggcacacaaauauccaggugaaaucaacaaaggggaaguaguaacucugcauugugggcccccugggagaaaaggagaaaaggacccggaaugguauuaggaagaaucacaaaggaacugcaccuguuugcagagugugguuuuuuuucccuuuugguaaguuuaacuuuuauuuuaucaaaauaauacaugugagacugggcacauuagcucaugcuuguaauccuagcacuuugggaggccaaggcaggcggaucacuugaggucaggaguuggagaccagccuggccaacauagugaaacccccaucucuacuaaaaauacaaaaauauuagcugggcgugguggcgggugccuguaaucccagcuacucgggaggcugaggugggagaauugccugaaccugggaggcggagauugcagugagccgagaucaugccacuacacuccagccugggugacagagugagacgcucucaaauaauaauaauaauacauguggacacuucugaaagucagauuguacccugaggcucauuugcccccgccaccccugucccacugcccuccccaugagugccucccagaggcugcccugcaacuccuguuccccacggcauugcucuguuuaguggucuccuuugauggaagauugagcucacuuuuacugcccuccccaucucaaacccugccccacacauguacccacuuucccucccuucacccugcaugguuauauagaaacacuuuuaaguacauuuucagaauuuacauuuuuguuuuguuuuguuuuuugagauggagucucacucugucacccaggcuggggugcggugucgcgaucucggcucacagcaaccuccgccuccuggguucaagcgauucuccugccucagcguccugaguagcugggauuacaggcaugcaccaccacgcccggcuaauuuuuguauuuuuaguagagacgggguuucaccauguuggucaggguggucucgaacuccugaccuugugauuugcccgccugggccucccagagugcugggauuacaggugugagccacugcacccagccaagauuuuacauuguuaacauuaaguuaauauucacaucugaaaauacagagugucuacuaugguggcauuaacuuuucauuuuccuggaguugauguucauccccagacaaguugugcguugccaucuccucuucauucuuucggagacaccagguaaucugccuuuuuguuuguuuauuuaaggccacauccccaggagcugcuguccaggugccuggcgggucuccaggccuguggacagcgagcgaccugggccucccuccccaucgccgugggaguucccuuugccuccucugugcuggcugcccaggugccuggaucccuugucuuccuuauucuugguuuauuuaguccuuuguuuuguucgugcccaucccugggcuucuugggcagacaggcucacagguggcacaccucccaaggccuggcgugucucaaaagauugguauuuuacccccacuggauuaguagucuaacuggauagaggacuccagcuugggaagcguuuucccuccaaaauuggaggacauuacuccagaagcuucugacuccaugucacugcugaagacaguugugugugacccuuggucuucagaagugugguaggcuggagauggccuccaaagguacccagguccuaauccuaguuguuaccuuagaaggaagaagggcuuuuucagaugugaugaaggauucugaccuggaaaggugaucccggaucauccaggugggccccgaaugccaucacaaguguccuuagaggacagagaccuaugcugaggagaaggcgauguggagacagagccagaggugggagugauguggccacgagcaaaggagcccggcagccauagaggcuggaaaagacucgggagggauucguugcaggcccucggaggggcgcagcccugcccucacuugguuucggccugugaaagugauguuggauuuuugaccucccaaacugaaagagagugggaggucucuuuuggcaucccaaacugaucuuucuucugagugggacuuuuggcaucacuccaggcgcuccaagaccuuuccacauggauacgcguccuucagucccgggagacuuuccagcaggauuccccugccccuggcucucucgucuccccuuccgggagucccaggcagcuggaugcuggacuugcuggacugagucucuuauuuucuuaucuuuucuccuauuuuccauauguuagucuuucuggguaaugucccaaacuaucuucuaauucucuauuuauuauguuuaaaaauuuugcaacucuauuuuuaauuuccuagagcucuuucuuguugccuuuuuaaaauagcugccgccucuuacuuaauggaugcaauagcuuuucuuguuucucugaggagauaaauuauaguuuuucugaguaucuguucucuauauuacuuuucuccucaauguuccuguuuuuuaaaaaucccaauuuguuuuggugaauuuuuuggucauuuccucaaauaucugguggugguucgcugaccguucacacugaaaaaugagacaccaacacccauuggcaagucuggguugggguggagcuugguggccccugguccucucgcugggagaugagacugggcucccuggggagcccacugcauaccaguagcugcaggacuccugguuccuggaacggaagcuuccaguucgcugccuggaaaagagcccaguaagcacucuguggagccgagaggaccuuccacacauuccccaacagccaugugaugccucaccuccugggccagcccugauggccggggcuggagccuuguaucuugggaaagacgcuguggcacaguggucaaaggcaggacccuagguucugaagccaggggcgugcaccguggcacugacacauccuagcagcgugccuuccugccuucgucucuggagcgggcugggaugacucccaggucucugcagcucagaacucuuuacacaggagacucacugucuagcugucuguucuuuccagccggauacucuucagguucaaagcugagucacuguuucuacccacauuggcuucgcguucuuuaauuugguguugccaucguucaccuuaaaacccagggccacccuucccugcugccucucugccucccaucuaaugggugcuguugaugccaccuccuaaguauuucuuggcacagucccucuucauuccuauucccaccaccgugguucagguccucauugucucuugcccacauuagaacaucuuccuagcugaccuucuacuucucaucuuuccuucucaaauccagcuuccccagagcugccacagugguccugagcucucaguugcaaaucugucucccugcugccugguauuuccauagcaucccgacauagaggacacugcccaagcugcugguggggcccacuagcucuggacugagucucaggcucagcccuuaggcuccucucccugccugcacucccugccucagcgggccacgccaggcuguuugcuuccugccuuaucugccuuugcuccagccgccccagcaccuggaccuccuccccuccucugccugccccccucccuccccucuucucccucuggacgucccuuccuccucccacccuggagucuuuccuucaggccaucuugcuaacucugcccugcucuccacgcaggcguggcccgccucaucauccuucacuucucaucucugcugccucucacucagccugccccagccagcugaucacagucccaaauagcgacaugcucugaaagccaccgcuguggccugcaucaggaugugcggaugagagggggguauuuuuaccaucauugugcuucuccagccccugguguuaggaucuguauaggaucugguuauuuguaggcaaccuggguguauuagauuccuacagcugccaucacagggugccaaaagcugggugaaaacaacggugacuucuugccucacaucuggaggccagaaaccccaauucaaggugugagcagggccgugcucucucggauggcucugggaggguccugccuggccacugccagcuucugguguuugccagcaguccuuggccuugccugacuuguagcugccucacuccagucauguggccgucaucuccugugucuucacaucuucauucugugugugucuguguccagauuucccccuuuuuauaaggacacuaagcauauuggauuagggccacccuaaugacuuuauuuuuacuugauuacccuauuuccaaauaaggucacuuuuuuuuuuuuuuuuuuuuagacagagucucacuguugcccaggcuggagugcaauggcgccaucucggcucacugcaaccucugccucccggguucaagcaaauucuccugucucagcuucccgaguagcugggauuauaggcagccaccaccacaccuggcuaauuuuuuguauuuuuugguagagauggguuucgccuuguuggccaggcuagucuugaacuccugaccucaggugaucagcccacuucagccuccgaaagugcugggauuacaggcgugagccaucgcgccuggcccaaauaaggucacauucugaccuaggugcuagggguuaggacuucaguguaucuuuuuuggugggggacacaauucaaccucuaacaccgggugacacccgcuuguccugagcuugacaggucccgaaguccccaaggccucugggaggcccucucuaauccagccagcauucauguccugucaucuuggaacgaggggaauugaguggggagcagguccugugaagcucuccagcaggggugggguggccugaagagggucgggaaauguccugggccaccugcaagugucugcuggguccuggcaucuuccucccugcaaagauuguccaguucuguuuagaauugagucuuuggugccccuagccucugucgccccucgcagcccugaaacucagcuucccugguucccauugccaggcugcgucugaguccuuuugggcuuuagugacaaaauaccacaggcuggguggcuuuuaaacaacagacauuuauuucucacaguuauggaggcuggaaguccaagaucaagguuucaacauauggguguggggggcacaggcacgcucugcauuagucugggaggugcuuuuugcugaccuuguccuucagacccucucucuguccugucaacaucacuuugggcucuaaucaauauguaugggacauuugugugucccacuagugugugugugcuguucccaggaggggccaagccuuacuaaucuuuaucugaaugcuccauaauauuucuagguaaaucuuuuuuuuuaacuaauugauuaauuauuuuuugagacagagucuugcucuguugcccaggcuggagugcacugggaccaucauggcucacugcagcuucaaccuucuagguucaagcaauccuucugccucaggcuuccaagcagcugagacuaucuaugggcaccaccaugcccagcuaauuuuuuuuuuuuuuuuuugagauggaguuuugcucuuguugcccaggcuggagugcaauagcacgaucucagcccaccgcaaccucugccucccacguucaagcgauuuuccugccucagccucccaaguagcugggauuacaggcgugugccaccaugcccggcuaauuuuguauuuuuaguagagaugggguuucugcauguuggucaggcuggucuugaacucccaaccuuaggugauccacccgcuucagccucccaaagugcugggauuacaagugugagccacgugccaggccacacccagcuaauuuuaaaaaguuuuuuuuuuaauuuuuuggcagagacaggaucucaauauguugcccaagcugaucucaaacuccuagacucaagugauaccccugccucggccucuuaaagugcugagauuacaagcaugagccaccacgccucacggugaaucuuaacagccucaugccacucugcaaccucauugugaccugaaguauuucuucacugauucauucccucagacauuuauuuaguucuggucuuacgcacuguacagagugccagggagauguggggacaaaagagaccagggauccugugcccagggcccuaacagugucuauuaaaggagacaagacgggucaacaaaucuuuauaacauuaaaugcucuuugcugaggacacagacgccacggagaccucauggagagcccccugagcaggacgauggguggggcacagacaaggacagagcugagggagguggcugcccggggaauauagggaaggcauuccugagccuacuccuauaggauguggaggaauggggacaagugaccuucccaugugagcccugcccacaccccgugcugcagggucggcaggaagcuggcuccucgugcgccagggggcaguguuggcccugaaauucucacugcuuuccagugaggcugggauggagcagccaccucacugcaggcccucgggaccccucacucugcuuucucugagacccccuuugucccccaguccacaagucccgagaccauggcgccagucgccucggugccacccuuucccccucggcugcuccuuugaauagaggguugccagggcgaugaggagcccugcuggcacuguucacugcuguucgucgccgcagugccacuuggagcagccggcgcuccugggggcccagagcccggacagcugagccucggcgagcacccgugcugugucuguuuccgucuuugguauugucucucuccugucuucugugucugucaccugcauuguuuccagcguccucccuucugcccccccugcccagaaaucucagccucagucuguccucucuugggugcuuugauaucagccguggcagcccugagagccagguggagucguucuuucaucugucccucuuggcugccagcccuggggcccgucggacauguuuagagcagagccgccuggggagagcggccccauccgucagagcugccaccgccgcagccccgagugcucugccaagagcucuuucuuucugguucugaccugcuuucacuggcagcuguggagcccagcuggggcuaggggcacagccuggugcgggugcuggugcugggggcagcugggcccauaggaaguagguguguggagcuuuguugguucggagguuccuggggccuguuucugaaccacacuucuuucuucucugcccucugcugcucuccagcacaccucugaggauuugcugagggacccaggugcucugcugggcuuucagaaccaacuugcuggccacccgccccugaagcagggccuggucuuucccuuccucugcggccucuugcccacugcugcccucugaggcugcaggagacgcucugugaggacaggaauauguaggacgaagcgauguggggccucagcugcagcagcucuuagguggcgcccugcccugguccccagaaaggcugcugagcacuggggccacguuguugucuggaacaaaacuugggggaugauggccugacagcaggauucugugcuccuucugguugcaagaggcauccugggagauguaguucaggucugaaguagugggauuucagggacauuuugaugauuuauuagacaaauugaaacugccuuggcuuaucugggacaugugacugcugacauuguucgucagcucucguugggaagcucugagugccacugguggcccugcuggaggccaggccagugacaguuuuaucagaagugggguuuuugguuuugguauuuugguuuccaagugccugucacacugugcuccugaugaaagccgugacuuacuccuuuaguugagugaagaguccauaggccaacucugauggguccgagcuccugcucuggagggggccauaugaagcgggcuccaggccggcucugcugguggccugggugugucacuuaaucccacugcaccuggucccuuaccuguacagggaggugaugaggggcugugaggguuacugagugagucugcgugaagagccacaguggccccugccuggcaaggagcaaggcucugcuggggucacugcccaccauugugcccuccuccacuggcacuggccgggcaccagguggagcucagugaguauguguugugugcuauggaagcggcagcucugucaggagcggggcaggugacggccaggcccucgcccugccucagccugcaggucgucguaggugccuuccugacucccuucuggaaggggaaugcugaguuauugaucugaagcugaagcugggagggaaauggaagcuguggagucacccgagaggcagcaggggaggaagcaggugccccacacacuacuggcuucacuguggcucauucuugcuugcaaggaguuauuuacacgucccaagugacagucaaagcugucuuauuucuuggucucuuaugcacaacccgaggccaagaaaagggaucugucagcuggcauuugcagaaaauagcaagugggucucugggcugucagcucucuggagaggaaaacagggugaaggaucuuugggugauggugguugcuuuucucucacucacucacuacuguuuccccauuucugaggucagaaagggagagcuuugcuuguguguaucaccaggagcaagcaagacaguggcaucccccgaggcguguaacuguaaccugagcugguugcuggcccuggcagcaucccagaaugcccuucacaccuggggcucuagcagccucccuugaagaguugcggcucagcucgagggagcaggaaacggcucuguggguucuguuaguaaagcccucugcauuuccagggaagcuucucagccaaacuugacaaccuugagaacuucuugauugccauccaccaaccaaauacccaaaagcagggugcagcaugggacugcagcaugggacugcagcaugggaccgcagagggagccuggccccagccauugcugcccccugcuuccugugccuggccaucgccuauucugugccgugcugugaagauggcaggaagugccuggaauggugccagccagaagggcugcagacugguggcacuugcugggaaugugccauugugaguugaaaggcuggcauacuccagugucugggcuugguuucguacagccugaggaccgggagugucauuaauaccagaggcaaggcuucugggggucucaggaaggccgucucccacccucugcugccacuuccgagggucaccauaggugccuccagcugcagggguuccuucuucuauaccccaagugcugugcagaggccccugcucccuucggcuuuggggaauggucuaguauuggggagcagggggagucugcccacccagcuccucccuuugaaccaucccagaccccucaagcucagcauacccagagucggcuuauuccaccauaaccuugaagacccugcuuccuggagagaggguggugugagggggccacgcccaucuuacagugcgguuucucccagccgauguugauucuggaaaggccuggguuucagaucugggaaggcagugccauucgauaaggaaaaacuggguuaaccaaguucuaggaagggugcaggcgcccugggaaugcagugguguuucaguucaucuuuaugucuguugggccccauccgugccuggcauugugugcgggucagggagagacagguugguggugggggucuugugugaccacagcggugagcuuaguuucagggccauaacuagguucuaaggagcagugcagcccucacccuccgucauucacagcagcuccugacagccuuccccagccccacacugccugcuggccaacauuuccgugucuuccgccucacucggcagcacaucccaaauccaucacagaaaccugcccucccgucucugacugccuccugucucagaccaccucccucaucaucuugccaggucccuagggggccgagggagcaggcugugggcuguggaucagcuacucucugcgugacccaaccucccgccucccugcagccagcggcccaugccagcuucuaggccucagguucacagccucuaggcucacugcugccccuuccccugauugcagcccaggccuccagcagccuuguguuggggaacuuuguauucugggccaguaaccucaggcagaagagcagcugucuguggcuccucagacacccuccucugugcacugaaggccgguacagggugagugcucugggacaggugccccccucucugcaacaccugacacucccaacuacuuuuguuuggggugggucuuccuuugcagaggaauguuggggacagguuucugcauuggcaaaagcacgugguguccucgggccuguguguuugcuccaaguguaugugggcaucacaccugcuggcuccccuaugcagugaacucugcuaagcauugggugcauggucagccuggcuuggugggugggcugccugugcugccuucaccccaggacggccuggccuguggggaggucagcauggagcugcaucauggugcgagugggagggcgcaagugugugggccuuccagcuguguggggccgggggcuuccucccuggcccucuguucaucugggaggggagggaguugggaagauagugacagcagcugauguuugucacccaggcauggcgcuuuagcuguacugucucagucgacccccaggaugaccugcuuagggugggcugguggaaccccguuuuacagaugugaaagcuggggccucagaggugcccaaaccauggagcuggggcagcccccggccaguggacugugggccugcgcugggcugugccccagaggaggcuacucucuguuccacuuuucccugcucugacuucagccgaagagcccugaucuuuucccuuccauaaacaucugccuggcaugcugccacccaaagagcucccgugccccggggacaguccucuuggccucaagucuaggccugcuuucgcuucccucugagggacacaaggacucacggaggcauuccugugccccccgcugcccacagccuccggcucuugguggagugggacugcuaaggaauccuuuacccaccaagaaaaaaugaggauccaaugcaagaauguaugugagaggggccgccgagggggcggcaacaugucagcacuccaucauuuuccugccugagcuaagcagacacuugguggccacgcuguggggcagggugcagccuuccagaggcucuggaggugaccggccuuuggcauaucuucugaggaaaucucuuucuuugcauggaaaaggcaguggggagugagugugguguggacaggggaggagagcaacaaaaaugaccuguuuacccacaaaccacggguaagugccccuguggucgcaggguaaacccacccaggugggaggaaaggacuggggcucccuggaaaaagcuugaaacugcccuggagguuugagaaucucggugccagugggcugcugccagcugugaggcugcucaccuauaggcaggccagcaggugaggagggggagggugcuaggcuccugggagacacauagccaaguccucccacccaaggagucgguguagcaggagcucccuucgccuuuuccugcggagcucuuccugucccuucuguauauuucuucuuuuuuuucuaauuauaaauaacgcauccccaauggagaaaauauggaaauuuuccauauggaaauauagaaaagcauaaagaaggaggaaaacacaacucuacagcaauuccauagcacgugggagugaggaggguggcaugcaagcaguccuacaguuguugccauuccuuuaaaaaaacuucaugagaucauguuguuuaccauuaaauuuucuuggcuucacauuacaucacaagcauuucccaugucaucaaaaccugugcaaacacauuauuguuaaugguuacauaaugucugugggagccaggguguggaaucuuuaaauugcuucucaugauuuucuguuguaaauaaugcugcuuugaacaucuuucugcguacaucuugguucccauuuuggaauauuuccugggguuggauuucuggaauaguaaugacugggcucaggggcauaacccgccaccaugccuagcuaauuuuuuuguauuuuuuaguagagaugggguuucaccguguuagccaggauggucuccaucuccugaccucgugaugcacccgcccuggccucccaaaguguugggauuacaggcgucagccacugugcccggcuuuuuuuguuuuguuuuguuuuugagauggagucucgcucuaucacccaggcuggaaugcaauggcgcgaucucggcucacugcaacuuccgccucacaggcucaagcaacucuccugccucagccucccgaguagcugggacuauaggcgcccacuaucaugcugggcuaauuuuuguacuuuuaguagagacggggauucaccauguuggccagggugguuuugaauucgugaccucaaaugauccgccugucucagcgucccaaagugcugggauuacaggcgugagccaccgcgccuggccgggcauaaauaccuuaaaggcucuugauaaguuuugcaaacagcuucccggagaagcugccgugaugcucagcagugccugcgggccgccuccugaaggccuuccuggcgcucagcacugcauuuacaaagcucccaggcaggaguggcaccucaugguuguauuuugaaucucuugcuuucucguggguucaagagccacuuguguuugcugucuuguugcugugcuugucccgaaggcuccccucgccucuuccugacuuugcccuaugugguaacuugagcucuuuugacauggccuuucccagcgcucagcagaguagacauuuggugcccaggaggagggugagauuuacaccccacaccugcucucugaugccagugccgccugcucccagcugggaaagaccuguccuccuagugggcagcauccgauaacucgccuggagcagggcuuagaggauuguagaucugcaugugggagauagcagggugauaacgucugacguucauccugcucugagcagggugucuccacaccugagcuccucgcuggugcucccggcaccucuugagcagcaggugcuggggcaugcacucccuaagguuaucuccuccagcggcauuagcgguggguaugguucuuuucacuugucaauuugaaaugauuucagacuuucaguaaaguugcaagaguaagacaaagaauucucguaccccugaccccaguucccccaauacuagcauuugcuucauuguucccguuuuucccugaaccaugugaguggguguaaauugcagauguggugcucguggacccuugaguuccucaguguuuuucccuaagaaugaggcuguucucuaacauaaccacaguccacugaucaagaucaggaaauugauaucaacgcaauccucuuucaaaccugcagaccuuauuuaaauuguaucguuguccccugauguccucuuagcaauagaaacccggauccaauccaggaucguguguggcucucaccauuguugcuuuggucuccuuucaucugaaaccguucuugcgucuuugucucucacgaccuuugacauguuugaagaguccaagccaguuauucuguggaauuucccugaauuugaguuugccccuugcuuucuccugauuaaauucaggccgugcacggcagcgggaaccccaucaggaggugugugguaucccuucggugcuagugauauuaaccuucaucucucggucagcgugguguccgccagguuucuccacugugcaaugaauaaggacaagguauauuuuagaaagaggaggagcccagaguccagcaagguuacucuacccacguucaccauagccgggugugaccugggugccuccuggucaccgcaguggccccuucccagcccccaucuuacccugccucugggagucaugcucugcccaacucgcgccccauccuccugagagccgcucgcuucugcccagcgacccgugcgucccucccuccuccaggcauccccccugggcuccuucuuggcucuuccuccucggccagacucaacuccagugggccugaagacgcaggccugacccacuucucccaggcuguucucucccuggcuucagacaccaccgccccugugaugcugcccagguucuugucccugcucuucccccucugugagcuugccucacucccagcccugccuuuucugucuugcccuucuuauagcaggaaaagucaucuccacccacccauacaggauuucuuccucuaccuugcuuucuauggggggucucucgacgaaucuugucugucauagcccagauguuuccuaagccccaccccgacccccauagcuucccccugucagaggcuccgcgucucucagcucagccucugaauugccccagacaugcgucgucugucagccccugcugcucgccaguccagagagauccuuuccacugugcaucgaucaugucccuccuguccuguccauggcugaagggaggccucaaccacugggcccugucuguggcugcagccccaccucaggccgugggcucacacuucccucucucaggacagcaccaagccuguucuuccugagaacuucacaauugcuaucccuucuuccuggagcuuucucugcggaucugugcguggccgacuucuccccauccaggucccagcuucuguguccccuccucagagaggccuuuucuaauauccagcccccaaaccccugcacccgccccagaucauucgcaaaaugucaccuguuucuuaucuuccaggcacuugugaucugaaauguucugauuugugucuuguuuuucuuuucuuugcuccuuucacugccauucaucuuccaugagcagaacccuucacuguuguguucucgacuccuaaggcuuagaacugugccuggcauaaggucugccccuagugggguuuucuguuuuucuccccuggcugugggucuuuccuccuccuccucuucucuuucuucuacuuauuuccuuguuucuucucuuuucuuuuucuucugucuuuauuuccccuuuucuagguuguuggcuguaauauggcacuaagguuuuugcaauauuuguuucauuucuugaguauguuuuuauguuccuuacuuaaaacaaaauggcugagucaaguguuuuaaacguuuucuaagaaaugaaucagaucggccgggugugguggcucacaccuguaaugcuagcacuuugugaggccgaggcggguagaccacuugaggucaggaguucaagaccagccuggccaacauggugaaaccccaucuuuauuuaaaauacagccaggcguggugguucacaccuguaaucccagcacuuugggaggccaaggcagguggaucgccugaggucaggaggucgaggccagccuggccaagauggugaaacccugucucuacuaaaaauacaaaaauuagcugggcgugguggcgggugccuguaauuccagcuacucgggaggcugaggcaggagaaucacucgaacccaggaggcggagguugcagugagccgagaucgcaccauugcgcuccagccugggugacagagcaagacucugucucaaaaaaaaaaagaaaaaagaaaagaaacaaaacaaaaacaaaauuagccaggcaugguggugcaugccuauaaucccagcuacuugggaggcugaggcaggagaauugccugaaccugggaggcagagguuacagugagcagagaucaugccauugcacuccagccugggcaacaagagcgagacuccgucucaaaagaaagaaaugaaucagaugguuagaugaggcccagaugcaggggugaaaagagugugucugguuuggcuugggcucugugcugggcagcugucuuuuuagucuccacuguaccuugguuuccuucauuuuacaaaugaagggcuggccaaccucugaagccucuuugcauucagggauauaaguugucgucaguugauuuaaauauauauauaauauuauauaauauuauaauauuauauauaauauauauuauaauauauaauauaauauauaauauuauauaauauauauaauauuauauauuauauuauauauaauauauauuuuauauauaauauaauauauaauauauauaauauauuauauauauuuauauuauauuauauauaauauuuuauauuuuauauauaauauauuauauauaauauauauauauuuuuuaaagauggagucuugcugugucacccagacugguacaguggugccaucucagcucacugcaaccuccaccucccaggcucaagugauucucaugccucacccucccaaguagcugggauuacaggcaugugccaccaugccuggcuaaguuuuauauuuucuguagagacaggguuucaccauguugcccagguggguuucaaacucuugagcucacacaaaugugccuuggccucccaaagugcuggguuuacaggugugagccaccgugcccaaccugaaguauuauacuuuuuuuuuuuccugggacagagucuugaugucacccaggcugagggcaguggcgcaaucucagcucacugcaaccucugucuucuagguucaagcgauucucgugccucagccuccugaguagcuagaauuacaggcgugugccaccaugcccggcuaauuuuuauauuuuuaguaagaggcgggguuucaccauguuggccaggcuggucucgaacuccugauguaaggugcuccucccacuucagccucccaaagugcugggauuacaggcaugagccaccgcgcccaaccugauacuuuuauuuuuuuugagacggagucuugcccugucgcccaggcuggaguacaguggcacgaucucggcucgcugcaagcucugccuccuggguucaugccauucuccugccucagccucccaaguagcugggacuacagaugcccgccaccacgcccggcuaauuuuuuuuuuuuuguauuuuuaguagagacgggguuucaccguguuagccagggugggccaaccugauacuuuuaaaaguuauagugcauauuaugcuggguacggcagcucacaccuguagucuuaacuacucaggaggcugaggugggaggaucauuugcgaccagccuaggcaacauagggagacccugucucuacaacaauaaagucacaguuaggauaucaggcugagcuggggguuccauuugggguuggauuugcucccuucucuagagccaggaaauguugggcuuggccaggcaucaggagguagauggugcuagccuuucuguggggccacugugggguugggaagggcccucacucauucugaggagccucagugcugaggcugcgcuaaccugggcucuaacuucccucccuagaugcugaaguuccgaacaguccaugggggccugaggcuccugggaauccgccgaaccuccaccgcccccgcugccuccccaaauguccggcgccuggaguauaagcccaucaagaaagucaugguggccaacagaggugagcaccaguggggccggugagaggagccucauggccgccccagccuuggcauucuucucccacucacugccccaggcccuggcuucccacuccccuuucugcuucuccuaggaccuaggaaucuaacuucuuguuucuuugcccucuaggugagauugccauccguguguuccgggccugcacggagcugggcauccgcaccguagccaucuacucugagcaggacacgggccagaugcaccggcagaaagcagaugaagccuaucucaucggccgcggccuggcccccgugcaggccuaccugcacaucccagacaucaucaagguggccaaggugagcccaguggccuggcugggccuggacagcagggaccagggagucuuaguugccgcgggggucucuugaggcuggcgugcucagcgccucugugcguggguggguaaacggaugcagcucagcagguuaggcaggggaagaggcuggccgaggccuuggaagggacugcaagguaccguccucucccugacccccaccugcaggagaacaacguagaugcagugcacccuggcuacggguuccucucugagcgagcggacuucgcccaggccugccaggaugcagggguccgguuuauugggccaagcccagaagugguccgcaagaugggagacaagguggaggcccgggccaucgccauugcugcgggugaauauaacgggcaagcaagggguggccccgcagcuccuggagaggguccagcagggagggguggcagggauucccgccuguuacagagacucccccacaccuuucucccaacagguguucccguugucccuggcacagaugcccccaucacgucccugcaugaggcccacgaguucuccaacaccuacggcuuccccaucaucuucaaggcggccuauggggguggagggcguggcaugaggguggugcacagcuacgaggugagugaagaugcccagggcugggagcagggcagggcagccugccgugggggcaggggcggaccacucaagggaucuggaaagugggugggguucauggcaggggagagguagcgcuguggggucugaggucuggcuggccccugcccgcccucgcaggagcuggaggagaauuacacccgggccuacucagaggcucuggccgccuuugggaauggggcgcuguuuguggagaaguucaucgagaagccacggcacaucgaggugcagaucuugggugagugguccugacgccccgccuggggcagcuggaggcgggagcugagaggcccaguccuggugccgucacaguggcuggccuuggggacagcccuggggccugucgggcgcuuuuccagaggacucuggaaagugggcucuaggggccgagcuggcaguugguccucacagccuuggugaugcuggugucucuccuggcagccucuguaccgcuggcagccggcacugacuggcgacagugguuaugugggggugauggggcauuuaggaggcguguagauuccaguaaaagcuaagcccaguuuaccucccuccccaggggaccaguaugggaacauccugcaccuguacgagcgagacugcuccauccagcggcggcaccagaagguggucgagauugcccccgccgcccaccuggacccgcagcuucggacucggcucaccagcgacucugugaaacucgcuaaacaggugaagggugggcuucccguguugggacaggagccugugcucacaggccggcaggccucacaguggggcgcugguuggggaaggggacccugaguccccuucuggggacuggggauggggagaagagggugaaggacucuccugggggccagaaguggguuuguggcauccuucccaugugcaguugaggcaccuggcccagaggccaagcuuagaguccaggauggcugagaagagggagggaaggagccccagccgccuccucagcccugcugcuacacagaccuggcuucucuguggcaucagcucaucccugucaucaggagaaugagauuccguggauucugucaagauugaggaccauuaugaaggcaguccucccucaugugcuucugucuccuacaucauguuuauuaugaucuguuuccuugcucugcacccucugcccaucucugcuuuucugggaccucuggucgggggguccugggcuguggaggaggcugagguggcaagcuaucuccccacagugaccugccccaggacuggccuggagagcaccugcuguggccaggugugcagcgggguccugcccccucuucuucccuggccuauaggcagcagaggaugcgucaccuccccaugccgaaggccggggugugcacucugcagcaaggccucagccacagcuaaugcgaggcaucgaccagggucgcguuuaagucaggucuuauuuacuggcuuauacuauuucacauuccagaacagguuuaagggaggugauucagucugguuuaucguuuuggugagaccaaaagugaaacuggaauuagggcugaaauuugaguuagagucauuaucuguugguaccucucaaaugaauuucuuuggguggugguggccagaggugacugcgcaguagacuagaaggggacuuucugaaaacaccuccaagcagaagcagcggcugggagaggccugggucuccgugucuggguggaugacacagccuuggcgggcaagcccaggaggcagcagggcaaggugccgagccugggaugggugggggcuucugcccaugucucgucccagauaagcugggugcagccaucuguggcuccgggaacccuggagccuaguggacuacuugggggacguguccaggcaggagcaugaccugggcccuggggucugucugccaucugugggggcaggguuugccacaggccauucuuuuacggaaccaacccaaugggugggacggaaucccuguccugaguccagugaguuugcccaggcccugccugugcccuccccugcucacguggccgcccccacaggugggcuacgagaacgcaggcaccguggaguuccugguggacaggcacggcaagcacuacuucaucgaggucaacucccgccugcagguggagcacacggucacagaggagaucaccgagugagugugggcgggcaggcggggcgggaggcgcggcuucuaggauuugcauaaaguacaggcgaaguggcuccuggggccagccagggggcuugcucacuccccacauugguggagagcaauggggauccagguacuuaguguuuuaaaagucauuauucuaaaagcauuacgugguuauuauaaaaaucagcacaaaggagcaaauaaaaaugacugacagcccuccucucugucaggacgcugccgauugcucaggcccaggugcucccaucugucagaggaguaaagcaaggcucagagacauuuggagaguugcucggggucacacagcuggcgcuggaacccaggcaucuccggcugucuuugguuugcuccuuucccgguuuaccuguuuuacuagagacauaguuugaugcaauagagauguuuuauauagaauuuuuauucuacuuuucaaauuauuuaauauuuguugaaggcauuuccccaggccauaauucugucugaauacuuuuaguggcugcguacuauuccgucuuguguguauuucuuaacuuacauaguccucgauuguuaggcaauuaguuugugugucuggcuuuggugguuauuaagcgugucacuuaucaucugugugccugaauguuuggcuucagcucugaagaguucugaggguaaacccuucaacaggauuaucugauugaaggauaaguagcaucccucggaacagcccucuagagagguggcacuagcgugcucccugcaggcacugaggaugacauuuucaaaauccgccugguuucuaaaugacagucaugauggcccucacccuucaaggucucuacuaugagccauguaauuucuugacgcugcuuugggccagcccaucucacuguggagcaucccugaccccaguucugcccccagccccaaccccaccugagacugaggaugcugucgggguggcugcuguggcucgccgggggcauggaggccccucccuccccuuaggagaagcuuagagacaaggccaacacuuuggccgagugagacucuuccccucaagcugcugugaacuccucggucuugggucugcuuagagcguccuguuagggaugggagucugucugcuguggagcacggguuuugugucagacagauuggggcucaggugcucucaggucccaagccacguggagccugggugagcuccaaccucucugacccucgagcuccuccucuggugggaaugacagggcucucagcacaccgucguggagaugaagcaugggaggagugcagccuggccuguggcacugaguggaagcugucaucucugcugcgaagugggccagcaggcagcaagaacacggggaaauccugccaguguagguuccaggcugccuucaccacaagccucaguggcaauacauguaaaaccuugagugguuuuuuuuaagacauagucuugcucugucacccaggcuggagugcaguggugcaaucuuugcucacugcaacuucugccucccggguucaagugauucuccugccucagccuccugaguagcugggauuacaggcacacacuaccaggccuggcuaauuuuuguauuuuuaguagagacaggguuucaccauguuggccaggcuagucucgaacuccuggccucgugggauucacccacuuuggccucccaaagugcugggauuacaggcaugaccugcugugcccagccugguuuuuuuguuuguuuguuuuguuuuuuaaacagcuguuccacuuggacuugugacugcccuuaggagcaguaaggcugagcuuggaaaacccugcagagguggggaagcuugcacucuccaagcaucucuaggggguuuugggcacaaguccagcaggaaaacaggccucagaaggacagguccugacccagcacccacugugcaacccucucacagcugugguuaccauuucgaggagcccagccuucacagcaccuguucccuugcacacugccccccucacaaccacccacacagcauagcacauauggccccaagaaugugcuauccuggcccucugaccuagagaucugcugaggcuucaaaucuaggcuuuaccaagggggaguuuaggggaguggggaaaacagaccucaaggaaggaggaggcagaguacagggaggagcagcuuagggcuguguggacggcaccgugagucaggaaugcaggagcaggugguccugguauuucagcgggccaucuccagcugccaggcacuguguaguuuagucggcucccggcgggagcagggcaggggcugguggagccacugguugggaggaaccggcuguucaggcuggcccagagccuaugggcaggagucgcacuguguguggacgccccacuggcugcggugccccucgucuaucccccgccucauguuucccccuuucucccguccuuuccccccuccccccaaugcccuacagcguagaccugguccaugcucagauccacguggcugagggcaggagccuacccgaccugggccugcggcaggagaacauccgcaucaacgggugugccauccagugccgggucaccaccgaggaccccgcgcgcagcuuccagccggacaccggccgcauugaggugggcggagcucgagcagagggagaugccagcucaccugugcacagguucugccuggugccuggggcugcagugccaaguugccacagcccggcaguuagggaggacccgcaugugggcucugaaguggacauagaguacacggaggcaggcagugcccagaggaggggcggcgccucccaggggaagagacugcugggcgcccaggucaggaggaagccgugagggugggagcggggagcaggcuggcuugguggagcaaaacgcagggacccagacacaaagccagccccugacccuccagcucccacaggagccccacgccuggcugccgacggagcccaagcaccaccucccaucugagggaugggcugacauggcaggaccuggggguggggguggcaaaggacugggcccagaggucccaauggagucugagccaagcucaggggcccaucaaggaugggggagggagucggagauggcggcacaggagggagaccgagagguagauucggggccgcgagauggcagccuuggugggggagagagugguguagggggcgcugaggcgguccacggcaggcuccucagcacagcaagacucgcgccuucuccaggagggcucccuguaccuuucuuccucucagcaccgggacccagucauuggccuccgaaacccaucucccccgccucuggucccagcugugggcaggagcccugcggccugcucggugccuguucccagcccugcacgugcugccagcaccgugccagcugugcuagggacuugcucccuauccaggggccugagccccaaaggaggcaagacauugauggagcuccagcuuugcuccagaguccaaggcagaggcccccgggcuuguguggggcggugaggggagcaaacaugaguuugggccaggcucugggcuucugagacaagggaggcuggggaggcuggggguagggaccagagcucucuggauucuggaagcagcagagccuguggcuucagcagggagcuggccaccugccuucuguuucuggaagagucuguagguggcggcagccccaggcugagugcugcccggcggccccugacuucucugccucccuccauccccacuuccaagcccuggcucuucagagccugccucaucacagaguauuuuuagccgacaguuucugcucucagcugaguguucacccuuaaauauuuuaugaaguuccuuuuuauugaacacaggccucugcccccgagaagcggaaaugggcagugggugucccgagccccucugggcgguccccccacuccccuucuuccuuaccugggccugacgggucccccaccuccggggagcccuucucugcggggcucacucgggcggcacgaacaggugcaggcggcacgagccaccugugugugugagugucggcgccucugucuccuccucuccgcugccccucccauugccgucuggcccuggcccugucccgcugccccgcugcccucuccucgcccuugguuugcuucccugauggguguggacccugccucuggcacuuucccuucauuuccucucccacuuccuccucguugccuccucucccucccauccucccuucuggaaggaaaggaaaggaaaggaagggagcauggguggauguugaggccuuccccaccacccuguuaaaaacaaaaacaaacccccggucagccuugccucuugccucgcacaugguccuuuggaggcccugucgccggccugccguccccucgcugucugggagcccacggcgaggcccuuuagcggccgggucagcagaccucaauccgugcuguggaacgaacguggaugagucugaaaggcuagaggguugcucaggcaggugcagcagguccgugggaauagaggcagggcuggccccugccugcccgggccccucucccgcucugcggcaggcauucccuuccuccucugcccccucccagcuccucacagggagccaguagcagugacugcguggcacguagagaagggacgcacuccuggguuugguggcagaaacagcaaaaccugaccagccagagcugggauucaccugcagacaccccacgcucugcucucagcagcugcugggugcacaccuggccagccucgggguggguggggcacuuuugaccgcaguuucuggcgcagguccucacgccucacccuucccacagguguuccggagcggagagggcaugggcauccgccuggauaaugcuuccgccuuccaaggagccgucaucucgccccacuacgacucccugcuggucaaagucauugcccacggcaaagaccaccccacggccgccaccaagaugagcagggcccuugcggaguuccgcguccgaggugugaaggugagaggcugcagcccccgccugccuuugcucccggcccuuggagggcccccugaccguucacuuccccaccaagggccuugcacauggcuucaccucagccuugccccugacugaugggucgaggucaguggcucuccuuggcugcagcugcacgccagacuccagcuguuuucagagucugcaggcgccugggcaacccgcugccagagucccuggcaguggccuggccggagcucguccucacaugccuccugucuagucuuguuccggggagacccacgcugugucccgccccucuggggugagaaucaccuggaauguguguuaaauaucaucaggcuucccuucuggaaauccugaucccacagguuuggguagaggcgccagaaccuguguuuugaacaaguucuccagauaauucuuuuuuauuuuugaaguggaaucuugcugucgcccaggcuggagugcaguggcgcgaucucggcucacugcaagcucugccuccuggguucaagcgauucuccugccucagccucccgaguagcugggacuacaggugccccccaccacgcccggcuaauuuuuguauuuuuaguagacgggguuuuaucacauuggccaggcuggucucaaacuccugaccucagguguuccacccgccuugaccucccaaaaugcugagauuacaggugugagccaccgugccuggccucccagauaauucuuaauuucuggaaaauguggauccccccccaccaggcaagagcccaagucauguagaugcggucacuuugcacagugucaggcccccgccagcccccugcucuccucaccuggccuggugcacacagugucaggugcuucaggagcagccgagggugggggcgcagcagagacaugagcaggaggcuugggaggcaaccugcccuuggugggcuggcagcucggcuugucuuuggguggccuuggugggugcccugccuggcaugaggacucuaaauggguauuuaggaucuaaagagcccuuugcugggcucuguuacuggcgucuguagcuagagaggaauccacagccaggaaaugccgccucggccuuugaagccagcacgugucccgugggagccacccucagaauggcaagaagagccggaggacaggggcuuuggcccucagccccugugggaguuaccaccccaucuucuucuuggggguccccacagggcgggcugugcugggcacuggcaccggccccucugccuuggccucguguccuccuugcagcuucuuccagcccugccugucaucgaggcgcaguugcuugggggaugggggggcaugugggccgugcuguccccucaggguccugcaaucacuucucacauguccacauggcugcuuggucgcaagagccccuggaggcuucugggccuaugccuguguguguggccagccugucucccaccuuaagagggaacagcgcacuuccuagaggccaggggguguuacucuuccguggggagccucucagccucccuguugggggucccugucgugcacauaggcagaggugugucgcgacaucagcugucgacaucacgcgcucccccugcaccuugcugcggcuccugguguccuggcggggauguccugcggcugcuucgguguugaggggaugcguggccaugcacaggggugacccaggccaucccccucgccugccccugcccguugcucugugguccuggcuggcuccugggguugugcccgguuccucugcucccuccucacccucagcagcuccccacgugccaagcuggucccugggcccuagaaccuugcgccugcuaggggugcagcuagaggugggcuucugcacccuggagggcccggaaagaucuuccucuuuagaccgucccccgccccccagguggagaaaggggcacuagagaccgugaccacggggccagcagcaggauaagugucucuggugucugggggugccaaguccuccccaaaugugcaccaagaccaggccgcuggcucuagccgccuccugagccucaugcuagcgcccagcguggcagcccuggcccuccugucccuuugccgucugugcccacccacccugucccgcgcccccgcccacuccuccauggcguucgcuccccacacccuucucugucgaggaccuugcucccauucaucuaaaccaggcucucgaagcccaccucuagcugcauguucuggggcugggagggcaggcacacgcgugugagccagguccaugcacacgugaacacacguaugccuuagagcaccugccucaccucggcugcccgguggcagcgccuuggcccucacacagaaaacaccagggagucugugcagcguguuugccguggccuggggugccagggccgccuucugaguuuucauacagcaccugggggagcuugacccucugcagggcugagggccacgucugcccaugccccccagccagugccuagaagcagauaguucaggaggcugcaggggcugggccaggucggaggcugcccgggccuggccagggguccuagcagagaaagcagggcucgugcccauccggcugccucccugcagcgagggagggcgaaggccgccuucccaggaaggcccagagcacaucugagcuggcagcugcgguccugcucggacccacaguucugacaggaaccuuccagaggaucacgggcugauggcagagcagugggguucccugcccuuccagucccuuugggauggcguuuuaccaguccacaagaugcccugggagguggcagacacagcugucagcaccuggagccaugaggacuuuucacuguacgcucagcccagguccguucucccagagggcuguaccgucccccaccuccuccuguugcuuaguccaguccuguguccgccccgcagacccugaagugccauggggaaggcgcucacacgugcuccccaggcuuuacacuggauacggcguccugucgccaccuggcaggaaggggcguucuuugcacuuacaggcgaggguaggccgccugcccaagcccaugcucuugcaggucagaagacaccaggcacagcccuuggccgcagcccugggccgccccuguggacaggaagccaggaggccccaggcugcugugacugcccccaccggcccugguagccccacccuuguccgugugccaccagcggcccguguccuguccucccgucucgggggaccuagccagacaacaccagagacuagcacugagguguccccaacaauuuuauuauaaauaaaaacaagacucccaguggguggcugcagccccugccucgguggcugugagcaccuguuggaggggccugcccuuacccuggucuggaggccagaaccgaggaaagggcucccugccccuccaaguacacaggggagccugagguacugagaauaaaaaccagggagggacucccaggccaggcggcggccccgggcccucugccccacgaggcucaucccuuggagcacacaggaagcugcccguccaucacaccacacucucuuccagccgcucggcgcugccuccuaccccccggcacccugccccgagcagccccccaugcacagaguggcuccgucgggcccaagcuccucccaggcgccuggcauaaccguagcacccggcaucucccagguccagagagcagcugcgcugcggccggggcggggggcuccgcggcgggugggccuuggguguggggcuggggccuccauuggucugggacuggacguggcugagcuugagggggaggcggccauuuccggccccccggccccgaaccagcaaggccacagugaagaccaguaaggcagccaccagcacaccccccacggccacggucagggucccgcccagcacgugggccugcagggcguggcacaggggcgaggccggcagcguggagaaaugggcacagcccagcagccugguggccgugaggucagagggcccagcggccggugacaaggccagcaggcagaggucauagucagcgccggggacgaggugcuucagcaggaagugguggcuggaggcugggacaauccugcaggcaagggcagguggucagagcccggggcuggggucuagccccauccucaccuccccacucccgugcucccagcuccaaacaccccucccccuggggccacucgggcucuuggguucacucaggaaggugaacaggcuggagaguguggccaggagaugggugugugcacuggcacaggacgcaggcaagcgaggggaaugggguggggggauggcaccagcagaggcagaaauaacacgcgggcgcgggccaugugcuucagacagacccaaccgccaccugcugccggggaggccugcacagcucagugacaccugggacaucucggggugggguccuucugccgccccuugagcuccagcccccucaggcagccaggccaggccaggccacugcuccuccaagaguccagcagccauggucggggagggggugucagccccagagagaggagggguggaagcaaagccuuguggggagcagagggcggaggaagggcgccgggagugcagccggguguggggcacgcauccucaccgguagaugagggucucaucuucgcugcuguuguacuggauuuggaacauccacacugggucggcuggccgcccgggaccccagcucaccagcccugagguggcggucaccuccgucaccugcacggcuggcucagacuccagcguccccucacccucggcagcagugcgagcggaggcggcgauguccgagggcccggggcggccccccucggcacugcuguucccaccauggggcaaggccagcacccgcaguucuacucgggcuguggccucaccagcaggguugguggcgaugcagguguagcccccagcguccccagcgccggucaccccaaucucuaaggucccguuggggaaagcccgggcucgggaggaguugccaaccaaccggucgucaggaccgacccagugcaugguaggcgcggggucacccagggcccggcaccgcagcguggcccgcuggccuuccagcacccagaggcgcugcguguggcgggcaaugaggggcggcucacaggagaacucgcccucgggcacugcccagaaguagcggccggccaggccgggcggggaggcgcacguuuccaggucguccggccgcgccagccgccgcagccacagcagcucacaguugcagugcaggggguucccgcuaaagcucagcaccaggggggcgggagaggccucugcaucacgcccacgagagaaaagcggguccggagccagcguggccaggcgguuggaggugagguccaggcgggagagcugaccgagcugggcgaaggcgccugggggcagugcgucaauaagguuaugguccagguugagggugugcagggcaggcauggcgccgaugccggcccagggcaccugccggagguuguuguaggacagguccagguccuccaggcucucuaggaagucgucgaaggcucccggcgcgaugcggcccagcugguugccgcugaggaugaggugcugcagauugacggggccccggaggcucccggugcccagcuccaccagccuguugccgucaagguggagggaacgcaggcucucgagguccccaaaggcgcgggccccaaugcgggugauggcauugcgagacagugucagguccaccagucccgucauguugcggaagucagggggccccagggccuggaugaaguugucagccagccgcagcuccacugugcgccgguccacguugggcggcacaaacagcaggccucggugggcacagagggugcugagcgacucggacagguucuggcagacgcagggcagcgggcaggcggccgcuccacuggccagcagcagcagcaggagcggcggggccauggugagcgcccuguaggaaggggccacagcccaggcacagguggggcuggcgcaggugcccacuugggcccaggacagucccagaagccagcuucugugagccuggcccggggaggggcugggucagaggcccaagagggccgccagagaugagggaagguuggggccugcagggccaggccccccagagcaaaggucacauuucccaagcaguuaagggggaguccaggcgcuggggacaaggugaggcaugaggcaggaagcggaggaggaccgagagcagggagggucccggaacuuccuuucccaggcguccccaggaaucgccagccgccuccccacuccccgccauacccucccccgccagagaaggcgccccccgaaccucccguggaguccguggccccucccuggccggcccccgcgcugcgcccggcggcccccucaccugguguccgucgcucagggggcgcgggccggccucccugcgagcccggccggcccccgccgacuccuggccgcucucccgcggggacgaggcccggggaugaccggccgcccgccgcccacccucgggcccauggcgcucgggcccgcggccccggcucgcucgguucccggcaccuuuucccggcgcgguuagcgguggcggcggcgacaggcgagcgggugcgcgccggcgggcgcgcgcgccgcggacacgcacguggagggcggacggggaggggcgcgcggggauccacccgggcccgggccggcuccugaggucacggggacacgcggccgcugcagcgcccacggguggcgcccagucacgcccgaggcccgggccggcgcgggcccuccgcgcugucccccggcgcugccgcagcgcacucacccuggcacaggcgcgcgcgcccccggccauccuggcgccccggcauccugcaccgcacgggcgcccgccgccgcggcgcgaaccucacucugcagacagccagacaaagcgccugcucgcgggccccuucaccaucucccggagacgggcgucuuugucacaugucgcugggcacccuccccaacacacccacacaugcccacacacccacacgucccugcacccacgggcagggccgagcgcaaacccgcacuguugcugggacccuugcguucacagacacacgcugaaggucauaaccguucugcaucaccgagucacguggaggguccccaaccggcacgggguucggccguggggggggcuggggcggcgccccuggcagggcugcugcgggguggggccgagagggcuuggccuccgggcaggcgccccgcccccgccgccccgcccuguccccagcugccucucgccucucccucccuccccagcugccccgcccgccccgcgggccaggcguuccggagccaaccggccuccgccucgggccggauuggucugcgcggcgcggcuucccaaccgccgggggcacgcauugggaagcugugcguccucgcagcgccugcggccccucccucccgcucugucgccgccgggccauuucccuggaagagcggcucggaaccagcuccucucagagaaagggcucccggcgugaggugggggagguucuuugcuuccugguugagaaagcuggggcuucgguggcucggcgagccugguuuccuuccagcugugcccgccaccaccaguggucugcccaguugggaaacaggaagucaccaccuccccgugucuccugguccuuaagccaccuaaaccucagccauccucguucucccuccagcccugauccccaugggccagguggcaggaaacucggggaaacccaagauuggaauucugauccugucagcacagcaguguaguccugggcacguuaccugaccacugaaaacaaguuccuccuguaggccaggagaguuggaugguacauacauaagcauuuccuaggggcgagaggggaggacagcugcagcuugugaggggcuuacaggcagccagaagccauucugucaccacucacugggccucagcuguggcguuuguaaaaugagggggauucaguccuggugcaggucaacucugaugugcaguggcaccagcuaugucuuuguuccucuucuccccaucaaaaauguuuuccaccgggugcagugguucaugccuguaaucccagcaguuugggaggccgaggcggguggaucacuugaggccaggaguuccagaccagccuggcaaacauggcgaaaccccaucucuauuaaaaauacaaaaauuagccgggcgugguaccgcaugucuguugggaugaggcacgagaaucgcauuaaccagggagccacagguugcagugagcugagauugugccacugaauuccagccugggcgacacacuuugucucaaaaaaaaaguuuucauucacucuaaauauagauguuuaccagcauccaccauggccacccagugcugggagccggguucaucaggaaccagaugggccugguuccugcccccauagagcuuacaguauggaggagaggaugggcaacccgacagucacaaaggggagacucaguggggacccuccacaugacucggugaugcagaacgguuaugaccuucagcgugugucugugaacacaagggucccagcaacagugugggucugcgcucagcccugcccgugcagguuccucagcggccugcuggaaaggugagcaucagcucugccgagggugugaggacagggcgaaggccuccaaggguccuucucacucugcgcgcucggggcucuuuggaugguuucauuagcugccucccuucuccagugccaugccuuggcccagcugaaaugucagcaucucuucaggagaggcaggggcgaggcucaggggcagacaggcacagcacugcuggcggggucccacucuguggugagcaccugacaggcuggugggggaggcacccuuccuguccaggccuccagguaauaggagccuaagagacggagagcucagaggagucuggguggccuugagucccuguugaaggugccgacagggaucaugaauaagugacgcguggagguguuuucuucgcgguggaagccagggcugucgcuacacagccacaggccaugcuuucacaggucuuggagcaccugucacagugcuggcucgcauguccccguuuaagucauacucacccuggcccagccucauguugucacccaggcauuuaaugaguggaaccgagggccccugugcacaaagugcacugacacaugccucaggcagcacccugcccccaaggguucccaggcagacaagcagaggaugaagccgaugggugugcuugcccacagcggguuccucaggggacugcuggaaaggugagugucagcucugccgagggugugaggacagggcgaaggcccuugagaaguucagggagagcuucccaggcaggugcaaagguguggagcgcaaggcaaguuugauguggcuggagguggccacaaugaggaaggcgguggaggguguggccuggagauggagaagaggucacaaggucccaaaauggccguggucgaauccucuggcuugaccaguggcaugggaggagugggugaugagggugaugggaugcagguuuugguaacuggggggacaguggggcacccacugggcacaggaggacugggugcauaggcaggaagcuggccguggacuugcugaacuuaugcgaggggugaacaaggaaaggcccgggaggcaguugcaccucugggucuugcccuggaggcagagccugucacuggcgccacagccccgggacggggccuccuggggagcauguggugugugaggagcuggggaggaagaggacaggagagcaagauggcuuggaagcccagggaacgagcagcaaggcgggagcaugcccgcuggacucagcugggaggagugacuuagagugccagaguguggucuguugcggucaaggcccucuuucgagaagcguggacgaggggcaagggugacugcugugggccacgcugcuggagaaaaaggcugagcccuguucuaggcugcggggaggcaggaaggguggccuucagcacaugcuuugguguaaacaaguauggagggagcaggcccagcccgugacagcuuagggggcucugcuggagugaggagagggcugagggacggggaagugccccucugcagggaggcccagaagcugugcuggcccagggcagcaucuucagccuuuucucuuucagccuuuucuccucugccuucccugucugugcugcauggugacccccucccacccgccucuguccugcagaccaacaucgccuuccugcagaaugugcucaacaaccagcaguuccuggcaggcacuguggacacccaguucaucgacgagaacccagagcuguuccagcugcggccugcacagaaccgggcccaaaagcuguugcacuaccucggucuggcccgagacugcccugcccugcccuccccuccccuccgcucuccaaucucuugcuccuaccuccuugccacuccccaugaccaaagaacuccuuagugcccccugccccucaccccugcccucauucuggcccugcguccucuuguccugcacccugccauucacugcucuccuugcuucugaucugagagaccccaccuuuccauccacgugguccucaagacguccccacugccuguacccaggaggcccuggcuuuggagaggacaggggccagcuggaagcccggggauccuggagggaugugucccugucccugagcccagccacucucacugcugcccucgacucagccucugcccagcccacccugacccacugcccgcuuucuccccaggccaugucaugguaaacgguccaaccaccccgauucccgucaaggccagccccagccccacggaccccguugucccugcagugcccauagguaggugagauccauucugucaacucaugggggagacaggagguugccaccugcaggaugggcaccaaugccccugucuacccuaggcccgcccccggcugguuucagagacauccugcugcgagaggggccugagggcuuugcucgagcugugcggaaccacccggggcugcugcugauggacacgaccuucagggacgcccaccagucacugcuggccacucgugugcgcacccacgaucucaaaaagaucgcccccuauguugcccacaacuucagcaagcucuucagcauggagaacuggggagguaggcuggcaugcugcgcagcgccugguaggaaugggcgcccgcucuguggccagucccacaggcuuaggccacuggggacaagcuagagacgcugacacgaagaacaccaaagaggaaggaccgaagaaggcacagcgcccucuccggccaggccuggugccggcacgagguugcagagcugagaccaggugcauccugggagguccagggucaggaggagacaccugccuguuaauuauagcacagagagguagaggagaagaugggauuauaaagggggcauagaagggacacaaaugagccuggucucccccuuagagaucagacaagggaaaaaucuguggggguuggagcagggaacacagguauggcgaagaugagcaggaccugguauuggggccagaggcuugugcugcagagcuagcuccaaggccugguggaguuccccaggcaugcagagcugaucugggccucucgguuccugugcaggagccacguuugacgucgccaugcgcuuccuguaugagugccccuggcggcggcugcaggagcuccgggagcucauccccaacaucccuuuccagaugcugcugcggggggccaaugcugugggcuacaccaacuacccagacaacguggucuucaagugagccugggguggggugggcagacgcuaccugguguggcccagaggguaccgagccaugucgugauggccucuguucuccacggucagccugacaccaagucucucuguggccacacgcagcaggggcugcuguuuggaaauaucgagaaguguaaaauuggaguugcagaaccagacaggcuucuaaaucacucccucacuccuggggcaguggaaggucugagacuugccugggucacucggugcagggcugggauuggaacccaggccucaagacuccuugcucaguacccucuuccacagccugccacuggccuagcugauccuccagggccugguccacacuuguguggccaccccccgccuguggaugccacacccccugccaggcgagacccucagaucucauuccccaggggccauagagugggucaggaaggagccagggaagacuguucagagggaggugggguggggcucagcccugggcucucucacccuugcagguucugugaaguggccaaagagaauggcauggaugucuuccguguguuugacucccucaacuacuugcccaacaugcugcugggcauggaggcggcaggaagugccggaggcgugguggaggcugccaucucauacacgggcgacguggccgaccccagccgcaccaaguacucacugcaguacuacaugggcuuggccgaagagcuggugcgagcuggcacccacauccugugcaucaaggugccugggccacuuguccgucccucccucucugccccggccauguccccgccacccacaggcacacauccugcccucucuaccaucucucucucucucucucccacuucccccaggacauggccgggcugcugaagcccacggccugcaccaugcuggucagcucccuccgggaccgcuuccccgaccucccacugcacauccacacccacgacacgucaggggcaggcguggcagccaugcuggccugugcccaggcuggagcugaugugguggauguggcagcugauuccaugucugggaugacuucacagcccagcaugggggcccugguggccuguaccagagggacuccccuggacacagguaggaagaacagcagcccguggccacaccccucucaaagccgcagccaccaccagucccaguaguguuggaccugccuaggauccagaugcccugcucuggccuugccgccuucugucaccugagucagacaugggaccugagcuagcccuggguccuggaagagucacacauuucuaaggccuccucugacucuggccucccugcagaggugcccauggagcgcguguuugacuacagugaguacugggagggggcucggggacuguacgcggccuucgacugcacggccaccaugaagucuggcaacucggacguguaugaaaaugagaucccagggggccaguacaccaaccugcacuuccaggcccacagcauggggcuuggcuccaaguucaaggaggucaagaaggccuauguggaggccaaccagaugcugggcgaucucaucaaggugagcccggcccggugcuccuuaccugacccagcccugcaugcaccugccacuggccuccuugaggugccuggcacccuaaccuccagggccuucuccucaggugacgcccuccuccaagaucgugggggaccuggcccaguuuauggugcagaauggauugagccgggcagaggccgaagcucaggcggaagagcuguccuuuccccgcuccgugguggaguuccugcagggcuacaucggugucccccaugggggguuccccgaacccuuucgcucuaagguagggaaggcccagcauggugugagggugggggcuggaugcaggacuugggacugauccucugcuuugcuccccagguacugaaggaccugccaaggguggaggggcggccuggagccucccucccuccccuggaucugcaggcacuggagaaggagcugguagaccggcauggggaggaggugacgccggaagaugugcucucagcagcuauguaccccgauguguuugcccacuucaaggacuucacugccaccuuuggcccccuggauagccugaauacucgccucuuccugcagggacccaagaucgcagaggaguuugaggucaguggcucuggcgcuucuccacacuccacccuggcccccugccccagagcucuggaguuuagcuuggcugucacccagccucgcaagcuuugggagcagaaaggacccuugagaccgggagcuaggccuuuaggaacgaggagccaaggcccaguguggggacuuccuauggccagggccgggggacugcucucccaccuuggcguccagcucugagucugcacacccucccugcagguggagcuggagcggggcaagacgcugcacaucaaagcccuggccgugagcgaccugaaccgggccggccagaggcaggucuucuuugagcucaaugggcagcugcgguccaucuuggucaaggacacccaggccaugaagguauugucucccccagggccagccaggcgguggggcuuggcugggcccaggaugucauguccccucugcccugugucuucaggagaugcacuuccaccccaaggcccuaaaggacgugaagggccagaucggggcgcccaugccugggaaggugauagacaucaaagugguggcaggggccaagguggccaagggccagccccugugugugcucagugccaugaagauggagacuguggugaccucacccauggaggguacuguccgcaagguucaugugaccaaggacaugacacuggaaggugacgaccucauccuggagaucgagugaucuugccccagaccggcagccuggccauccccaagccuucaacagaagcugugcugccacggcaggcccaggccagccagugcccgaggccaggaaggccgggccguggagguccuguccacagcuggacaggagagacaccgccugcggugguucauuccuuucagccaucguccuuuccuccggcggacagcugcuuacauguucaucucuugccaaauaaggguccccuccucacuggagacuacaaguggugggucaggugguccuaggacccaggggagguuuagggguccuaucuccugggggaaggggagaucuaagaugucccagguccugggaaguuuacucaauaaagcuggcuuuccccugc

SEQ ID NO: 61591 - RNA, 109851 nt, Homo sapiens; identical to SEQ ID NO: 61590

SEQ ID NO: 61592 - RNA, 59344 nt, Homo sapiens
uuacaggaacaguguggccucucuggaacucugcagaccaacugccgugguaagagaaccgacuuucagaggccucuaggcacuuuguccuggguaggggugcccacacauccuggccauuguugcucuucccucuggaacuuggcagcuuucuagcaguuagaagagcagaggguagaaggaugggaacaguccuuagagaacaggaaucuaggggaggguuggacuagaucauuucucaagagcuguggggacuguucuggucaggcaugggcaagcugaggggcaggagguaggcaaacccuacuugaccugagaacagauuuguuguuguuuuguuuuuguuuuugagucucgcuuugucauccaggcuggagugcggugguaugaucucggcucacugcaaccccugccucccggguucaagcgauucuucugccucagccucccgaguagcugggauuacacgugugugccaccacacccggcuaauuuuguauuuuucguagagacgggguuucaccaugcuggccaggauggucuugaacuccugaccucaggugaucugcccgccucggccucccaaagugcugggauuacaggcgugaaccacuguuccuggccgagaacagguuuugccugagaccuuggacagaagaccuuggccauggauccaagagcucugggccagaacacccuugcaugauggugacaguugagggaaaggccacaugguuccuuguguaaauggcauggcugccaguggucauggggaggcccugcucauaguucagcaccagccggcccuucgugugcugugcuccagcuccccagccggcucaguccuucacaaaaugcccuggaguuacagaacagaaaggcccggcuuuccuuuaggaaucugggaaauaggagggcugaggucaugcucuguucaacaugugagaccucccagacagcagugcaggaaaaacauguuacuacccguauuuugggagaccagaccucuggcguuugaguaggacucacugcucagaucuaaggggagagaacaucucccauuuugaagaaaaccuuuuccucaguuuaggaggaggagaaacugaucagguuccaaauggccucuuguucuuuaacugcaaacgggccaggcucccugccaggucaugggauaacaauccaaggagaggggagaaaugcagugugcauguguguguacaugggcaugcucguagggggaaagacuggggggauggaggugacguggacaucuguguaugcuucagcucuauuucccucugcuuagucccaaacugcucgggauuagcaauuguuaagaacaugccuuucuccccaccccgggaguucuaggccagggguggagggauugagcaccguggcuuuguucucugucagguggugccuuucucugugacaccgagggagaccugccaucaggagggagucugaggccaggagacaguacuuaccgaucaggauggaucuuuggucuuguuugugugcuugguuuccuggcuggaaugaaaugucaguuucaugaggacagggaccuguucucuccugcacaacuuucucucugaugaccgacagugccuggcauguuguaaaggcucguucagaagugacugaaugaaugaaugcauacuuuuuaggcggggcugcauaucguucccuuaaaccuccugauucaucuuccguugcuuccgugucagcuucucacugggucauugucugcuuuggugcugcccuuccccacaacuuugagaguucauguuacugcaggcuccccgcccgcccaccucugccugaaacuucucuuuugggcuccugugcugugacauacuagcaguauuuguuugccccucuuaagaccaucccuucaguuucauuccugccucaguuucuccuccucacauuucugcuguuccaccucugcuccugugcucuucucaggaaagcaggugaguggugaugcccugggcuaagcucgccagggccugggcagcccaggcacccgugguucggguggggagggagcaugcugguggccggagcugggcuugugggcagcagcccuccccaccuugcugaggccaagcucuuucucauggcuuuggcugucacuucuaugcugaucacccccaaaucauugugucuauauuucucuauuggugcuucugaccuuccaaaaucugaucccacccuggcagucagaccuuauuugaugucaaggauuauuaauuuguagcauguauuacaucccuaauauggaccaguucacaugcauucucauauuucauccucccaaugaacauacaaagucaaauaauuauucuuauuuuacagagucucagacaacuuaguuccucuagguaaccagauuaauuagcauuaggggguugugaucaggauuugaacuggcuccacuggccccugacccugaacagagucagcuuggaguccgcccuuggagacgaggacagccgguccuguuucucccucucaccccagugcacucacacagcaggcguuggcacccuugcuaagggccaggccaagcgucuccucugugagccuucacuuagcucuccuaagcugcucggccugccuccucucccuuuucucuaacagcagugccuuugcacacacuauguguuuguuauauguuggcugugccagucuugccucgucagcagauagugauuuucuuaaaggcagaggccauguuuuauaugauccuccaucccucaaguguguguuacaggcaguuuguugcucaguaaacacuugauaccucugaugaggugaaaucuaaucacaguccuuugcauauguauugugguuuacaguuucugaaaccgaagagccaauuugaaguuuccuguaaaacagaucccuuaauugucagcgcucugugcugagagggauaaaucuguuuuguagacggacuaacagguccagagguagagugaauuccccaaggucauaugauggaugauagcaaagccagaacuugaacccaagguuuaacucuuaaugccguuccucuuaaugccguucccuucccacagaaucacagcagccugugguccagacuuggccaggugaccccugccaggccuuccaucccacuuagucauacaguuccuuauuuguauuuguccuuucucuuucauuagaacucgugucuuuuuguguguguguguguuuugagacagggucucgcucugucacccaugcuggagugugguggcacaaucacagcucacugcagccuugaccucccaggcucaggugauucucccaccucagccuccugaguagcugggacuacaggcgcaugccaccaugcaaggcuaauuuuuguauuuuuuuagaggcagaguuucaccguauugcccaggcuggugucaaacuccugggcucaagugaucugcuugcuuuggccucccaaagugcugagauuacagacaugagccaccgcgcccagccuuagaaugcuugucucuugagggcagggacccuggcugcuuuucccauuauccuuccaaagcuccagcucuggggccaugaaccagaaaucauuccuucaaggauguugacacagugagucaccugagaaggggcagggugcaggagggguggggcaggagaucaggaacuggugugggacauuaggggugggagauaggccagaaagccccaugcucuguguaaaagcuucugucaaaugaagaugugcuuguccuaccuaccaggcgagguuacucuuaguagcaagugagagugucugcuaaagcgccuucuaaacugcagagcacuagcaauauuguuguuaaauauaauuauagucuguagcugggcauggugcugggugucuguaaucccagcuacccgggaggcugaggcaggaguauugcuugggccuaggaggcggagguugcagugagcugagaucgugccguuguacuccagccugggugacgaagugagacucugucucuaaauaaaaaaaaaaaaaauguauauauguguguggguguguguggguguguguauauauauauauauauauuuuuuuuuuuuuuuuuuuuuuccugagauggagucucucacucuguugcccaggcuggagugcaauggcaccaucuuggcucacugcaaccuccgccucccagguugaagugauucuccugccucagccuccccaguagcugggauuacaggugccugccaccacgccuggcuaauuuuuuuuuuuuuguauuuuuaguagagacaggguuucgccaaguuggccaggcugguuuugaacuccugaccucaggugauccaccugccucggcuucccaaagugcaaggauuacaggcgugagccaccacgcccagccaaaaaauauauuuuuuaaaauaauaauaauuauaguccguagggaugagcucaacaacaugguuggauagaaucauacuggccuugugaguauugaggagacaaucaggauggugccucacccaaggccuggcacuccagcuauuaugaauuauucuuguuuucauaauuauuauaagacaugcccucuuccuucagauuggggaaaggaguuggcagugcugagaaugcaucgcuucuggauugggacuaagaagaugggaaaggcagucuggcccuagggcuuucguagauccacucaccaccgcagguccccgacucugaauaccuccuuccucccaguggggguuuucagcaagcuaauuucucaccccugaggaggaacuguuauauucggaugaacaccccccugcuaauguggagcagaaaaguaaggccuggcgagucagcagcugcucagcagguggaugggcugcggugguguagcggguaggcgccugacagcccggcuugccgcagccgcugugcuucccucccaucccuggggugugcauuuuaggguaaaggcaaacuggaagcucuugcuauuugcagaacuccaaaacaacaaaacaaaauguccacucagcuggggguuggcugggcagcaccacugugauuacacaguuagccugggggaagggcuguggucagaguuugggggacacacaggugugacugugaugugauacagcuggaggaggaagaggagggugugaucacaggcccgggaguggccagggcaagagugaugguggaggagaguggcugagguuggcaggcagggaggagagauugguaacuacuaaucacuagcaugaucagucuugacaaucuaucuacaagggacucccagguggcagggcaggaccugaggcacagcucggcaugacgggcagacaggggucuacguggcuuugagcucugagaccauaggcaagcuguucaucugggugucuuuccaugcuuacaauaauauuccccuuacaagcccucugaugauugagaucauagaaaucacucagugcaguggcuggcacucaguagcagcucacacaaaugaucagcaauuccgacacuugcuauguggccaucacaguaaaaucagcaauaguggaugcccagagcugcaucuccgggaagccucugagccagucaguguuugugcucaaacuccaaagcauaggaugaaaggucagaucauggggcuaugaagauauguucuccuaggagucacgaauagggagagaaaacagcagcaaacacagucaaggccauguccugccuggguugcuguuuacuuuccucuuccaggaacugaagcuguuucccauuggauuucuuuacuaucgccuuggcucauggacuggguacuuugguaaucaguucgcccagagaaccaggcuuucacauugaccuagguuccacagugacuuccuccacgggaugucggggugugucaucuagcagaauagcagucaagacuacccaggaaugguugaggguugcacacuauuuuuaauaaauugaauuaaauagccaagaaaagucagacacccaacaagggaaguugaggcaccaagcgacaguggaaagucauuacuaccacuaggcuugaaggggucaggagaagaaauagcauuuccuggcugggcgugguggcucacgccuguaauccuagcacuuugggaggcugaggcgggcggaucaccugaagucaagaguucaagaccagccuggccaacauggcaaaaccccaucucuacuaaaaauacaaaaaaauuagccaggcaugguggcaggugccuguaaucccagcuacuccagaggcugaagcagaagaauugguuaaacccagggagguggagguugcagugagccaagaucgcgccauuguacugcagccugggugacagagcgggacucugucuccaaaaaaaaauaaauaaauagccuuuccugcaaacaccagugagggcugaauaguggacacugggaugccagcaggaacugucauagcgacaagacacagccugggucaggaugguggcaucaaagcugguagagagugaggaaggcacaccccacguucucucuccaccgccuccuaccuacccuugucucccgccugugccucugucucaucggcuggaccuacaggaaaccagccaggaagggagcccaggugccuccacccagagggcucagccccgcuggguccagagaagggcauacagggaggccgccaaccagguagccuuuccccaaaaggcaaagcuguggaggaggcauccacucagcagguguggaaagcaggggggaugagagcucuggcauccuagggucugagcggcugcugcugcuacuuuuugggaaggggcugccaaaucaaaacuaguuacuaguucaaaauuugaucauaaagggcaauuaggaaagauaaggaaauaaagaacauccagauuggaaaggaagagguaaaaguauuuuuauuuucaguugacaugaucuuguauagaaaaaccuagggaacucauuaaaaaucuauuugaauuaaaugaguucagcaagguugcaggacauaagaucaguaugccaaaaucaauuguauuucaguagcagugggcaaauugaaaaugaagaaaacaauuccauuuaagauagcaucaaaauaaaauauuugggaauaaauuuaauaaaagugcaagacuuauacucugaaaacuaugaaacauuguugaaaacaauuaaagaagacccaaauaaauggaaagauaccccaugaucauggaucagagacuuaauauuguuaagauggcaauacuuccugaauugaucugcaaucccuaucacaauccaagaugccuucauuagcggaaauugacaagaugauccuaaaauucacagagaaauguaagggaaccagaacaaccaaaagaaucuuaagaaagaagaacaggcugggugcaguggcucgcaccuguaaucccagcacuuugggaggccaaggcgggcggaucaugaggucaggagaucaagaccauccuggcuaacaucucuacuaaaaauacaaaaaaauuagucgggcgugguggugggcgccuguagucccagcuaguugggaggcuggagaaugacgugaacccgggagucagagcuugcagugagccgagaucgugccacugcacuccagccugggcaacagagcaagacuccgucucaaaaaaaaaaaaaaaaaaaacaacguuggaggacucacacuuccugauuucagaauuuaacugcagugugguacugguguaaggauagacauauagauauauagaucaauggaauagaacugagagcccagaauaaacccucacauuaacaguuaauugauuuucaguaagagcgccaagacaauuuaaugggggaaagaauagucuuuucaacaaguggcgcuaaaacaacuguauaucugcaugcacaggaaugaacuggaccccaccucauaccauauacaaaaauuaauucaaaauggaccaaagaccuaaauguaagaagagcuauaaggagaaaaauaaguguaauucuuugugaccuuagguuaggcaaugauuuuuuagauacgacgccaaagcacaagcaauaaaagaaaaugaacuguacgucaucagaaucaaccuuuguacaucaaagaacacuaucaagaaagggaaaagacaacccacaaagugggagaacauuuuggaaaucaucuauguaacaaggaacuuguaucuagacuaccucaagaacucuuggcuggguacgguggcucacaugggaggauggcuugagguugggaguucaagaccagccugggcaaugucauaagacccugucucugcaaaaaguaaaaaggaaaaaaaaacuagcuacuugggaggcugaagcaggaggauggcuucaggagcccaggaguuugaggcugcagugaacuauggucgugccacugcccuccagccugggcgacagagugagacucugucaaguaaaaucaauaauauuaugggaccaccaucguauaugcauuucaucauugacugcaacaucguguggcacauaccuguagucauaugaugggauauuauuuagccauacaaagaagugaaguacuggcacacaccacaacacggaugaaccuugagagcaauaugcuaagugaaagaagccagacccaaaacccacauaauuuaugauucuguugauaugaaauguccagaauuggcugggcacgguggcucaccccuguaaucccagcacuuugggaggccaaggcagguggaucacuugaggucgggaguucaagaccagccugaccaauauggagaaaccccgucucuacuaaaaauacaaaauuagccgggcaugguggcgcaugccuguaaucccagcuacucaggaggcugaggcaggagaaucgcuugaacccgggaggcagagguuguggugagccaagaucguugccauagcacuccagcccgggcaacaagagcgaaacuccaucuuaaaaaagaaaagaaaagaaauguccagaauaggcaaauccauagagacugagaguagaugagugguugccaagggcugagggagcuaaggggguuggagcaugacagcuaggggauaggaaauguucuaaaagcggauuauggcgguagaugcacauaucugugaauauauuuaaaaagccauugaauugcacuuuauuuguuucuugagacagagucuugcucugucgcccaggcuggaaugcaguggcgcaaucucggcuuacugcgaccuccaccuccuggguucaagcgauucuccugucucagccuccuaaguaucugggauuacaggugccugccaccacgcccagcgaauuuuuguauuuuuaguagagaugggguuuugccauguuggccaggcuggucuuaaacuccugacuucaagugaucugcccaccucagccuuccaaagugcugggauuauaggugugagccacuacacccggccauugaauugcacuuuaugugucucaucuauaugguaugugaauuguaucucaguaaagcuguuaaaaaacaaaacccuggcccugaagggcagcgcagucggcuaaaagacugugauuuaaugaggaaacuuucccaccgggcugugaccgcuggcccuggcucccuuuggccggguggaggugcugucugccacugagggcccucagcugcuuuuucaggaucucagaacaugggaggaccccagcuccagaagaaaaucuuaauuccaguuuaaucuuaauuccaauuuaauuugguugaguuaaacauuuuuggaacuguacugugagcuaggcaccaggcuagcugcucucaugaaaaaacaggggcccuggagcugggcagccuuaauuauucuugaguuugcuacuuccuguggguccuucccagccucaauuuucuuuucaguaaaaugaggguugauaauaccccaugagauuguggugacaauucagugggcuaaaaggaagaugccuggaauauuguaggcagaaaaugaaaguuucuuuccagugcuccuggagcaaguuaucucuaccaaguggacauaacaaagaugaguuaguuaugucugcccccguagagcucaaggcuggauacaugaccuguacucgcuaaccagggccuggggagaagcaggccaggaggagggucccugucuuacucugguccuggguugggaaccggggaaggcuuccucagggagggggcaaugaagugaggcuuugaaggaggauagcuuuucgcauguuguauuuuauucgcuuuuuguuuauuuauuuuuuguaggcaggucucucucugucgcccaggcuggagugcaguggcauaaucucugcuuacugcaaccucugccucccggguuuaagcaauucuccugcuucagccucccgaguaacugggacuacaggugugugccaccacauccagauaauuuauuauauuuuuaguagaaacgggguuuugccauguuggccagacuggugacgaacucuuggccucagguaaucugccugcuucggccucccaaagugcugggauuauaggugugagccacugcaccccgacuuagucacuuuuugaauagauaaucaaguacauggugccaauucaaaagggucaaggcugggcgcgguggcucaugccuguaauuccagcacuuugggacgccuaggcagguggaucaccugaggucaggagcucgagaccagccuggccaacauggugaaaccccaucucuacuaaaaauacaaaaaaaucagccaggcaugguggugcgcgccuguaaucccagcuacucuggaggcugaggcaugagaaucucuugaaucccgggggcagagguugcagugagccgagauugcaccacugcacuccagccugggcgacaagagugagacuccaucucaaaaaacaaacaaacaaacaaacaaaaaacaaaaggaucagcagugaaagagaaaccuuucccagaggcagccacuguuaccagcuccugaagugucauucuagaaauacucuauguuuaugaguguaugugcguauauauaggcggacgcuucucaucuaggcagauuuucacagcauccacauugugguccguggggaucaggggccuccugcuaagguguggguuaggcuucagguguuauguucuugcugcuuucgugucuugcggucagguucggcauaggcccucucaucaguaagagugaggcuucauuuuccuuuaguuccccuugaagggagccagcggcgcuguccauccuccuugccccucugcucccuuggcgugcccucucccagggauuuccucugucuuucuccuuuguuccccgcuccucuuucucguuugcuugcucccuuguuugggugcagcauauugacagcagcuuccuaacaaagaccuuugccuuuucuuguuauuuuacuuucauacaugguugauaguuuagcuggauagagaauuucagguuggggccaggagccauggcucaugccuguaaucccagcacuuugggaggccgaggcagguggaucacuugaggccaggaguucaagaccaucuuggccaacauggugaaaccccaucccuacugaaaauacaaaaauuagcuaggcaugguggcacaugucuguaaucccagcuacucgagaggcugaggcagaggauugcuugaacccaagagguggagguugcagugagcugagauugugccacugcacuccagacuggaugacagagccagacugucuccggaaagaaaaaaaaaagagaauuucagguuggaaacaauuuuuccuugacaaguuugaaggauugcuuugcacuuuucuaacuucugaaacugcuaagaaguccaaaaccuuucugauuucugauacuuuugucuuuuuuuucuuuuuacccuccuuugggaaagcuuacaggaucugaaauuggacacagugccuugguguaggccuguguucaucuguuucgugaggcucucagcaaguccuuccaguguggaaacucauguccuauccugggaguuucuugaaacauuccuuuucuugcccucuguuuuuuacuguucugucuuucugaaacuccuauuauuuaguuuuuggaucucuuggacugacccucuaauuuuuuucccuuuuucaccuauuuuccaucucuuugucucuuuucuucaguuucuagaagauuuccuuuuaucuuucaaccuuucuauugcuuugucuuauuguauuuuuuaauuuccaagagcuuuuuugcuccccaaaugguucuuuaaaaauguguguagcauccuauguuuucacugauguaaucguuucuuauuucugugagaaugugaaugccauguuugucucuaaguuuucuucucccugcauaguugguuuccuccaaauugcuuucucugcucuuuccuuuggucuccauccucuuugaaugaaucugcccagggaccuuugguugcccacucauaauuauuaggagggucuaaaaugcugccugggagcuggagcagguggggguccaguucugaguuuaccaguacaugaucugggcaggcuguuuguuggggaaccucagugucaacaccugggagcucaguuggggaaggggguagcaugcaaagagucacguaaccugccacccccauuuuuggcaagguccccaggcccucaacugugccucgaauuucccaguccagagaccccacacuuuucccuccccagaaaguaaaccucuguucuuccagggcuggagaggggaggucucuggcaugagaugggggagguaggggucuaacugcuauuuuuuuuuuuuuuuuuccugagacggaguuuuaacucuugucacccaggcuggagugcaauggcacaaucucggcucacuucagcuuccgccuccuggguucaagugauucuccugccucagcguccugaguagcugggacuacaggugcaugccaccacgcccaacugauuuuuguauuuuuaguagauacgggguuucaccauguuggccaggcuggucucgaacuccugaccucaggugauccacccgccuuggccucccaaaguguuggcauuacaggugcgagccacugugcccagcccugauugcuuuuugaaagcuuucagccugcccucuuuauacacggcagcccguucagcccauuguggaggugggaggccuggagcugcaguucccuggccuuuggaggauuccugguggauggugggaacccggguguucucagccugcuccagacccaggcugugaggucagcugacgcgagcugcgcuccagcuucugcagucauguugcuguugucuccucuccuguucugcccuuggggguucauagcuuuaaaaauauauauauauuugcugaagucuuagugggauuucauaagggagggagaaaaauuagaugcauaccugagacaggagcaggacuugcaugggcaaaagcugggacgggaaggguguucuaaugguagagggagugcucugagggagaggggcaggugcuaggauuucugagaacaaagaggaggcagcugggcugcagcuggagaauccgggaggcuggggcauggggggacaaggcuggacaggcagggugcacuaauuuugggggagguccccaaggagacuugaguuucccaccuacagacaguggggagucagagaauuaccccacuuuucaggaagagugccgucaugccuguauuuggggaugcuagcuaucccuaguaccuaauguggauugguagcuagagcugugguaaugaguaggagguuuuuacgauaguuaaguaguaagaagaggacauuucaggguccucuucuuagaaaugaaaagagggaaggaugugagggauuaaagagguaaaacugcccagacuucuugaccagaugguaggugagggaggggaagagcuaaagaagacccuaagcuuaacccuuggugaccagggagaggguggugaggaaggaaggaggaggugucugguuggguuugguguaugugugcaguuugggagggggagugaggggguagggggcgggggcuaaguucugcuauagaauaggcauuugccauguccaccaaaaagcgugauuuuacacccccacgcuucaaccuccaagugccuguguugauggagagagagaaagaagguguugagagcagggguaaagaaaucagucccuuagaagacaaaagaauaauuuuccaguuguuaaaugagauucucaaaagaauuuuuauguugauauccucaaagauuaauucauguugcagaaugucauuggaacuaccuuaagacauugauagagugccugucugcugucuuccuuagcucauccucauguuuugaucaaauuaaguacuuggacaccaggucuguaaaaaagaaaagagccuucuuuauuuggguucuguaggcaaaagggagaguggagaagcgacucugucuacgcugcuccccucacuccccgucucugggcccuucugggauuugcaugccacccacugcucugucaggaguggcucuuagggaagugaggaaagggccuugauuauaguguuugccaauuucuguggcauaaauaugcccacuguggcccgugucaggcuaccaacgugaugucauagcacagagcuggagucaggcaagcccgugggagugagucgugcccuggggucacaguggggguccucacugacacggugcagcuggacagcagaaucucaucuuucaggucgucugacuuguucuaagggucugucaggguugaaucaugcuugccaaguagcaucuuaaaagauauuuccacugcagcagccccagcccuucaaccugggcuucuguggccuucuaauucuuccuucucugccuccccuccacccacccccacaucaucagcagcagauccaacaugaauaccaaacacucacaguuaauacuaaaagccaacaauuuuuuuuuuuuugagauggagucuugcucugucacccaggcuagaaugcaguggcgccaucuuggcucacugcaaccuccacguccuggguucaagcgauucuccugccucagccucccgaguagcugggaagcugggauuauaggcgcccgccaccgugccuggcuaauuuuuuuguauuuuuaguagagacgggguuucaccaucuuggccaggcuggucuugaacuccugaccucaugauccacccaccuuggccucccaaagugcugggacuacaggcgugagccaccgcgcccggcgacauuuuucuuaaaguucaaucucucaucucugaugcagcucgcacucauuauugccauccuuggagcagcuguggcaaacgaguagcuuggaugucaguaggaagucuugucucuacaggcugaccugccuggacuguugcuuugcccuuuugguugugcguucuggaacgugaugccugugcuugucagccuugaugagucacauugaaaaagcucuuagucaucccaggcccuggcugagucaguguauugggugacaccuguggccaagcacuggcuguuuuacaacugagacugucccagaacucuuaggcacucuggucucaggggaaguguucuucaucuaguucaaggccagucuuucacccgagccucgcagccuuguucccggacucgccccaccuuuuauucucauccuuccuucuucaacuugucauucccucucaacuccuuccccuuccucuuccuauaacuugcuaaacauccucccaagcgucugccauggguauaacagagaauggauucaugccuagaauacauaaagauuuauuacagcucaguaagaaaaagacaaccagcccagcagaaaagugggcaaaugaugugaacaggcaguucacaaaaggaaaaaccuaaaaauauauccacaaucauaagaaaauagccaacuucaguaauaaucaggggacugaaaauuaaaaugauaccauuuuauacuacaagguugacagaaaucaaagucuaacaauauaacaguugguaaagauguggggagauagacauucuguuguauuucuaguggcuguguaaauuauuaggauaacuaccuugagacuuauuuggcaauauugauauuaaaaacuugccuauuggcugggugcgguggcucacgccuguaaucccagcacuuugggaggcugagguggguggaucaccugaggucaggaguucacgaccagccugaccaacguggugaaacccgucucuacuaaaaauacaaaauuagucgggcaugguggugcauuccuguaaucccagcuacucgggaggcugaggcuggagaaucgcucgaacccgggaggcggagguuguggugagcugagaucgcgccauuguacuccagccugggcaacaagagcaaaacucugucucaaaaaaacaaaacaaaacaaaacaaacaaaaaacaaaaaaacuugccuauuaggugggcacaguggcucaugccuguaaucccagcacuuugggaggccaaggugggcagaucaccugaggucaggagguaaagaccagccuggccaacauggugaaacccugucucuacuaaaaauacaaaaaaaauuaguugggcauguuggcgcacaucuguaaucccagcuacucaggaggcugagccaggagaaucacuugaaccugggaggcggaaguugcagugagccgagaucgcgccacugcacucaagcuugggcgacagagcgagacucugaaaacaaaaacaaaaacaaaaaaaaaccccaugccuauugucugacgcagcaauuccaauucuagguauauguccuagagaaauuuuugcacauuuucuauauggggucaaaguuauucauuuuuuaacacuuuuaaucgacuacuuuuauauagacacaaaaauagagcaaauaguauaaugaacucuauguaccugucgcccagcuucaacaaugaucauuuugucagccuauacaacacaguucuuaauugcuaaaaauuggaaacaaccgcggcgggggagguggcucaugccuguaaucccagcgcuuugggaggcugagguggguggaucgccugagguugggaguggaguucgagaucagccugaccaacauggagaaaacccaucucuccuaaaaauacaaaauuagccgggcaugguggcacaugccuguagucccagcuacucgggaggcugaggcaggagaaucgcuugaaccugggaggcagagguugcacugagccaagaucacgccauugcacuccagccugggugauagagugagacuccaucucaaaaaaaaaaaaaaaaagaugaaacugccuuauuuauuuauuuauuuuuugagauggagucucgcucugucacuccagcccaggcaacaagagugaaacuccaucucaaaaaaaaaaaaaaaaaugggaaacaaucuauuugucacugccuuagucugggcugcuauaacacaauaccauagguucauuaaacagcagaaaugcauuucucacaguccuaaagaccagaaagugcaagaucaagugucagcagauucagcgucuggugagggcccacugcccgguucauagaucacuguguucucacggacaaaggggaaacagaguugucugaucucuucugugaggcuucuaaucccauucaggaaggcucugcuaccagccgcuaaucuucuccccgaggccccaccuucugacacugccacauugguuaggguuucagcauaggaauuugguguggacacaaacauucaggcaauagcagucccucauucggcauguacagauugcgauaugucuaauagaacauugugcagucauucgugaaguaggucuacuguauuaacauggagagauuucaaauauauauuggguaaaacaaguuaaaaugauuauaucauuuaugaaaaaaauuagaacauaugguuaugggcacacaaauauccaggugaaaucaacaaaggggaaguaguaacucugcauugugggcccccugggagaaaaggagaaaaggacccggaaugguauuaggaagaaucacaaaggaacugcaccuguuugcagagugugguuuuuuuucccuuuugguaaguuuaacuuuuauuuuaucaaaauaauacaugugagacugggcacauuagcucaugcuuguaauccuagcacuuugggaggccaaggcaggcggaucacuugaggucaggaguuggagaccagccuggccaacauagugaaacccccaucucuacuaaaaauacaaaaauauuagcugggcgugguggcgggugccuguaaucccagcuacucgggaggcugaggugggagaauugccugaaccugggaggcggagauugcagugagccgagaucaugccacuacacuccagccugggugacagagugagacgcucucaaauaauaauaauaauacauguggacacuucugaaagucagauuguacccugaggcucauuugcccccgccaccccugucccacugcccuccccaugagugccucccagaggcugcccugcaacuccuguuccccacggcauugcucuguuuaguggucuccuuugauggaagauugagcucacuuuuacugcccuccccaucucaaacccugccccacacauguacccacuuucccucccuucacccugcaugguuauauagaaacacuuuuaaguacauuuucagaauuuacauuuuuguuuuguuuuguuuuuugagauggagucucacucugucacccaggcuggggugcggugucgcgaucucggcucacagcaaccuccgccuccuggguucaagcgauucuccugccucagcguccugaguagcugggauuacaggcaugcaccaccacgcccggcuaauuuuuguauuuuuaguagagacgggguuucaccauguuggucaggguggucucgaacuccugaccuugugauuugcccgccugggccucccagagugcugggauuacaggugugagccacugcacccagccaagauuuuacauuguuaacauuaaguuaauauucacaucugaaaauacagagugucuacuaugguggcauuaacuuuucauuuuccuggaguugauguucauccccagacaaguugugcguugccaucuccucuucauucuuucggagacaccagguaaucugccuuuuuguuuguuuauuuaaggccacauccccaggagcugcuguccaggugccuggcgggucuccaggccuguggacagcgagcgaccugggccucccuccccaucgccgugggaguucccuuugccuccucugugcuggcugcccaggugccuggaucccuugucuuccuuauucuugguuuauuuaguccuuuguuuuguucgugcccaucccugggcuucuugggcagacaggcucacagguggcacaccucccaaggccuggcgugucucaaaagauugguauuuuacccccacuggauuaguagucuaacuggauagaggacuccagcuugggaagcguuuucccuccaaaauuggaggacauuacuccagaagcuucugacuccaugucacugcugaagacaguugugugugacccuuggucuucagaagugugguaggcuggagauggccuccaaagguacccagguccuaauccuaguuguuaccuuagaaggaagaagggcuuuuucagaugugaugaaggauucugaccuggaaaggugaucccggaucauccaggugggccccgaaugccaucacaaguguccuuagaggacagagaccuaugcugaggagaaggcgauguggagacagagccagaggugggagugauguggccacgagcaaaggagcccggcagccauagaggcuggaaaagacucgggagggauucguugcaggcccucggaggggcgcagcccugcccucacuugguuucggccugugaaagugauguuggauuuuugaccucccaaacugaaagagagugggaggucucuuuuggcaucccaaacugaucuuucuucugagugggacuuuuggcaucacuccaggcgcuccaagaccuuuccacauggauacgcguccuucagucccgggagacuuuccagcaggauuccccugccccuggcucucucgucuccccuuccgggagucccaggcagcuggaugcuggacuugcuggacugagucucuuauuuucuuaucuuuucuccuauuuuccauauguuagucuuucuggguaaugucccaaacuaucuucuaauucucuauuuauuauguuuaaaaauuuugcaacucuauuuuuaauuuccuagagcucuuucuuguugccuuuuuaaaauagcugccgccucuuacuuaauggaugcaauagcuuuucuuguuucucugaggagauaaauuauaguuuuucugaguaucuguucucuauauuacuuuucuccucaauguuccuguuuuuuaaaaaucccaauuuguuuuggugaauuuuuuggucauuuccucaaauaucugguggugguucgcugaccguucacacugaaaaaugagacaccaacacccauuggcaagucuggguugggguggagcuugguggccccugguccucucgcugggagaugagacugggcucccuggggagcccacugcauaccaguagcugcaggacuccugguuccuggaacggaagcuuccaguucgcugccuggaaaagagcccaguaagcacucuguggagccgagaggaccuuccacacauuccccaacagccaugugaugccucaccuccugggccagcccugauggccggggcuggagccuuguaucuugggaaagacgcuguggcacaguggucaaaggcaggacccuagguucugaagccaggggcgugcaccguggcacugacacauccuagcagcgugccuuccugccuucgucucuggagcgggcugggaugacucccaggucucugcagcucagaacucuuuacacaggagacucacugucuagcugucuguucuuuccagccggauacucuucagguucaaagcugagucacuguuucuacccacauuggcuucgcguucuuuaauuugguguugccaucguucaccuuaaaacccagggccacccuucccugcugccucucugccucccaucuaaugggugcuguugaugccaccuccuaaguauuucuuggcacagucccucuucauuccuauucccaccaccgugguucagguccucauugucucuugcccacauuagaacaucuuccuagcugaccuucuacuucucaucuuuccuucucaaauccagcuuccccagagcugccacagugguccugagcucucaguugcaaaucugucucccugcugccugguauuuccauagcaucccgacauagaggacacugcccaagcugcugguggggcccacuagcucuggacugagucucaggcucagcccuuaggcuccucucccugccugcacucccugccucagcgggccacgccaggcuguuugcuuccugccuuaucugccuuugcuccagccgccccagcaccuggaccuccuccccuccucugccugccccccucccuccccucuucucccucuggacgucccuuccuccucccacccuggagucuuuccuucaggccaucuugcuaacucugcccugcucuccacgcaggcguggcccgccucaucauccuucacuucucaucucugcugccucucacucagccugccccagccagcugaucacagucccaaauagcgacaugcucugaaagccaccgcuguggccugcaucaggaugugcggaugagagggggguauuuuuaccaucauugugcuucuccagccccugguguuaggaucuguauaggaucugguuauuuguaggcaaccuggguguauuagauuccuacagcugccaucacagggugccaaaagcugggugaaaacaacggugacuucuugccucacaucuggaggccagaaaccccaauucaaggugugagcagggccgugcucucucggauggcucugggaggguccugccuggccacugccagcuucugguguuugccagcaguccuuggccuugccugacuuguagcugccucacuccagucauguggccgucaucuccugugucuucacaucuucauucugugugugucuguguccagauuucccccuuuuuauaaggacacuaagcauauuggauuagggccacccuaaugacuuuauuuuuacuugauuacccuauuuccaaauaaggucacuuuuuuuuuuuuuuuuuuuuagacagagucucacuguugcccaggcuggagugcaauggcgccaucucggcucacugcaaccucugccucccggguucaagcaaauucuccugucucagcuucccgaguagcugggauuauaggcagccaccaccacaccuggcuaauuuuuuguauuuuuugguagagauggguuucgccuuguuggccaggcuagucuugaacuccugaccucaggugaucagcccacuucagccuccgaaagugcugggauuacaggcgugagccaucgcgccuggcccaaauaaggucacauucugaccuaggugcuagggguuaggacuucaguguaucuuuuuuggugggggacacaauucaaccucuaacaccgggugacacccgcuuguccugagcuugacaggucccgaaguccccaaggccucugggaggcccucucuaauccagccagcauucauguccugucaucuuggaacgaggggaauugaguggggagcagguccugugaagcucuccagcaggggugggguggccugaagagggucgggaaauguccugggccaccugcaagugucugcuggguccuggcaucuuccucccugcaaagauuguccaguucuguuuagaauugagucuuuggugccccuagccucugucgccccucgcagcccugaaacucagcuucccugguucccauugccaggcugcgucugaguccuuuugggcuuuagugacaaaauaccacaggcuggguggcuuuuaaacaacagacauuuauuucucacaguuauggaggcuggaaguccaagaucaagguuucaacauauggguguggggggcacaggcacgcucugcauuagucugggaggugcuuuuugcugaccuuguccuucagacccucucucuguccugucaacaucacuuugggcucuaaucaauauguaugggacauuugugugucccacuagugugugugugcuguucccaggaggggccaagccuuacuaaucuuuaucugaaugcuccauaauauuucuagguaaaucuuuuuuuuuaacuaauugauuaauuauuuuuugagacagagucuugcucuguugcccaggcuggagugcacugggaccaucauggcucacugcagcuucaaccuucuagguucaagcaauccuucugccucaggcuuccaagcagcugagacuaucuaugggcaccaccaugcccagcuaauuuuuuuuuuuuuuuuuugagauggaguuuugcucuuguugcccaggcuggagugcaauagcacgaucucagcccaccgcaaccucugccucccacguucaagcgauuuuccugccucagccucccaaguagcugggauuacaggcgugugccaccaugcccggcuaauuuuguauuuuuaguagagaugggguuucugcauguuggucaggcuggucuugaacucccaaccuuaggugauccacccgcuucagccucccaaagugcugggauuacaagugugagccacgugccaggccacacccagcuaauuuuaaaaaguuuuuuuuuuaauuuuuuggcagagacaggaucucaauauguugcccaagcugaucucaaacuccuagacucaagugauaccccugccucggccucuuaaagugcugagauuacaagcaugagccaccacgccucacggugaaucuuaacagccucaugccacucugcaaccucauugugaccugaaguauuucuucacugauucauucccucagacauuuauuuaguucuggucuuacgcacuguacagagugccagggagauguggggacaaaagagaccagggauccugugcccagggcccuaacagugucuauuaaaggagacaagacgggucaacaaaucuuuauaacauuaaaugcucuuugcugaggacacagacgccacggagaccucauggagagcccccugagcaggacgauggguggggcacagacaaggacagagcugagggagguggcugcccggggaauauagggaaggcauuccugagccuacuccuauaggauguggaggaauggggacaagugaccuucccaugugagcccugcccacaccccgugcugcagggucggcaggaagcuggcuccucgugcgccagggggcaguguuggcccugaaauucucacugcuuuccagugaggcugggauggagcagccaccucacugcaggcccucgggaccccucacucugcuuucucugagacccccuuugucccccaguccacaagucccgagaccauggcgccagucgccucggugccacccuuucccccucggcugcuccuuugaauagaggguugccagggcgaugaggagcccugcuggcacuguucacugcuguucgucgccgcagugccacuuggagcagccggcgcuccugggggcccagagcccggacagcugagccucggcgagcacccgugcugugucuguuuccgucuuugguauugucucucuccugucuucugugucugucaccugcauuguuuccagcguccucccuucugcccccccugcccagaaaucucagccucagucuguccucucuugggugcuuugauaucagccguggcagcccugagagccagguggagucguucuuucaucugucccucuuggcugccagcccuggggcccgucggacauguuuagagcagagccgccuggggagagcggccccauccgucagagcugccaccgccgcagccccgagugcucugccaagagcucuuucuuucugguucugaccugcuuucacuggcagcuguggagcccagcuggggcuaggggcacagccuggugcgggugcuggugcugggggcagcugggcccauaggaaguagguguguggagcuuuguugguucggagguuccuggggccuguuucugaaccacacuucuuucuucucugcccucugcugcucuccagcacaccucugaggauuugcugagggacccaggugcucugcugggcuuucagaaccaacuugcuggccacccgccccugaagcagggccuggucuuucccuuccucugcggccucuugcccacugcugcccucugaggcugcaggagacgcucugugaggacaggaauauguaggacgaagcgauguggggccucagcugcagcagcucuuagguggcgcccugcccugguccccagaaaggcugcugagcacuggggccacguuguugucuggaacaaaacuugggggaugauggccugacagcaggauucugugcuccuucugguugcaagaggcauccugggagauguaguucaggucugaaguagugggauuucagggacauuuugaugauuuauuagacaaauugaaacugccuuggcuuaucugggacaugugacugcugacauuguucgucagcucucguugggaagcucugagugccacugguggcccugcuggaggccaggccagugacaguuuuaucagaagugggguuuuugguuuugguauuuugguuuccaagugccugucacacugugcuccugaugaaagccgugacuuacuccuuuaguugagugaagaguccauaggccaacucugauggguccgagcuccugcucuggagggggccauaugaagcgggcuccaggccggcucugcugguggccugggugugucacuuaaucccacugcaccuggucccuuaccuguacagggaggugaugaggggcugugaggguuacugagugagucugcgugaagagccacaguggccccugccuggcaaggagcaaggcucugcuggggucacugcccaccauugugcccuccuccacuggcacuggccgggcaccagguggagcucagugaguauguguugugugcuauggaagcggcagcucugucaggagcggggcaggugacggccaggcccucgcccugccucagccugcaggucgucguaggugccuuccugacucccuucuggaaggggaaugcugaguuauugaucugaagcugaagcugggagggaaauggaagcuguggagucacccgagaggcagcaggggaggaagcaggugccccacacacuacuggcuucacuguggcucauucuugcuugcaaggaguuauuuacacgucccaagugacagucaaagcugucuuauuucuuggucucuuaugcacaacccgaggccaagaaaagggaucugucagcuggcauuugcagaaaauagcaagugggucucugggcugucagcucucuggagaggaaaacagggugaaggaucuuugggugauggugguugcuuuucucucacucacucacuacuguuuccccauuucugaggucagaaagggagagcuuugcuuguguguaucaccaggagcaagcaagacaguggcaucccccgaggcguguaacuguaaccugagcugguugcuggcccuggcagcaucccagaaugcccuucacaccuggggcucuagcagccucccuugaagaguugcggcucagcucgagggagcaggaaacggcucuguggguucuguuaguaaagcccucugcauuuccagggaagcuucucagccaaacuugacaaccuugagaacuucuugauugccauccaccaaccaaauacccaaaagcagggugcagcaugggacugcagcaugggacugcagcaugggaccgcagagggagccuggccccagccauugcugcccccugcuuccugugccuggccaucgccuauucugugccgugcugugaagauggcaggaagugccuggaauggugccagccagaagggcugcagacugguggcacuugcugggaaugugccauugugaguugaaaggcuggcauacuccagugucugggcuugguuucguacagccugaggaccgggagugucauuaauaccagaggcaaggcuucugggggucucaggaaggccgucucccacccucugcugccacuuccgagggucaccauaggugccuccagcugcagggguuccuucuucuauaccccaagugcugugcagaggccccugcucccuucggcuuuggggaauggucuaguauuggggagcagggggagucugcccacccagcuccucccuuugaaccaucccagaccccucaagcucagcauacccagagucggcuuauuccaccauaaccuugaagacccugcuuccuggagagaggguggugugagggggccacgcccaucuuacagugcgguuucucccagccgauguugauucuggaaaggccuggguuucagaucugggaaggcagugccauucgauaaggaaaaacuggguuaaccaaguucuaggaagggugcaggcgcccugggaaugcagugguguuucaguucaucuuuaugucuguugggccccauccgugccuggcauugugugcgggucagggagagacagguugguggugggggucuugugugaccacagcggugagcuuaguuucagggccauaacuagguucuaaggagcagugcagcccucacccuccgucauucacagcagcuccugacagccuuccccagccccacacugccugcuggccaacauuuccgugucuuccgccucacucggcagcacaucccaaauccaucacagaaaccugcccucccgucucugacugccuccugucucagaccaccucccucaucaucuugccaggucccuagggggccgagggagcaggcugugggcuguggaucagcuacucucugcgugacccaaccucccgccucccugcagccagcggcccaugccagcuucuaggccucagguucacagccucuaggcucacugcugccccuuccccugauugcagcccaggccuccagcagccuuguguuggggaacuuuguauucugggccaguaaccucaggcagaagagcagcugucuguggcuccucagacacccuccucugugcacugaaggccgguacagggugagugcucugggacaggugccccccucucugcaacaccugacacucccaacuacuuuuguuuggggugggucuuccuuugcagaggaauguuggggacagguuucugcauuggcaaaagcacgugguguccucgggccuguguguuugcuccaaguguaugugggcaucacaccugcuggcuccccuaugcagugaacucugcuaagcauugggugcauggucagccuggcuuggugggugggcugccugugcugccuucaccccaggacggccuggccuguggggaggucagcauggagcugcaucauggugcgagugggagggcgcaagugugugggccuuccagcuguguggggccgggggcuuccucccuggcccucuguucaucugggaggggagggaguugggaagauagugacagcagcugauguuugucacccaggcauggcgcuuuagcuguacugucucagucgacccccaggaugaccugcuuagggugggcugguggaaccccguuuuacagaugugaaagcuggggccucagaggugcccaaaccauggagcuggggcagcccccggccaguggacugugggccugcgcugggcugugccccagaggaggcuacucucuguuccacuuuucccugcucugacuucagccgaagagcccugaucuuuucccuuccauaaacaucugccuggcaugcugccacccaaagagcucccgugccccggggacaguccucuuggccucaagucuaggccugcuuucgcuucccucugagggacacaaggacucacggaggcauuccugugccccccgcugcccacagccuccggcucuugguggagugggacugcuaaggaauccuuuacccaccaagaaaaaaugaggauccaaugcaagaauguaugugagaggggccgccgagggggcggcaacaugucagcacuccaucauuuuccugccugagcuaagcagacacuugguggccacgcuguggggcagggugcagccuuccagaggcucuggaggugaccggccuuuggcauaucuucugaggaaaucucuuucuuugcauggaaaaggcaguggggagugagugugguguggacaggggaggagagcaacaaaaaugaccuguuuacccacaaaccacggguaagugccccuguggucgcaggguaaacccacccaggugggaggaaaggacuggggcucccuggaaaaagcuugaaacugcccuggagguuugagaaucucggugccagugggcugcugccagcugugaggcugcucaccuauaggcaggccagcaggugaggagggggagggugcuaggcuccugggagacacauagccaaguccucccacccaaggagucgguguagcaggagcucccuucgccuuuuccugcggagcucuuccugucccuucuguauauuucuucuuuuuuuucuaauuauaaauaacgcauccccaauggagaaaauauggaaauuuuccauauggaaauauagaaaagcauaaagaaggaggaaaacacaacucuacagcaauuccauagcacgugggagugaggaggguggcaugcaagcaguccuacaguuguugccauuccuuuaaaaaaacuucaugagaucauguuguuuaccauuaaauuuucuuggcuucacauuacaucacaagcauuucccaugucaucaaaaccugugcaaacacauuauuguuaaugguuacauaaugucugugggagccaggguguggaaucuuuaaauugcuucucaugauuuucuguuguaaauaaugcugcuuugaacaucuuucugcguacaucuugguucccauuuuggaauauuuccugggguuggauuucuggaauaguaaugacugggcucaggggcauaacccgccaccaugccuagcuaauuuuuuuguauuuuuuaguagagaugggguuucaccguguuagccaggauggucuccaucuccugaccucgugaugcacccgcccuggccucccaaaguguugggauuacaggcgucagccacugugcccggcuuuuuuuguuuuguuuuguuuuugagauggagucucgcucuaucacccaggcuggaaugcaauggcgcgaucucggcucacugcaacuuccgccucacaggcucaagcaacucuccugccucagccucccgaguagcugggacuauaggcgcccacuaucaugcugggcuaauuuuuguacuuuuaguagagacggggauucaccauguuggccagggugguuuugaauucgugaccucaaaugauccgccugucucagcgucccaaagugcugggauuacaggcgugagccaccgcgccuggccgggcauaaauaccuuaaaggcucuugauaaguuuugcaaacagcuucccggagaagcugccgugaugcucagcagugccugcgggccgccuccugaaggccuuccuggcgcucagcacugcauuuacaaagcucccaggcaggaguggcaccucaugguuguauuuugaaucucuugcuuucucguggguucaagagccacuuguguuugcugucuuguugcugugcuugucccgaaggcuccccucgccucuuccugacuuugcccuaugugguaacuugagcucuuuugacauggccuuucccagcgcucagcagaguagacauuuggugcccaggaggagggugagauuuacaccccacaccugcucucugaugccagugccgccugcucccagcugggaaagaccuguccuccuagugggcagcauccgauaacucgccuggagcagggcuuagaggauuguagaucugcaugugggagauagcagggugauaacgucugacguucauccugcucugagcagggugucuccacaccugagcuccucgcuggugcucccggcaccucuugagcagcaggugcuggggcaugcacucccuaagguuaucuccuccagcggcauuagcgguggguaugguucuuuucacuugucaauuugaaaugauuucagacuuucaguaaaguugcaagaguaagacaaagaauucucguaccccugaccccaguucccccaauacuagcauuugcuucauuguucccguuuuucccugaaccaugugaguggguguaaauugcagauguggugcucguggacccuugaguuccucaguguuuuucccuaagaaugaggcuguucucuaacauaaccacaguccacugaucaagaucaggaaauugauaucaacgcaauccucuuucaaaccugcagaccuuauuuaaauuguaucguuguccccugauguccucuuagcaauagaaacccggauccaauccaggaucguguguggcucucaccauuguugcuuuggucuccuuucaucugaaaccguucuugcgucuuugucucucacgaccuuugacauguuugaagaguccaagccaguuauucuguggaauuucccugaauuugaguuugccccuugcuuucuccugauuaaauucaggccgugcacggcagcgggaaccccaucaggaggugugugguaucccuucggugcuagugauauuaaccuucaucucucggucagcgugguguccgccagguuucuccacugugcaaugaauaaggacaagguauauuuuagaaagaggaggagcccagaguccagcaagguuacucuacccacguucaccauagccgggugugaccugggugccuccuggucaccgcaguggccccuucccagcccccaucuuacccugccucugggagucaugcucugcccaacucgcgccccauccuccugagagccgcucgcuucugcccagcgacccgugcgucccucccuccuccaggcauccccccugggcuccuucuuggcucuuccuccucggccagacucaacuccagugggccugaagacgcaggccugacccacuucucccaggcuguucucucccuggcuucagacaccaccgccccugugaugcugcccagguucuugucccugcucuucccccucugugagcuugccucacucccagcccugccuuuucugucuugcccuucuuauagcaggaaaagucaucuccacccacccauacaggauuucuuccucuaccuugcuuucuauggggggucucucgacgaaucuugucugucauagcccagauguuuccuaagccccaccccgacccccauagcuucccccugucagaggcuccgcgucucucagcucagccucugaauugccccagacaugcgucgucugucagccccugcugcucgccaguccagagagauccuuuccacugugcaucgaucaugucccuccuguccuguccauggcugaagggaggccucaaccacugggcccugucuguggcugcagccccaccucaggccgugggcucacacuucccucucucaggacagcaccaagccuguucuuccugagaacuucacaauugcuaucccuucuuccuggagcuuucucugcggaucugugcguggccgacuucuccccauccaggucccagcuucuguguccccuccucagagaggccuuuucuaauauccagcccccaaaccccugcacccgccccagaucauucgcaaaaugucaccuguuucuuaucuuccaggcacuugugaucugaaauguucugauuugugucuuguuuuucuuuucuuugcuccuuucacugccauucaucuuccaugagcagaacccuucacuguuguguucucgacuccuaaggcuuagaacugugccuggcauaaggucugccccuagugggguuuucuguuuuucuccccuggcugugggucuuuccuccuccuccucuucucuuucuucuacuuauuuccuuguuucuucucuuuucuuuuucuucugucuuuauuuccccuuuucuagguuguuggcuguaauauggcacuaagguuuuugcaauauuuguuucauuucuugaguauguuuuuauguuccuuacuuaaaacaaaauggcugagucaaguguuuuaaacguuuucuaagaaaugaaucagaucggccgggugugguggcucacaccuguaaugcuagcacuuugugaggccgaggcggguagaccacuugaggucaggaguucaagaccagccuggccaacauggugaaaccccaucuuuauuuaaaauacagccaggcguggugguucacaccuguaaucccagcacuuugggaggccaaggcagguggaucgccugaggucaggaggucgaggccagccuggccaagauggugaaacccugucucuacuaaaaauacaaaaauuagcugggcgugguggcgggugccuguaauuccagcuacucgggaggcugaggcaggagaaucacucgaacccaggaggcggagguugcagugagccgagaucgcaccauugcgcuccagccugggugacagagcaagacucugucucaaaaaaaaaaagaaaaaagaaaagaaacaaaacaaaaacaaaauuagccaggcaugguggugcaugccuauaaucccagcuacuugggaggcugaggcaggagaauugccugaaccugggaggcagagguuacagugagcagagaucaugccauugcacuccagccugggcaacaagagcgagacuccgucucaaaagaaagaaaugaaucagaugguuagaugaggcccagaugcaggggugaaaagagugugucugguuuggcuugggcucugugcugggcagcugucuuuuuagucuccacuguaccuugguuuccuucauuuuacaaaugaagggcuggccaaccucugaagccucuuugcauucagggauauaaguugucgucaguugauuuaaauauauauauaauauuauauaauauuauaauauuauauauaauauauauuauaauauauaauauaauauauaauauuauauaauauauauaauauuauauauuauauuauauauaauauauauuuuauauauaauauaauauauaauauauauaauauauuauauauauuuauauuauauuauauauaauauuuuauauuuuauauauaauauauuauauauaauauauauauauuuuuuaaagauggagucuugcugugucacccagacugguacaguggugccaucucagcucacugcaaccuccaccucccaggcucaagugauucucaugccucacccucccaaguagcugggauuacaggcaugugccaccaugccuggcuaaguuuuauauuuucuguagagacaggguuucaccauguugcccagguggguuucaaacucuugagcucacacaaaugugccuuggccucccaaagugcuggguuuacaggugugagccaccgugcccaaccugaaguauuauacuuuuuuuuuuuccugggacagagucuugaugucacccaggcugagggcaguggcgcaaucucagcucacugcaaccucugucuucuagguucaagcgauucucgugccucagccuccugaguagcuagaauuacaggcgugugccaccaugcccggcuaauuuuuauauuuuuaguaagaggcgggguuucaccauguuggccaggcuggucucgaacuccugauguaaggugcuccucccacuucagccucccaaagugcugggauuacaggcaugagccaccgcgcccaaccugauacuuuuauuuuuuuugagacggagucuugcccugucgcccaggcuggaguacaguggcacgaucucggcucgcugcaagcucugccuccuggguucaugccauucuccugccucagccucccaaguagcugggacuacagaugcccgccaccacgcccggcuaauuuuuuuuuuuuuguauuuuuaguagagacgggguuucaccguguuagccagggugggccaaccugauacuuuuaaaaguuauagugcauauuaugcuggguacggcagcucacaccuguagucuuaacuacucaggaggcugaggugggaggaucauuugcgaccagccuaggcaacauagggagacccugucucuacaacaauaaagucacaguuaggauaucaggcugagcuggggguuccauuugggguuggauuugcucccuucucuagagccaggaaauguugggcuuggccaggcaucaggagguagauggugcuagccuuucuguggggccacugugggguugggaagggcccucacucauucugaggagccucagugcugaggcugcgcuaaccugggcucuaacuucccucccuagaugcugaaguuccgaacaguccaugggggccugaggcuccugggaauccgccgaaccuccaccgcccccgcugccuccccaaauguccggcgccuggaguauaagcccaucaagaaagucaugguggccaacagaggugagcaccaguggggccggugagaggagccucauggccgccccagccuuggcauucuucucccacucacugccccaggcccuggcuucccacuccccuuucugcuucuccuaggaccuaggaaucuaacuucuuguuucuuugcccucuaggugagauugccauccguguguuccgggccugcacggagcugggcauccgcaccguagccaucuacucugagcaggacacgggccagaugcaccggcagaaagcagaugaagccuaucucaucggccgcggccuggcccccgugcaggccuaccugcacaucccagacaucaucaagguggccaaggugagcccaguggccuggcugggccuggacagcagggaccagggagucuuaguugccgcgggggucucuugaggcuggcgugcucagcgccucugugcguggguggguaaacggaugcagcucagcagguuaggcaggggaagaggcuggccgaggccuuggaagggacugcaagguaccguccucucccugacccccaccugcaggagaacaacguagaugcagugcacccuggcuacggguuccucucugagcgagcggacuucgcccaggccugccaggaugcagggguccgguuuauugggccaagcccagaagugguccgcaagaugggagacaagguggaggcccgggccaucgccauugcugcgggugaauauaacgggcaagcaagggguggccccgcagcuccuggagaggguccagcagggagggguggcagggauucccgccuguuacagagacucccccacaccuuucucccaacagguguucccguugucccuggcacagaugcccccaucacgucccugcaugaggcccacgaguucuccaacaccuacggcuuccccaucaucuucaaggcggccuauggggguggagggcguggcaugaggguggugcacagcuacgaggugagugaagaugcccagggcugggagcagggcagggcagccugccgugggggcaggggcggaccacucaagggaucuggaaagugggugggguucauggcaggggagagguagcgcuguggggucugaggucuggcuggccccugcccgcccucgcaggagcuggaggagaauuacacccgggccuacucagaggcucuggccgccuuugggaauggggcgcuguuuguggagaaguucaucgagaagccacggcacaucgaggugcagaucuugggugagugguccugacgccccgccuggggcagcuggaggcgggagcugagaggcccaguccuggugccgucacaguggcuggccuuggggacagcccuggggccugucgggcgcuuuuccagaggacucuggaaagugggcucuaggggccgagcuggcaguugguccucacagccuuggugaugcuggugucucuccuggcagccucuguaccgcuggcagccggcacugacuggcgacagugguuaugugggggugauggggcauuuaggaggcguguagauuccaguaaaagcuaagcccaguuuaccucccuccccaggggaccaguaugggaacauccugcaccuguacgagcgagacugcuccauccagcggcggcaccagaagguggucgagauugcccccgccgcccaccuggacccgcagcuucggacucggcucaccagcgacucugugaaacucgcuaaacaggugaagggugggcuucccguguugggacaggagccugugcucacaggccggcaggccucacaguggggcgcugguuggggaaggggacccugaguccccuucuggggacuggggauggggagaagagggugaaggacucuccugggggccagaaguggguuuguggcauccuucccaugugcaguugaggcaccuggcccagaggccaagcuuagaguccaggauggcugagaagagggagggaaggagccccagccgccuccucagcccugcugcuacacagaccuggcuucucuguggcaucagcucaucccugucaucaggagaaugagauuccguggauucugucaagauugaggaccauuaugaaggcaguccucccucaugugcuucugucuccuacaucauguuuauuaugaucuguuuccuugcucugcacccucugcccaucucugcuuuucugggaccucuggucgggggguccugggcuguggaggaggcugagguggcaagcuaucuccccacagugaccugccccaggacuggccuggagagcaccugcuguggccaggugugcagcgggguccugcccccucuucuucccuggccuauaggcagcagaggaugcgucaccuccccaugccgaaggccggggugugcacucugcagcaaggccucagccacagcuaaugcgaggcaucgaccagggucgcguuuaagucaggucuuauuuacuggcuuauacuauuucacauuccagaacagguuuaagggaggugauucagucugguuuaucguuuuggugagaccaaaagugaaacuggaauuagggcugaaauuugaguuagagucauuaucuguugguaccucucaaaugaauuucuuuggguggugguggccagaggugacugcgcaguagacuagaaggggacuuucugaaaacaccuccaagcagaagcagcggcugggagaggccugggucuccgugucuggguggaugacacagccuuggcgggcaagcccaggaggcagcagggcaaggugccgagccugggaugggugggggcuucugcccaugucucgucccagauaagcugggugcagccaucuguggcuccgggaacccuggagccuaguggacuacuugggggacguguccaggcaggagcaugaccugggcccuggggucugucugccaucugugggggcaggguuugccacaggccauucuuuuacggaaccaacccaaugggugggacggaaucccuguccugaguccagugaguuugcccaggcccugccugugcccuccccugcucacguggccgcccccacaggugggcuacgagaacgcaggcaccguggaguuccugguggacaggcacggcaagcacuacuucaucgaggucaacucccgccugcagguggagcacacggucacagaggagaucaccgagugagugugggcgggcaggcggggcgggaggcgcggcuucuaggauuugcauaaaguacaggcgaaguggcuccuggggccagccagggggcuugcucacuccccacauugguggagagcaauggggauccagguacuuaguguuuuaaaagucauuauucuaaaagcauuacgugguuauuauaaaaaucagcacaaaggagcaaauaaaaaugacugacagcccuccucucugucaggacgcugccgauugcucaggcccaggugcucccaucugucagaggaguaaagcaaggcucagagacauuuggagaguugcucggggucacacagcuggcgcuggaacccaggcaucuccggcugucuuugguuugcuccuuucccgguuuaccuguuuuacuagagacauaguuugaugcaauagagauguuuuauauagaauuuuuauucuacuuuucaaauuauuuaauauuuguugaaggcauuuccccaggccauaauucugucugaauacuuuuaguggcugcguacuauuccgucuuguguguauuucuuaacuuacauaguccucgauuguuaggcaauuaguuugugugucuggcuuuggugguuauuaagcgugucacuuaucaucugugugccugaauguuuggcuucagcucugaagaguucugaggguaaacccuucaacaggauuaucugauugaaggauaaguagcaucccucggaacagcccucuagagagguggcacuagcgugcucccugcaggcacugaggaugacauuuucaaaauccgccugguuucuaaaugacagucaugauggcccucacccuucaaggucucuacuaugagccauguaauuucuugacgcugcuuugggccagcccaucucacuguggagcaucccugaccccaguucugcccccagccccaaccccaccugagacugaggaugcugucgggguggcugcuguggcucgccgggggcauggaggccccucccuccccuuaggagaagcuuagagacaaggccaacacuuuggccgagugagacucuuccccucaagcugcugugaacuccucggucuugggucugcuuagagcguccuguuagggaugggagucugucugcuguggagcacggguuuugugucagacagauuggggcucaggugcucucaggucccaagccacguggagccugggugagcuccaaccucucugacccucgagcuccuccucuggugggaaugacagggcucucagcacaccgucguggagaugaagcaugggaggagugcagccuggccuguggcacugaguggaagcugucaucucugcugcgaagugggccagcaggcagcaagaacacggggaaauccugccaguguagguuccaggcugccuucaccacaagccucaguggcaauacauguaaaaccuugagugguuuuuuuuaagacauagucuugcucugucacccaggcuggagugcaguggugcaaucuuugcucacugcaacuucugccucccggguucaagugauucuccugccucagccuccugaguagcugggauuacaggcacacacuaccaggccuggcuaauuuuuguauuuuuaguagagacaggguuucaccauguuggccaggcuagucucgaacuccuggccucgugggauucacccacuuuggccucccaaagugcugggauuacaggcaugaccugcugugcccagccugguuuuuuuguuuguuuguuuuguuuuuuaaacagcuguuccacuuggacuugugacugcccuuaggagcaguaaggcugagcuuggaaaacccugcagagguggggaagcuugcacucuccaagcaucucuaggggguuuugggcacaaguccagcaggaaaacaggccucagaaggacagguccugacccagcacccacugugcaacccucucacagcugugguuaccauuucgaggagcccagccuucacagcaccuguucccuugcacacugccccccucacaaccacccacacagcauagcacauauggccccaagaaugugcuauccuggcccucugaccuagagaucugcugaggcuucaaaucuaggcuuuaccaagggggaguuuaggggaguggggaaaacagaccucaaggaaggaggaggcagaguacagggaggagcagcuuagggcuguguggacggcaccgugagucaggaaugcaggagcaggugguccugguauuucagcgggccaucuccagcugccaggcacuguguaguuuagucggcucccggcgggagcagggcaggggcugguggagccacugguugggaggaaccggcuguucaggcuggcccagagccuaugggcaggagucgcacuguguguggacgccccacuggcugcggugccccucgucuaucccccgccucauguuucccccuuucucccguccuuuccccccuccccccaaugcccuacagcguagaccugguccaugcucagauccacguggcugagggcaggagccuacccgaccugggccugcggcaggagaacauccgcaucaacgggugugccauccagugccgggucaccaccgaggaccccgcgcgcagcuuccagccggacaccggccgcauugaggugggcggagcucgagcagagggagaugccagcucaccugugcacagguucugccuggugccuggggcugcagugccaaguugccacagcccggcaguuagggaggacccgcaugugggcucugaaguggacauagaguacacggaggcaggcagugcccagaggaggggcggcgccucccaggggaagagacugcugggcgcccaggucaggaggaagccgugagggugggagcggggagcaggcuggcuugguggagcaaaacgcagggacccagacacaaagccagccccugacccuccagcucccacaggagccccacgccuggcugccgacggagcccaagcaccaccucccaucugagggaugggcugacauggcaggaccuggggguggggguggcaaaggacugggcccagaggucccaauggagucugagccaagcucaggggcccaucaaggaugggggagggagucggagauggcggcacaggagggagaccgagagguagauucggggccgcgagauggcagccuuggugggggagagagugguguagggggcgcugaggcgguccacggcaggcuccucagcacagcaagacucgcgccuucuccaggagggcucccuguaccuuucuuccucucagcaccgggacccagucauuggccuccgaaacccaucucccccgccucuggucccagcugugggcaggagcccugcggccugcucggugccuguucccagcccugcacgugcugccagcaccgugccagcugugcuagggacuugcucccuauccaggggccugagccccaaaggaggcaagacauugauggagcuccagcuuugcuccagaguccaaggcagaggcccccgggcuuguguggggcggugaggggagcaaacaugaguuugggccaggcucugggcuucugagacaagggaggcuggggaggcuggggguagggaccagagcucucuggauucuggaagcagcagagccuguggcuucagcagggagcuggccaccugccuucuguuucuggaagagucuguagguggcggcagccccaggcugagugcugcccggcggccccugacuucucugccucccuccauccccacuuccaagcccuggcucuucagagccugccucaucacagaguauuuuuagccgacaguuucugcucucagcugaguguucacccuuaaauauuuuaugaaguuccuuuuuauugaacacaggccucugcccccgagaagcggaaaugggcagugggugucccgagccccucugggcgguccccccacuccccuucuuccuuaccugggccugacgggucccccaccuccggggagcccuucucugcggggcucacucgggcggcacgaacaggugcaggcggcacgagccaccugugugugugagugucggcgccucugucuccuccucuccgcugccccucccauugccgucuggcccuggcccugucccgcugccccgcugcccucuccucgcccuugguuugcuucccugauggguguggacccugccucuggcacuuucccuucauuuccucucccacuuccuccucguugccuccucucccucccauccucccuucuggaaggaaaggaaaggaaaggaagggagcauggguggauguugaggccuuccccaccacccuguuaaaaacaaaaacaaacccccggucagccuugccucuugccucgcacaugguccuuuggaggcccugucgccggccugccguccccucgcugucugggagcccacggcgaggcccuuuagcggccgggucagcagaccucaauccgugcuguggaacgaacguggaugagucugaaaggcuagaggguugcucaggcaggugcagcagguccgugggaauagaggcagggcuggccccugccugcccgggccccucucccgcucugcggcaggcauucccuuccuccucugcccccucccagcuccucacagggagccaguagcagugacugcguggcacguagagaagggacgcacuccuggguuugguggcagaaacagcaaaaccugaccagccagagcugggauucaccugcagacaccccacgcucugcucucagcagcugcugggugcacaccuggccagccucgggguggguggggcacuuuugaccgcaguuucuggcgcagguccucacgccucacccuucccacagguguuccggagcggagagggcaugggcauccgccuggauaaugcuuccgccuuccaaggagccgucaucucgccccacuacgacucccugcuggucaaagucauugcccacggcaaagaccaccccacggccgccaccaagaugagcagggcccuugcggaguuccgcguccgaggugugaaggugagaggcugcagcccccgccugccuuugcucccggcccuuggagggcccccugaccguucacuuccccaccaagggccuugcacauggcuucaccucagccuugccccugacugaugggucgaggucaguggcucuccuuggcugcagcugcacgccagacuccagcuguuuucagagucugcaggcgccugggcaacccgcugccagagucccuggcaguggccuggccggagcucguccucacaugccuccugucuagucuuguuccggggagacccacgcugugucccgccccucuggggugagaaucaccuggaauguguguuaaauaucaucaggcuucccuucuggaaauccugaucccacagguuuggguagaggcgccagaaccuguguuuugaacaaguucuccagauaauucuuuuuuauuuuugaaguggaaucuugcugucgcccaggcuggagugcaguggcgcgaucucggcucacugcaagcucugccuccuggguucaagcgauucuccugccucagccucccgaguagcugggacuacaggugccccccaccacgcccggcuaauuuuuguauuuuuaguagacgggguuuuaucacauuggccaggcuggucucaaacuccugaccucagguguuccacccgccuugaccucccaaaaugcugagauuacaggugugagccaccgugccuggccucccagauaauucuuaauuucuggaaaauguggauccccccccaccaggcaagagcccaagucauguagaugcggucacuuugcacagugucaggcccccgccagcccccugcucuccucaccuggccuggugcacacagugucaggugcuucaggagcagccgagggugggggcgcagcagagacaugagcaggaggcuugggaggcaaccugcccuuggugggcuggcagcucggcuugucuuuggguggccuuggugggugcccugccuggcaugaggacucuaaauggguauuuaggaucuaaagagcccuuugcugggcucuguuacuggcgucuguagcuagagaggaauccacagccaggaaaugccgccucggccuuugaagccagcacgugucccgugggagccacccucagaauggcaagaagagccggaggacaggggcuuuggcccucagccccugugggaguuaccaccccaucuucuucuuggggguccccacagggcgggcugugcugggcacuggcaccggccccucugccuuggccucguguccuccuugcagcuucuuccagcccugccugucaucgaggcgcaguugcuugggggaugggggggcaugugggccgugcuguccccucaggguccugcaaucacuucucacauguccacauggcugcuuggucgcaagagccccuggaggcuucugggccuaugccuguguguguggccagccugucucccaccuuaagagggaacagcgcacuuccuagaggccaggggguguuacucuuccguggggagccucucagccucccuguugggggucccugucgugcacauaggcagaggugugucgcgacaucagcugucgacaucacgcgcucccccugcaccuugcugcggcuccugguguccuggcggggauguccugcggcugcuucgguguugaggggaugcguggccaugcacaggggugacccaggccaucccccucgccugccccugcccguugcucugugguccuggcuggcuccugggguugugcccgguuccucugcucccuccucacccucagcagcuccccacgugccaagcuggucccugggcccuagaaccuugcgccugcuaggggugcagcuagaggugggcuucugcacccuggagggcccggaaagaucuuccucuuuagaccgucccccgccccccagguggagaaaggggcacuagagaccgugaccacggggccagcagcaggauaagugucucuggugucugggggugccaaguccuccccaaaugugcaccaagaccaggccgcuggcucuagccgccuccugagccucaugcuagcgcccagcguggcagcccuggcccuccugucccuuugccgucugugcccacccacccugucccgcgcccccgcccacuccuccauggcguucgcuccccacacccuucucugucgaggaccuugcucccauucaucuaaaccaggcucucgaagcccaccucuagcugcauguucuggggcugggagggcaggcacacgcgugugagccagguccaugcacacgugaacacacguaugccuuagagcaccugccucaccucggcugcccgguggcagcgccuuggcccucacacagaaaacaccagggagucugugcagcguguuugccguggccuggggugccagggccgccuucugaguuuucauacagcaccugggggagcuugacccucugcagggcugagggccacgucugcccaugccccccagccagugccuagaagcagauaguucaggaggcugcaggggcugggccaggucggaggcugcccgggccuggccagggguccuagcagagaaagcagggcucgugcccauccggcugccucccugcagcgagggagggcgaaggccgccuucccaggaaggcccagagcacaucugagcuggcagcugcgguccugcucggacccacaguucugacaggaaccuuccagaggaucacgggcugauggcagagcagugggguucccugcccuuccagucccuuugggauggcguuuuaccaguccacaagaugcccugggagguggcagacacagcugucagcaccuggagccaugaggacuuuucacuguacgcucagcccagguccguucucccagagggcuguaccgucccccaccuccuccuguugcuuaguccaguccuguguccgccccgcagacccugaagugccauggggaaggcgcucacacgugcuccccaggcuuuacacuggauacggcguccugucgccaccuggcaggaaggggcguucuuugcacuuacaggcgaggguaggccgccugcccaagcccaugcucuugcaggucagaagacaccaggcacagcccuuggccgcagcccugggccgccccuguggacaggaagccaggaggccccaggcugcugugacugcccccaccggcccugguagccccacccuuguccgugugccaccagcggcccguguccuguccucccgucucgggggaccuagccagacaacaccagagacuagcacugagguguccccaacaauuuuauuauaaauaaaaacaagacucccaguggguggcugcagccccugccucgguggcugugagcaccuguuggaggggccugcccuuacccuggucuggaggccagaaccgaggaaagggcucccugccccuccaaguacacaggggagccugagguacugagaauaaaaaccagggagggacucccaggccaggcggcggccccgggcccucugccccacgaggcucaucccuuggagcacacaggaagcugcccguccaucacaccacacucucuuccagccgcucggcgcugccuccuaccccccggcacccugccccgagcagccccccaugcacagaguggcuccgucgggcccaagcuccucccaggcgccuggcauaaccguagcacccggcaucucccagguccagagagcagcugcgcugcggccggggcggggggcuccgcggcgggugggccuuggguguggggcuggggccuccauuggucugggacuggacguggcugagcuugagggggaggcggccauuuccggccccccggccccgaaccagcaaggccacagugaagaccaguaaggcagccaccagcacaccccccacggccacggucagggucccgcccagcacgugggccugcagggcguggcacaggggcgaggccggcagcguggagaaaugggcacagcccagcagccugguggccgugaggucagagggcccagcggccggugacaaggccagcaggcagaggucauagucagcgccggggacgaggugcuucagcaggaagugguggcuggaggcugggacaauccugcaggcaagggcagguggucagagcccggggcuggggucuagccccauccucaccuccccacucccgugcucccagcuccaaacaccccucccccuggggccacucgggcucuuggguucacucaggaaggugaacaggcuggagaguguggccaggagaugggugugugcacuggcacaggacgcaggcaagcgaggggaaugggguggggggauggcaccagcagaggcagaaauaacacgcgggcgcgggccaugugcuucagacagacccaaccgccaccugcugccggggaggccugcacagcucagugacaccugggacaucucggggugggguccuucugccgccccuugagcuccagcccccucaggcagccaggccaggccaggccacugcuccuccaagaguccagcagccauggucggggagggggugucagccccagagagaggagggguggaagcaaagccuuguggggagcagagggcggaggaagggcgccgggagugcagccggguguggggcacgcauccucaccgguagaugagggucucaucuucgcugcuguuguacuggauuuggaacauccacacugggucggcuggccgcccgggaccccagcucaccagcccugagguggcggucaccuccgucaccugcacggcuggcucagacuccagcguccccucacccucggcagcagugcgagcggaggcggcgauguccgagggcccggggcggccccccucggcacugcuguucccaccauggggcaaggccagcacccgcaguucuacucgggcuguggccucaccagcaggguugguggcgaugcagguguagcccccagcguccccagcgccggucaccccaaucucuaaggucccguuggggaaagcccgggcucgggaggaguugccaaccaaccggucgucaggaccgacccagugcaugguaggcgcggggucacccagggcccggcaccgcagcguggcccgcuggccuuccagcacccagaggcgcugcguguggcgggcaaugaggggcggcucacaggagaacucgcccucgggcacugcccagaaguagcggccggccaggccgggcggggaggcgcacguuuccaggucguccggccgcgccagccgccgcagccacagcagcucacaguugcagugcaggggguucccgcuaaagcucagcaccaggggggcgggagaggccucugcaucacgcccacgagagaaaagcggguccggagccagcguggccaggcgguuggaggugagguccaggcgggagagcugaccgagcugggcgaaggcgccugggggcagugcgucaauaagguuaugguccagguugagggugugcagggcaggcauggcgccgaugccggcccagggcaccugccggagguuguuguaggacagguccagguccuccaggcucucuaggaagucgucgaaggcucccggcgcgaugcggcccagcugguugccgcugaggaugaggugcugcagauugacggggccccggaggcucccggugcccagcuccaccagccuguugccgucaagguggagggaacgcaggcucucgagguccccaaaggcgcgggccccaaugcgggugauggcauugcgagacagugucagguccaccagucccgucauguugcggaagucagggggccccagggccuggaugaaguugucagccagccgcagcuccacugugcgccgguccacguugggcggcacaaacagcaggccucggugggcacagagggugcugagcgacucggacagguucuggcagacgcagggcagcgggcaggcggccgcuccacuggccagcagcagcagcaggagcggcggggccauggugagcgcccuguaggaaggggccacagcccaggcacagguggggcuggcgcaggugcccacuugggcccaggacagucccagaagccagcuucugugagccuggcccggggaggggcugggucagaggcccaagagggccgccagagaugagggaagguuggggccugcagggccaggccccccagagcaaaggucacauuucccaagcaguuaagggggaguccaggcgcuggggacaaggugaggcaugaggcaggaagcggaggaggaccgagagcagggagggucccggaacuuccuuucccaggcguccccaggaaucgccagccgccuccccacuccccgccauacccucccccgccagagaaggcgccccccgaaccucccguggaguccguggccccucccuggccggcccccgcgcugcgcccggcggcccccucaccugguguccgucgcucagggggcgcgggccggccucccugcgagcccggccggcccccgccgacuccuggccgcucucccgcggggacgaggcccggggaugaccggccgcccgccgcccacccucgggcccauggcgcucgggcccgcggccccggcucgcucgguucccggcaccuuuucccggcgcgguuagcgguggcggcggcgacaggcgagcgggugcgcgccggcgggcgcgcgcgccgcggacacgcacguggagggcggacggggaggggcgcgcggggauccacccgggcccgggccggcuccugaggucacggggacacgcggccgcugcagcgcccacggguggcgcccagucacgcccgaggcccgggccggcgcgggcccuccgcgcugucccccggcgcugccgcagcgcacucacccuggcacaggcgcgcgcgcccccggccauccuggcgccccggcauccugcaccgcacgggcgcccgccgccgcggcgcgaaccucacucugcagacagccagacaaagcgccugcucgcgggccccuucaccaucucccggagacgggcgucuuugucacaugucgcugggcacccuccccaacacacccacacaugcccacacacccacacgucccugcacccacgggcagggccgagcgcaaacccgcacuguugcugggacccuugcguucacagacacacgcugaaggucauaaccguucugcaucaccgagucacguggaggguccccaaccggcacgggguucggccguggggggggcuggggcggcgccccuggcagggcugcugcgggguggggccgagagggcuuggccuccgggcaggcgccccgcccccgccgccccgcccuguccccagcugccucucgccucucccucccuccccagcugccccgcccgccccgcgggccaggcguuccggagccaaccggccuccgccucgggccggauuggucugcgcggcgcggcuucccaaccgccgggggcacgcauugggaagcugugcguccucgcagcgccugcggccccucccucccgcucugucgccgccgggccauuucccuggaagagcggcucggaaccagcuccucucagagaaagggcucccggcgugaggugggggagguucuuugcuuccugguugagaaagcuggggcuucgguggcucggcgagccugguuuccuuccagcugugcccgccaccaccaguggucugcccaguugggaaacaggaagucaccaccuccccgugucuccugguccuuaagccaccuaaaccucagccauccucguucucccuccagcccugauccccaugggccagguggcaggaaacucggggaaacccaagauuggaauucugauccugucagcacagcaguguaguccugggcacguuaccugaccacugaaaacaaguuccuccuguaggccaggagaguuggaugguacauacauaagcauuuccuaggggcgagaggggaggacagcugcagcuugugaggggcuuacaggcagccagaagccauucugucaccacucacugggccucagcuguggcguuuguaaaaugagggggauucaguccuggugcaggucaacucugaugugcaguggcaccagcuaugucuuuguuccucuucuccccaucaaaaauguuuuccaccgggugcagugguucaugccuguaaucccagcaguuugggaggccgaggcggguggaucacuugaggccaggaguuccagaccagccuggcaaacauggcgaaaccccaucucuauuaaaaauacaaaaauuagccgggcgugguaccgcaugucuguugggaugaggcacgagaaucgcauuaaccagggagccacagguugcagugagcugagauugugccacugaauuccagccugggcgacacacuuugucucaaaaaaaaaguuuucauucacucuaaauauagauguuuaccagcauccaccauggccacccagugcugggagccggguucaucaggaaccagaugggccugguuccugcccccauagagcuuacaguauggaggagaggaugggcaacccgacagucacaaaggggagacucaguggggacccuccacaugacucggugaugcagaacgguuaugaccuucagcgugugucugugaacacaagggucccagcaacagugugggucugcgcucagcccugcccgugcagguuccucagcggccugcuggaaaggugagcaucagcucugccgagggugugaggacagggcgaaggccuccaaggguccuucucacucugcgcgcucggggcucuuuggaugguuucauuagcugccucccuucuccagugccaugccuuggcccagcugaaaugucagcaucucuucaggagaggcaggggcgaggcucaggggcagacaggcacagcacugcuggcggggucccacucuguggugagcaccugacaggcuggugggggaggcacccuuccuguccaggccuccagguaauaggagccuaagagacggagagcucagaggagucuggguggccuugagucccuguugaaggugccgacagggaucaugaauaagugacgcguggagguguuuucuucgcgguggaagccagggcugucgcuacacagccacaggccaugcuuucacaggucuuggagcaccugucacagugcuggcucgcauguccccguuuaagucauacucacccuggcccagccucauguugucacccaggcauuuaaugaguggaaccgagggccccugugcacaaagugcacugacacaugccucaggcagcacccugcccccaaggguucccaggcagacaagcagaggaugaagccgaugggugugcuugcccacagcggguuccucaggggacugcuggaaaggugagugucagcucugccgagggugugaggacagggcgaaggcccuugagaaguucagggagagcuucccaggcaggugcaaagguguggagcgcaaggcaaguuugauguggcuggagguggccacaaugaggaaggcgguggaggguguggccuggagauggagaagaggucacaaggucccaaaauggccguggucgaauccucuggcuugaccaguggcaugggaggagugggugaugagggugaugggaugcagguuuugguaacuggggggacaguggggcacccacugggcacaggaggacugggugcauaggcaggaagcuggccguggacuugcugaacuuaugcgaggggugaacaaggaaaggcccgggaggcaguugcaccucugggucuugcccuggaggcagagccugucacuggcgccacagccccgggacggggccuccuggggagcauguggugugugaggagcuggggaggaagaggacaggagagcaagauggcuuggaagcccagggaacgagcagcaaggcgggagcaugcccgcuggacucagcugggaggagugacuuagagugccagaguguggucuguugcggucaaggcccucuuucgagaagcguggacgaggggcaagggugacugcugugggccacgcugcuggagaaaaaggcugagcccuguucuaggcugcggggaggcaggaaggguggccuucagcacaugcuuugguguaaacaaguauggagggagcaggcccagcccgugacagcuuagggggcucugcuggagugaggagagggcugagggacggggaagugccccucugcagggaggcccagaagcugugcuggcccagggcagcaucuucagccuuuucucuuucagccuuuucuccucugccuucccugucugugcugcauggugacccccucccacccgccucuguccugcagaccaacaucgccuuccugcagaaugugcucaacaaccagcaguuccuggcaggcacuguggacacccaguucaucgacgagaacccagagcuguuccagcugcggccugcacagaaccgggcccaaaagcuguugcacuaccucggucuggcccgagacugcccugcccugcccuccccuccccuccgcucuccaaucucuugcuccuaccuccuugccacuccccaugaccaaagaacuccuuagugcccccugccccucaccccugcccucauucuggcccugcguccucuuguccugcacccugccauucacugcucuccuugcuucugaucugagagaccccaccuuuccauccacgugguccucaagacguccccacugccuguacccaggaggcccuggcuuuggagaggacaggggccagcuggaagcccggggauccuggagggaugugucccugucccugagcccagccacucucacugcugcccucgacucagccucugcccagcccacccugacccacugcccgcuuucuccccaggccaugucaugguaaacgguccaaccaccccgauucccgucaaggccagccccagccccacggaccccguugucccugcagugcccauagguaggugagauccauucugucaacucaugggggagacaggagguugccaccugcaggaugggcaccaaugccccugucuacccuaggcccgcccccggcugguuucagagacauccugcugcgagaggggccugagggcuuugcucgagcugugcggaaccacccggggcugcugcugauggacacgaccuucagggacgcccaccagucacugcuggccacucgugugcgcacccacgaucucaaaaagaucgcccccuauguugcccacaacuucagcaagcucuucagcauggagaacuggggagguaggcuggcaugcugcgcagcgccugguaggaaugggcgcccgcucuguggccagucccacaggcuuaggccacuggggacaagcuagagacgcugacacgaagaacaccaaagaggaaggaccgaagaaggcacagcgcccucuccggccaggccuggugccggcacgagguugcagagcugagaccaggugcauccugggagguccagggucaggaggagacaccugccuguuaauuauagcacagagagguagaggagaagaugggauuauaaagggggcauagaagggacacaaaugagccuggucucccccuuagagaucagacaagggaaaaaucuguggggguuggagcagggaacacagguauggcgaagaugagcaggaccugguauuggggccagaggcuugugcugcagagcuagcuccaaggccugguggaguuccccaggcaugcagagcugaucugggccucucgguuccugugcaggagccacguuugacgucgccaugcgcuuccuguaugagugccccuggcggcggcugcaggagcuccgggagcucauccccaacaucccuuuccagaugcugcugcggggggccaaugcugugggcuacaccaacuacccagacaacguggucuucaagugagccugggguggggugggcagacgcuaccugguguggcccagaggguaccgagccaugucgugauggccucuguucuccacggucagccugacaccaagucucucuguggccacacgcagcaggggcugcuguuuggaaauaucgagaaguguaaaauuggaguugcagaaccagacaggcuucuaaaucacucccucacuccuggggcaguggaaggucugagacuugccugggucacucggugcagggcugggauuggaacccaggccucaagacuccuugcucaguacccucuuccacagccugccacuggccuagcugauccuccagggccugguccacacuuguguggccaccccccgccuguggaugccacacccccugccaggcgagacccucagaucucauuccccaggggccauagagugggucaggaaggagccagggaagacuguucagagggaggugggguggggcucagcccugggcucucucacccuugcagguucugugaaguggccaaagagaauggcauggaugucuuccguguguuugacucccucaacuacuugcccaacaugcugcugggcauggaggcggcaggaagugccggaggcgugguggaggcugccaucucauacacgggcgacguggccgaccccagccgcaccaaguacucacugcaguacuacaugggcuuggccgaagagcuggugcgagcuggcacccacauccugugcaucaaggugccugggccacuuguccgucccucccucucugccccggccauguccccgccacccacaggcacacauccugcccucucuaccaucucucucucucucucucccacuucccccaggacauggccgggcugcugaagcccacggccugcaccaugcuggucagcucccuccgggaccgcuuccccgaccucccacugcacauccacacccacgacacgucaggggcaggcguggcagccaugcuggccugugcccaggcuggagcugaugugguggauguggcagcugauuccaugucugggaugacuucacagcccagcaugggggcccugguggccuguaccagagggacuccccuggacacagguaggaagaacagcagcccguggccacaccccucucaaagccgcagccaccaccagucccaguaguguuggaccugccuaggauccagaugcccugcucuggccuugccgccuucugucaccugagucagacaugggaccugagcuagcccuggguccuggaagagucacacauuucuaaggccuccucugacucuggccucccugcagaggugcccauggagcgcguguuugacuacagugaguacugggagggggcucggggacuguacgcggccuucgacugcacggccaccaugaagucuggcaacucggacguguaugaaaaugagaucccagggggccaguacaccaaccugcacuuccaggcccacagcauggggcuuggcuccaaguucaaggaggucaagaaggccuauguggaggccaaccagaugcugggcgaucucaucaaggugagcccggcccggugcuccuuaccugacccagcccugcaugcaccugccacuggccuccuugaggugccuggcacccuaaccuccagggccuucuccucaggugacgcccuccuccaagaucgugggggaccuggcccaguuuauggugcagaauggauugagccgggcagaggccgaagcucaggcggaagagcuguccuuuccccgcuccgugguggaguuccugcagggcuacaucggugucccccaugggggguuccccgaacccuuucgcucuaagguagggaaggcccagcauggugugagggugggggcuggaugcaggacuugggacugauccucugcuuugcuccccagguacugaaggaccugccaaggguggaggggcggccuggagccucccucccuccccuggaucugcaggcacuggagaaggagcugguagaccggcauggggaggaggugacgccggaagaugugcucucagcagcuauguaccccgauguguuugcccacuucaaggacuucacugccaccuuuggcccccuggauagccugaauacucgccucuuccugcagggacccaagaucgcagaggaguuugaggucaguggcucuggcgcuucuccacacuccacccuggcccccugccccagagcucuggaguuuagcuuggcugucacccagccucgcaagcuuugggagcagaaaggacccuugagaccgggagcuaggccuuuaggaacgaggagccaaggcccaguguggggacuuccuauggccagggccgggggacugcucucccaccuuggcguccagcucugagucugcacacccucccugcagguggagcuggagcggggcaagacgcugcacaucaaagcccuggccgugagcgaccugaaccgggccggccagaggcaggucuucuuugagcucaaugggcagcugcgguccaucuuggucaaggacacccaggccaugaagguauugucucccccagggccagccaggcgguggggcuuggcugggcccaggaugucauguccccucugcccugugucuucaggagaugcacuuccaccccaaggcccuaaaggacgugaagggccagaucggggcgcccaugccugggaaggugauagacaucaaagugguggcaggggccaagguggccaagggccagccccugugugugcucagugccaugaagauggagacuguggugaccucacccauggaggguacuguccgcaagguucaugugaccaaggacaugacacuggaaggugacgaccucauccuggagaucgagugaucuugccccagaccggcagccuggccauccccaagccuucaacagaagcugugcugccacggcaggcccaggccagccagugcccgaggccaggaaggccgggccguggagguccuguccacagcuggacaggagagacaccgccugcggugguucauuccuuucagccaucguccuuuccuccggcggacagcugcuuacauguucaucucuugccaaauaaggguccccuccucacuggagacuacaaguggugggucaggugguccuaggacccaggggagguuuagggguccuaucuccugggggaaggggagaucuaagaugucccagguccugggaaguuuacucaauaaagcuggcuuuccccugc

SEQ ID NO: 61593 - RNA, 3051 nt, Homo sapiens
auaaagcagaaugucugcucucugugcccagacgugagcaggugagcagcuggggcagagggaugggggucacaguccuaagggagggcauugcagguggccucaggggagagccugggguggccccuaagacguccucuuggaacauuuuggcagaguugccucuucgcccucauuauggcucaguuuuuccaccaugaaaugggagggagggagacaggugggcaggggagaggugguagaaguggccuagagaacuguuccuggggucugggaccuuugcgaagggguuagagcaccacgcucccugcuaugugacugagguagcaagagcacgcccucuucccaugucugaggaagacacccuagccuccuugacucaccuaggucaguccucuugagccccaacagcucugugcuccccagcccaaggaagggguaacaggauuucgggcaguugccccugcagaggcccccugggcaaguccccugcgccaugucccuucgucuccuucuuccccuaaccaggccucccuccaccugucuucucagagcagguaauggcaagcauggcugccgugcucaccugggcucuggcucuucuuucaggugggucuccgacccugacuucaacguggggguguggguggaggcuggccagagggcccuguccacccugggggaggagagcccaggcccugauuaccuagucccucuccacagcguuuucggccacccaggcacggaaaggcuucugggacuacuucagccagaccagcggggacaaaggcaggguggagcagauccaucagcagaagauggcucgcgagcccgcgugagugcccaggggaagggguguaggcgaagggaggagacagcugggccaugccaugaugaccugccucugcugccucaaccucuguggccgcugcugggacagaggaaaggagcggugcuagcucugucugcagaucccggccauccugggcucuuuagcgcccucugccugcagcccccgccuugacaacuccguagcuguugcccccuugcucacugaggcgcgggaccugggaucaaucgggaggacgcccgcugcaguccccagaaucaaaggaugauguggcgcaucuauguuucuuuggagaguguuguaggucuggauuuguaugggcaauguguuugugcuucgugcgugaguuguuacuggccagggcuaggacaagagcccucgacccuggggccaacgcccugcguccuugguucccccagaggaucagugcgcgaugacuuggggacaaaggagaugauggaggcuagcagucugacggccuggauaucuguccccuucuccaggacccugaaagacagccuugagcaagaccucaacaauaugaacaaguuccuggaaaagcugaggccucugagugggagcgaggcuccucggcucccacaggacccggugggcaugcggcggcagcugcaggaggaguuggaggaggugaaggcucgccuccagcccuacauggcagaggcgcacgagcuggugggcuggaauuuggagggcuugcggcagcaacugaagcccuacacgauggaucugauggagcagguggcccugcgcgugcaggagcugcaggagcaguugcgcguggugggggaagacaccaaggcccaguugcuggggggcguggacgaggcuugggcuuugcugcagggacugcagagccgcguggugcaccacaccggccgcuucaaagagcucuuccacccauacgccgagagccuggugagcggcaucgggcgccacgugcaggagcugcaccgcaguguggcuccgcacgcccccgccagccccgcgcgccucagucgcugcgugcaggugcucucccggaagcucacgcucaaggccaaggcccugcacgcacgcauccagcagaaccuggaccagcugcgcgaagagcucagcagagccuuugcaggcacugggacugaggaaggggccggcccggacccccagaugcucuccgaggaggugcgccagcgacuucaggcuuuccgccaggacaccuaccugcagauagcugccuucacucgcgccaucgaccaggagacugaggagguccagcagcagcuggcgccaccuccaccaggccacagugccuucgccccagaguuucaacaaacagacaguggcaagguucugagcaagcugcaggcccgucuggaugaccugugggaagacaucacucacagccuucaugaccagggccacagccaucugggggaccccugaggaucuaccugcccaggcccauucccagcuccuugucuggggagccuuggcucugagccucuagcaugguucaguccuugaaaguggccuguuggguggaggguggaagguccugugcaggacagggaggccaccaaaggggcugcugucuccugcacauccagccuccugcgacuccccaaucuggaugcauuacauucaccaggcuuugcaaacccagccucccagugcucauuugggaaugcucaugaguuacuccauucaagggugagggaguagggagggagaggcaccaugcaugugggugauuaucugcaagccuguuugccgugaugcuggaagccugugccacuacauccuggaguuuggcucuagucacuucuggcugccugguggccacugcuacagcugguccacagagaggagcacuugucuccccagggcugccauggcagcuaucaggggaauagaagggagaaagagaauaucauggggagaacaugugauggugugugaauaucccugcuggcucugaugcugguggguacgaaaggugugggcugugauaggagagggcagagcccauguuuccugacauagcucuacaccuaaauaagggacugaacccucccaacugugggagcuccuuaaacccucuggggagcauacugugugcucuccccaucuccagccccucccucuggguucccaaguugaagccuagacuucuggcucaaaugaaauagauguuuaugaua

SEQ ID NO: 61594 - RNA, 3051 nt, Homo sapiens; identical to SEQ ID NO: 61593

SEQ ID NO: 61595 - RNA, 8673 nt, Homo sapiens
ccggaagugacgcgaggcucugcggagaccaggagucagacuguaggacgaccucgggucccacguguccccgguacucgccggccggagcccccggcuucccggggccgggggaccuuagcggcacccacacacagccuacuuuccaagcggagccaugucugguaacggcaaugcggcugcaacggcggugagugcugagccggugaccagcacacuuugggcuucuggacgagccgugcagcgauuggccccagguugccauccucagucgucuauuggucagaacggcuaucuuuuuuuuuuuuuuuuuuuuuuuuuuuuugguccgaguagcuuuuaaagggccaguagcucgguugcccuccggaaggaauggggaaaucagagagcggugauacuggguuaagaguggaaggauuguuuggaacggaacuccggucccugcgggcaucugggugggauucccaucaggccugggaugcacggcucuagauuuagugacccagaccaagaacguucgucuacacagacgggguccuuucauucgaggcugggcugaggcggaugcagauacggccccuuugggaagacacguuccacuuuugauucauaggagagaguaucagccaagccuccgaacugcacacaaacgucuuagaagugcgccuucuuuuuguguuauaguggucucccagccacagccaacgcuccaaguccccagcugugacacaccuacugaauuacuaccgugggugggaggccgccgugggccuuuccauuacgagccugcuugccgagcccugggcuugugcacagacaaacugcagagcugguggaggccacugccaggccgagauaagaaagagauggggagcugcuaaucucccccuguccagccuguuggugagggcugggaucuuugcucuugcagucauuccagagcccuggacuaggaguaggaagaucugaauuguggccccaacucucuuucgguuauuagcucugugacccuaggcaagucaccucaucccuugaugccacccguugcuucuguaacauggucccaaaggugccugucuuguccaccugauaggauuuuugagacgacaacaauaugcaaaagcaauagcuucaacauagaagugcucaguguuuuauuuuuuaaugaaacgguuugacuuggauaugcugugcacauucaaugaacuuaaggaauuguuugaaccuaguaguucugggaccuuagaguccuuucugugggcucccuguggcccagaauuuugguggccacguuuaauaucaagccuagccuaauuugcaaagggucucccaggguuaauuuauuggagugaucacauggaguagaccagagucugagggcagaaagcugucaccugcuucggcaauagaggccccagaugucugggugcaaaagaacuccauagcaccccgaccaacauggugaaaccccgucucuacuaaaaauauaaaaauuaggccgggcacaguggcucaugccuguaauccuagcacuuugggaggccgaggcagguggauugccugagcucaggaguucgagaccagccuagggaacacagugaaaccccguuucuacuaaaaauacaaaaaauuagccgacgugguggcaugcgccuguagucccagcuacuugggaggcuaagacaggagaaucgcuugaaccugggagguggagguugcacugagccgagaccgcgccauugcacuccagccugggugacagagcgcgacucccccucaaaaaaagaaaaaaaaaaaaaauauauauauauauauacacacacacacauauuuuagcugggcaugguggugugcgucuguaguagucccagcuacuugggaggcugagucaggagaaucgcuugaaccuggaaggcagugguuguaguuagcugagaacaugccacugcacuccagccugggcaacagagggagacucugucucaaaaaaaaaaaaaaaaggaacuacauaggaugaacaucccagaucagggaauguugacugucgacaguaucaguaucuacaguggcuacugucugauguagaaagaaaugggaucaggcuaggcgugguggcucacgccuguaaucccagcacuuugggaggcuggggcaggaggaucacaaguucgagaccagccuggccaacacagugaaaccccgucucuacuaaaaaugugaaaauuagcugggcaugguggaacaugccuguaguuccagcuugaacccagggguggagguuguagugagccuagaucacgccacugcacuccagccugagcaaaacagugagacucugucuaaaaaaaaaaaaaaaaaaagagagaaaugggaccuccgucuuagacugaagaauucaguucuacgugcuuagcagugaauacuuuuguccaagguacucuggcaggaggaagaggcguguccucuugaguucuugacuugggcucuggccuguuaauauuuccauguuggugaaaccagaggcagcacucuaggugcacgaacuuuaggcagcgcagccuccuagucuuauggaacaucugaggcagaagaaaccugaguccaaccuuuucauuuuauagaugaacaaacagauccuggugggacaguguacccaaggucacccagccaagaggcugagcaggacuguacgucagauccguuuaccucaguccuuaaugcaugcaguccagccagauuaagggacccuuaauacugucagcuuuccccacugugggaucuucauccucuugacuucuuuuguagccagacaucugggccucuugcuggagaagguggcagcuugcugcucuuagacucuagucuacuccauguggcaucuggauggcacugaaauuuucucaagugccuugucuguuguagauaaugaaucuauccuccagugacucagcacagguuccccagugugguccuggcugcccugccccugccagcugcaggccccacccuuccuguggccaggcugaugggccuuaucucuuuacccaccuggcugugcacagcacucccacugacaacugccuuggucaaggugggcuucagggcucaguguccugguuacugcagcggcagcaacagcagguccuacuaucgccucccucuagucucugcuucucuggaucccugaggagggcagaagguacugaggaagguuaaagggaccagccuuggaguauuuccccacucugagacucagcuggccacaggccagguucugaaguuccuuucuuccaagccagugauucugguucuuggacaagguguugaggaacacuagaaacagaggggacugugaccuggggacuuuuucugcaggaagaaaacagcccaaagaugagagugauucgcguggguacccgcaagagccaggugggugcaggagccgggguggaggagguuugucagaacaguuaugaugcucacagcaucacaaauugggggacucagaggguuaguuccuaguaugaaggagaugggguggcugggcguuaaguuccccgggaaauggcagauuacauucuauggcaagaucaucccuaggcugggaaaauuguuggagugcagagggcucccaagccccuucucaugcccagauggaaauuccagucccuucaggaucugccuaaccugugacagucuaaagagucugagccguggcugggaagggcaggacuaauccaagucucuacccgcagcuugcucgcauacagacggacagugugguggcaacauugaaagccucguacccuggccugcaguuugaaaucagugaguuuucuggaaaggaguggaagcuaaugggaagcccaguaccccgagaggagagaacacaacauuucuggcuuugccuauagcuaaagcccgucccgcugccccgagauuccuucugggcugcucccaguucugaaggugcuuuccucugaauaccuccagcucugacuaccuggauuagccuggcauuuaacaucuugagcuuugggucuuuuuaugaguguuucuggucuuccugcucgauuguauauacucagagggcaggaaccagggauuaugugccucuguccccaucaugaaucguagcacagcgcuaggcucaguaaaugcugaucaauaaugagcaccugauugauugacucucuccucaguugcuauguccaccacaggggacaagauucuugauacugcacucucuaagguaacaacaucuuccuccccaguucuuguccccacucuucuuuccuucccugaagggauucacucaggcucuuucuguccggcagauuggagagaaaagccuguuuaccaaggagcuugaacaugcccuggagaagaaugaguaaguaaagauaggagaguguggugcccucccagucucuugcugggacccuaguaugcuaggucucuugcugggacccggggugucagauaggcugcugggcuuaaacccucagagaggcugaaggcagcucauagguggguuuuuucaggcuucagaaaaggagagugucugguucugagccaucuggcugccuggacugcaagaauggcugggggagggaggguaggagggagaguaggagggagagugagaggagagcaguuuucaugcuccugagaucuugagaaggugugcuuccugaacugcccuaggcuccaccacugaaguagaggcagggguggguggagaaggggugaaggcuggcugcucauacccuuucucuuugccccccucucccaucucuauagaguggaccugguuguucacuccuugaaggaccugcccacugugcuuccuccuggcuucaccaucggagccaucugcaaguaagagucuugcaaguaaggggcuugggcagggguaggcaucaugugaaccuuugccuuucccuuuggggccugacccucugcuucaggguuaucuccucugcccugaggaguguugacugguggcagaaaacucaagaaauaccagugaguuggcaaucgagagagaauagaggugaucugaacuuaaaucucuucccucauucugugcccuucccuccucccccaggcgggaaaacccucaugaugcuguugucuuucacccaaaauuuguugggaagacccuagaaacccugccagagaagagguaaguggggccuggauaggcagcuuggugggaugugcccagaagaugcagggaugggaggaggaggaaaggaacagugacugccuaguguuaaaaucucauuguaacuucucucugggcaguguggugggaaccagcucccugcgaagagcagcccagcugcagagaaaguucccgcaucuggaguucaggaguauuguauccuuuuagaagagugacggauccuuuuggaagagugacggagacagcagccaaggaaaaagacaaggucuagagggcucugggaguccggagaguggaaggggcuuccagcaagcagcccguggggucaguggccugucugucuuuccaugcacucauccguccacucauuuacagucuaauguuuucuuagccccagacaaguguucagagugcaaggcauuggggauaauggugagcaagauaaacauuucccugcauauguagaguuuacgucuuacuuagggauaaugcaguuauacugaacugaauagugacuacuucuggagggauagggaguacuuccuuuuuuuuuuuuuuuuuuuucugagacggagucucgcucuguugcccagguuggagugcaguggcgcaaucuaggcucacugcaacuucugccuccugaguucaagcaaucuuccugccucagccuccuaaguaguugggauuacaggugccaccacaccuggcuaauuuuuguauuuuuaguagagacuggguuucaccauguuagucaggcuggucucaaacuccugaccucaggugauccaccagccucggccucccaaagggcugggauuacaggcuugagccccgcacccggucaguacuuccauuuuuauaugcuacuauauugucuugacuuuuacaaugaauauguaguacauuucauaaaacuaaauuuaaaaauaguaugugcuaagugcuccaauaagugaaguugggaauuuucuggaaacuucuaguuggaacaucuaaacacagaagucuggggugucagggaagguuucucagaggucuuguaaccuuggcaaguuauuuagccucccuaugucauuuuccuuaucuguaaaguggggauaauaauacuaccuuccucacaggguuguugugaagaugaaaugagcugacauauggaaaguacuuuuagagcagugucuggcauguaguaaguaugauguaacuguuagcuguuaacauuaagcugagagcuggaagaugacugaaagucagccagcuagagagggaaagacagacucaggcagagggaaccgcacgaggccccagauugcccgacacugugguccuuagcaacucuccacagcggggaaaccucaacacccggcuucggaagcuggacgagcagcaggaguucagugccaucauccuggcaacagcuggccugcagcgcaugggcuggcacaaccggguggggcagguagggccugccccuauccucuccccagcucaucugcaucuccuuucugccuuacagucauccccaauuuaggauuuuuagacuuuaugauugugugaaagcgauauacguucaguagaaacuguacuuaguacccauacagccauucuguuuuuuacuuucaguacaguauucauuacaugagauauucacuuuauuguaaaacaggcuuggugucagaugauuuuguccaacuauaauaggcuaaucuuaaguguucugagcacauguaagguaggcuagguguauuaaaugcauuuucagcuuguuuucaacuuaacaauggguuuaucaggauguaacccuauuguaagucaaggaccaucugucuucacuucuugaccaccccaccucuaacaccguaggcugggaagauugugaaucagaggccagacucuaggcuuucauggagaaaauuuacaaaaaaaaaaaaaaagaggccagacucacacuuaggccuacccaggcuuucuagaugauagggaacucccaucucacugccaggugcuuuuagacacccccguguccacccuuuugacucccuguuccgccuccacagauccugcacccugaggaaugcauguaugcugugggccagguacacuugaccagggaagccacauggugacauaugccuucccuuuguucucaaccaagaagcuugucucacaaccuucugcaucugcuuccccagaauagcauucucagggaggggcagaccuugggaugcuaccgguccaaaaggcgcuggggagcaaguagauagagguggucccaugcuuugcgccauugguuggggaaagaucaggccugauguccuaggauguuuuuccaucagggggccuugggcguggaagugcgagccaaggaccaggacaucuuggaucuggugggugugcugcacgaucccgagacucugcuucgcugcaucgcugaaagggccuuccugaggcaccugguagggccugugcuccaccuguggagggcuggggacuuggagagcugggaaagguggcagggaagauuucuuacaugaaugcucuguauacagugcuaacucauucuuguugaauguuguguauggauaggaccaggucugggcccacaguugccuuuucagugauguccucaggucuguggucacagggugguguuaagagcccuugcagcucacaagaacuucuuguuacaggaaggaggcugcagugugccaguagccgugcauacagcuaugaaggaugggcaaguaaguggggggaaaugggcgggaagccagggaaaggaggacuguggcauuucuuccugugcaucccagguuucuagguaguccccucucagacugugcugaggcaacuguuuucuuccccagcuguaccugacuggaggagucuggagucuagacggcucagauagcauacaagagaccaugcaggcuaccauccaugucccugcccagguaccaaagcuggagggcgaggggguaauaaacaagagugcauauaaucucuuguucucaccaaaucccaccuccuucccucauacagcaugaagauggcccugaggaugacccacaguugguaggcaucacugcucguaacauuccacgagggccccaguuggcugcccagaacuugggcaucagccuggccaacuuguugcugagcaaaggagccaaaaacauccuggauguugcacggcagcuuaacgaugcccauuaacugguuuguggggcacagaugccuggguugcugcuguccagugccuacaucccgggccucagugccccauucucacugcuaucuggggagugauuaccccgggagacugaacugcaggguucaagccuuccagggauuugccucaccuuggggccuugaugacugccuugccuccucaguaugugggggcuucaucucuuuagagaaguccaagcaacagccuuugaauguaaccaauccuacuaauaaaccaguucugaaggugu

SEQ ID NO: 61596 - RNA, 8673 nt, Homo sapiens; identical to SEQ ID NO: 61595

SEQ ID NO: 61597 - RNA, 5563 nt, Homo sapiens
aguguccugguuacugcagcggcagcaacagcagguccuacuaucgccucccucuagucucugcuucucuggaucccugaggagggcagaagguacugaggaagguuaaagggaccagccuuggaguauuuccccacucugagacucagcuggccacaggccagguucugaaguuccuuucuuccaagccagugauucugguucuuggacaagguguugaggaacacuagaaacagaggggacugugaccuggggacuuuuucugcaggaagaaaacagcccaaagaugagagugauucgcguggguacccgcaagagccaggugggugcaggagccgggguggaggagguuugucagaacaguuaugaugcucacagcaucacaaauugggggacucagaggguuaguuccuaguaugaaggagaugggguggcugggcguuaaguuccccgggaaauggcagauuacauucuauggcaagaucaucccuaggcugggaaaauuguuggagugcagagggcucccaagccccuucucaugcccagauggaaauuccagucccuucaggaucugccuaaccugugacagucuaaagagucugagccguggcugggaagggcaggacuaauccaagucucuacccgcagcuugcucgcauacagacggacagugugguggcaacauugaaagccucguacccuggccugcaguuugaaaucagugaguuuucuggaaaggaguggaagcuaaugggaagcccaguaccccgagaggagagaacacaacauuucuggcuuugccuauagcuaaagcccgucccgcugccccgagauuccuucugggcugcucccaguucugaaggugcuuuccucugaauaccuccagcucugacuaccuggauuagccuggcauuuaacaucuugagcuuugggucuuuuuaugaguguuucuggucuuccugcucgauuguauauacucagagggcaggaaccagggauuaugugccucuguccccaucaugaaucguagcacagcgcuaggcucaguaaaugcugaucaauaaugagcaccugauugauugacucucuccucaguugcuauguccaccacaggggacaagauucuugauacugcacucucuaagguaacaacaucuuccuccccaguucuuguccccacucuucuuuccuucccugaagggauucacucaggcucuuucuguccggcagauuggagagaaaagccuguuuaccaaggagcuugaacaugcccuggagaagaaugaguaaguaaagauaggagaguguggugcccucccagucucuugcugggacccuaguaugcuaggucucuugcugggacccggggugucagauaggcugcugggcuuaaacccucagagaggcugaaggcagcucauagguggguuuuuucaggcuucagaaaaggagagugucugguucugagccaucuggcugccuggacugcaagaauggcugggggagggaggguaggagggagaguaggagggagagugagaggagagcaguuuucaugcuccugagaucuugagaaggugugcuuccugaacugcccuaggcuccaccacugaaguagaggcagggguggguggagaaggggugaaggcuggcugcucauacccuuucucuuugccccccucucccaucucuauagaguggaccugguuguucacuccuugaaggaccugcccacugugcuuccuccuggcuucaccaucggagccaucugcaaguaagagucuugcaaguaaggggcuugggcagggguaggcaucaugugaaccuuugccuuucccuuuggggccugacccucugcuucaggguuaucuccucugcccugaggaguguugacugguggcagaaaacucaagaaauaccagugaguuggcaaucgagagagaauagaggugaucugaacuuaaaucucuucccucauucugugcccuucccuccucccccaggcgggaaaacccucaugaugcuguugucuuucacccaaaauuuguugggaagacccuagaaacccugccagagaagagguaaguggggccuggauaggcagcuuggugggaugugcccagaagaugcagggaugggaggaggaggaaaggaacagugacugccuaguguuaaaaucucauuguaacuucucucugggcaguguggugggaaccagcucccugcgaagagcagcccagcugcagagaaaguucccgcaucuggaguucaggaguauuguauccuuuuagaagagugacggauccuuuuggaagagugacggagacagcagccaaggaaaaagacaaggucuagagggcucugggaguccggagaguggaaggggcuuccagcaagcagcccguggggucaguggccugucugucuuuccaugcacucauccguccacucauuuacagucuaauguuuucuuagccccagacaaguguucagagugcaaggcauuggggauaauggugagcaagauaaacauuucccugcauauguagaguuuacgucuuacuuagggauaaugcaguuauacugaacugaauagugacuacuucuggagggauagggaguacuuccuuuuuuuuuuuuuuuuuuuucugagacggagucucgcucuguugcccagguuggagugcaguggcgcaaucuaggcucacugcaacuucugccuccugaguucaagcaaucuuccugccucagccuccuaaguaguugggauuacaggugccaccacaccuggcuaauuuuuguauuuuuaguagagacuggguuucaccauguuagucaggcuggucucaaacuccugaccucaggugauccaccagccucggccucccaaagggcugggauuacaggcuugagccccgcacccggucaguacuuccauuuuuauaugcuacuauauugucuugacuuuuacaaugaauauguaguacauuucauaaaacuaaauuuaaaaauaguaugugcuaagugcuccaauaagugaaguugggaauuuucuggaaacuucuaguuggaacaucuaaacacagaagucuggggugucagggaagguuucucagaggucuuguaaccuuggcaaguuauuuagccucccuaugucauuuuccuuaucuguaaaguggggauaauaauacuaccuuccucacaggguuguugugaagaugaaaugagcugacauauggaaaguacuuuuagagcagugucuggcauguaguaaguaugauguaacuguuagcuguuaacauuaagcugagagcuggaagaugacugaaagucagccagcuagagagggaaagacagacucaggcagagggaaccgcacgaggccccagauugcccgacacugugguccuuagcaacucuccacagcggggaaaccucaacacccggcuucggaagcuggacgagcagcaggaguucagugccaucauccuggcaacagcuggccugcagcgcaugggcuggcacaaccggguggggcagguagggccugccccuauccucuccccagcucaucugcaucuccuuucugccuuacagucauccccaauuuaggauuuuuagacuuuaugauugugugaaagcgauauacguucaguagaaacuguacuuaguacccauacagccauucuguuuuuuacuuucaguacaguauucauuacaugagauauucacuuuauuguaaaacaggcuuggugucagaugauuuuguccaacuauaauaggcuaaucuuaaguguucugagcacauguaagguaggcuagguguauuaaaugcauuuucagcuuguuuucaacuuaacaauggguuuaucaggauguaacccuauuguaagucaaggaccaucugucuucacuucuugaccaccccaccucuaacaccguaggcugggaagauugugaaucagaggccagacucuaggcuuucauggagaaaauuuacaaaaaaaaaaaaaaagaggccagacucacacuuaggccuacccaggcuuucuagaugauagggaacucccaucucacugccaggugcuuuuagacacccccguguccacccuuuugacucccuguuccgccuccacagauccugcacccugaggaaugcauguaugcugugggccagguacacuugaccagggaagccacauggugacauaugccuucccuuuguucucaaccaagaagcuugucucacaaccuucugcaucugcuuccccagaauagcauucucagggaggggcagaccuugggaugcuaccgguccaaaaggcgcuggggagcaaguagauagagguggucccaugcuuugcgccauugguuggggaaagaucaggccugauguccuaggauguuuuuccaucagggggccuugggcguggaagugcgagccaaggaccaggacaucuuggaucuggugggugugcugcacgaucccgagacucugcuucgcugcaucgcugaaagggccuuccugaggcaccugguagggccugugcuccaccuguggagggcuggggacuuggagagcugggaaagguggcagggaagauuucuuacaugaaugcucuguauacagugcuaacucauucuuguugaauguuguguauggauaggaccaggucugggcccacaguugccuuuucagugauguccucaggucuguggucacagggugguguuaagagcccuugcagcucacaagaacuucuuguuacaggaaggaggcugcagugugccaguagccgugcauacagcuaugaaggaugggcaaguaaguggggggaaaugggcgggaagccagggaaaggaggacuguggcauuucuuccugugcaucccagguuucuagguaguccccucucagacugugcugaggcaacuguuuucuuccccagcuguaccugacuggaggagucuggagucuagacggcucagauagcauacaagagaccaugcaggcuaccauccaugucccugcccagguaccaaagcuggagggcgaggggguaauaaacaagagugcauauaaucucuuguucucaccaaaucccaccuccuucccucauacagcaugaagauggcccugaggaugacccacaguugguaggcaucacugcucguaacauuccacgagggccccaguuggcugcccagaacuugggcaucagccuggccaacuuguugcugagcaaaggagccaaaaacauccuggauguugcacggcagcuuaacgaugcccauuaacugguuuguggggcacagaugccuggguugcugcuguccagugccuacaucccgggccucagugccccauucucacugcuaucuggggagugauuaccccgggagacugaacugcaggguucaagccuuccagggauuugccucaccuuggggccuugaugacugccuugccuccucaguaugugggggcuucaucucuuuagagaaguccaagcaacagccuuugaauguaaccaauccuacuaauaaaccaguucugaaggugu

SEQ ID NO: 61598 - RNA, 8673 nt, Homo sapiens; identical to SEQ ID NO: 61595

SEQ ID NO: 61599 - RNA, 23944 nt, Homo sapiens
ggggcccugauucacgggccgcuggggccaggguuggggguugggggugcccacagggcuuggcuagugggguuuugggggggcagugggugcaaggaguuugguuugugucugccggccggcaggcaaacgcaacccacgcggugggggaggcggcuagcgugguggacccgggccgcguggcccuguggcagccgagccaugguuucuaaacugagccagcugcagacggagcuccuggcggcccugcucgagucagggcugagcaaagaggcacugauccaggcacugggugagccggggcccuaccuccuggcuggagaaggcccccuggacaagggggaguccugcggcggcggucgaggggagcuggcugagcugcccaaugggcugggggagacucggggcuccgaggacgagacggacgacgauggggaagacuucacgccacccauccucaaagagcuggagaaccucagcccugaggaggcggcccaccagaaagccgugguggagacccuucugcaguaaggagcccugccccguccccgcucccaggagagccuagaggggccccccucagcuccuaacgagccccccuucugaguugaguccccaugaccuucagccuuuagccuaguugcugggaagggggacagggcccaugagagcccagggguccuugcuuggagguuugagccuccagccccugaacugcuccucugcagagucccaaaucccaugagcccaggccuuuagcccaguccuugggcaagggggacauuucccagggggguccaagaugggagaaaaagcaggugaguucacaacucaaaugccuggagaacugggaggugguggaaauuuuuagccacucugaucauuuauacucuccagacccuaacuccugcacugaguccucaguggguaggcuccggggcccaggaagcacugccagggaggagggcccgaagcugggguuugggggcuuuccuggccuccuagggacucaugcguuuagccagggaagcccaggucuuucuuaccugaggcagacagagccucgaggugggagcugcuccccuuuccuguauggccacaggcaccccaccucaccagcaggcgccauuagaggcugcccguucuacauccccauccgcuggcggacuccccgucuccuggagaacuggguggguccugagcucgaugccuccccucuccucagcagagcugaccuaguuacuaauuacccaugugcuuuauuauuucucuuuuguuuuauaaauuuauaaauggcaaaaggcucugauaaggucugugaucauuaacuuguaggaaugguggccuggaaagaucugggccaacccaccucccaccuagugggggugggggaugggggugugggggagaaggaaggauggccugggggcuacaggggccaccccuccccagcggcucccugaccuccacccuacagcgccugcuugaggagguucacuacuuccugggcgcugugcugagguuucacaggaauaauuucccuucauggugaggaguccugggcagaagcuauuggugacucugcuucacaaauggggaaacuggggcuuagagccgggaaggagcuagacuaaguucaccaaacugaggccccaaaccuacucuguucggugcucucaauugcuaugaccggggaccagaggccugcaggggguggccagggagucagagagagaccgagccccaaagaugcuccaaaggggcccaucucuuuucuguccaagguccugaucccagcuggggugggggagggcugguggauuccugcuuucccagaggccucagggagccucccgagggccuggacagggggcaggggagcagucagggcccccugacuuggcaggaagaggagggcaaaggacuccagagcugcaggggaggggcaaagagucaggcaucccagacccagggcgaaggcaaccugacgggguggggcugggccugaccugcccagggccccagaugggacugggggcuuuggggugagggugggggcaggggaugcuuucuuaccuggcugagugagcucucucggucagcagcccccuuuggugggauggugggguuggggaggcuugauccacagcauuugaaggggaagcagaggucaaagugcuuccuagggaccagcagagaccuggaagcugaggcagagaguguagagagaggccauugggggagauggacagagaagcugggagaagcagaacggaggagccaggggggcgggggcucagacccagcugggagaaggggcacgggagagaaugaggcgccccaagcuugcaaggaggcuggagugcuucccgccugccccgauuggguuuucuuuaaugcuaacagcaugcuauuuacuuuccauuuaaauuugagauguugcuauaaauuaucaaccagcuccuuguuccugcagaguuuauaacuaacuaccuggguuacuuauuguucagguaacaaaagggaucggaaaacgcccugagugaaaaaaguggggccuccagcgucagggucaggaaaggagccagggagagaggggcgggggaccccuauugaaggccugggccauuggggagguugaggcugggaagacgguacagaggcagaaugucuaguagaagcuguuucccgggagaagucagugucugggaagaagccgggguggguccugggucccaggccucccuggggugccccauguugguggccacagcaggaaccugagcucuuucuucagaucucccccuuagcucccugagugaccuugggaaagucuguuccucuccuucugccucaguuucccucccuggccaaggaauaaaguccaaacucccugccuugguuucguuccccucccuccaccccaccaaauuccuggaucucuucccaggucuuucucuuccucucggccuuugcugcagucauuuuggcuuugcuguuccucaguaccccaagccaauucccaccccagggccuuugcacgugcucuuccugcugcucagaaccucuuuccagaucuucccauggccgauuccuucuccuucagcucccugauugcuccauccaaaagggggccccacccccgucacucucuuccacuacuguuguucacuuucucugguucccugucaagacuugugaucaucugauuuguuuguuuucuaucuccugccaugaaaauagaagcucuucaaggacaaggcccguguugccuuauuuaccacuuguacccacauccugcccaguggcugaugcacagcaggaaugagugagugacugggauugucugaggcccugaagauaucugcugcccuguuggucagggcccagcagccugagacguggccaagggagaaacugggacccagaguuccuuccuggguguccucccggguccuuucugucccugaucagcucaaaccccagcguguuucuuuuuuguuguuguuguuguuauuuuugagacggagucucacucugucggcccggcuggagugcauggcgcgaucucggcucacugcaagcucugccuccuggguucacgccauucuccugccucagccucccgaguagcugggauuacaggcaugcaccaccacgccuggcugauuuuuuguauuuuaguagagaugggguuucacuauguuggccaggcuggucucaaacuccugaccucaggugauccgcccgccucggccucccaaagugcugggauuacaggcacucagagccacugcccucagccuucaaaccccaaucuugaaguauucugauccugcccaucaggcagcaucagggcacugagacucaggaaaacaguagccacggcaggaggggggggggacagaggaucugacguccccaacaaaagccagacugccugcauccuaauccuagcucugccccuuucuagcuugagcaggugauuuuauacuucugagccucaguuucgucugcaggguagagaugacaauagcccuuguccacaggguuaaauggcauggcacuuguagaguaaacauguaguaacugcaauauacagcaguuauuauuagugaucccauuuuacagaugagcaaauuaaggcugagagaggcagugccuuaccgaacgaaacucuuccaaaugacugaaggcaagccaggacuuggaccuggguccuccuaccucacgcuccauacagcaaccucgaggucacacuuuccccuccccagucauuccugcuguuuaaguugaccaucaacucacuuccauacagugcuuuggaguucacaaagggcuuacaaaaugcgcuaagcucauuuuuuccuccuccccaucucugaagucugaaauaucauuagccccauuucacagaugcggaaacugaggcacacggagguuaagcaaagaaucaaggccaggucuaaagcccccacacugagaagucagcuccccuccagauguggagaugaauaccacaaccuugcaugcccugaaaccccaggggccagagggcaagaggcucaaagccuuggacauccgauugacccuggaaaggguaggagagagaggaggaagaugugggcgggucuucacuucuccugggcucugcuguguggggccaagggucuccagggcugcauuguuaagaugaugaugaugacaauauuauuccacaaauucagcacuuacugugcaccaggcauugcccuaaguucauccucccuauuugaagcucauuuaauuuucccaguagcagugugagguagggguggauuuaccccacguuacagggcagaugugggucaugcaagagcacgcguggcuaggucacaguggugggauuugaacccacauugguuugacucucaaacccauuagagucaaagcaggagaugccuggagacuuguccucuuaguucuuuccuuuuucuuucuuucuuuuuuuuuuuuugagauggagucucacucuguugcuggggguggagugcaguggcgcagucuuggcucauugcaaccuccgccucccggguucaagugauccuccugccucagccuccugaguagcugggaccacaggcauacgacaccacacccagcuaauuuuuguauuuuuaguagagacaggguuucacuguguuggccaggguggucucuaacuccugaccucaugugauccacccgccucggccucccaaaguguggggauuacaggcaugagccaccacgcccagccuuggccucuuaguucugagcuaggacaguuggagaaucugcccucaaaaauagucaggcccuugaagacucuguguguguguguguguguguguguguguguguuuguguaagagacacacagagagacagaagagagagagugauagcaagggagugggggguagggagagagagacaucgauucaguagguucuagaaaaaaguggcacagguggcuucucccagaaaagggaaagacaugcccucuugguucucugacuccuaacuggcauuuaaaauucacuuuuuuguuguggauuuuuugcccaacucuacuaggaauuguuuaaaaguggaacguucguaucagcucacuuuaacaguuugcuuuccauuuucacauucaaaagccugucuucgguuucuaaggguugcacauguauuugugcaggguggcuggccuuuguuuuauuuucaaguucagcuuaaauuugaccuggcaugagagaaugagaaugagagagagagagagagaaagaaacagacagacauggaaucagauggacaggggcacauagaaaaucuuugguuugagcccaggagaggcucucaagaggugagaggaagacugacccuauucucuuugugggagagagaagggaaggagggaggaagggaggacacaggaggacauggcacaggagggugauggcugcagaugggggaggggaggcaucaggcagccuggcucuaggaucagauaaacauguuugccacagagcaccaggcuggacuuuguacugcccuuccuucugagcucugacuggcacucagcaaagcagggagaugaaggagagaggauccuaggagccccggaaagaagggagagagagaagcuggggagaggccugcggggguggggugguccuggcaacaugaaauauuuuugagucccaacuagaucaccuugcacaagugacugcaccuuucugagccucaguuuucuccucugcaaaaugggcacaccgucuacuuccuaggguuauaagauguaaguggccaguccucagcacggugccuggcucacaguaaauccucaagaaacaugaguucucagacuuuuuuuuuuuuuuuuuugagacaggauuucacucugucgccaaggcuggagugcaguggcgcgaucacagcucauugcagccccgaccucucgggcucaagagauccucuugucucagccuucuaaguagcugggacuacaggcuugugccaccacacuuagcuaauuuuucuauuuuuuguagaaacagggucccacuauguuguccaggcuggucucaaacuccugggcccaaggaauccucccaccuuagccuccugaggagcugggacuacaggugugcaccaccaugccuggcuaauuuauuuuuuuuuuuauagagacagagucucacuauguuguccaggcuggucuugaacugcagggcucaagugauccucccaccucggccuuucaaagagcugggauuaccaccaugagccaccauacccaguuuacaauucaguuuuaaauauuauauaugccaaggugggaggaucgcuugagcccaggaguuugagaccagccuggccaacauagcaagacccugucucuaugaaaaaaaaaaaauagaaaaaagaagaaaaaguacaaaaauuagcugggcauguuggcaugugccuguggucccaaguacuugggaguccgaggugggagaaccaauugagcccaggaguuugaggcuacagugagcuaugaucacgccacugugcuccagccugggagacagagcaaguagccucuaaaaagaaaaauaaauaaauaaaaauaaauauuggcugggcacgguggcucacaccuguaaucccagcacuuugggaggccaaggcagauggaucaccugaagucgggaguuugagaccagccuggccaacauggugaaacccugucucuacuaaaaauauaaaaauuagcugggugugguagcgcacaccuguaaucccagcuacucgggaggcugaggcaggagaaucgcuugaaccugggaaucagagguugcagugagcugagcucgcgccacugcacuccagccuggccacagagcaaggcuuugucucaaaaaaaaaaacuaaauaaaaauaaauaucauguaugcauauauaguauauauuauguaauuuacaaaguacacaaggacaacagagaaaacuguccuucucacucccauccccagcaccccguucuccucuggaaggaaccagaguccccaguuccuugcgugcccuccgguauuuuacacgugcacaaauauguagaaauccucuuuuaccucacuucaaauuauucauaaguagcagcacagcagacacaccagauaaacucugcuccaccugggcacacagagcuuccucagcgggguuuuuucagugguugcauugaacagaugcaccuccauuuaguuaaucaguauccuuuugcugggcuccuugguggcuuccaaucuuuugcuauggcaagcaacguggcaaggaauugccuucuacuugugccauuugucaccugugccaauauuaaaagccacaaauucuagaagcgaauugcucagcgaggcaggggaaagcacaggcuuuggaaucacgcagacccaaguucaaaucccagucugccuguuucagugcugcuguauugagcuguauuuaucuguaacuuuuuguuuguuuguuuguuuuuugagacggagucucacucuguugcccaggcuggaaugcaguggcgcgaucucggcucacugcaaccucugccucccggguucaagcaauccuccugccucagccucccgaguagccgggauuacaggcaccugccacaauaucugacuuauuuuuuauuuuuauuauuuuuuucguagagaugguuuucuccauguuggccaggcuggucuugaacuccuaaccucaaaagacccgcccaccuuggccucccaaagugcugggauuacaggugugagucacugcacccagccuaucugugacauauugguaauauaaguucaggagagggagagagaaagaggcagggauugagacagagcaggagaggaggagagaaaauuuauauggcucaggcagucugaucccuucuguucccccacagggagacccacagcagagacaugacucacagguggcaucaggucccuuugagucucucuggugggagaaucucaacccacagaguaggauuccaguguucacaugcauuuuugguacuaugaggccucugaaugucaacccugucaccugagacucuguugaaaaaccagccgcggccgggcgcgguggcucacgccaguaaucccagcacuuugggaggccgaggcaggcagaucacaagaucaggagaucgagaccauccuggcuaacacggugaaaccccgucucuacuaaaaauacaaaaaaauuagccgggcgugguggcgggugccuguaggcccagcuacuugggaggcugaggcaggagaacggcaugaacccaggagguggaacuugcagugagccgagaucgcgccacugcacucgagccugggugacagagugagacuccaucucaaaaaaaaaaaaaaaaaagaaaaagaaaagaaaaaccagccuccuguucuggugcugcagggaaacaggccuggccacagccaagggugcagauuuucaggaagcauuuuuaaaaauauauauauauauauauacacauauauauauauacagagagagagaagccacugaggcccacagaauuugcaucauuuuauuccuuguccaaggucacaggacaagcagagucccacccaccugaaaggauucaguucuaagacagccuuuagggcaaaaagucacaaaguugaucuaucuaucuaucuaucuaucuaucuaucuaucuaucuaucuaucuacguguuugcacccuaaucacuggcaguaaaugcacuuuuuuucuuuucuuuucuuuuuuuugagacagggucuuguucugucacccaggcuggaguagguguaaaauuggagaauccauauuucuuuccuuguuuucagauuuaaugcuuuccuuuuuccagcaggucuccuucguccauccauccaucauccaucuacccacccacccaccaauccauccauccauucauccaaccauccauccauccaucauccauccacccacccacccaccaauccauccauccauucauccaaccauccauccauccaucauccauccacccacccacccaccaauccauccauccauucauccaaccauccauccauccaucauccaucuacccacccacccaccaauccauccauccauucauccaaccauccauccauccaucauccauccacccacccacccaccaauccauccauccauucauccaaccauccauccauccaucauccauccacccaucuaucuguccauccacucuacccuaccauccauccaccaguccauccaucuauccaccaauucauccauccauccacccauucgcccauccauccauccacccacccauccauccauccguccauccacccauucauccauucauccauucacccauccauccauccacauaucuucaucuguguugugugucuguguauccauguuucuaaaccuuuaucuguuccagugucuguauccauaggccuguguccacguuugucaugugugugcgucuacaagucucuguccucaugaccaugugucugugucccuguguccuggcauaaaugaccauaccucaccgucccugagucuauguguaggccccugggcuccauaacugcuuucaugcacaguccccacccucaggguugacaagguuccagcacccaggaccgcagccccaccuauggggagagacagcccuugcugagcagaucccguccuugcccucucccagggaggacccguggcguguggcgaagauggucaaguccuaccugcagcagcacaacaucccacagcgggagguggucgauaccacuggccucaaccagucccaccugucccaacaccucaacaagggcacucccaugaagacgcagaagcgggccgcccuguacaccugguacguccgcaagcagcgagagguggcgcagcguaaguaaugacccuaccccgcaucuucccugggagggcccaggacucuccccuaacucauaggugggggcuggaagcuucaccauccccauuacacagacagguagauggaaaggaagucagugggauucaaccugcauuuauuaccuauucugcgccaggcacucugugggacgggaguagacuugguccugaacauccaaagaugaaugaaaugggucccugcuuucuuuuucuuuuuuuagauagaguuuugcucuuauugcccaggcuggaguucaguggugcgaccucagcucacugugaccuccuccucccagguucaagcaauucuccugccucagccuccggaauagcugggaucacaggugcccaccaccaugccuggcuaauuuuuuguaguuuuaguagagacggggguuucaccauguuggccaggcuggucucgaacuccugaccucaggugauccacccaccucagccucccaaagugcugggauuacaggcgugagccaccauacccggccugggucccugcuuucucagagcccaugguuaagugggaaagugggagaaaagcucauuaugauccagcgagucauguauuagaaugggacaacagcagccacaacaacaacaauaauggccacuauuuaucaugcauuuuuggggugccugguccagugcagaguauuacacaaagcauuucagggugcugagcugacugucgacuggggaguaaccuguucuuccucaggaaggcagagguaucaggaagccucacauugcaaauaugaccuuuagaauaugaccuuuagacuaggucuuaaagugggaguugaauuuugacccauggagacgcagggaaggguguuucaggcagaaggaacagcaucaguaaaggcucagaggcaaggucuacggucaggaaauccuccacugcaaacucaggaagcucugggagcccuauuacucagggaaugguggguuuucuucuccaggccucauaccccaccaaaucccaagggcacugucaccuuccaaccuccaucuaugugugacauuuuuugacauuucuuuuauuaauuauccagguuaauuuuuuuuuauuauuuuuuuauuuuuuugagacagagucucacucuguugcccaggcuggagugcaguggcgugaucucggcucacugcaagcuccgccuuccggguucaugccauucuccugccucagccucccgaguagcugggacuacaggugcccgccaccacgcccagcuaauuuuuuguauuuuuaguagagucgggguuucaccauggucucgaucuccugaccucgugauccgcccgccuuggccucccaaagcgcugggauuauaggcgugagccaccgcgccuggccuuaauuauccagguuuuuaaaaaaggaaauagccaggcaugguggugugccauaaucucagcuacugaggaggcugaggugggaggacuguuugagcccccagggguucggcuccaaccuggacaacauggcaagguuccuccucuaaaaaagaaagaaaggaaagaugauaggaaagggaggaaagauaggaaagggaggaaagauaggaaagggaggaaagguaggaaagggaggaaagguaggaaagggaggaaggaaggaaggaaggaaaagaaaagaaagaaaaagaacgagagaaagaaagaaaggcaauacacauuugguuaaaaaaaaagaagaaaaacagaguuuauaagaaaaauuagaugccuuuacccuaaagcagccacuggaauucccagacucuuguguauccuuccagagagauuuucugcauauaguagcaauagauauguuauuuucuugcucuuuuucugauuaaugggaacauacuagacacacuauuuuacauguuguguuuugucucuuggcaauaaauccuguauaucuuuucauauuggcacugagagauugauggaucucauucuuuauaagggcugcuggcuguuauuuguuuaacuggccaccuacugaaggacuuuuagggauuuugcaaucugcgaauacaaccaacugcagcaaaaaacauccuucuuuauauaagugcauguucacaugugacugugucuguaggauaaauuccuagaaguggacugcuggaacacagaguagcugcuuuaaaaucuuggguacauauuggcauaguuccuuccaaagaaguuauaucaauguacacuuccaccagcaguaaaaaucacuguugaaaaaaaaaauguaugcaggccgggcgcaguggcucaugccuguaaucccagcacuuugggaggccaaggcagguggcucacuugagggcaggagucugagaccagccuggucaacauggugaaaccccaucuuaacuaaaaauacaaaaauuagcuggacauaguggcgcaugccuguaaucccagcuacuugggaggccaaggcaagggaaucgcuugaacccaggaggcagagguugcagugagccaagaucacgccacugcacuccagccugggugacagagggagacucugucaaauaaauguauguauguauguauguauguauguaugauguauguauguaugcaugcaugcaugcaugcaauagacaacucuaguccuuacucuauagcuaccccucaucccaauuauugggguguucacacucuacugugcuguaauacacacuuggaaaaacaguacauuuuaauacuauuuuaauuuguaugagaagaaacaaagauuuauucugaaaaucuguuagaacuagauuuaguuucugagagaaauaguguucuccuaaaaccaucacuagacgaaauuuuacaauauucgauaaaaugcauuaaaaaauuucuaacaguuagaaaugucaucaaggacuucagccuagagcugagaauagagaugcaaacuguggcccaaauagcuuucccugggggauuuuuaacuuuuaaggagaaauuggagaauuugagaugcagagucaauauaugacuguaguauuaggacucuuucaguaacaggggacagaaccccaacucaaauggauuuaaacagaaaagggaaugaauugacugaagcaaugugaggaguccagggcugcuucaggcauggcuagaucaaggggcucaaaugagguucacacagcauuucuugacucuuuucuuuuuuguuggcuucauucucagacaggcucuccucauauaggcaaagauggguucuggaagcccugggcugccauccuaccagcuuagcaaccuuggaaggaaaagagcucuucuuuucagcuacuuucaguugaaugacucuuuuuauacuugauaauguaaacuuuuauuuauuuuauuuuuugagaugaggucuugccauguugcccaggcuaguuuugaacuuccgggcucaagugaucccugccucagccucuuaaguagcuggaauggcaggcacacaucacugugucugcuauaacagaaacuuuuaaaugaagucuaacauaaaaagugcccaaauccaaagcauacaguucaaugaauuuucacaaagugaacacaccaauacagauaaaaaauagaauauuaccagcucccagccuggugugguuguacccaccuguaaucccagcacauuugggaggcaaaagugggaggaucacuugagccuaagaguucaagaccagccugggcaacagaaggagaccccaucucuccaaaaaauacgaauaaaugagccagguguggugcagcagguguguaguccuagccacuuaugcccgcugcuguuucuuggcacugagauggugagggcccugcugcugcugcugcgccccugauucagaaucuaccuuccucucuucucauaaagugcuguccuagcacuugugugucccaguccuuugguggccugcucagggauaagcugguagaccaguuuccaguaaagugguaccagcugaugaaggcuggcugggucucuuccucuagcuaacauuugcauuuuaagccugauuuucaagucuggaaagcugaauauaauucugaauacacugaggacauauggcucaaauuuuugcucuacugcgugacucuggaaaaauauguaagcucucugagccucagcuuccucaucuguacaauggggauaguaaaugugccaaaucagaacaaaugcuaaugcuuaccugcagucuuguacugagaaggauggugagaucauaucuuggguugguaggaaagcauucagggauugauuagugauguuugccuugaacacagguuaagaaagugauggcaugugugcuguguguuugucaucaguagauuagaugauuucuaaguucuagcuguaagcuccucugguucagcgccauggcaaugagaaagaaucaagggcaaggucaggggaauggacgugggaaggugagaguggccaguaccccacucacggcuuucugugccugcagaguucacccaugcagggcagggagggcugauugaagagcccacaggugaugagcuaccaaccaagaaggggcggaggaaccguuucaaguggggcccagcaucccagcagauccuguuccaggccuaugagaggcagaagaacccuagcaaggaggagcgagagacgcuaguggaggagugcaauagguacaacggcgggcgggaaacagugcugguuuggucugggcugcggcaaggccagggaaggggaaggugacucuagguccuguaaaaggcuguccaguugccgagaacuccugauauuggcuuagccuggcccagaaaauugagaauacuugaaccuaagcccauuccucgcagccccccugcacccuggacaccaagcaaccccuuccauggaugcucacccaauucgauucucucuacaauccuauggcucuuuugcucacuuuaugaauggagagacugaggucagacagacugucaauugcccaaggucacacagcagaccuggcauuggaacccagaucugccagccucaaacccuccggcagagcucagcuucucagaacccuccccuucaugcccaggacaggguuccucugagccuggccuggaggcucauggguggcuauuucugcagggcggaaugcauccagagagggguguccccaucacaggcacaggggcugggcuccaaccucgucacggaggugcgugucuacaacugguuugccaaccggcgcaaagaagaagccuuccggcacaagcuggccauggacacguacagcgggccccccccagggccaggcccgggaccugcgcugcccgcucacagcuccccuggccugccuccaccugcccucucccccaguaagguccacgguaagugguauguggggacaagggacacgugggaaggugggaggguuggggaggacugucccagugacagcagucaccuaaaccucuuugcacuucaguuugguuccauuccauucaugccacuccuuaucacucuacuucacucuguucauucauccauuccacucuaucucauuccauucacucuacuccuuuccacucuauucacuccauccaccacaauuaaccccauuccauccacuccauccacuaccuucgacuccacuccauccacucuacuccauucacuccacucaacuccacuccauccacuccacuccguccaacuucaucccauccacuacauucaacuccacuccauccacucuacuccaucuacuaccuucaacucuaccccauccauccacuccacuccauccauuccauccaacuucaucccaucuacuacauucaacucuacuccauccacuccacuccauccauugcauccaacuucaucccaucuacuacauucaacuccacuccauccacuccacuccauccauucccuccaacuucaucccauccaguacauucaacuccacuccauccacuguacuccaucuacuacauucaacucuacuccauccacuccccuccauccauuccauccaacuucaucccaucuacuacauucaacuccacuccauucauuccacuccauccauuccauccaacuucaucccauccacuacauucaacuccacuccauccacuccauaccuggcuccauccacuccacuccaucuacuacauucaacucuacuccauccacuccauacucuauuccauccacuuacuccauccacuccauucagcuccacuccauccacuccacucacucaacuccaucuacuccacucccucuacuucauucaacucugcuccauccacuccacuccacccauuccauccacugcacuccaaccagcuccauuagacuccacuccauccacucuacccacucuucucuccacuccucuccacuacauaccauuuuauucuaucugucccauccacucaacuccauucacuccacaugacuccacauuucauccauuccacucuacuucauccacucacuccacucuauaccauuccacuccacucuauucacauacuccaccauuccagucuacuccauucacuccacuccaacccacucacuccacuccauaccauuccacuccacuguguucacacaacuccauccauuccacucuagccacuccauucauuccacuccacgccacacuauuccucaccauuccauccacuccacccuauaccauuccacuccacucuauuccuccccacccguccucuccacccuuuaccacuccacucgacuguacccauuccacuugaucccacucauuccacucaauuccaucuacucuacuccacaccauccacuccacuucauaucauuccacucaacucaaccuaaguugauuuggguuaauucaauucaauucauucauuucagauuguaucaauucaauucauuucaauucaacuaaauucaguuaaauucaguucaguugucuucuacugagcaccuacugcaugucagguauagcacuaggcagugggaggaauggagcuaauaaaugcagucccagccuucaaggaacugggagcagcugacccagggcuuggcaaaagguagaaacaaaggcagauuugcuggcugcauaaaggcagacaggcagcuggccuaagcaaaccaauggaguuugaagugcugagggcuguggaggcaggggagggcagggaaguggggugcugaggcaggacacugcuucccucuccaggugugcgcuauggacagccugcgaccagugagacugcagaaguacccucaagcagcggcggucccuuagugacagugucuacaccccuccaccaagugucccccacgggccuggagcccagccacagccugcugaguacagaagccaagcuggugaguguccuugcuuguaaggaaaacccaaccucaucuuuccuuggcagggagauucuggagcagucccuagggaggcccuguggggaccccggccccccggacacagcuuggcuuccccucguaggucucagcagcugggggcccccuccccccugucagcacccugacagcacugcacagcuuggagcagacauccccaggccucaaccagcagccccagaaccucaucauggccucacuuccuggggucaugaccaucgggccuggugagccugccucccuggguccuacguucaccaacacaggugccuccacccuggucaucgguaagcugguggggaugggugggcaccugggugggaggcucauggggcaaccgcagaauccaggagcuggaagagccacugggacucauucauucauucauacaacauguauuuauccagugccuacucuggaccagucacugugcuacaucagugauaccugggugaaccaaacagaccaaaaucucagcaacucaagcagggaggcaggcacuaagcauaauacaucaauucugugguaccucagaaggugaagggucuaugggcaaauuacagcaggguaagggggacugauguuuucuaaguuuuuguuuuaugaagaaaaauuaagcccagaaagcccuuauuugcagguacaauuaugcagaagcccaguacauaagauagauaaggagcugcuaggagaggggagcagagaacugaccccauggccuuugcacugcuguggaaccccagggcuccagggaaccgcaguuugacaacuuuugaacaagucaccgccugccucucccacuagccuagacaaagagcuaaaggcucagagagggggaaugacuugccagagccacuuaaauuaguggcaggucccaguggagggcuguuuccugaccacccugcccccuccuccaaaccacgggcucugggaaggagagguggugcccuugggaggucuugggcaggggugggauauaacuggggggcccagcugauucccuccccuuccacuccaggccuggccuccacgcaggcacagagugugccggucaucaacagcaugggcagcagccugaccacccugcagcccguccaguucucccagccgcugcaccccuccuaccagcagccgcucaugccaccugugcagagccaugugacccagagccccuucauggccaccauggcucagcugcagagcccccacggugagcgcccugugccccacacagcaggagaugaugauagagguuggcugucaauggaugcaggggaaaggggugccuggcaggcauugcagucugcaugugucucugggacaaguguguuuccgugauugagggugucugcaggccaguguguucccaugugaaugcacguaucugugugugugcacgacugcuugugugagcagaucccuagugcgugucuggguguguaucgguugugcaugcauuugugugcaugccuguguuucucugaaacucuuagggccauaugaauuucuaaaaucuauucagauuuuagaaagguaaucuggggccaggcgugguggcucaugccuguaaucccagcacuuuggaaggccgaggugggcagaucacuugaggucaggaguucaagaccagccuggccaacacggugaaaccccgucucuacuaaaaguacaaaaauuagccaggcguggaggcacgugccuguagucccagcuacuugggaggcugaggcagaaucgcuugaaccugggaggcggagguugcagugagcugagauugugccacugcacugcacuccagccugggcaacagagugaguacucugccaaaaaaaaaaaaaagaaaaagaaaaguaauuugguggauaugccagcuaucacauaacacucccagcaggguuugagacagcccccugugaucaaagcacugcuauuucugcagccaaagauaggauuuccacaaggcaguuuaaacacucauaaccucauaccagguucaggcuggguuucgccaccaaaugagcucuagugccaaucuuaaggaaaucuuuugguuucagaccuuuuuggaauuugggacuggguuaagagauuuggggccuguguaugucuguguguacaugguugagaguguaugcguguguguguguuacauuuuuaucugagucacugugagaauaugugguuuaugugcguuuuccuagugucugugugucucuuguagggucuaugugucuccugagggguggguggaggugcuguaggcaaaacaugggguuauauuuggaaagguggccuggagauggaaguacugcuguccucugccuugcucuuugacaggggccaccugaacuuacuacacagcaccugaguuuaguacaguagcaccugugcuuaguacauagcaccuguguuuaguauaguagcaccugugcuuaguacauagcgccugcauuuaguacaguagcaccugcgcuuaguacguagcacccgugcuuaguacaguagcccugcaccugcaccucccguucccuuucauaccugcugucuccaggugacaagaggagcuggaguugguuucuggccuccuccaggcuccccugcaucaagcgcagcugagcaguucccuguaauggggagagggucugucccuuuaucuggagccuccaguuuugaaaaucagcccuggaucuccaacugcugcccagucuggcuguucagcaggccccaugccccccuuuccccagucuugaggccugggacuagggcugucaggcacgucugccacgucugccccucucuccccugcggccagcccucuacagccacaagcccgagguggcccaguacacccacacgggccugcucccgcagacuaugcucaucaccgacaccaccaaccugagcgcccuggccagccucacgcccaccaagcagguaagguccaggccugcuggcccucccuuggccugugacagagccccucacccccacaucccccgggcucaggaggcugcucugcucccccaggucuucaccucagacacugaggccuccagugaguccgggcuucacacgccggcaucucaggccaccacccuccacguccccagccaggacccugccagcauccagcaccugcagccggcccaccggcucagcgccagccccacaggugagaggcccuggcuccacccccucccuuacugucccugcccccuuccauguuggucccaccccuucuguugcuguccgucacuguggggcugugcaugcagcaggccuagggcugcugugaggaagcacuggcaggcguggagggguggggugggcuuccaugaagcccaagaggcacaggcgaccccaggaagauggggcccaccuuacaagaacaucucagggacuggacugaggaaaaugaugaaguaauuguuagaggcaguggagaguaacgauaaggaccaggucugugagccagaagcgacucuugcauguguuugguuuggcuuggcucaggguugaacauucuuugaauuuguugccaacauuucaaaaucaggaauuuucacauagaaauccagauuucuggcaucuuuuggaaaauuggaaaaauucauauucccauauaacagugcaccaggccucacugcauccacucacaucggcuccaaugaccccuggcgguggggcggucaccugaguuuguaaucuaugaugccauugucaggagugggcacuuuggagucaggugggugggcuuugcagccugccuuuuugcaagcugcccccuuucuauaagguuccuggacccggcccuggcagcugucaugacagccacugaggccauucuguguccuggcauucaccccaugaggcguguccaugaccacccccauuuuacagaugagaaaguggacacucaaggaggggagggacuugccucaucucccacagcuaccagauggcagggccaggacucgaacccaggucccaccucaaagcccauucucuuaaccauugccaucagucaggguucuccaggaacacagaaccaacagauuuauuugaaggacuuggcccgugucugcggggggcuggcaggccugaaaucuguugcuggcagcucuggggagugaauucugcagccuugaggcagaauuccuucucugggaaaccgguuuuugcucuuacggccuuccacugauguaggaggcccacccauauuuucaggguaaucuccuucacucaaagccaacugauuguggcauuaaccacaucuacaaagcaccugcauucacagcagcgccuagauuaguguuugacucagccuagccaagccaacacguacaacuaccuaccucggcaucucaccggggcuucuccaguguucacacuaagauguacucaggccacuccaugggcggccguggacccuggcugggaggcucccuuugaagaaccgaggguagaggugugacuuugggguuccuguuaucugcugugauccaggagguguggcccugccuccccauccugaguaccccuagggacaggcagguggggugggugugggugccugguggguggcuagcagccuuguuugccucugcaguguccuccagcagccuggugcuguaccagagcucagacuccagcaauggccagagccaccugcugccauccaaccacagcgucaucgagaccuucaucuccacccagauggccucuuccucccaguaaccacggcaccugggcccuggggccuguacugccugcuuggggggugaugagggcagcagccagcccugccuggaggaccugagccugccgagcaaccguggcccuuccuggacagcugugccucgcuccccacucugcucugaugcaucagaaagggagggcucugaggcgccccaacccguggaggcugcucggggugcacaggagggggucguggagagcuaggagcaaagccuguucauggcagauguaggagggacugucgcugcuucgugggauacagucuucuuacuuggaacugaagggggcggccuaugacuugggcacccccagccugggccuauggagagcccugggaccgcuacaccacucuggcagccacacuucucaggacacaggccuguguagcugugaccugcugagcucugagaggcccuggaucagcguggccuuguucugucaccaauguacccaccgggccacuccuuccugccccaacuccuuccagcuagugacccacaugccauuuguacugaccccaucaccuacucacacaggcauuuccuggguggcuacucugugccagagccuggggcucuaacgccugagcccagggaggccgaagcuaacagggaaggcaggcagggcucuccuggcuucccauccccagcgauucccucucccaggccccaugaccuccagcuuuccuguauuuguucccaagagcaucaugccucugaggccagccuggccuccugccucuacugggaaggcuacuucggggcugggaagucguccuuacuccugugggagccucgcaacccgugccaaguccagguccugguggggcagcuccucugucucgagcgcccugcagacccugcccuuguuuggggcaggaguagcugagcucacaaggcagcaaggcccgagcagcugagcagggccggggaacuggccaagcugaggugcccaggagaagaaagaggugaccccagggcacaggagcuaccuguguggacaggacuaacacucagaagccugggggccuggcuggcugagggcaguucgcagccacccugaggagucugagguccugagcacugccaggagggacaaaggagccugugaacccaggacaagcauggucccacaucccugggccugcugcugagaaccuggccuucaguguaccgcgucuacccugggauucaggaaaaggccuggggugacccggcacccccugcagcuuguagccagccggggcgaguggcacguuuauuuaacuuuuaguaaagucaaggagaaaugcgguggaa

SEQ ID NO: 61600 - RNA, 23944 nt, Homo sapiens; identical to SEQ ID NO: 61599

SEQ ID NO: 61601 - RNA, 78825 nt, Homo sapiens
uucccggaccccuguuugcuuuagagccgagccgcgccgaugcccucacacucugcgccuccucucccgggacuuuaacaccccgcucuccuccaccgaccaggugaccuuuugcucugagccagaucagagaagaauucgguguccgugcgggacgaugccugagcaggagagacagaucacagccagagaaggggccagucggaaagugaguuuuguucccccgcguccgcgcagcgugcucacucccaccaggaggauuuuccuccccgcguucggcgcuuacucgcccccagggggugcgcagggaaggccgagccagaccccagcuccagggaugucuuggcgugggagaaaaggacccuuuagaaaaagugugccgucaacugauguuugggagcaauggaaaaccccgcaccucaaaauucaucuuuaugcuuuuaaggggucugaugcuggagagauaaagugagcgucgaguugcugugcuagagcccuaauggcucaaaacgaugaaguuaguuaccuggagaaguuacucagagccuggugcuuggaccagauaugguauaucgagguccuggaacuuuuauaacuguuuuaaauucauuuuaauuguacaaguaauacauuaagacagucuuuuaaaaauggaaacagcacagaaauauuuugcacaaaaagcagaucuauuuuucagucuuuuucuauucacguacauaugucuucauucggcaaauauuuauugagaacuuucuauguuucaggcacacaguguugaguugauacagugguuaacaagacauguaucuauauguaauaugcacacauucagagaaaucuuuagguuucauuuguaugagguguuaaaauuuuuguuuuaccuaaaugagaucacuguaugugcauucucuuuuuucaguuuaacgauauaucuuagagauuguuucacuaacugucuaauucagugcaaccucugcacaguuuggacgcaucauaguuuauucaugguuuccuagugguggacguucuguuugcuacuuuuuuucucucucucuugcaagugaacaucuuuguacaugauuuuuaaugcugacacuauuucuuuaggauagauacuuaggccuggauugcuggacagaacaguaggcuguuucuuuuccacagauuucugaaacuaauucacugacguugcugggugcccuuuaguagugaauucaucuaggcuccggugauacagaaaugaaaacuaacggauuaguggacagacagagagaggcugguuaguaggugguuuguaggguaugaugacuaugcauuugauaggaguaugaagaaauguugggagggguggcuuguacagaggagauuucaacuuccuacaguguccccaccuagagaaagaaaucauuauccuuccaaaucaagcucaagaccugccaccuccuugaaacguucuguaacugcuccugcccauguugaccugucuucuggaauccucugauaauagcguugaccagcguuauugagcuuacugugugcugggcauuguguuaggcacucauaucccucuaugugcacucucgcguuuaauccucacaaaaacccuuugauguagguauuauaucuuguuaucaacauuuauucaacaaauuuuuuuguguguacuaugugcucaaacacauaguacucaaaguuuuagacacuggggauuuagguaggaccgagaccuugcccucaugaauuuacauccuaguuggagauaggaaaaaaaaagggauaaacaaauguauagcguaggaguuaagggaaaacuuuugugccccgugaagcgucacugaaaaaucaacugacaaauggcagauuaauaggagagaaggcauacacauuuacuaacgugccgugagagucuuacaacauaagaucucaaaggaaggcaaggugguugccacaauuauacuauccugagguuacagaaagugugggggcucuaagcuuggccaaaaacagguuaugguuguaaaucagguuauaggagggagagaagaggagaccuggcuagcaaagguggucuuauguagaugaaaccucacagguagcagcccucagggagaagaaauguuucagaccuugaaggugccaaauucagcuaaucucacccagauccagacaaggaagggcccucugagaaaaacuggcugcgucaauggagguucucaacagaugcucaucucccucacaguaggacuacuuuugucuguaggcccucugaacggccaucucaaaauauuuccaauaagucuguuuugaggugaaauguuuuaguuuccuucaauagcuuuauuucagguacuaguaaguacuaugaagaaaauaaagcaguuuggguccaggaguucaagaccagccuggcagcauaucaagacaucguuuauacaaaaaaaaaagaaaaauuagcugggcauaauggugugugccugucgaaccagcuacucgggaggcugaggcaggaggauggcuugagcccaggaguuugaggcuacagugaguugugaucccaccacugcacuucagccugagugauaaagcaagauccugucucaaaaaaaaagaaaagaaaagaaagcagaauaagggaauaagauagggauugacauggguggagaggaagaugcuguuuuaaguagguggucagggaaugauuucucuuggaagguaggauuugaguagagaccugaaugauucagauuucagagaaguagccuagguugagaaaccauaaagugugagaguccuacggcagucaugugauaagaagaaauauauacuuggucuugucccaaguuccugacauagagcuucuuaaaccguuguaauuuccugagagauggugauaagagcaucuuuuguuauucauaacaagucucuuucaccccuaccugaguuucuguuaaugagagggcucuugauaggccccuagauagcuucaggauggagacugauugccagaagaaccaaccaugugauuaggggauucgaauguucagccccgugcuccaaccucuggagauugugccaaucaccaguggacaaugaucuaaucagugaugccggcagaauagagcuuucuuuaaauuuuuauuuauuuaguuuuuugagagguagucucacucuguugcuaggcuggagugcaguggcgggaucucgguucacugcaaccugugccucccgggcucaagugauucuccggccucagccuccugaguagcugggauuacaggcgcacgccaccacacccagcuaauuuuuguauuuuuaguggagacgggguuucaccauguuggucagggucaucucuaucucuugaucucgugauccgcccaccucggccucccaaaguguuggaauuacaggcgugaggccacugugccuggccuuuuuuuuuuuaaccaaugcaguggaucacaaauagagcuuucuuaaaaacccuaaaugauggguuuuggagagcuuccuguuagugaacacaucaaggugcugggaaggugguuccuggaaaggauauggaagcuccuggaaaccuccauucccauauuuugcccuaucuuuuccauguggugguuucuuagcuguauuuuguauaauaaacuggugauauuaaauaaagugcuuuccuaaguucugcgagcuguucuagcaaauuacccaaccugaggagguaauuguaggaaccuccugacuuuacaguuggucaggaguacagauggcccagacccagcgacuggcaugugaagugugggcauucuuguggucuugugggccugagcccuuaccugugggguccgugcuaacuccagaugguuggugucggaauugaauugaauuguagggcacccaguuagugucuggagagagagcauugguuggugugaagaaaaaccccacacauuuggugucagaagugucgugaguggaaacaguacagaagacaugauguuagaguuuggggaacaauaggaaagccagaguggcuguggcagagggaaggagugggagugauagaacaggagaucagaguucaucauugcuuuacagauggggaaacugagccagacacaaguuaaguaacuugcccgauguaccuugcuuauaagaggcagaucuaggauugaguccuagccaggccugccugacuuucucagcgauuuuuuauugucaaaacuuacuugacacuuggucauaccaccugguaugauuauuuaaugaauauagcuuuuauuugcaacucugugcuucuugaaaugggaaccggguuuuuaccguuuaaaaaacuauuucccacauguaggugcaccacaguuguucuugaaugaauggauucucgacaugauuucuccacauuguuuucucuucagaggccucucuguggggcagcagugaccuggucauucagccuucaguccacaaacauuauggagcacuuucuguuugccugguacugggccaagcagggggaugcauagaugaagagaggucagccccugugcuggaugcaugcugggacagagcugucuacaugguacagcacccacagaaggggcagaaaaauuccuucagugggagguggugcucgagugggucuuucaggaagagcaggcauugauugggcacacaggagcauggagagaagggcauugaaggcagagaccagcauguauaaagguccagaggacuggaaauggaaagaggcauuuaggggacugugaggggcguggcaaggcuggaagaguggaaggcuggaaggucuguggaagacccuguuuaucaggcuaggaguuuggacuuuacccuacaggaaaacagcguaagucacuccugcaaggcagagggugaacugggcagggagcugcgggagaccagcuagagacuguuggaaaugaucguccccauccagaccaaagguggcugaaaagccugaaaaagaacuguaaguugggucuucuacccuuauucuuuauggaauugucuucucaguagagaaacuaggcuauccaaacucaacuguccugaguauuagaggccaguggucguuuuagcagcaacagagugcaguugguaccuacggagcaggguaauaaacuaagcaagugacagagauggauuuaagugcuucuuuacgugacacacauuuucuucucaaugggagggauggagauggcccaguaacaugaacacugcucacugaugccauagcauagauaucgaggaaguauccguguucagugcugagagccccgaacaaagauuuacccacgaauuuauuaacagcaagccagucauuagcauuguuucuauagauauucauuaacuaaaaguaucccuuaugggaaaggaagggaugggccgaaauaaaggggugggucuggcuaguuaucugcagcaggaacaugcccuuaaggcacagaucgcucaugcuguuugugguuuaaggacaccuuuaagcaguuuucugcccugggcgggccagguguuccuugccuucauuccaguaaacccacaaccuuccagcgugggcguuacggccaucaugaacauuucacagugcugcagagauuuuguuuauggucaguuuuggggccaguuuauggcuagauuuuggggggccuguucccaacagaggcacaaagggacuaagauagaaauugguaccaagaaguggaguguugguauaacagaucccugaaaaugcagaguuggcuuuggaacuggguaaaggguagaggcuggaagaguuuggagguacaugcuggaaaaagccuagauagugauaaacuaagcauuaaggauuauuuuggugagggcuuagaagaacagagcuguagacagaaccugaaucuucuuagagauuacuuaaguggucaugaucagaauguugguggaaguauggacagcaaaggucauuuugaugaggucuuagacagaaaugaggaauauuuuauugggaacuagagaaaagcccauucuguuuuuauuuauaaaauggcagagaacgugggucaguugugucugugcccuaaugcuuuguggaggauagaugaugaacuagaugaagagugaugaacuaggauauuugguggaagaaauaucuaagcagagugugcagggugcugcauggcuucucuugauugcuuauaagaaaaugcaagaagaaaacaaauuaaagacagaaauuauaaucaaaagggaagcagaacuuagaaagauuuggaaaauuuucagccuggcuagaucauaaagaauaaaaaggcugcugggaagaaugaccuuaaagggauuugggaggucuuugggacugcuccuccugucacaggcccagagugccuggaccaugagggcaggagggagaggaccauaccccgccagcaggucuaugggucuaguugcccagggccaccucgagccucugcuuccugcauucugcggugcuccuuggccaccccaggugcggcucagguguggcuugggcugcugcucuggaaggugcaggcuauaaaccuugguguccauguggugcuaacugcagcugagcagaguucaagagcuguggaguguggcuacuuucaucuagauuuccgaggaugucuuggagaacccggggcccaggcagaaaacgucuauggggaagagccaccacagagugcccccacuagggcaguaccaucagucaugaauugggcagugccagacuacauaguucagggcuccaucuagggggaaugagggaaagacuuuguaaguguucagggaagcaaaacaaagagaauaauugauugguuaaaguagaaaggccuaguuauaagcugucaugagauuggagaaaaaaauaaaaauaaggaauaaaaaagacccuaguuagaguuuaguuggugguuccugauugaugaagucucuaguuagagauaguuaauggauugugauugguuaagcuaagcuuuguuuuacuguuuauauugaguuggguuugguuugcuuacauaggaaccugaaauguuggagucaucucagccuaauugcuuccugauuaaugauuuguuaacacaaguuaggaugcaacuccaucuuccugauaccucauggccuaaaacaguuguuggugcugcagccguguauuucaaguugcacauagcugaaauaagggaaaggcaaggauaauccugcucucucuuuuuuuuugagacagagucuugcucugucagccaggcuggagugcaguggcacgauuuuggcucacugcaaccucccucugccgggcuaaggaaacucuucugccucagccucccgaguagcuggguuuacaggcaugugccaccaugcccggcuaauuuuuguaauuuuuuuuaguagagacgggguuucaccauguuggccaggcuggucuugaacuccugaccucagguaauccgccccccucggccucccaaagugcuggauuacaggugugagccaccgcgcccggccaguccugcugucuuuuagggagccugcuuaggagcccugacaaacaacuuugccuuauauuccauuggcuagaacuuuggccaguuuucaacaucuuaaaaugggaagauuuuacuauguaaaacuccagcuauccaccuucucucggaagcucuggugacaccaggccuuuugacaacaguuggcuggagcugaggaacagcugccugcuccagguggggcaugagcuccuccuguggccgcaagccccgcauggccuguucugcucauuuaagucacugccuacuugugacaguacaggcaaaccuuugcuuuauugcccuuuugcagaugcuguauuuuuuuuuuuuaccaguugaagguuuguggcaacccugcacugagcaagucuacugacgccauuuguguaacagcauauacucacuucaugccacauuuugguaauucucacaauauuucagauuuuucauuauuauuauaucuguuacggugaucugugaucagugcucuuugaugcuacuguuauaaucaucuuggggcccguguaagauggcaaaguuaaucuauaaauguguacauucugacugcuccacugacuccagcaguucaugucucugucucucccucccucucaggucucccuauuuccuaagacacaacaauauuaaaauuaggccaauuaauaacccuacaauggauucuaaguguucaagugaaagaguccacucccuuuaaaucaaaagcuagaaaugauuaagcuuagugaggaaggcuugucaaaagcugagauaggcugaaaccuaggccucuggugccaaacaguuagcaaaguuuuuaaugcaaagguaaaguccuugaaggaaaguaaguacuacucuagugaacagauaaaugauaagaaagcaaaacagccuuacugcugauauggagaaaguuuuagugauuugaacauaagaucaaaccagacacaacauucucuuaagccaaagccuaguccagagcaagguccucagcauugaagcaaggccuuccacuagcagaaagaccaugacuuacugacagcucagaugauuguuagcauuuuuuugccauaacauauuuuaaaauuaaaguauauguauuuuuuuaggcauaaugcuauugcacacuugauagacuauaguguaaacauaacuuuuauaugcacaaggaaaccaaaaccuuugugucacucacguuauuaggauauuugcuuuauugugaugaucuagaaccaaacccauggauaucucugagagaugccuguauuugagcuuagaucccuggcuugaagggauaaaugaaugaguaagugagggaggagggagccagcuuuugcaugaggcuugcucccuuccccuccccuccccuccccucuccccucgccucccugccccucuuguuucacagguucucuguugcucagguuggaaugcaguggcaggcucacugcagccuggaucuccucgggcucaggugauccuaucaccucagcuucucgaguaguugggacugcaggcaugugccaccaugcccagauaauuaaaaacauuuuuuuuuuuagagacacgguuucaccauguugcccaagcugguuuuaaacuccugggcucaagugauccucccauuucagccucucaaagugcuaggauuacagguguuagcccccacgccuggcccugaauguugaguauugucggaaaguuuagcaguccuuuuacagcaagcacauuuguaaguuguuuuugcuuggcauucuuugucauucauuuaacaaaugcuuauugagaaauucuuuaagugucaagcacuguuuuagaccuuggaauaaagcagugacugaacaaaauagaugugaagaggcuguguguggugguucagaccucuaaucccagcacuuugggaggccaaaguaggcggauugcuugagcucaggaguucgaggccagccuggauaacauagugaaaccccugucucuacuaaauaaauaaauaaauaagcaagcugggcaucguggcacgcaccuguagccccagguacuugggaggcugagaugggaggaucacuugagccagggaggcggaggcugcagugagccaagaucaugccacugcacuccagcuugggugacagagugaaacccuguccuuaaaaaaaaaaaugugaaggauuccugcacuugugaaacuuauauccuaacuggggagauaguuguuaaaaagaguaaguaaaagauguauuauugcauuugguggugauugagaauucucaagaaaaauaagacagggaaggaugauagggaauugggaguguaugaaauuuagaugggaucauuugggggaaaucauugagaaguugacguuugagcaaagauuucauggaggugaggaagugagcccuuuggauaugggauguuggagggagguauuucuaagcuaguagacaguuccggaggcagguguaugcuuugcuuaccuaaggaacagcaagaucagaaugacuguuucagaaugaguaaggggccaggagugugaggauaaguuggaagguaaugggagggcugcaacuguauagucuuacaggucaucauuguaaggauuuuagguuuuauuaagcacaugggaacccccuagaggcauuuuagaggaaugacaucuugugacuuccucuuauagguauucugacuuuuguguugagaauagacuuuaggggcuaagagcagaagccaggaggucgcuuaggagauucuaagcaauagugcaggugagaugagcugguggcuuggaccaggguucuuguggauguguugaagucauuagaugcuggaugcauuuuguugguggaacuaacaggauuugcuaaacauuuacauguggguuugaaagaagaugauucuuuuuuacuuuuuaauuuuaaauucauuuuaauuauuauuuuugagacagaaucucacacugucacccaggguagagugcagugguccaaucacagaucgcugcaaccuccaccuccugggcucaagugauccucccaccucagccuucugaguagcugggacuacaagugugcaccaccaugcccagcuaauuuuuuauuuuuugaagagauggugucucacuauguugcccaagcuguucugaaacaucugggcucaagugguccuccugccuuggccuuccaaagugcugggauuacaggcaugagccccugcaccuggaugagauuauucuuaucaaagagggauccaggauuuuuuccugggcaaguggagggaaggaguuguauuuacuaagguggggaagacugugggagcagcaggggaagggcagaauguugagagcucuguuguagacaaguuaaguuugcgaugcauaugaaacaccgaggagauggugaugaggcauuugggucuguaaguauagaguugggaauuguaggcuauagguggugauauagucugaauguuaaugucccugccaaauucauauguuggaaccuaacccccaagguggugguauuaggaggugaggacuuuaggaggugauuuggccaugagggcucugccuucucgaaugggauuagugcccuuauaaaagaggcuugagggagccacuuugcucuucugccauuugaggaugcagcagcaaggcaccaucugugaagcaaagaacagccuucaccggauacugaaucugcuggcuccuugaucugggacuucccagguuccugaacugugagcaauaaauuuuuguugcuuauaaauuacccagucuaagguauuuugugauagcagccugagugagcuaagaaagguauacuucuccuggccuggaugaguguacaaggaaugaguagagauggaagagguccaagggcugagcugggggccacugcagcacuuggagguuuggggacuuggaggcucuggugaaagacucugaguaggagcuguuggugggaaggauaggaggaaaaucaggagguggggcaacuuggaggcugagcuuggagacaaggacuggucaccuugggcagugugucacuggcugagaguaaguaugggggugggcacuggggaccugaggagccagagaggggauaggaccacugucucggagagcgaagggugagcggacuaggggguaguuggacugccagguggcagcacggguccucccgcaguucguggugcugaaucagagugugggcagccagccuggaugugcguucugucacauucuuguugagcugcuagaggacaggcgugaagccaaguggaacugagaguaaagccguguuggaguuuugcaggaaggugccagaugaugagggcagccagcgaagucgaaggugcauggaaugaacugugaaauggaaacauuggcuuuuacuuuucgauaaucccauuguuucucuuuuuggccaucccaucucuucguaauuuagaacuaucauaaucguuuuucacucaagacuguucagccaagugcaguuuauuuaagagcacuccuucagugagcuuacuuagguauguguguguuugugccugucuccuguuaauaagcugauaugaaaguccugcugagcuaguuguuucagucuuggagaucagcagcgauauggggaggagaagccaagccucuguuaaagcccaccaguccuucccucccccgcucccagcaccuaguguuugaggaauucagacuuugaauacugcucuuugcuacuguucuucucuccuaacuugccaguaaacuuccaagggcaguaugugucuugugcuccucuccuggucuucuguugugcauacacuuaaauacggcucucaggcugugaauaaucugcuuugguuaacacuccccucuguucugaaggcugggcugcuagagcccugacuguugguggcugugcuguuugcagugcucauguucucuucuugggaacccaacauaugcagcuuuaaugucaggcucugcccuccuguccugucacaggauccgggacuccucuccccaucuugggagggauggccuggggauuucgucugggaagcccugcccagugugagccucuagcuggacugagcagguaauguuugugagugcugaaauauuuuaaccagaugucccuccuccaaagagcccuuuguccuggagguucauggaaacaugagcugcccaucugccuuugggcccaggcuucucagguugcaacaagauuguuuaggacaccaaagagauauuuauuuuuauacaggaaaaauccacagacugggaaggcgaauaggagguaaagaagaugaauuuucuucuggaaaauggcucgugaaauuuguacauauggaagacagaauaaucuagugcaaggaaauccuugaagaccuagaagaaauaugugagggacugauagaguuugcccuuguguugugguaagggggacaaaaaguaccaugaaauucuagguagaaagcacauucugagcaguauauaauugaacucauuuauuuaaauaugguuaaauauacuuauucaaauguaaauauguaaauauuuaacugcuuaaauauacuuauuuaaugucugauauuguucaucaccauguuaggucugugggcagcuaagauaugagauccuuguguuccaggaucugaccacguuucccaaagugagcacaugcccauaggcaucaguaacaaguguggacugagcugacugcagccucgguggacagagaagacuuguccuccagcaguguuacaggcugaccaccugcuggcacccugauguugacauuagugaugcuggaauucagauaagggagagagcugcuagcaggauuccacagagaggcaggacuuaaaggauaagaaggauuagauggugccgggaaggggaggagcagggaagccagggucaggugugaggaaaggggaaggugcuagaaagaggaguuuggacuuaauacuguagccuaggaagguggcccaugccuuggcuguuccacacgucucuuagauucuaugggagcaaaggagaagccacuguguuuaccccagacuugccuucuucccacccuccccgcucaucuugguguacucaucaccaugugcucaaucugcgaaacuggaaauggcauugucauccucaggcccccacuuuuugucaccugcugugauccagcagucacugaguugggaggccuccucguuuguuuaaucguauucuacuauuaaauuuucugccccuuguaaucccuccucuccugggucuucauucuuguuucugcccaaacuguuuccagaucacaaauaugauucugugaguucucuccucagaaacuccuggugauucuacaccacccacaggacaaagucuagacucugcccuuucuaaccuggccccagcccccuuuucuggcugucuucugggucugagccaccaucuagaaaugguuugaauggugaaguauuucaauuucauggagcuaacagaauagauuauuuaaaagcaugugggacauaugaucccaacauauuuuccuuauuagcuauucauaggcacagcacagaagaagcauuuauauuuauaaugaucucaugucaccaaggaaaaguuaaaauauguucaauaacucacuuuaaaaggcagcggaaaaauagaugucacuuauggggaauauuuucacccagaaugacaaaauuuuuaaaaaaucuaaugcucaaagcgaugagcuucaguuaccuggaaaaucuacuucugaugccccauaaaugaaaugucagguggucagcagggcaugugaggcuccugauagauccuuucaggaagggagagacauagauaagcaagaccugaagaaucacuagaaagcaaucacagaugcaccugauguauuuacaugggcucccauagaggcagcugcacagccccacagugcuggccucuggcagggaggcuaggguuggggcucaaggccuuuagcaucaaauauaccuuuccuuugaugaaaauggguuugaaugacauuucuuggaaauugaggcagguucuuuguuuuuuggcugagcacuuaggagauaagaaacaaacccagacacauuuuggaggaguugguugcucagcgugugcuuuagaagugauagcaaccgccacaagugugguaagaagcagcaggauaaagcaggcacgaaggggcuuuggugcauggaccagccuugguguugccuuuccucaaagagaacagaucucucagucaggaguucuuggggcagggaugacaguguuaaugggggaggaagcgucacugugggcaaccuaugaggaggcagccuucagugaccuugggcauguguucugagugcccucacugggugcacaccuuagugacccccugcugguacauucugcugugaagaauaacacggagagacagagugaucauuuuacccugaauucaauuccacacucacuugcagcaggagguauggcuggaauuaguggcugugguggagcuguuccugccaugggggauguggucucuccuucugguccccgagugguggggugggaauggaggcagcgcugcccgacagagcaggcugcugcuggaauuaccacagugucgugugucuccuccuauuaauccccauguggaacagcagguagccugagaagccugaauugugccuuaguuccuggccguggugcugcuuaaacagaugagccuuguuagccaguuugugcagucaguucuuacugaagucaagccuuugguccaagggaaaacaaagcuacaggaaacauggaacuuucuuacaccuucuugaaaauacaagucauguugccuaggaaauacuucucucaccaaguauucugcacgcugccaacauuggagcuguggaagaggcagcugaagcaauuccaagaaagugcuagcaguuugguaauaaaaggaaguggcauaucucuccugccucuagacuggguuucuaggagugcacauggccaaaaggaaacugcugcacucuggcaagugauuacauguugugcucauggacaccuuggccggguguccagugugcacugggugagggugugcaugggcugugugcaaagaucugcagugcugcacacaguguguugagugagagggugccaagugcugggacgguuguagauaaacaaaagcaaauaggugcaguacugugcagccugcccaaguucccaaagcuugcugccaggcugaagacugcuggcagccucuccugggcugggucaggaguagaagggugucuuccccuugcuaauuaggaggacacuucuaaagcauuucucucuaacacaaccaaauagucugcugaaggugaacugcuuuagugaggagggaagccguggccgugaacucagcgauagagaaagccaggggugaugugccccagagccccgagcaguccuuccuggcaacucugagugaccaacaugugacccugcugucuguccacaagcagugguccuuuaggaagagcccugggguuaggcauucagccaggccagugucuacuguggaggaaggcacuccaccgucagaggaaggagaauuuccacagagaguuuugaauggaaccugggaaaugaguuccagucaggucagugcaauugcagaugggcuaaaaagccuggaagggccuggacccauuuuaaagauggagguuucucuccaugucucuugugugggauauuggggagaggucuggggagcggaaugagagugugaauguagcaccuggcaggagucaagcugauuaauuacaccauggcuuggaaguuuggguuuuguugcuuuuuauuuucagaauauuuuguaagacucuaugaagcaaaaguuuuccacaaugcaagucaaacaaaaaugaauccuuccuucuuuuuacuaauauguuuuauaguguauaccuuauuuuguuaaucuguacauuuuaacuaaacauuuugaaaaugcugcaaaaugaaguuccuuuucuuaagcaaguugaaguuuuguuacuccaaagguuaggucauguccaaaaguaagacaguauaacguuuuguaaaaauggugccuuuuagcagcauuucugagcagacuggugguguguacagggucuucuucauugaccuagucagacgaaaauaaaaaacaacuuuugaaggcauuuacuaguuagauacaaaggaagguuucauaaguacuuugcuuccucuaagacuuauuuuugugcuguucauugguuaaagucccaaagacuaaaggaaauuuugugaaaagaacuuucaaaugugcuaugcaagagauuuacauacguugaaaucacaggguacuuggauauugaagacagaaacuccuuuugaguauuuaaagauucugcauuuugcuaucagguuuuuaaccaaggauauaacuaugcucggagguauuuauuuuaaaauauuaaaaguguuuuuugguguucugaauuuguggaaauuuccaagagacuccuuuaaaguuuuuuccuaggcaaauuuaaaaauaugaaauguagaauuauucaguggcugcccguuuggguagcuucuacacagagguucgagugguuuuaggggagggaagugaggugauagauacaauuuuaauuacuuuguuuucuaaaguaguuuuauaaauuucauuuuaugucucuuuaaacuguauuaagccaguagcuaaacuaauguguuaaaucacuuagaauuuuaaagagugacagagcguuuaaucuuuuaaucagccuuuucauauguugccgguuuauacaauauacggugaacauuuauacuuuuagccauguguuuaaaauagugaaauacuaaauauguuggggugaaaaugcuugaggcauuuuuaaaaaauguccaaacuguuacuuuacaauuuccagccuauaucugaaguuuugagauaugacgugugcuggugauuuuuaaggccagcaccaaucugugacuaguggggcgaccugaagcugacuaggggagccucuucagaaaggagggcuggggaagaggccuugguggaggggaucugagugcagacccaacacaaguugugggaccugggcaggugagucuuggacacucuccuuuagauucuucauugcaaaguggaugauaaauccugccucauaugauugugaaagcacuuuguagauuaucaugcaaaugcaaaauaguguuacuucugccaaaauuaugcuuuuucagaagaauuuccaacucugagauauguuugauguguugucugaaggucuggacaggacugugauaacccaguaaucuaucugagcacaguugcaacucuauuuuuccuuuguuuguuuuuuucuaaguuuuuuauuuugggacauggucucuugcugaugccgaggcuggagugcaguggcaugaucauggcucauagcacccucgaccuuccggguucaaaugauuuuccugccucagcccccugaguagcugccaccacaggugcaugccaccauuuccaguuucucuuuauuuguagagauguggucucccuauguugcccaggcuggucucaaacuccugggcucaaaugauccuccugccucccccucccaaagugcugggauuauagaugugagccaccgugccuggcagcucuauuuuuucuaaagcucugauuauaaaaguaacauauacucuauauaaaaaacaaauuuacgauggaacgaggagaauacaaaaaaguauaaagaaaaagcagucguuuucccaacaaauaugaauguguauacguguauguauguuuauguuuacauaauguauauuuuuaaaauaaauaugggaucaaauuauacauacuaucuuauacuuugcauuucuuacugaauauuuuguggacauuucuguaugucaauauauauguaaaucuguauuaucuuuuuuuuuuuuuuuuuuuuuuugagacagagucuugcucugucauccaggcuauagagugcaguggcguaaucuuggcucacugcaaccuccaucuccuggguucaagugauucuccugccucagccuccagaguagcugggacuacaggcaccugacaccauaccuagcuaauuuuuguguuuuuaguagagaugagguuuccccauguugcccaggcuggucucaaacuccugagcucaagugauccacucaccucagccauccaaagugcugggauuacaggcgugaaccacccugccuggccuauauaaucauuuuuuauugcaguuccacuuuuaaauuuaggauuaauuuuuagaaagaauuuaguuauccuuaaauagaagaaauuugcaguagcugguuuaugauuauaaaaaccaacccaaaaguuaauuucaauugugacucaaagucuguuauaaaucagcuuugcaccuugagaacuaacauuuagcacuugguauaugguaggaaccuuacucuugucacuuaaucauuuuaacaacuuuaguagguaucaucaguccaccuuuaacagacgagaaagcugagugagagcuuagguuuccugaaaaauuuaaucccagguccgucugaugacaaguccuugcuuuuccauuggaacacugaaguauuauuuaauacacugggcaaaauagaguuuugaaaguauuggaaaacugcuaauucauagugaauggaaaguuagcuuuuagguggcacguuguucagaaaggccgcugcuaugaauaaaacauuuaaaaauugcuguuuaugccuagcagauuuguuugcuuauauuuuacauuucuuuuuuuuuuuuuuuacauuucuuacacaaugcagaguacauucuguacaauguagaaugaaaucaugacuuuggaaaaccuguuucuuugauucuucuauguuucagacaggcagagaggggaaaaagaucuguuuuaaaaggcauaacugguaaaagcucagagucuggagggcacauuuccgcccgcuccucucccacauuagaaaguuucuguuugcugaugugagcagggcuaagccuggugagguuccuaggaauuaauuaugaaaagggggaaauagggaggagggccuuccccgcaaauccccuccauaagagcacgcuaaccagaguagaagucaggggcuccgugcuuuggcccagguguuccuaucaaagguuccacagacaaccuuucaggcccagaauggugagcuggagaggaaugggugccugccacugaggcucucccuucucuagccccuccuuaacucucuccucuacuugucuuggcaggugggaaaugguuggagguuacuagaaaguuguuccagcuguauacagaauuacccuuuguuuccagaaacaacugcuuaagccuccuuacucaugacucuguugacuucuuuggccaagcuuggcugcuguuuuuuuuuguuuguuuuuuucccgacagggucucaccgugucacccagguuggagugcaguugccgcagaucuuggcucacugcaaccuccaccucccgagcucaagggauccucccaucagugauccucccacccuagccuccugaguagcugggacuacaggugcacacuggcugcuguuuuaauuugucaucguauccuguaucugacagaguucaguccaugguaucaagcuauugacugagugaacaaaugaaugaacuagaaguagauuuauacugcagcagggaggauugauguuagacacauugaacugauggugacuauaagguuguuacgugguggacuuagcauuuuuagagaccagaauauggaauuuuguucuuagguaaguggugguuagguucuuuuuuuuuuuucuuuaaauaugagacagagucucgcuccgucgccaggcuggagugcaguggcgcgaucuuggcucagugaaagcuccgccucccaggcucaagcgauucuucugccucaggcuccugaauaucugggacuacaggugcaugccaccacgcccaacuaauauuuguauuuuuaguagagaugagguuucaccguguuguccaggaucgucucaaucucuugaccccgugauccaccugccucggccucccgaagugcugggauuacagguaugagccauugugccaggguggguucgguuuuauuuuugccuaguugaaaucaggaugacuuggcuggcacagauauaucccuucuaaaauaaaggaaaaacaauaaaugaaguggugugaucuagucauuuaaagaaguuaucugucauuauggaaucaucagcauucgcuauuauuuuauuugcuuuuguagagaccauuugaaguggauucuugaauuuaguuuuuccuaaaaguaguaucugcuggauacaaacauuaguagcaaaguauagaaguguaguucuuuuccucucuuagauaaagaggacugucuuaauacaguucugcaacuuuuuuuucuuuuuaacaucauggaagucuuuccacgucaauacauguaaauucaccuauuuuuaaaaaaccaugacauagauuucuguucgauggacuauauuuuauguagacaguucucuauagaagaauauugagaugguuuccaguuuuucacuauuugaauguagcaaugaacauuaauauguaauuguauaucuauaugguaaaauucccagaaguggaauuucuaggacaaaagcaguaauacuuuuugaagagcaauuaggcaaaauuuagcuuucuacaaacagugguuaagaacuguuuuuccuuauacucuuguuuacuguaucaucagacuuuuuaaauuaauaaaauaacauuuauuuuauuaauguuauaauaaauguuauuuuaauuuuaaaaaagauuuauuagauacuuaauauuucuuuuucuaaggauuauuuuaaguagcauuucccaucaugcauuuauagaguagugcuaauuuauaaacauuagguuuguacaugucuuaaaggaauacauuuguuuuaugugucauaccuauaauucuaggcagaaaccaauacuccuuggaguacagaguaaaaaaaauaaauaaauaaaaccucuuuguugggaaaggcuugaaauacagaguguuauuagagaagauucugaagcaggaaaaugcuguuaauugauaaaaguuagauggaauaauuguuacaauagacauaaauuaaaagcagcacauucucugaaacgguugauuauaaagcuguguagcacgagauugugaauggguuuucuaagauaauauugugaagugcuccuuggagacgauacccugucuuauaguuugugaauuucuaaauuucauuuuguuguauauugaaaauaacauauuuguauguacauauguggugagguuuguuaauuuuguuuuuaauuuuacucacuuuuuuuuuuuuaggcaagugucagauaugcuacauuuuguuucucaguaaggguuaauauuuucccuugcugugguugagagaagcaaauaggcaaugaauagucauuugcacagaauuacccagaaaguuuacagucuguccucagaagggcagagauuggguuaaugcacacauagcccuggcacauaguaggcccuccuauguguuugaaugaaugccuucauuuuuaaaguagauaaaauuuaaauaauugucaguggaaagucuuuuuggaccauugugaaacaggauucaaggccagagugaagggcuugggggaauauguacacuacuuuuaauaauuaguuugccuuaucaguaaaauggagaaaacuauguagaguacucgaaccuuccugggucauguuugaagaucaaaugaggugauguuugucuucauagucauuuguuuucaaacauguaugauguuaaucuuuuuuuaaaaaauuauacuuuaaguucugggguacaugugcagaacgugcagguuuguuacauagauauacacgugucauggugguuugcugcacccaucaaaccgucaucuacauuagguauuucuccuaaugguaucccuccccuagcccccccacccccgacaggccccagugugugauguuccccucccuguguccauguguucucauuguuuagcucccacuuaugagugagaacaugcacuguuugguuuucuguucuuguguuaguuugcugagaauggugguuuccagcuucauccaugucccugcaaagaacaugaacucauccuuuuuuauggcuccauaguauuccaugguguauaugugccacauuuucuuuauccagucuaucauuaaugggcauuuggguugguuccaagucuuugcuauugugaguagugccacaauaaacauaugugugcgugugucuuuaucguagaaugauuuacaauccucuggguauauacccaguaaugggauugcugggucaaaugguauuucugguucuagauccuugaggaaucgccacacugucuuccacaaugguugaacuaauuuacacucccaccaauaguguaaaaguguuccuauuucucuacauccucuccagcaucuauuguuuccugacuuuuuaaugauugccauccuaacuggcaugagaugguaucucauugugguuuugauuugcaugucuguaauaaccagugaugaugagcuuuuuuucauguuuguuggcugcauaaaugucuucuuuugagaagugucuguucauaaucuucacccacuuuuugaugggguuguuuuuuuuuucuuguaaauuuguuuaaguuccuuguagauccuggauauuagcccuuugucagauggauagauugcaaaaauuuucucccauucuguagguugccuguucacucugaugauaguuucuuuugcugugcagaagcucuuuaguuuaauuagaucccauuugucaauuuuggcuuuuguugccauugcuuuugguguuuuagucauuaaguuguugcccauuucuguguccugaaugguacugccuauguuuucuucuaggguuuuuaugguuuuaggucuuacguuuaaguuuuaauccaucuugaguuaauuuuuguguaagguguaaggaagggguccaguuucaguuuucugcauauggcuagccaguuuucccaagaccauuuauuaaauagggaauccuuuccccauugcuuuugucagguuugucaaagaucggaugguuguagaugugugguguuauuucugaggcccauguucuguuccauuggucuauaucucuguuuugguaccaguaccaugcuguuuugguuacuauagccuuguaguauaguuugaaguuagguagugugaugccuccggcuuuguucuuuuugcuuaggauugucuuggcuaucugggcucuuuuuugguuccguaugaaauuuaaaguaguuuuuucuaauucugugaagaaagucagugguaguuugauggggauagcauugaaucuauaaauuacuuugggcaguauggccauuuucacgauauugauuguuccuaugcaugagcauggaauguuuuuccauuuguuuguguccucucuuauuuccuugagcagugguuuguaguucuccuugaagagguccuucacauccuuugccaaauuguauuccuggguauuuuauucucuuuguagcaauugugaaugggaguucacucaugauuuggcuuucuguuauugguguauagaaaugcuugugauuuuugcacauugauuuuguauccugagacuuugcugaaauugcuuaucagcuuaaggagauuuugggcugagaugaugggguuuucuaaauauacaaucaugucaucugcaaacagagacaauuugacuuccucucuuccuauuugaauauccuuuauuucuuucucuugccugauugcccuggccagaacuuccaauacuguguugaauaggaguggugagagagggcauccuugucuugugccaguuuucaaaaggagugcuuccaguuuuugcccauucacugugauauuggcucuggguuugucauaaauagcuguuauuauuuugagauacaucccaucaguaccuaguuuauugagaguuuuuagcaugaagggguguugaauuuuuucgaaggucuucucugcgucuauugagauaaucaugugguuuuugucauugguucuguuuaugugauggauuucguuuauugauaugcauguguugaaccagccuugcugcauccuagggaugaagccgacuugaucaugguggauaagcuuuuugaugugcugcuggauucgguuugccaguauuuuauugagaauuuuugcaucgauguucaucagggauauuggccugaaauuuucuuuuuuuguucuaucucugcaagguuuuggugucaggaugaugcuggccucauaaaaugaguuagggaggagucccucuuuuucuauuguuuggaauaguuucagaaggaaugguaccagcuccucuuuauaccucugguagaauuugacuguguauccaccugauccuagacuuuuuuugauugguaggcuauuaauuacucccucaauuucagaacuuguuauuugucuauucagggauucgacuucuuccuaguuuagacuuuggaggguguauguguccaggaauuuauccauuucuucuagauuuucuaguucauuugcuuagagguguuuguaguauucucugaugguaguuuguauuucugugggaucgguggugauaucuccuuuaucauuuuuuauugcaucgauuugauuccucucucuuuucuucuuuauuagucuggcuagcggucuaucuauuuuguugaucuuuucaaaaaaccagcuccuggauucauugauuuuuuugaaagguuuuucaugugucuaucuccuucaguucuguuuugaucuuaguuauuucuugucuucugcuagcguuugaauuucuuugcgcuugcugcucuaguucuuuuaauugugguguuaggguguugauuuuagagcuuuccagcuuucuuuugugggcauuuaguccuagaaauuucccacuaaccagugcuuuggcugugucccagagauucugggauguugugucuuuguucucauuggcuucaaagaacuuauuucugccuuaauuucauuauuuacccaguagucauucaggagcagguuguucaguuuccauguaguuuuacaguuuugagugaguuucuuaauccugaguucuaauuugauugcacugugaucugagagacuguuuguuauuauuucuguucuuuugcauuugcugaggaguguuucacuuccaauuauguggucaauuuuaggauaacugcaauguggugcugagaagaauguauauucuguugauuugggguggagaguucuguagaugucuauuaagucuguuugguccagagcugauuucaagcccugaauaucguuguuaauuuucugccucauugaucugucuaauauugacagugggguguuaaagucucccacuauuacuguguggaagucuaagucuuuuuguaggucucuaagaacuugcuuuaugaaucuggguguuccuguauugggugcauauauauuuaggauaguuagcucuucuuguugcauugaucccuuuaccauuauguaaggcccuucuuugucucuuuugaucuuuuugguuuaaagucuguuuuaucagagacuaggauuccaaccccgacuuuuuuuugcuuuccauuugcuugguaaaucuuccuccaucccuguauuucgagccuauguguguguuugcacaugaggugggucuccugaauacagcacaucaaugagucuugacucuuuauccaauucgccagucugugucuuuuaauuggggcauuuagccuguuuacguuuaagguuaguauuguuaugugugaauuugauccugucauuaugaugcuagcugguuauuuuggcuauuaguugaugcaguuucuucauagugucuauggucuuuacaauuugguauguuuuugcagugacugguaccaguuguuccuuuccauguuuagugcuucccuucaggaacucuuguaaggcaggccuaguggugacaaaaucucucagcauuugcuugucuguaaagaauuuuauuucuccuucacuuaugaagcuuaguuuggcuggauaugaaauucuggguugaaaauuauuuucuuuaagaaugucgaauauuggccccuauucucuucuggcuuguaggguuucugcagagagaucugcuguuaagucugaugagcuucccuuuguggguaaccugaccuuucucucuggcugcccucaacauuuuuuccuucauuucaagcuuggugaaucugacgauuaugugucuugggguugcucuucuugaggaguaucuuuguuguguucucuguauuuccugaauuugaauguuggccugucuugcuagguuggggaaguucuccuggauaauauccugaagaguguuuuccaacuugguuccauucuccccgucauuuucagguacaccagucaaacuuauguuuggucuuuucacauagucuuauauuucuuggaggcuuuguuuguuccuuuucauucuuuuuucucuaucuugucuucacgcuuuauuucauuaaguugaucuucagucgcugauauucuuucuucugcuugaucgauuuggcuauugauacuuguguaugcuucacgaaguucuugugcuguguuuuucagcuccaucaggucauuuauguuccucucuaaacugauuauucuaguuagcaauuucucuaaccuuuuuucaggguucuuagcuuccuugccuuggguuagaacaugcuacuuuagcucgguggaguuuuuuuauuacccaccuucuaaaaccuacuucugucaauuuguuaaacgcauucuccauccaguuuuguucccuugcuggcgagggaguugugauccuuugaaggagaagaggcauucugguuuuuggaauuuucaggcuuguugcgcugguuucuccccaucuucauggauuuaucuaccuuugcuuuuugauguuggugaccuucggauggcguuucugaguggacguccuuuuuguugauauugaugcuauaccuuucuguuuguuaguuuuccuucuaacagucaggucccucugcugcaggucugcuagaguuugcuggagguccacuccagacccuguuugccugaguaucaccagcagaggcuacagaacagcaaagauugcugccuguuccuuccuggaagcauugucccugaggggcaccugccagaugccagccagacucucuuguaugggguaucuuuuggccccugcuggggggugucuccuggucaggagacacaggggucacggacccacuugaggaggcagucugacccuuagcagagcucgagcacugugcuaggagauccacugcucucuucagagcuggcaggcagggaccuuugagacugcugaagcugcacccacagccaccauuugccccaggugaucugucccagggagauggcuucaucuauaagccccugacuggggcugcugccuuuuuuucagagaugcccugcccagagaagaggaaucuagagaggcagucuagcuacaguagcuuugcugagcugcggagggcuccagccaguugccauuucccuguggcuuuguuuacacuaugaggggaaaaccaccugcucaagccucaguaaugguggaugccccucccccgaccaagcuugagcaucccaggucgauuucagacuguugugcuggcagugagaauuucaaaccaguggaucuuaacuugcugggcucuguaggggugggauccgcugagcuagaccacuuggcucccuggcuucagccaccuuuccaggcgagugaacgguucugucuugcuggcauuccaggcaccacugggguaugaaaaaaaaacuccugcagcuagcuuggugucugcccaaacggcuguccaguuuugugcuugaaacccagggcccuggugguguaggcacccgagggaaucuccuggucuguggguugugaagaccgugggaaaaguguagugccuggaccagagugcaccauuccucauggcacagucccucgcggcuucccuuggcuaguggaggagguucacuaaccacuugugcuuccugcaugaggcaacaccccacccugcuuuggcuugcccuccaugggcuguacccgcuguuuaaccagaugagcuggguaccucagcuggaaaugcagaaaucacccuccuucugcguugaucucgcugggagcugcagacuggagcuguuccuauucggccaucuugccacaagcugauguuagucuuuuagggcccauuagcucucaagccuuccuguacaacuguaagauggccauuauuauuacucccgccagaugccagccggagcuuucuuguaucuaaaccuguguuuguuuuuuaaaacucaucaggagaguuuuuuccuccaaagaucaucuuaauugaagaacugaauuaaaagcauacaugugcccugugucuacacuuaaaacuauccaaaacacaaaccuuuauaccuaaaggaaacugaggccuggauuugcucagauaaugcuggaauucauacuuaaaacucucagacauacccucaagaaauucagaaguaggaaagacagauauuuaaacaaauauaugugaaaaugcucuuugaacuauaaagcaauuuacaaaagugucaucaauucaucauuguuguuaucuuuaucacagucaauaauauuguugcccaaauuagaaugguuuaacaaaacauuuucuuccuugccuuagagcagggguguccaaacuuuugacuuuccugggccacauuagaagaagaaugugucuucggccacacauaaaauacgcuaacacuaauaauagaugaugagcuaaaaaaaaaaaaaaaaaauucacacccaaaaaaaucucauuauguuuuaagaaaguuuacaaauuuguguugggccguauucaaagccauccugggcugcauguggcuugcaggccauggguuggacaggcuugccuuagacaaacgggaaaaucacauuuauuuucugcuugugaaaguaacacuuguuuuuuuaauuuaaguuugaaaaauuggaacuauguacagauauuuuuaaaaaucaguauuucauaacucaccaaaagauaaccugaauuuucucuacugauauuuacguuuaucccccuguauacuuaauguucauagagguuaauaugggacauugauucuuccucaguggggguuuuagagaccaacccccacuggccuggaugccugggaugguuugggugagauccuuucuugagucaggcaucauuuuugaccugugcccuccccugugaauuuguggcauccagagaauucuuagauaaggccgagcaaggcaguacucauuccagauauucaggauguacgugguccagagcuguugucuucucugacuugugucuugugugccuucuccuguaagugugguugccuugauuagggauauugaggaaaguggagcgaguguggauauuuugcuguaguuuuccugaggugacagauacuagugggugaagccagggcucaggcagcucagcucucuuguguguuagccuggcuugcugcuugcagguauggcuguuuauuuucauuucacuuuucugcauuguagucucuuccuauaauuaacauggcugaaaagaaaagguuacucuaaaaguuguuuuuaaaaaauacagagccucucggauuucucagcagcguuuaaaucccagcucuguuacuuaauguugauuugugcucuuggauaagcuucugagucaguuucaacagugaaauggugauaauaucuccuucuagaauugcccuaagcaugagggauauaaaaugccauccucauaaaauaacacucagaaucauuaauuauuuguuauuauuggaucugcgugcauaugaaagaauccggacuuuuuuguauuuugaaucccaugaaaguucagauguguuaaguuguauggggggaggugauauauuggaaaaguugccuucauguauaacauguuugccucauaaguuguuauggguguuauacauccuucaaagugaaagaauucuugaggauaggcagcaggggacugacugguauccuauuuaagguugaugggaauccaagagugaucaagagaccuccaaaguggccagugguccuucacuuguacaugaguuaguauuuuuugauuugugaucacagccacuuucuaacaaagcauguuguuucugcuuuuucacuaucagauuggcuuugaaagccuucaugaaaacaugccacccaguuucugauuucuucauaucagaauggcuuauccagagauuuuguuuuccuuucuggcuucaucuuggugaaucaguaguuauuuuuuuaaccuauauuuuauuuuaaaagcccuggcacucucagcaaauuucgugugacuuggguaccuagagagguagcagagaauugaaauucacuuuuggacucccuucuguggccuccucugcuuccaguccuuucucauccugacgucuaccaucauuuaucaaaaauucaaaagcuagaaaaagucauucuaaagccugguguugggucugcagaaaaugucccaaaugucuguccguaaggagugcagaaucuagugggaauuagauaaacuagggcuuucacaaggcuuucugggauauccauguggaaccuuggccugcucuccauuucugugacucuuugaugggcccuuaaaucuaaaccuguguuuguuuuuuaaaacucaucaggagaguuuuuucccccaaggaucaucuuaauugaagaacugaauuaaaagcaugcauaugcccugugucuacacuuaaaacuauccaaacacuaccaguuguuuaaugagguuguuccuagaccaacagauacuuuaguguuuuguagagauauguuauuugcaaggcuuugucuucuguaacugcuuggccuuaaaaaccugccugucuagaaaggggggccucugaguaguguuugauaauaagaaauugcuuucaguacuacugcaaacccuuuuggcagaaacauagaaucaacauucuagaaauuaagggcugcuguuaugguuugggguuuguaaaguuguaguuggagcgaggaccaaaaaauguaaacuggguuaucaugagggauuuguuuuuccaacaaacuagaugguugaggguuaugucuuucuuauuaugaggaagagguuuuugccuaauaagguacuauaugaaaaugaaugucuuugaauaucuucuuaguuuuucuuuuauccuugguucuuuuuuaauuaaagaaguauuuaauuaacaccaacuacaaucaagucacuguucugagucuucuuugugcucauguuauuuuaauuuuaaauuaauuuuuagauuuugguaauguguguauuguacaguuaaauuauauagugaaaguaauucucuguaucccagccaccugguccccuucagcugccuaaucuuccucaaauucuguacuagcuuuugcacugucccagagauaauccaugccuauacaagcauccauuuguaugauauucucuuguuucacacagguaguccuagcaccaugacagaauuguagcccucucagugaacuacacacccuuguauucaagcuccguguaauuccugcccauauugacugugcuuggccgugugacugguuuuggccaauggguguuagcaagugugaugcaagcagagguuugauaagagcuugcacuuugaaauguguucuagaggagugcuugcuauugugacacucccucucaguacccagaagcccccagcugugagguccccaccuagucauaaagagaagccacauggaagagaaccgggucccugccaacagccucaucugagccccuagccggcagcaagcauccacuuggcagccaugugaugaaugaacuaucuucuuggaaguggaacugccagccccauucaggccacccccaguggugcuauguggagaagagacaagcuuucccugccaagcccuguccgaauugaaaaauugugagcuguugcuaguaauguacuaaaguugguuugucauguagcaacagauaacaaacacaugcuauauauaugauauuuucugugccuugcuuuuguugcugagcaguauauuagauaucagcuuauuucauuacauacagagucacaucauucauuuuaagagcugaauaauauuccauuuauggcuguacaguaauuaacuagccucuuauugauggacauugauguuucuaaucuuucucagcauuuaauaucuccauggcaugcuuuguuuugcacaugaacaaauauauuuauuggguaaauucuuagaaguagaguugcugaguaaaagaguacguaaauuuguaauuuuaauagguauugcaaauugcccuccagagagguuacacucccacuagcaauguaggaagacugugccagugugguuggaauguuacauuucuuuuuaauauuuucccauguauuuuaaaaaccauaugcauuucuuuuuugaugaacugucuucuuuuuuguuuggauuguuggccuuuuucuuuuuuggaggaacucucuguauuuaaagaaauuaacucuuaauguaugcuaugugaagcaaaucuuuuuucccccaguuuuuuaucuuuugacuucauuugaauaauuuuuuguccuuauuguguuuaguuaugucaaaucuuuuauagcuuuuggauuuucuugguuuuguucugguuuguuggucauauuuaggcuuuucucacuuuaagauuauuguagauauucuccuguguuuucuucuaguguuuuuguuauuucuuuuuuacauguuaaucuuugaucugccugaaaugucuuuugacguagacguuuccagguagguguccgagguggcuagucauuugucuguuaauauuguuauaccaugucauccuuacuauacagucaugaugcuuuagucaaugauggacugcacauaugacacuggucccaugauauuacaaugaaacugaaaaauuccuauugccuagugaucucgcagcuguuguaaugucauaguaaugcauuacucauguauuuuuggugagcugguguaaaccaacuuacuguacugccagucauauaaaaauagagcacauacaauucuguacaguacauaauacucgauaauaaaugacuauguuacugguuuauguauuuacuauacucuauuguuauuuuagaguguacuccuucuacuuauaaaaagaaaaaguuaacuguaaaguagccucaggcagguccuaggagguauccagaagaaggcauuguuauuauaggagaugacagcuccaugccuguuaucgcaccugaagaccuuccagugggagaagauguagagauggaagacaguuauacugaugauccugaccauguguaggccgaggcuaauguauguguuugugucuuaguuuuuaacaaaaaugcuuaaacaguuuaaaaauaaaaaaauuuuaaaagcuuauaggauaaguauauaaagaaaauauuugauaaagcuguccaguguguuugugcuuuaagcuaaguguuauuacaaaagagucgaaaguaaaaaaaaaaaaaauuaaacguuuaugaaguaaaaaaguuacagcaagcugagguuaauuaauaaauuauuauuauuguuucagagacagggucuuguuuugucucccaggcuagaguacaguggugcaaucauagcucacuguaaccuugaacuccugggcucaagcaguccuccugccucggccucccaaagcauugagauuacaaugagccacugucuggcuauguugauuuauuguugaagaaauaaaacuauuuuuuauaaauuuaguguagccuaaguuuacaguguuuauaaaaucgacaguagugcaguguccuaagucuucacaucuacucaacacucauucaccgacucacccagagcaacuuccaguccugcaagcuccauucaugauaagugccccauacaggugcaccauuuuuuaaucuuuuauauuguguuuuuacuguaccuuuucuauguucagauauguuuagauacacaaguacuuaccauuguguuacaauugccuacaguauucaguacaguaacaugcuguacagguguguggccuaggagcaacaggcuacaccauacagcucagguguuugguaggcuacaucagcuagguguguguaagugacucuaugauggucacacaacgaugaagucacaaugaugacucauuucucagaauguaucaccauccuuaacaucauuaaacauucauguauuuacuggauucagcaauaucuuuugaacugcugucccccaaauuacuuaauuauucccuuuuuucucuuaggaaaugcuacagugaauauuuaaaauucuauguaauuauuaaucccaaaccuuuguggauauagaaaucaacauuuauauagucugcauuuuacaaguuauuuaaacauuuguguuguuaagcugcucaaaagccgguuggcaaggucugcauuuuaugcacaggaaaaaggagaagaucauuccauguaaaggagauucaucugaagacaagcaggauuguguacaaguagagagaaaugugcuuuuuuaugauguaucauguauaaaggccuguucccaaauuucugaagcacauggaaguucugguguaaaaaguauaucuaguuaagacagcuguaggcugggagccugugaaaggaagauuuugcuuguuaauagaaugacugagacuacaucauccuguguagaaaccagggaauaacacuuguacuguguuguguuaagaaaacagguucuuuaauuaagugauguaccugaaauuucagguaaugacuacagcucuccugaacacccaggagggcggugacacugagucacaggcagaacuaugaaauuccuugugaaacucaacuuucuguucuuccagccuuuccccucccgccccucggcucagccacaggugcucauuaaaccucgcccagggagcauaccuccaaagcuuuuucacaggcauguggcccaccuuuggauuccgacccuaugguccugggaagucugcauuuggagcguguaccugaaggguguuaagcacauuuaaccucugcuaagauaaucagacagacaccccuagaaagagauauagaaguaagguguugacuauucugggguuuguauuucagcaggacccccaaaguuugagcugaaaggacuaaguucuguggggagguaucagccagagguggggaccucuuuugggauaccugugccuucccaccgugagccgcugugcccucugccucugcugcaggccagccgugcugcauuccauauguaaagcugugucgugcuuuccuucuuucccucagaauccuccacgucuguugugugagaacgacauuucacuaaggaggacagacaguuagcuucugucagagaagaaugucagagcucuuucauuuuguagaugcugccuuuagcuugcuuucuguguauguuauguucuucuacccuugggauauuuugacaccaguggcauuguuuuccauuuucucagugccagagaagcugggauguuguagaaaauauuugguuucaagguuaaaaaauguuauuucuuuucuuuuuagaucuuaucuaagcuuucuuugccuacccgugccugggaaccagcaaugaagaagaguuuugcuuuugacaauguuggcuaugaagguggucuggauggccugggcccuucuucucagguggccaccagcacagucaggaucuugggcaugacuugccagucaugugugaaguccauugaggacaggauuuccaauuugaaaggcaucaucagcaugaagguuucccuggaacaaggcagugccacugugaaauaugugccaucgguugugugccugcaacagguuugccaucaaauuggggacaugggcuucgaggccagcauugcagaaggaaaggcagccuccuggcccucaagguccuugccugcccaggaggcuguggucaagcuccggguggagggcaugaccugccaguccugugucagcuccauugaaggcaagguccggaaacugcaaggaguagugagagucaaagucucacucagcaaccaagaggccgucaucacuuaucagccuuaucucauucagcccgaagaccucagggaccauguaaaugacaugggauuugaagcugccaucaagagcaaaguggcucccuuaagccugggaccaauugauauugagcgguuacaaagcacuaacccaaagagaccuuuaucuucugcuaaccagaauuuuaauaauucugagaccuuggggcaccaaggaagccauguggucacccuccaacugagaauagauggaaugcauuguaagucuugcgucuugaauauugaagaaaauauuggccagcuccuagggguucaaaguauucaaguguccuuggagaacaaaacugcccaaguaaaguaugacccuucuuguaccagcccaguggcucugcagagggcuaucgaggcacuuccaccugggaauuuuaaaguuucucuuccugauggagccgaagggagugggacagaucacaggucuuccaguucucauuccccuggcuccccaccgagaaaccagguccagggcacaugcaguaccacucugauugccauugccggcaugaccugugcauccuguguccauuccauugaaggcaugaucucccaacuggaaggggugcagcaaauaucggugucuuuggccgaagggacugcaacaguucuuuauaaucccucuguaauuagcccagaagaacucagagcugcuauagaagacaugggauuugaggcuucagucguuucugguacguaguguguuugaggcauguccugagcuugucuccuuuucucuuugugucuuauagcuccuggauggugguauaggugagcccugcucccugccucccaugucaacaguggaacaaaauccugcaaacuuuccuugcauguuaaauuuguuaagauagaggaaauauaaucuccaagugucuagauuuugcuuuucauguaguugggauuuuguauuagucuguuuuguguugcuuauaacagaauggcugaauuuggguaauuuauaaagauauggaauuuguuucuuauaguuacugagaagucuaagguugagggccacaucuggugagagccuucugccaguggggacuccggugccacagggcaucacauggcaggggugcugagcaugcucacgugguugcuuagguggcucuuccucuuuuuagaaagccucgaugccacaccugugauaacccauuaauccaugaguggauuccauucaugaggguagaacccucaugauccagucacuucuuaaagcccucaccuuuuaacacugccacauuggggauuauguuuccaacacaugaaauuugggggacacagucaaaccauggcugacuugaaugcgaaccuccuuggauuugggcuucuuuucuggagagaauucugauucuguauccugaaauagagcacugugggaccauccaggcccuuuucuuaccaagagaacuauuaucaccuucucaaaagauuuuacugcuaaacaacagaaccuuagucucaucaccuagagaccaugcugguaaaaaugagaguuaaggaaaggauuuauaaaugauuuuuuucucccuguuugaugaauauaagagaagagguaaaggugagggagccaccaggcuuuuauauuuuuuaauuaaaaaauuuuuuaauuuuuuuagggacacggucuugcccuguuguccaagauggaggauagugacaugaucauaggucacugcauccuugaaccuuugggcucaggugauccucgcaccucagccuccugaguagcugggacuacaggugugcaccaccacaccgggcucauuuuuuauuuuuauuuuuuuguagagacggaguguugcuguguuucccaggcuggucuugaacucuuggccucuagcaauccucccgccucagccucccaaagugcugggauugcaggcgugagccacuaugcucagccaccaucauggguuuuaaucagaggaagcacgaagucagauuauauuuuagaagacugguguggugucacaguacaguguccauggaggcaaugagaccacguaggaggccgggugagaaagagguggguuugaaagacauucaggagggcagcuccaccaagcuuggggucaccaagaggggugugugauggggagggccauggaggaaagggguaacugggaugagccuuuagcugagaugcuggaggacagugggauagaagggccuugaauuuugagggagaguguggggccggaaaugcagagugugggaagaugacagagaccuagaaagagugauugugagaugggaaagaauuagagggaggaggaggggucuccuagucacccuggacauaaugcgagccgcagaggccaaggucugaaucguaucuucgcggguuaacuaggggaggccauuggaggccucggcagcugcuucaggacccugggaaggugggagcccagcuuggcugcugguaaggguggagaccacuaguagcuuagauuagggauaaagaggaugauaggugaguggagaugguugagagaaaugcugaagauaaggagggaaggggcacauguugugaggggcagcugugugggugguguguuguaaccgauuaggucccagacaugggcccugcccgugcgugucucuguggacuggaccaggacauggcuggcuuccucagccuuuuggcuggagcucgguacuguagggagcagcgggcccaacacuaagaagagcugcuuucaguggcgugggcaagcccacuggcagcucagugcucagggauggcugaacuuugguuucccacaucauuuccuguggucacugagauaaaguuuguguccuugaaaaguucacucagcugugagucuuugcugccuccccucugugcccacagcacacaccuacugcugaagggagugggcauucauguggaguggccuggccccauuuugugcuuugucuuuuguaucaaguuucaggaaggaguuucuuuaaaacaaaaaucaauaaggaaaacacaauagaacaguaaauccuguacgcaauagguaagaaauauaguauaagguaaacaucugccuguuuuugugugauguuuaaagucuuucaaccgugcaaucagguuauuagugguaaaaagaaauuagcacugaacuuacauauuacagaauaauuggauuugauuaaauaaaccuagaaagaaaagaauagugauuuuuuuaauugggcaggauuaugagaauuuuauuuagccgaagagguauuuaggguaucagacuuagcaaauaaaaauauaggacaucuacuuaaauuuuaauuuuucauaaacaaugaaugguuuuuuaguauaaacauguccagcucaauauucaugacauauguauaguaaaaauuauuuguuguuugucugagaaucaaauuuaacuggauguccuguauuuuaccuggcaacuuuaauuuggaauaaaccauuagugugccaguuuguauuugaagagcccuucuugauugauuaggagcuccuugaggacagccuugcggccagcgugauuuguuucuccuuggacucaauagcaccccgcaugcaguaaguauuccugaaggaaaugaaagauaaggugaaguuacgggguagcucaguggaaggauuuaauauagagaacuauuuacaaagguauuagagagcuggaaauccaaauaggcaaugggaagaaccccagagauuaacaacagcagggagcucuguccuccaggauggcugagggacaagguaguuacuggagcccaggggcugaggcugcucggugggagccgggacaaugaacccucaccaagagcccugaaaccucuuguucugaaaaacauauuauuugcucuucuaauuugaauauuuucugacauuuuauccuagaaagcuguucuacuaacccucuuggaaaccacagugcugggaauuccauggugcaaacuacagaugguacaccuacaucugugcaggaaguggcuccccacacugggaggcucccugcaaaccaugccccggacaucuuggcaaaguccccacaaucaaccagagcaguggcaccgcagaagugcuucuuacagaucaaaggcaugaccugugcauccugugugucuaacauagaaaggaaucugcagaaagaagcugguaagagaugaacgcccauguugaacuuaggaaugcugcguauagaccucguauucucccuucagaauacccagcaacuguguuuaucaguagcccugauaaccagguagcaaguucauuauauagcauaaauguuugucuaauguccuuguauaacuggcauuguguucuuuaagaaguauuuaguuugagauaaaauauaucucugaguaaguuagccauugaaaauccaguuuaaaggucauaguaccuuuuguggauagacuucucaguuagguuguacuaguauuauuccauauuuuguucccucccaucccaucaaccccuuacuauaaaaugaauaaauaaccugcauuuuguauagaaguuccaauuucaaauauucuuucuuguuguuccuguaaaccagagaguguuuguaggaacaacaggacagaaauauguggaaaugucaaaguuuuguccuccagaaugcauuuccaauacuuuuaaaccugaaaguacaauaaaauucggauccauuuauuuguuuggaaaaucucuuaaccaugacucuaccuugccaccagaaucacuuucucuuuucuuaccccagugaugugucuuuuuacuugaacucccuggcccuuagaaucagcccugaauucagaugacauguuuuuccagccucuuguucacuaugcauuauagcuuccugcagcucuagagugacuguuagcagauggagguguuaauaggagaucccuuguuauccauggucugacugcucauaaaauuagccuauaaucuccuauagccuauguuucuguuccugacuugaauccucauuuuuauccuauguggcauccuuucugaagcacuuccuuccuuucauuuauuugaacgaggcuuuuuuucccauguaaaacuaacacaauaguguuagcaagauugugggauuucuuuuucauaccugaaagucauuagaaacuauaaaagaguaaggaaaaccacuuuugaaaauucuuuauuuuuuccuuguaugaaaguaucuggagaaaaggagaaaaaaaaaaaaggauauccuuccgguaacagcagucaauaacugcagaccacauuccuuauuucauuggugucuucuaaagccugagugagaauguguccaugggcaggcagcaugagcaucaccugggagcuggauggaccugcagacucucaaaccucauccuagaccgacuagucagaagcucuauuuuaacaagguccucgggugauucauauguccauuaaaguuugagaagcauuguucuucuagaauagugguugucagacuucccuguacauuaggaucaccuggggagcuuuuuuuuuuuaaaaaaaaaugaugccuugggaggccaaggcgagcggaucacaaggucaggaguucaagaccagcuugaccaacauggugaaaccccaucucuacuaaaaauacaaaaauuagcugggcaugguggcacgcaccuguaaccccagcuacucaggaggcugaggcaggagaaucacuugaacccuggaggcagagguugcagugagccgagaucaugcuacuguacccagccugggcaacagagugagauuccaucucaaaaaaaaaaaaaaaagaaaaaagaaaaaaagaugccugccaccuacccugggauacucugauuugguuggucuggguaagagaccagacaucgugauugucgaaggcuuuccaagcaagccucaugugcagccucauuuucaaacaguguuugaaaacugcuguucuagaggauucugggaagauguguuucuuuguucgguuauauugacugugucaaccuagaggcccugcccacccagaguguuacagccaugaccugaugguuccagguguucucuccguguugguugccuugauggcaggaaaggcagagaucaaguaugacccagaggucauccagccccucgagauagcucaguucauccaggaccuggguuuugaggcagcagucauggaggacuacgcaggcuccgauggcaacauugagcugacaguaaguacugugggugcguuacgggguuacaggcuucugacaguuugcauuuuggacacauccaucuuugugauuaguaaauuuccccaucuuggacgugucugguuuguuguuguuggguauuuuguuuguuucacuuuccuuugaagccgacaacaaugacuuguucauuuuaagaaaggucaguuacguuaaacagucauggggaggaucccacugagaguauucaggguguuaggaggaagagauggugagcugcaggaguauagaagaaacaggaauuaaagacgguggacugcccugagcugggugguuagggggaguugaacaugaacacaguccuucaagccuaaaaagaagcuagcaugccugcaacuaucucaaggcagaagagggaaguccaugugguagaaagugccauucuaagagaaaagggcuugugauaggugcaugggugucuagagggccaaagugcuccacaacacucagucugaggggaaugcuccagguagugauuguugccaguguuuuggguggggagguauuauuucccaucugucuacgugccaacacauuauugaaaacaauggaugugucugaugccuagaacaugcuauguuugaaagcacuucuguacuuuuuguacagcucuuuuuguguaagcaaagggagacuuagaagaacucacagagaauugaaugaugcugcuuuacccaggccagaggguuucuacuuccuuuguguguuuugucagugccauuagugguaacuggauguuugaggggaaagcacugaggacacagaggcccaugagcuccugauaagccguguucuuuguggagcaaacccuuugcugugguagggccucccugugucuggagggcauagcugauacuugcugggacacagcuuuggucagccccacaagaggugcccaacaagaggggcagggucucugcugcaaaccucuggaucuacauguggacaucucugccugcucagacuucuauguggaaaaucuaaagcaagaggauuauuggaaaagguguacauuucuuuuaaacaauuuuuuuauuguaguguucuuuuuucuuuuagcacacauuuauuaaacaaagggauaauccuaauuaauccaacacacuuugaaauaacugcauguaaaauguuugugauaaagauaauugaacacaguaaugaaaaaaaaaagaaagaaacaguauggagauuugcucauugaacugagcuuggucauucucuuaguuaacuccuguccaaagugaugauggaauuuuuauucuacuuuuucauagauccgaguacaggugacauuguucaugacacacuccaccacuaauuucccaucuuucaauuuucuuguuauugugcuuuccuucccaucccacuccugaugcugaaccaaugcaccaucuguaaaguugcagacagucuguguuuuucugccaucagcugugguuucuucaaacucaucucccaggguacaagaaaacuguguuguuuucaaagugcucucgguuuuuguggugagguuucugccaucacaagugaugauacaaucuggcuuggccauugcgcccauuuuuugcaaagcuauucccacuccuagcuccuucauguauucaucaaagccuuugcuguccagcaggcgccaucuuccuuccagcugcugaacuguggccauggugggugcgggcgggcuggcgugcagagcagggucuacgucggcauggcagcaugcugugucuguaguguucuuuuuuuaaaaaaaccaugcuguaucaauaguugcauugucaucacauauucagauuuuaugugaauuucugcauuuaacuagucuucuaggaagugcugaccacugauacucagaagagugaauugucuguuugcuucauauuugccuaauacauaucccaggaauagcacgucacacuuaagacuucccuuucccaugucaggauacacaacaugguacggcacaagcgguguaggcuuuaaaaaccggguuugaguuuuggcccugucgcugcagggauacuucugaaccuggucugagaagacucaccucaugcugcagauggcaguggcucagagcagauucuggagccagcccaucuggggacgugcuucagcucuacccgucacuaguugcgcgacuuuggacaaguuccuaaaccucucaguacugcgguuuugagacuuaccucuuagguuuggugugaguagcacaaugccuaggacagcaccagccauguugcaagugcaaaguaaaugcuaccuguuauuguuguuguuauaaaaacaaaaggagagcagagaaguaccauugaaauauuuggauacuugauuuuuaaaauucuguuggcagucaccugccaacagauaagcuccuaaguuuuccuggugguccuugcagucccauuuuuuccuugggucuugggccaaguugaaugcauucugauugcagaugagcuccccucuucuuccucccuaauuccagaugggacccuuggcucuuuuuguauuuauucugggaucacugaugcgaauuucagcaugcagcuccagucacaucauuccacugcucauuaccccucagugacuucgcaucaggugcuagcuuagcaacacuuuagcuggcugcuugagagccuucaggcuguggacccauccagcccugcagccuucccuccucucccucgagcauccuguguccagagaagccuggcuuuugauguuugccugaauacaucaugcuauccugccugucgucuuuuucgagcuucuccuucugguaguguccuucccuucacuugucaauagccuauuuguaccuugggaccaccuuugauuacaucuccugcaucagccacuuuucuccuguuaauaagagguauuaacaucauuacccuuggagccagcagagcacuaaaauagggaggaugcuagcagcagcugcagaccgcaugccagcaacacucaggauuacggagaguauuucaggagugcagcgaguuucacagaagugcacaaccccguacaggcauuaguaucccggcuuugccagugagguaacagacaguggagaggggcuuauaaaagcccaucuguaucagagccggaagucaagccuuggucuguugccaucugcuucacgauuggcugucucuuguaccuguuuuggggaagagcuacucuuuagucccugaagccgcuggaggaacguugagaaucucacaugcgggguuuggagguggaguccagggucuugagagcagugcugaggagggaaaggcucuuggcugccuguuaccuagacucccuggacuggcuuucacaggcuuuccuugauccugggucugugggauucuugccauccuguguugcagaucacagggaugaccugcgcguccuguguccacaacauagaguccaaacucacgaggacaaauggcaucacuuaugccuccguugcccuugccaccagcaaagcccuuguuaaguuugacccggaaauuaucgguccacgggauauuaucaaaauuauugagguaaguaauucauuaaaaaauuguagucaccuuuuuaaaaacaguaauauauaaucagugaagaaaaaugagaaaauauagcuaagaaaaaaugaaaauaaccaaaauucuucaacuuuucccauggaaauaagcucagucauuuuaaaauaaacugcagguaaguaaauaauaaauaaucugagggaggauaucagugaauggguaagagaaagaugaggaaaagacauuauuauuguuuuaauuuuagauauucccuaagaaacaucaauauugucaagauacccuguacauaggguuaaagugccuaauuguaauuuuuaagugugaucuuugcccaaacgaaguaucuguagagcaaaggaacguuggccuuggaaaaaaugauccacauuuugccacuaugccaggccacucuuguuguggagagcuuggccgcuucugcuuuggaaaauccgugagaauuuucaugcgugcccugccucuuacucccuucccaguuuguccacagacaugcuauuuccuuuuuacauuuuauacaauacuaggcuauaagagaaugagcaucaguggugaucugaauggguuaaggcagucaaaacugaaaaagauuaacuuguaacagcuaguaaggauaaauuaaguuuagugggaacuacauguuauaaaaucgcuuaugaaaugaagccucuuauagcaggcuuaauguaguauccugaauuuccucuucauuguguguguguguguguguguguguguguguuuaaagagagaugcugucuguuauguggccugggaaagcuuuuuuuuucuuucuuuuuuugacagagucucauucugucgcccaggcuggagugcaguggcaugauuuuggcucacugcaaccuccgccucccaggucaagagauucuccuaccuuagucuccccaguagcugggacuacaggcgugcaccgccaugccuggcuaauuuuuguauuuuuacuugagaugguguuucgccauguuggccaggccggucucaaacuccugacaccuuaggugauccaccugccugggcuucccaaagugcuaggauuacagaugugagccacugugcccggccuuggagaguuuuuuuuuuuuuuuuuuuuuuugagacguggucucgcucuugucccccaggcuggagugugauggcaugaucucggcucacugcaaccuccgccuccugggaucaagcgauucuccugccucgguuccccgaguaguugggauuacaggcaccugccaccaugccuggcuaauuuuuguauuuuugguagagacaggguuucaucauguuuuccaggcuggucuagaacuccugacgucaggugauccaccugccucagccucccaaaguggugggauuacaggcaugagccaccgugccuagccccgggaaagcuuuuugacauggaaaugaucaugcugcugaugguccagggccccacccuuggaggcagacagcauagcuuuuuuaucagcugaggaaagaugcucagagagguuaaguaacuuuacucacaauacccagcucacggacagcagaacugguguucaaacccaggucuugugcuuccgagcucaguggccuuugugagucuaguacaccacaaaucuuaaagaacaguagugauauggcauugaugaggcucagacaucagacugaugcagucaacagcaaggagagucccauguggugcuuuugaacacaacuuagucaccauuucugauuucuuucuuucuuuuuuuuuuugaguugguguuuugcucuuguugcccaggcuggagugcaguggcauggucucagcucacugcaagcucugccucccggguucaagcaauucuccugccucagccucccgaguagcugggauuacagguaugcaccaccacgccuggcuaauuuuuguauuuuuaguagagaugggguuucgccauguuugucaggcuggucucgaacuccugaccucaggugauccaccugccucggccucccaaagugcugggauuacaggugugagccacugugcccagccaacccuuuuugauuucugauaccucacuugcuucuaugcuacccagccugcuaagugugguguggcauccaugcugaccuuauuuggggacuauugcuaaugucuguccuccauucuugcaucucugggccauuuuuugcuaauauaauuaggcugguauuacuuguaaaaggauuugucuuuagacagucucagcugcucuuccucccaccccaacuuuuaauuuuuguguaaaagucccagcaccagaguucuggggcccuucucuuaauugugcuaccagacaagagcauucguggcaguuuuuccuguguguauucauaaagaguaucagagauauaguggucagaugaacgugguaacaaagcgcuugaguuaaacugugagcaaagcacaagauugcgguguaggcucuguuggggcacaguggaagcugugcuuccaaaugcugaaggagccgaguucugccgcaguggcaagaagccugggcuggaagcuggaggcuggagcucugaguccagcucuucugagaaggguggggcuuugggcaagguauuuauccucuccgaccuucuguuuccucauacauggaaugaagauuucugaccauuagguaucugggauuccuucacucaaaaaugcugaguuuaaauuauaagucagcacugcucagcuuuggagucuggggaagcugucuucccagaagugcugaacuucugcacaggguuuguagggcuauuggguaaagaaguuguaagcagaaaacccacaaagucuacugaggcacuuuuagauucacuuucuaauuuccaaagcugaaaagugcuuucugccaaugcauauuuuaaccaaguaccuuccuccuuuuuccccaccccucucuuuuuaaugacaaggaaauuggcuuucaugcuucccuggcccagagaaaccccaacgcucaucacuuggaccacaagauggaaauaaagcaguagguagaacacaaaagauaaacuccagcucucaucuaagucccuuccucuaccugggcccaacucugccagcuggucuugucuucccauggugccuuccuccuggauuagcugccuuuacccuuguaaugugaacccucugaaacagugcuguccaaaagaaguucuggaaugauggcaguguucuguaucugcacugcccagugugauagccgcuagucacauguagcuagugagcacuucaaaugcagcuagugugacuguggaaaugaauuuuuaauuuuuaaggaauuucaauuuagcuaccuuuagcuaacagauuggacagcacuuaaguugggagggagggagagaguguagauuuuuuuuccuuugacaauguuuucagacuuuauuugcauggguucuagaacuagaauuugaaggcaggcauaauggcugaguggaaagaaaauggcccaggcgcgggagaccugagaucauucauuauuucagauggccaguuacucauucagcaccauaaaggcugcuguugugugcagggcagugugcuaggugcuggggauaaauacuuucccugucucggaggggcccauagucuggcugagaaagagugagugagcaaugaaaucaauggcucuggcagauucuggaaggucuaggaaaacuccaagcaggggacauaagaucugagccucaaagaaugaguggaaguuugcuuggcugaaggaauugguggcggcuacccuuggggacugcuguggcuugguucaguaggcaugccuggggcacaggaggagcuuacgggagaggcaucugaacagccaguugggggucugguucuuggguagcaguccaacagccuaagacuucagccucaaaggccagugguuuucaugucauguuuuaggugcauuugagguuccacaaccacucgguuggaauuucauggaugcugcagcuaacaugagaccacagcugucagccaugacccccgauuccaaacuaugguguucauugagacagccagugaucacuguucucauggacucuauuuuaaauaauuguuuaaagauagaauguauaaguuuauacuaauaaaauacugcuuuuaucuauuuuuuucuuugggggucuguauaagauugcauuuugaaaagaaagcuauaggcaaccauaggccgaggaugguaggcaccuuuggggcuagauucucagcuuuggggccucacuugccucacccguaaauuggagguaaccacaguaugugaaggcaggggcugggccucaacaucuuuggaaccuccuuauagugauguuuagaccucuagaugcucccucagauggccagugucagagagagagaguucuuacuuucauuuuaaccccugguggucugucccagacaugugacaaaggcaggucuuaaacuguguccucagaaggggaguggcuuguaauccaggugacaagcagcaucugauauaucuguguugcugcauuugcuuuccagguggaagaagucuuuccugugcagccugguguuuggcaucccugucauggccuuaaugaucuauaugcugauacccagcaacgagccccaccaguccaugguccuggaccacaacaucauuccaggacuguccauucuaaaucucaucuucuuuaucuuguguaccuuuguccagguauauaugagaaagugggcagaccucucccuuccaugcuguguguggcccucagauauucugcccgcuaagcgcaaacauagugcuuuagcuugguuuaaauggcacuuuauugcagcuuuccugccccacccaggcaguugcugcuuuuuuucucucuuaaugaccaguagguggggcuuggggcccccccagugugggggacuacuaagggccugguuucacugucaguuucaguugauugcaagugaucagaacuggcccuggaauagcaaccuccuugcugcaagguguggugaacucugugucuccaaugugcauauuguuuagguuaauuuacguuuguugcuggaagcaacaacuggaucacccuugagcccaugccacucuugaguguucuaucuuaaaagguggagauaugguccuugucuuucaggaaguuauaauuuaaaagagaaaggcaugaaacgucugcuuugguggugauauuaaggaacuagcugugugucuggugggaagugugcccucuauguguauauuuuggaauauaaaacuaaaucccuguccuaauauuggaauguuuaggggcuauuugggggcaagcauugguaggcuggauuuuuuuuuuuuuuuuuuuuugagacagggucucacccugucacccaggcuggaguucagugaugugaucauaguucacuguagucuugaacuccugggcucaagcgauccucccaccucagccuccugaguagcuaggaccacaagcgccugccaccaugccuggcuagauagggucuugcuaugugcccagguuggucucaaacuccuggccuucaacaguccuccaagcucagucucccaaagcucugagaugacaggugugagccacugcacccagccugaauuuguguuuuucuauauuuuguuugauuauaaguguaauguacacuuauuauuaacaauucaaaccguacugaaguauaagaagaaaagaggaagaugcccuuucacugaucacauucugccucccgcccaaucucauuccccaguguugcuauggugauauuaauaguugggcauuaaucucuccaaaucuuuauauagagaaaaugcacacuugcguguauguguauguauauguucacguaauacagauacagacuuuuuuaacugaaaugggaucauacaagauagacugaugugcagcuggcuuuuucacuuaacuauguauuagacaucuuuuaugccaguggguuauagauagagcccauucucuuuagggaauggaaugccuugugcugucuacaguacaaaugagucgugauuuuuuuccccaacuuuucaccauucucuuauuagaggacauuuguguuguaagcacuggguuuuaaaggucucacaugcucuuggucauccauuccuguggacaguaguccucugaaugggaaaguauauuucauaaacgcccaucacagaggaagaaguacugucacgacugugcacaaagcuagaggcuuugccauccccagggcccuuggcccugugucgcucauugaacucuccucccuacuugcuggcagccuucacuguccuugucuuucagcuccucggugggugguacuucuacguucaggccuacaaaucucugagacacaggucagccaacauggacgugcucaucguccuggccacaagcauugcuuauguuuauucucuggucauccuggugguugcuguggcugagaaggcggagaggagcccugugacauucuucgacacgccccccaugcucuuuguguucauugcccugggccgguggcuggaacacuuggcaaagguaacagcagcuucagguucagaaaagagcugcuccuucaguaaacaaaucucacuuccucugaacaccauguuuagaauuacuaauuauacacagcauagagacagacuuaaagaaauaggaaaccuccauauaauuaaggugcucuagucacuaaucuccaaauuggucacuacuucugaaaucccagcuaaucugguuaauuauuaaaaccaucauucagguguauuguguaaacuaaagaaaccuggccuucagggcagagccuacauugucucuuggugcaaaacugaauauguaguuggucuagacauccauacauccuccucaaggucaugccauuuuuaacacccuucauuguccccaacacugaaauguaucuuacaagagaauggaacucaggcccuaaaagaaauuagauugaaccuaaaagaaaauggucagugggaagacugauguuuguuuccagucugaaauguaauucccggacuuuaguggcacaggcacugugcaucacuguggaagugacauguggccaugugugguggauagcaaguaacgcccaccugcagagccuuuuaucgugccgugcggcuguuucucucgcaccagcugucucuaacaccacgcuugugacucucaggcuggguuuggacaggucugcuuucgauagcucucauuucacauucugguuauuuccuagagcaaaaccucagaagcccuggcuaaacucaugucucuccaagccacagaagccaccguugugacccuuggugaggacaauuuaaucaucaggugaguuaugguuaucaaaugucuuugugguugguaucuaucaaucugugugagcugcaucagaugcccauguuguauugacauugcaauagaccuugugagugugggcagagacacaguaagaucaccacucucaauccagcuacgaaagcaaggcauugaacuauaaaacuagcaagauuuguagguggugugugugugcgaaauggcacaugggagguguagaugauuaguauuccaggaauuaagaagaggaaggccaguguuggucaagggaaacuucacagagaacauagaguaugaauuaggccuuccuaguaagauacacauucagacaggcagagagauaaggacuucaacuugcuaaagaauaaaaauugaaggagaaauuuaucuucuucuuaagguugccugauauuaaaaauaauaauuauuauuauuccuggaaacucuuguugcauuuauuguuugcuagacacuauucuaaucucuuuguauuuaaucuaaccaaagauggaaacuuucugaggcagggacuauuauuacucuuaauuuacagaugaggaagcugagguucagagaggcuaagcaacuggcccaaggucacacagguauucaguaauggaauugggauguaacccaggcugguggauccagagucuauuuucuuaaccuuuacacacacugacucuuaaugcauauuuaauaauauggaaauuuuucuaauuaaggcuucuguauuuccuugggguuagcuucuuuuuuauauucuaggcaaugguuauuucagcccuccuucauauuccuaaaaucucucccuggucccaccacauuuucuauuagccuguggucucgcuuuggacuacuggaaggagaaguguucagauggaaacccuccaguucccugucccucagccuacacagcuagccuccuccguggcaccucccgcuccugccccguuggugggagaggcgucuccuccaaugccucuacccgggaaccuuucucuguugguuuucucagugguuuuuggugucucugauucuuauccuccgaugucaugcagacucuaaccacucccauuuucagaggcguugugccuugccccucccuugugugcccuuguccauguaucacacuguugauggagccagccugcccuagcuguguccuggaggccugggcgugaaggcugagacagaccccuugcuuccccauggggucugcagggcuggugcagcuggcccugggcacgccccaggugaguagaggaacugaccggggccacacagaugcaugaguguucaugaggugcaggcuggcugcugcgcgguggcacugguuuuguucuggauccuggcuuuuaaaugaucaucacaauuguaggacuggcaacugagauuugaguccuucugguguuccaggcucacuccccagcacuugccacagaucgucuaguuccacucuguagcuguuccgugaggcagcacugucaucaucccagcuuuccucaggaaaagccaagugcagugagguggaguaauauccccagaguccauggcaggcaggcagcagagcugggauuggaacccuggaggcacagagccccccucagccacugugcugcgcugcccccaaacaggacccugugugacggcaccuggcaugcugggcucugcugugccaugggucugcagcagucacaugccuuggcuucuuuuuuuuuucuucucuuauaaauuaauugcaugaaaguuucugagaagugaaaacguucagacagggagccaagccgcuggcagcuguguugguuuugacucauguuuccuccaacucgccuugcuagggucuucgguacaguuugaggcgccucugauggcacugacugcaguugcuuggaacuauuccagggaucugaacaggaggagaaggcaucugccggccgaagugcccacggggugcgugcagcaccugucauaacucaguucuuuuccaagaaugccgauucauuuuuuggcuggggacgcacggccugacuacuaccaugcaacaugacaggacauuauuaagcuaggggccagaagaccagaguucauucugccuuuggcucacuguuuggguguggucauuccuacuugccuccugacagcacaccccgagcccaacccucugucccaggccaaggcugcacccacugccgccuggauugccgcagucuaggccuccccugagcucaaccauucugugcuuugaggugcacuggacacugguuucccagugacucugccucccacagggcccucccgcgucugggccucugcuugugccuuugguccauggcaccaucugaaggcccccagagguucucgcauaacugcccucuuugacugaggcuugggcuucuuccucugaccaucccuuugcuggggacacuugugcuuucucuuuacuccaagucuugggugcuggcagcguuucuaggugcgauccgucuggcacacuguaguuuccuugcugcugcugcugcuuagucuccaugggcuuucuucucuccuuuuuccuuguggaugguccuugggguucuggugguacugccucugucuuuguguguuacacaccgucacugggacgucucacucucccacgucuuugguuaacagccgugagaagcucauucucaaaccuacgucuagaucccagagacuaccugcugguuggaguguuuuucuugguugacugguaaaggcucagacucggccugucuguauucuucuucaccuucccccacuuuuuccccaaaaauauuccccuuccuuggugccugucugucucaggcaaagguacccucaugccagcucccaguguguccucuacaaugccugucugcccucauucacacaucugcaguccauccucaugguucuagcaccucugucucuaggggcgucauccacuggcaccaugcugguccaggccacuguggccuugccccuaaaacaccgcagcugucucuucauacugcuugcagccauuuaucaauccaguauuuuuccacauucaaaccagugaucuuccugaaagcacaaauugaucauauuacagugcuuucugaaagcacaaauugaucauauuggaaaauccuucaauggcugcaugcuguccuuaggaucaaaaccaccuuccuaacguggcagugaggcccggcauccgccugcaugccuguugagcccagccugucuugccauccccugcguugugcuccagcugcccugcaccacuggcaggucccaggaagggacugccucucucugcagaccucugcacacauccuuccuucccucugaacucccuucuuccuuaaccuuugccuggcuccuugccuucagggcucagcauggaaguugcauccuccagaagccuuuccugauuccccaggccuggcucagcuguggcuccucagugcucucagaacacucugugccucagccacccugggauguaaacauggcgggugcugagauacucacugguggaaugaaacugcugucagauguuaaagaaacauacugcacacaugcaugugugugcuugauauuaaaaggcuugcacagccccauccccagucucccauguugaaauuuucugguuuuuuuuuuuuuuuuuacaauugauggggaaacaaauuacaaaucauaucuagaccagugaccauaaugcuauaaguuuuuucuuuguuuucuuaacuuguguuuaaugaggaaggggaguagaagagaggagacaagugaaguaaacagauuccuggcagaaacucuuaaagaugaagugcuaugaaacaaaccacugucuuuuaauuaagaggguuccuaucgcucagcacuuggagaggaauaguagcuucugaagaauacaugcuauugagauucaccaguaggagccacauuaacccucauaaaggacuauuccuuguaagcugcuuagaguuagaaagaugugguuaauuuagaucaaaggagaaauucaaaguuagauuuaacagagauuagcauuacuaaagauuucuuagaaagacacccaacuguacauucgugccaauuuuaagucuccuuacagaaguggacauuuuaaaacuuagugauuagguucugcuggaggagggucugaccuuuaguucuuggggucuuucauuucuaaauugaaugcagggagcuccuccucccgacuugggcuucucaggccauguggagaccucugugggaugauaaauccuccagguuguucagagggggccucaagggcaauguucagccuggacuucuccaucgcuggaggacuuuaaaauuaagcagagaauauucuuggguucucgagauccuuccguucuccuggcucacucagccaccaaacagauuuacacagguauacucccagcacuaaagacuucagucuuugaaagucuccuuuucaguacuccauuuauuuugguugccaugauugaacuuucugugugugucuuaacuguccaucugugugucugcuuuuaguuaugaggcuauaaaccuccugagaggaaggcucuacucuguccuguuuguaaccccagccuacccuggugccugguacacaagaggccaaucaauaugaaaaugucaauuaggugauaauaaaaaucaccagcauucauugggcacuuacuguguacaggugccauacuaagcaucucacguaaucacaggaaguagccacacaagccuugaauccucguagcacagagacuguuccugaacaauuuuuacaaaggaaaauaaugaugcaaauauuuaacauacaugccugcauaugguaguuacuaaguuuuauauaguuguacauagcaacauuuaaauaagugggcauguauguucaauuuugugccuuucuaagacaucuucagguuuugcugaaauggggguaauaagacucaccuuguaugugucugggaagauucagugagguaaaacauguaaaaaucuagcacaguuccuagcacucaguaaaugucuauuucuccuucucaaguaaguaagauggcuuuugugccugugauaguuuaaauguagucuuuguagaaugaaagcaagguguaaaauaaccucagagcccugcuugcuuuccaugcaugcucuucuggcuuguugaccauuagcucaugagccaguauuaccuauacaauuaauucuguugggcccaugccaugcuuuuagugagcugcugcugaagcuggcccugggccguaggugcccucccucuggcuuugucucuguuccugccgucuucuccucuccccccgcagcaucucugucucugcaggacaugucccacuagcacacaguucacauguauguacaagacacaauccccacuuuaauccacccucccuucuacugcucuguuuuucuguuccuucacaaaagccuucuuuaaaaacgugacuuucgcuguugucuuugccuucucacugcgugcucucucagcccauucuaguugagccucugccuuuaccaguuucugaacuugguuuggccagugccaucaaguaauuuccauauaccccaauccaacauugcuuguguuaaguccucauuucagucucucaccaguauuucccccuugucuguuucuuugauuuuuuuucuuuuuucaauguguaacucacagucacugcaacacacaaacccuacguguagagugugaugaauuuuacguauauuugccccuguggaacuacuugugcagcguuuggugugguuggaugggugcucccuccuccuccuccucauccccacucucauuuuccuccugugucacuggcugguccuucagcuucugcucagcuuucagauaguggagugucucagggaugaguucuaggaccccuucuguguuuucuccgucacuccuaggggcgcuuauaugaucucauggcuuuaaaugcuaucuacaugugacagcucucagguuuguucucuaccucugaccucuucuuuccacuucagacucauauuuucagcucccuaguuggcauuucuacguggaagucaaauaggcaucucaaacccgacaugucaaaaugaaccauuucucuccauccccuccccuucucuucccucacccucccuuagcugcuucuccauaaucaucuccaucucauuaaaugguuucucuauccacccaguugcucaaaaugaaaauuuggagcucaucuuugauuccuuucuuuacccucauauucagugcauuuucacaucuuguuaacacaugaucuaagaauaugcuguguauuucuucucccucucucuguaguccagguuacuuccaucuuccgcuugggcugcugcaacagccugacucucccccucacuccugugaucaucccuacagcccauucucaugcagcagccaaagagaucacuuaaaugugaaucagauugugucacuuuccugcuaaaagccuuacauccaaaacccaugcucugcuccaggagacucggcaugaucuggacucugccugcuucucugaccucaacuugcacgucacuuacuuccugccagccuugcuugcuuucuugcuguuucucagacgcacccuuccugccugccuuaaaccuuugugucaguuguuuucucuccgugaacuuccuuuccguguguguuggaccuucuuggcaugcaggucucagcuuaaauguuaccuucccagagaagcccuuccaugucuccuccucccucugccacucuaagaagcccuccagucacauuauccuuguuuuuuucaucacagcacuuauuaauauuuaauaccugauucuaucuugcuuguuguccauuucuaccacagaacuugucuucaugagguaguagggccuuugcugugccauucacagcuguaucaccagugccuagaacagugccugguauucagcagcugcacgauaaauaucuguaaaugaacagaucaaaugaauacuguugcucaguauaagcaaauacaguguaacuauuguaacagcuggccuagaaccugacccggugaccgaaugaguggccaugugagugauaaguggcguuuguugcagggaggagcaaguccccauggagcuggugcagcggggcgauaucgucaagguggucccugggggaaaguuuccaguggaugggaaaguccuggaaggcaauaccauggcugaugagucccucaucacaggugagauggcuuguuucauguucccucaggaggauaucauagcagcugucaggucacaugagugcuggauggggcugagcaagugacaguugucucuuuccuacgucuaggagaagccaugccagucacuaagaaacccggaagcacuguaauugcggggucuauaaaugcacauggcucugugcucauuaaagcuacccacgugggcaaugacaccacuuuggcucagauugugaaacugguggaagaggcucagaugucaaagguaaugaagaaauuuuuaaaacuaacuucaucuuucucguuuuagaaauuaugugaagaguucugggaaaucagacaguuuuauugaguagagauugauuaguaaaugugguuaaaugaaggagauuaucccaaucuuuauccaugcuugugguguuuuauuucuucauagguuguaauuucccauggucuugguguuuuauuuucauaggcacccauucagcagcuggcugaccgguuuaguggauauuuugucccauuuaucaucaucaugucaacuuugacguuggugguauggauuguaaucgguuuuaucgauuuugguguuguucagagauacuuuccuguaaguugaaugccuugggcuauauggugguuguguuuuaaauaaucuacugacauugauccuguucuuucauaucuuagauucacugggcuuuaauuauucauuacauuuuauuugcuugcuucucuuauugacagcaaaaucuaagccagaguaggauaaacagucacucuccuucugcagguuucuauuaaagaucuccuuuacauucuacuuagauaauuuucacagacaccaauuggugcucaguuguaaugcuugaagcauuuacaauauguauuauugguccuuuuugagguuaugaggcauacaucauagaaaauaguucacuuuaaaucucaauggcaugauaauauuauuuaauacauuuuaagaaaaauaucuuuugauguauauauuuaccaguaccaucuuugaccucccagcuucccaaguaauguaaauagcuuuuuauguuuguuuguuuauuuauuuauuuauuugagauggagucucccucuguuucccgggcuggagugcaguggcuugaucucgguucacugcaaccuccaccucccagguucaaccaguucucccgucucagccucccaaguagcugggacuacaggcacacgccaccacacccagcuaauuuuuguauuuuuagcagagaugggguuucaccguauuagucaggcuggcuucgaacuccugaccucaggugaucugccugucucggccuccuaaagugcugggauuucaggugugagccacugcacccaggcgugaauagcuuuuuauaauaguuaaauauuuacuaaacauuguaugugaggcaauggaauauacauuuuugaguuuaaaaaagugguugaagaacacuaucuuaggaaauaugguuuuauuaaaccucagaaaaagaaaggaaaauacaggccaccccucaaaaaaacauaucugcuugaggaauaaaagcuauauuacaucugugauucucaguuggcagcugugacauuuucgguguuugugacuggggggaugcugcuaaacauccugcaaggcacaucacaggcccuacaacaaagaguuaucuggccccaaaugucaguagcacugagguugaaaccuugauaauguacuuaaaaagcuaauggcacacuuagaacaguauuugguaauggcacaaugagcggaacaauguuuuuaccuuaucuuauuccuagcccagucuagugcuuguuauaccauagagccauagaaugagaaaccauacuggguguggugaugcaccuguagacucagcuacuugggaggcuaaggcagaggaucauuugaguccaggaguuugaggcuguagugugcuaugaucgugccugugaauagccacugcacuccaaccugggcaacguagcaaaaaguacaaauacagaauggauaauuuuuuucuuuuaaaaaaaauccuucacauaauuaaaaguauaucaaauauucucaggacacaugucauuuacuaggauguauuuucucccucaaauuucccaucuuaaauugaacaauguucaaguuaaacacuuucugacaucuaaggaaccucagugcucuuaaaaguaacuuacagauauauugguagaaugugccuguggcuauccauggcaccugacugccuauaauuucggcuuuuucgggaaagcagugcguuggcauauggccaugggaagacucaguccuaaacaaguuggaaucuguggcuuucugcuguuccaugccuuuccaucuuacuuuggcuucuuuuguuuuuaucugcaauaucagggaggaugcuggcaaaugagguacugcauguuccuuuaagauacugucaucucucugcuguacaaaagucauuguagagaagggcucaugguaacuuccagaaguccacccaguccuaucagaaugccaggugugauuuugacaagaauuaguguauuuuuaaaaaagauuacauaaucuuuaugucuaaaaaucuuaauauaucccucuaccuaaauauaacuguuucuaugaaaauuaaaagaccccuuuaauaauacauuauuuuagaauccugccuuucagagugaaauaauaaaauguagauggaagcuaaagaggcugugguccauagccuuaccuuagacaacugugcuuuuuacuauaaguaagugaacauaguaucucuugauuauacuccauagccaccagccauuuuuaaaaauaaaccaagauaauucaagcucucagaaugcaaauaauaccaagugucuggaaaguaggucauauuuuguuuguuuuggguacaaagaaaaaauagugaaaaauacagagaagaaaauaaagauaccuccaaaucauaucccuagaaguaauuuuuuugcauauugguggauaccuuuccaguauuguugaaaugcuguauucagauacaggcggagauuuuugcacgaauaaaucccagcacaugcgauuuuguacuugcuuuuuaauuuugcagugcugcugguaccuuuccauaucaguauguuccaucaucauuccaauaguugccucguaucccauuauauacaucacaccuacaguuuaauuaaccaauuccguauugguuguuuccauuuuuuaucauuacaaaaacaaaacaaaacacugugguaaauauccuugcaucuuuucuuauuuauaugauuaucaccuuagaauagcauuuuuaagcuuuccuaaugaugagaaaaauaacgauaauaguuacuguuucuuaaaugccgcuccuaugccagguguuauguacuguguauauuuauauguuuauauguguauugccucauucaauccuugccacaauuuaugagcuaugcauuaucaucuccauuuuguguaugaggaaaccaggaucuggaucugugugguccaucuccagagucugcuuuccccuaucaagggcuuuuauuugacucugcuccuguaaugccucuuugagggaaaccuguaggaugaaguuggauagcugggauguggagagcaguaacguguucucuaugauggcagagcaguguggaauaccaucuguuuccggaacccaaguucgucacguuguguccagugccccccugaaauguccuuaugugauuagaguucugggagcuuccuuauugaacucucaaccugccucugacucuguccuguuuucagaaccccaacaagcacaucucccagacagaggugaucauccgguuugcuuuccagacguccaucacggugcugugcauugccugccccugcucccuggggcuggccacgcccacggcugucauggugggcaccgggguggccgcgcagaacggcauccucaucaagggaggcaagccccuggagauggcgcacaaggucagccuguagcacggcuuuccccauccugagagaugaaaguaguaucuguuuacuauuucacauugagagaaaagccugagagccacucaagacagcaguguuaauuacauagaauaggaagucaaguauaacugggaauaacaacaguagcaacagaguagccaccagucauauaauggaacgcuuuaucaacauuacuugauuuaauugcauuaacaacucugugugguaggugcuuaucauucccauuuuacagaugaggaaacugcagcaggaggagauuagguaacuugaccaaacgccugcagcuaaccagaggcagagcugggauucacacccagguagccaggcuucaggacaaaagccccaccgugacaucugugggauuagugguggguccugugacccuggggagugaagagugagugacgguguuugugaagagucuuccuuuugcccaacuuacuaaccucuggccuuccacacuuucaccuauuuaaucaguauuugcugggcacucacugcgugugagcccugcacuggguucuggcgauggucaugguuuccagccgccaaggagcccaccagggggaaagacagacagugaaaaaguaaauagcaaagcugacugaguauuacgagauacugaguauugacugguggugcuugacguccuggggacacuugaacaggggccaauccuagacuuggggugcucgacucagggacaagggugcugcagguggucagggaagcgaauacgaacguucaucugagaccuuacuguugagugagagcuggacaacggagcuggggaagaguguuccaaaauggggacagaagguggaaagcaccuguggagguggaacuuccccuccccgcgguauccccagcaucuaaccugagacaucaagugcauucagaaguuaucuguugaaugagcaaaugaggaacuggaagaaaaucauugagagagaggaaccagagaugaggccguugagggaggggccagaauccaaaggcugaagauuuaguaaaguguucugaacguuagccuagaagccacguaggggauggcauacccacgugaugugacuggaucguguguugggaagaucauuccggcugcaguguuaagguugcgcugaaagcuggcaagaaucccuggaggaagaugaguuaaguguguugaaggaaggaaggccaccgcucagcaucagaaacaaaaagcugaauuauuguuugcuuguaagggagaacccugcuugugggacauggucugagaagagcaaccugcuggccuuaaauggguaaaauuauacacuucaggaauuacuggacuuucagaagcagggcucagggcucgacuggcccuggucauggaagugcagguaccugaauguagcugcugcccauaucugagcccagagguguggggacucugcagacugccauugacuaagugugaccaacuuaaaacuggcucuggggguuuguuugucauuauggccauagaauaguccuuuccuuucuugaacucagagugugaggacucuauucccaguagcuuuugcacuuaggcaggcaaaaggaagcugagguugggcucggcggauggcaguggacagggaggcaggugucccucaggguccugacuccugaccugaugugggggaguauguggauggugucacugucugggggacagugcugugccaucuccuguacagccgacugaggguuucuggcuuugccuggucaaggucaagccucaguguggcugguuugacuggacacauagggaaacaguuucuuugcagugggaguuguugaacccugagauugaacgacagaggaucacguuaggaagcugugcaggugucuuguuuccugucugaggcagguugggugaaguucugccucaggagugugacuauggaagccccuccaucuguauuguggucagugaguugugguuguuuuuggcagauaaagacugugauguuugacaagacuggcaccauuacccauggcguccccagggucaugcgggugcuccugcugggggauguggccacacugccccucaggaagguucuggcugugguggggacugcggaggccagcagugaacaccccuugggcguggcagucaccaaauacuguaaagagguacguggacuugggcguggcccugcccuccccgccaaugcucuuuuauuccucaccauguccuucucuccuagcugcccucgaggagccuucucuguguggucuggaaaaccacuuagagggcccuucugcagcaggcggagauauagggcucacagucagcccuugccacaguuccagguuaucacaaagggaguucagugucacaggcauuugcugaacaucaccaggcgccaggcucaggagaacaacaggagugggauaugaacucuacccuuugggagcucacggucuuggggaguacgggcagucuggaaacucagugcuuugacagugcuuagugcaaggggacacaaacaugaaaugggaguacugggguggaagggagaaaucuacuccccugggagcaccugggacagagaggaaccagcagaggugagccagagugcccagcagguuccuggcacuucguggagaagcauugccuucuuuuggucucuccacaggaaagguucuauuuuguuuucucuuaauuucagucugaauauaggggcagcagaacgcgucacacagaauauugcccugacaacuuuuaaacagccugagcaauacuguuagcaguaaauguagaaaggugacaucauugccuugaaaaacaauugacaacucuuccugaucaggggcucuuccagaaaccucauuucuaguuuuguccuucauguagggucagacagcccacucuuucucaccucacccuucugacauuucagggagaaucuugcucacccucagucauccuuuauuuguuguguggucuggaaaaccgcuuagaaggguccucugcagcaaguggagaugaggggcucacagucagcccuugccacaguucuagguugucauaaagugaggucggugucacagccauuugcugaacaucaccaggcgucaggcucaggagaacaacagaagugggaugugaacucuacccuuugggagcucacagccugggggaggacgggcaguccagaaaccccagccauuccuuuacccugccaccuuguccccuccuccuccagggucugauauacaggcaguuaucucuugauagucucaaagagcuuuguuaacacuacuuauuccauuguuuuuaaugaaauuauuugcaacauaaaauucacaucucccucucuuuggcaucugcaguccucuuuaauuugagguguuugauaugaguugccuuuuuccuuuccagucgguaaccuguucacugucaugaggcacccacccagggaaggauuuuaggcuguuuaaaauagucucauucaacuuacagcuauaauaucuuuaccaaaggagggagaaauaauuacaaguuacuagucacuaucuuaaccuuuccuaucuguuccaccucccuccccuccuuucucucaguucccgcuuuccgcugcucucuugccaccuucacccugugucccuguccugccugccccucccuuucacuucaccccucuuggcuuacaguuuccucuuccucucuuuccaccuucccaggaacuuggaacagagaccuugggauacugcacggacuuccaggcagugccaggcuguggaauugggugcaaagucagcaacguggaaggcauccuggcccacagugagcgcccuuugagugcaccggccagucaccugaaugaggcuggcagccuucccgcagaaaaagguauugcuggcuuuugucucugcagcugguuaaaaguagaggugggucaaaccacagagagcaccacgcccagcagugauugccucugcugugcggcagacgguucauggcuaaggcacccaagccugccuccccacacccaggaaaguuucucuuauguucuugggugcgucuaaauuuuguugcuuauggcugccuuaaauucauagagcauuguuuagcugacccaugauuuugauucuccucuuucuuaucccauaucggucuugcuucucauaagcuacagaguagacagacgggaauuccacuuucguucuuccuguuuccauucuguaugguagaauucugguauuuacaaagcaggcagaaaaagucagggaaagcagagggaaaugucugcccaagccaggaagggacacugcuuggagggacagcugcuuuugaagaauggccuuuuuuauucucaagguagcuugccagccaccagaauaaaggguggaaaacacucaaaaucugugacuaguguuuuuccuaaguguugguagugaaauuguggcuuagauugugugguuagaagccauccaccaccuuccagccuuuaaaaccccaggauggccuuuccaugagagcuuccagagccuggccguucagugacaccucagcuagcagcacacgcuguuagaaagugauaggugagaggugcauuagccucgggaguuacaguuuuaaacauuucauguagacgugucugauuauuuguugauucaccugggguuguugauaccaagcaguaaugaauguagucaacacuugcuuugugugcugggcaaauaccugagugcuucuaaucccugcagaaaaagaaucaguggauacuucuaagacaaagacggacauugccuuauguuuaauacguuuauaccauuuccacccauguagcauguacuauuaaugccccaucuuaauucauacccacauguccuacacauuaauuuuacuuuuuuuuuuuuuguccuaaaggaugcugucacaagaggugcuuacaagguuacaguuuuucagaaugguuaaaaggauauuuugcuguuaaaaggauugcaugguuuuuaguucacagugaaauuggaccauuuagaaauaaccacagccucuuuugaauagaugcagucccccagaccuucucugugcugauuggaaaccgugaguggcugaggcgcaacgguuuaaccauuucuagcgaugucagugacgcuaugacagaccacgagaugaaaggacagacagccauccugguggcuauugacgguaucuucugcuucugccuuccuuccgcucucucagaaauacaguuuucugcagauaucaggcaaaagaguccuccuuuauaaaagaaaagaagacaaacaaaagccuuccucucuuaauuucaggccuguuuuccagaagauugucuuuuugucuuuucucuucauucuuuccacuggcuccaucuuggccccagagcagcucuggucuggccucagucuccuugaccuuggaauucuaaacugucugugucaucaucauugcucuuguccaggugggcaguucagagucauccuucuccuucaucccugcagacagagcaggaauucacuucccagcagguuuaacuacaggaugcauuuaaauaaugagauccaugccacccuucucugucugcuuuauuuauuuauuauuacuuucuuuuucuuuuuuagacugaguuucccucuugucacccaggcuguagugcaguggaguggugugacuugucucacuacaagcuccaccuuccggguucaagcaauucuccugccucagacuccugaguagcugggauuacaggcccccgccaccacgcccagcuacauuuuguauuuuuaguagagacgggguuucaccaggcuggucucgaacuccugaccucaggugaucugcuugccuuggccucccaaagugcugggauuacaggcgugagccaccgcaccugcccuucuaucugcuuuauacagacuggugucgcacagaguacaggucucaagacuguguguuggccaggugcgguggcucacgccuguaaucccagcacuuugggaggcugagguggguggaucaccugaggucgggaguucgagaccagucugaccaacauggagaaaccccgucucuacuaaaaauaaaaaaauuagcggggugugguggcgcaugccucuaaucccagcuacuugggaggcugaggcaggagaauugcuugaacccgggaguuggagguuguggugagccaagaucacaccacugcccuccagccugggcaacaagagcguaacucugucucaaaaaaaaaaaaaaaaaaaaaaaaaaaaagacugcauguguuuuagugcucagauucuauccugggcuuuacaucccagagagauuagagucuuuacuuuguuaauguuaguuucugcuaauagaaguaacaguauaugcaagcaagaaauaaaauacaugacaccuuuugaaugcuccagccaaauaugucuuucucucacauucucucucuuuuuucccuuuuucuaagucuuuguaaauccacccgccccucggcuaucaaaccagaauuggcacaacuaaaggagucgugcccucucguaugucaucccuuacucuguucucauucacaccucagcccuaaaagcccuccugcuucuauagcuaagauucacucaaagagaaauucugccgaaauguuuucugcaggaaaagacgaaggauugauuuucuaguuuggacauuuaucacuuuaagugauaucuguuaugucucuugaauuuuaguagcuaauguguauugaauucuuauuacaagccaggcacuucgcaaagugucauacgugcuccuugcagaaaguuuggaaaauucagcuauaaaggagaaaaugaaaucacucguaauccuauuccuuggggagccacugcgaagauuucaauuauauugcuuccagacuuuuguguacauccguaaaugcauguacuuuuuaaaaagcaaaaaaaccacauuguguuauauaauuugauguuuuguuuuuugcacauaauauuauaugaugagaacauugcaagugugguaucuuggugcggggugccccaacuuguguagcugcugaugcuggcugguucgcuccaggugugcucugugggaugaucgcaaucgcagacgcugucaagcaggaggcugcccuggcugugcacacgcugcagagcauggguguggacgugguucugaucacgggggacaaccggaagacagccagagcuauugccacccagguacagcccuuuaauguugcaaacuguguaaagcucauaaaagcaguuagagacaaaaguaagcaccaguuggcccagcacugagcuguacuccugcucuuucucccuugcuggaugcuuuucucuccacguguuucauucuguggccauguaguguugcacgugagcacuguggugcugugcgaagaucucuucccuggagcuugggcgcaugcauccuggaaaaaaaggaguuccaggguucucuaaccguuucccagucuuugcaauggaaaaaaaaguaugugaccuaagggcugagauagacauuuucuaaccuuuauguuaagggaagauuuugccagcucagcucuucucacuggggugcucagauaagugacuccugggcaguucuccagcagccccugaugcugaguuuggucugugaggacagcaccacuggauggcugccugacuucucacacagcagcggcuccaguuuggauuccuagaaauuaugcaccuccaaaugugugcagagcucuaggcuucugaaagcuuaauuguguuccuugagggaagcagcaguaccccuguuuuccaugguccuccuugcuaauuauggaccuguuuagcguccuuccccccuuuucuggcuagcacuuguucaucuauucagcaggcacuuacgaagcaccacgaaugugacaggcagguguggggccaggcucugugaggagugaaggggggucugcccuugacgggcucauggucuugcaggaagguggaccagugacuguguagaucugagaagcgggaaagggacuaggaaaggaaaacugcaccuucccaggacagagcaggcagcaggagcauuucccaggggcacagaguagcacggcgguuuggagaugccgcggggagcugaaugguauggucaaguguggcaccagcugccagacccugggacccugggacucugggacccucggaagcagacccaagaguugagcugcccuccucugggagaugcauggggucuacuggaugugaagcaggagaguagggagggacauggccggacggaugcuuuggaaagaccaugggggcagcacauggagaagacaguuggaggacugagccguggacagggagaccagcaaggggguuguuugcacauccagaaaaggacagggccuaaaccagugcaggguguuggggcaggagccagggauaaacuggcccugugacagcaaaccugcagggugugguugaccaacaucacugacuggacccagaggccgagggcagagggggcaaggguaacuugagguuucugcugcuaucugauaccuuuugccaacacuaggcauugccuuccuuuugucuuagguuggcaucaacaaagucuuugcagaggugcugccuucgcacaagguggccaagguccaggagcuccagaauaaagggaagaaagucgccauggugggggauggggucaaugacuccccggccuuggcccaggcagacauggguguggccauuggcaccggcacggauguggccaucgaggcagccgacgucguccuuaucagagugagcguggcugcagccaggcugugggugcugggagggcaaugggcagaccccuuccucacugugugcuccucuccaucagaaugauuugcuggaugugguggcuagcauucaccuuuccaagaggacuguccgaaggauacgcaucaaccugguccuggcacugauuuauaaccugguugggauacccauugcagcagguaggcagcucuuacccacugugcuccagcugcgcccagaaaggcuucugucucccagguuccugcugggguuagugaguggcucacucacuggcuggcuagaggcguuuuagaaaggcuguuuuuuuuuuuuuuucauguccccugcuuuauaugucuuuaaaugagaaacuguggagaggaccugaaaccuucauucacucugguccuuucuaaaaagcuaguggagaugcuuggcuguauuuucugaucccuauuuuauuguggccuuauuuucugagccauuuguuaagucauauagucugagaaauaaucauuaguaagaauuauggggcaucugcuacaugcuaggcacaauuauugguguuucagaaccuuauccugaacauuaauccugcccaaguuucacucugaguuacacaaaugaucauggaaagaaauggcucuuugaccaggcaugguggcucaugccuguaauuccagcacuuugggaggcugaggcaggagggucauuugagcucagggguucaagacucaccugggcaacauggugagacuccaucucuacaaaaaauuuuaaaguuagcugggcgugguagcguacaccuuagucccaucugggaguacagaggcuggggcagaaggauuuauugagcccaggaguuggagguggcagugacccaugaucgcaccacuguacuguagccugggcaagagugaaacccuaucucagaaaaaaagaaaaagaaaagaaauagauuuuucugcuuuguaauucccccucauucccccuccuuaagaaccaucucucccccgcccccugcucccugcccccugcccccaggaacauggcaaugaaaaguuccagagugcuccuccaugggcugaggagagaucaaguuuguaaucacagcauuccugccucagucucccuugugucugagugguuaguggugacuuguguaacagggccuuggcuuccugagcccagugagucaggcagguuuacuucuuguccccagagccggcucaggagcuuaauucccccaguguaugugccucugccacacaaaguugaccauaccugucuccugacccuguccugggaccuggcucucauuccucuucuaaagaugucaugaagcccuggaggcgagaucaucugcuagagaaggacuguggcccucagccguguuuguccucugugggacuguggcuacaggaugggcaacuggcucccucagcuccugccgcuuuucuccucccgcuccucccacuccuugugguuugucgcugcccuggagcucgcccugaaaugggaugccaccugugggugguucugggaacaucagggcgaguggaagagagccaggcccacucaacagcaucccacacccagcuuucuaggaagccucacuuuggggggggccugugggcaagauccauuggcaggggcuucugagcacgccagguggagaccucacugggggccgcugaggguggggcagcccggugccugaagcccucuccuggcuccucuccccagaccuaggugugagugcgaguucuuucuuccccaggugucuucaugcccaucggcauugugcugcagcccuggaugggcucagcggccauggcagccuccucugugucuguggugcucucaucccugcagcucaaguggugaguccccucagguggagcaucugugggaggcucccaggaggccuugucauucugcaugcuuagcacaguggaacuugccucucauuucccauucauucaccugggacaaaugcugcaguggcagcccacauggagccuggugugcaugcauguaacuuaucagcaccaugagcaggcaauucacugcugcccauucacgugcugggcugcccuuacucugcuccucaagggcuguuuaugugaacaucaagcagacaugggucccuguguaugaucuaucacuuuuuuauuuaaaaaagauguucacuuauuuaugagugcauucauuuaacaaaaguuaguggcagccuacaaugugcaaggcauuugcuuaggaaguuucuaaaucaggugagcuuuccuggaaccauagggaguuuaauguccuuuuccuuggaaacucuugagguuuugauacugaauguuauuaaaagauggaugagaggccuucaccaggcuuagaaaaaaaaaaagccuuguuucuagaauggcucagaugcuguugcguuccugcuuuccagcuauaagaagccugaccuggagagguaugaggcacaggcgcauggccacaugaagccccugacggcaucccaggucagugugcacauaggcauggaugacagguggcgggacucccccagggccacaccaugggaccaggucagcuaugucagccaggugucgcuguccucccugacguccgacaagccaucucggcacagcgcugcagcagacgaugauggggacaaguggucucugcuccugaauggcagggaugaggagcaguacaucugaugacuucaggcaggcgggccggggcagggacuugccuccacucaccacaagcugagcaggacagccagcagcaggaugggcugagcuagccuccagcuuuggggacuuccgcucccuggauauguccagucauccugcccugcagcacgcggccuugucugggugcagcugggcuuggccuggagaggacggcccugccugccucuuggccucacgggaccgucagcaugggcuuugucuuggacucuaguccuuggcuggacuguagaaggugagaggcgagucacccuccucacagaccucugcuuggaguauuuaggaugacugcugugaaauggagaacaguuucaucaggaccaaaaaaccucacugggccuuuccagagaacugcagaccucacugucagggucuuucugaugacgccugucugugugcaucauguuucugagaccacaguuuaccucaggugugccuguugcuuucuuccugcauagucuguuccuuucuucguacauagucuguuccuuuucucuccugugugcuugucaguggggaccccucgcaacccugccugucaccugggagggugggaccaauguccuuguggucuuugcugcugcucucaggcgcuucuccaaugcucuggagugugcauuucagcuugaaccugcuuccuggcucacacauccccagccagggagcuugccacacucuucuucaaguugaggagaguucuuuuuugcuuaaagcccccuucuccauggaguguuggcuucucaauagaguguuguugcugaccagcuggagugagggccucagagccugaccugagaguccguacucggcuuccugugggguguagguucucgcgauucaggacguccuuccauaucccugcccagccuguggugcuugaaacguuugccccaugggaaacguaugugugcaggagccucccugcacggcccaaggggcuucguuuucagucuucugacugucaccucgugggguucaguagagaauucaugugacuagcgccuggccuuguguggcuuggaggaaaugguacugcccaaauaggaggaaaacacagccucccugagccugcauucugcacgcugcccaggggcuucagaaaaggaguggccacagcaccccgaagggagcaucuguuuaccuggcaguggcucucagagcagcagaacggguucaguuuuagacucugaaguugguugugauugacagaacccuuugggagcaaacuaguagaguuggauuaaauucugggugaaacccuuuucucccacacaaaauaguuuuagugauuuuuuucauuguccauuacuugccaggggcaguuuuagcagcacuuuugauagauuacgucuaauccucccaaccaaccagcaggguagcuauuacuguccacauuuuacaggcaaggaaacaggcuccaagaggcugaggacuuugcccaggaugacauagccaauggacaagcagugucugucagcugugaaggcuucacucuuauuguccuucuaccuugaauagaaguuuuccugauaagaauaaacgaggaaaagguccuugccuccuggaagaacaaaucuaccaggugaucuauucauuguuucaacucagaaugcacuugauucaggaggucaucugaccuucaccuuggaugguuaguuucacuuuuuacauauaguuuuugcaggguuuuauuuuauaaaauccaagcgcgcuguugauuguguuuuccuuguuuucagcccccccacuccagcccgcagcacauuuccgcuguccgucaguaauuguguccucucuuuaugcuugcuuggggaauguuguuuucugacuaggcugaucauuaucuaaagaaucuaauucuguugauuuuuaaaacuuuuaggaccauaaacguuguguucauauauggacauggaaauauuuauauaauuuuauagaaaauaaccuuuuagauggucaaaguguaaggaguuuuuuugucagauaaucauuucuacuucaaaaacauuucaugcaauauuagaauaaaguuccugucauuccucuaaaa

SEQ ID NO: 61602 - RNA, 78825 nt, Homo sapiens; identical to SEQ ID NO: 61601

SEQ ID NO: 61603 - RNA, 78825 nt, Homo sapiens; identical to SEQ ID NO: 61601

SEQ ID NO: 61604 - RNA, 78825 nt, Homo sapiens; identical to SEQ ID NO: 61601

SEQ ID NO: 61605 - RNA, 78825 nt, Homo sapiens; identical to SEQ ID NO: 61601

SEQ ID NO: 61606 - RNA, 33692 nt, Homo sapiens
gagaccaaaagucagguaggagccuccggggucccugcugugucacccggacaggccgugggggcgggcaggggggcggggccgggccugaccacagcggccgaguucaguccugcucuccgcacgccaccuuaggcccgcagccgugccgggugcucuucagcauguccuucaucccgguggccgaggauuccgacuuccccauccacaaccugcccuacggcgucuucucgaccagaggcgacgugagcaguggggcuuuggcguccgggcgcggggagggaguggaguggaguggaguggaguggaguggaguggaguggaauggaguggaaugaggggcgggauggaggcuugugccauuuuucucuuaagauucguuccgugagagugccuaugggcucgagucccgccucguaacuuucuagcugugcacguuguuuaacuuuucagccucauuguccgcagguuugcugagaauuaaaugcaaaaugaaaugaaucgugucacucucccagacaagcagagcaagcaggauucuguuaccggaagcugcagcacacaggcaugcugccuacuccgaggugguugcgguguguuucucucgcccaagaggccaggucagggcuggugguucaucucgcuggauagccccuaacccuagaacccgggaaaugauaacccgguaugcguagcaggucagaggggcacgcgcguuucuuggcuuagaguugugagaucuaagauggcaagugucucugccuauagcugaaauucuuucagcuccuggugugggcucccuggcauuccccuacugaucagaagaaagagggcagggaaacaaacuuugacuaagucaguguagucugauugguagaaagaaguauuugaaaacuggggguuuaucagcaaauagauaauaagagguucccuagguuggaaaagcagauucccuuggauuuguugaugauauuuuuggcuuagauuucugcucccaacuuuaaagguaaacuccugauucaucucuguaagccauagaaccccagaaucaggaaauguuugcuaaacgaggggccuggcaguuggcuucuucuuggaaagugggguucccuccuucccccauggcuugucauuggaugcaaguggcuggccuuuugugggccugucugcgguaagugcuuuggucuagaagagucaacuugugguuucacaucuggccgggcugaccagauguugcaaggauacagaaaguggacacucaauccccuggaggacacaaucugaggcacauuaaaucuuaacuugugauggccaacaaccuuucugcagacagagcccucccucugcccuccucaaacacuuugcccucggcagauguguccucccucaccuuuccugggagcacaaauccauuagacagaaacauuugugagaggcaggcacaccccaguagggagcucugacuugcuuucucaggggaaucgaauuaauauccguuagaguguggcuagguguuuucagacaccaugucccgcuguuucaacaucagaaugugcagggcagccacuacagaugucuggaagagagagccccauuccgcuguccucugauacagugcuggggguggagaguuggcccuuuggccuuccagcugaacaagccucuucugaagcuuucucugcaggcauuggacauuccaaccgugauggcugccuugccaggcaagacuaguugccaaggcaaaaccucccuucccccaugucagcagucagccuuuccuaauuugaguggaauaacaaugaauccugccaucacuuuauucauuuuuuuuuauucagcgaaugcuuaugaaccccaacucugguccagauuuugccugggcuccgaguuggcaucaaagacacaggagacgccuuccuuccauuucugguugauggacuaguaagguguacaggggugcucucugugaagguaggggugguggccucugagaacgggguuguaguaguguggagcugguuuugccgggugccuuguuaaaguccccguggucuggcugugcugcugccuccuggccucugcuuucuccagccacauuggcugccuuugagucucugagaugugcuaagagcagcuuccugccuucaggccuuagcacauguuguuccuucugccuggaauacucguccuucugcucucuauaugcuuggccccuucucacucuuugggacucagcuuaaaugucaccuccuaagcacccucucugaaugagcuccccgcugcggcccagccuugguuaucucucaccacacccuguguuuccuuuugcuucuggagagaaggaaccacgucacuguucccagggccucagcagccuuuguguaaugcugguacugagaagaugcucucuaaaucuuuguggcaugaauagcgucuacccugugucuguucuuguggugagagauuuacagauauuaauuaaauucucacaauaaaccuacugugaaguuauuguccccauucuacagaugaggaaacugagguccagagaggcaaagcaucaugcuccagaucucacagccaguaagaggcagauaugggguugauccccacaucugucagccucccaaucuguaagguccagcccuacggggcuuagcggguuuucucccugugugcggaaacgagagauuguaagaaauaaagacacaagacaaagagauaaagagagaacagcugggcccggggcacugcuaccacugagacacagagaccgguaguggccccgaauggcugggcacacugauauuuauugcacacaagacaaggggggcaggguagggagggugagucauccaagugauugauaaggucaagcaagucaugugaucaugggacgggggcucuucccucuaagguagccgaagcagagagggaaggcagcauaagucagcauuuucuucuaugcacuuauaagaaagaucaaagacuuuaagacuuucgcuauuucuucuaccgcuaucuacuacaaacuucaaagaggaaccaggaguacaggaggaacaugaaaguggacaaggagcgugaccauugaagcacagcaccacagggagggguuuaggccuccagaugacugcgggcaggccuggauaauauccagccuccuacaggaagcugguggagcagaguguucccugacuccuccaaggaaagggagacucccuuuugcggucugcuaaguaaugggugccuucccaggcacuggcguuaccgcuugaccaaggagcgcucaagcggcccuuaugcgggugugacagggcucaccucuugccuucuaggucacuucucagaaugucccuucaguaccugacccuauacccaccgguuauuccuagguuauauuguacuacaauaaagaguaauauuaaaaacuaaugauuaauaauguuuauacuaauaaucgauaauuguccaugaucaucuguauaucuaauuuguauuacaacuguauagcaguauagcuacaguuuaugccuucagucucuugccucggcaccuggguaauccuucgcccacaccaaucccaugcuucccccucuaugucaggcugggaguuggguaaugcuuuccuuuggacaacuuuauaucagauaugaccaacuauuuuaaaacaaaggcaaugcacauucauucucuugaaguuagacaaaugcggucucccuccuuaguuuguuucccucaaguugcagaugggaaacugaggcccagagacuuguccaaggugauaagauggugaaugagggagcagacuuggagcccaggaauccuggaucugaccugugagcccccucuaguuuugugcugaagaaaauaacucccaagguugaaaguagagggacucacucucucagacuuuuucuggguccucaggucauaguuugaagcacaaguuugaagcuucuaggcuuuguuugcauuugaggcagcaggcagcugcacuugugaccccauuuuggaaguugcuuacugguggugacuccuucuugccuucagcugggguguggggaccagggucagagaugugguccaagggucugcccugcacauucccugaauggaaagccacuuggauucaggugguucagcucuuugccuaaagcagauuugccauuuucaggaggggaagacugaggcccagggaguuggcaguggggcugagaaugaguaacuaagcucuccaggcagccucuucuaggguaggcucugcugggaccucagaugaggaguauggcucuggucuaccccgauuccaagagcugacaugcguggagaaauggucaucuuuucucagcccaccccagugagcagccaauggagauaaggccagccaauaaucccaccacuaagcucgcuggcacugaaauggccaagcuggugguucaggagagcuggaagccuggcucaggacagagcccugggaaguugagucugcaaacaugcccucggguucuuguugacgagcaaagcucaggguuguggggacaaagaccaggacuuaacaaauauuuaagacaucuuuguugaugcugggauuuugugguacagaaaggaacuugccuugcauguucugagcagucuggcuuccugcagcucccuuacaacccgagcucuccuccauuugagcuacaacagagcucauuaauccaagccaccuggcccucagcacuguguguugggcacucaugcuccaccgcacaacugaacuacccuagucaaggccuagaaaccuggaaaauaauccaacauccugguaaggugguaagcuccucaucacuggaggcauuuauguaaugccuagggaacuuugcaggggucuuugcccagguuaaguggcuaggaccaggcugacugcucuucccccaguccaagggauauuugauuucuuucccauucagggaacacagauuauuuuuccuuuuaguucuggaagcagagauggcacaagggagcuggggcaggaugcugagaacaugguucuucaguccgcucugcauacagggccaccuaaagggggaccuguggacucuucaauagauaggcuuucugaguaaaugagccaagcccagccaggggcuuuuucuggugcugacggugucgucuuccuccuagccaagaccgaggauagguguggccauuggcgaccagauccuggaccucagcaucaucaagcaccucuuuacugguccuguccucuccaaacaccaggaugucuucaaucagguaggacauugugaaacgacuugucccugaccucaguggcacuuacuguggaugccaacaagagaaugcuccuugcguuccauuuccgauagagguaaugccaucgaaggucucagagguuauacuuggauaaggcugggguuguuuugagacagacaaacugguaggagguggccuugggacaauucaggguggcuucucaccucagggcgaguuccuaggugaaaaaagugucagugucugcaguccugggucguuccuaguugucuaugagaugaagcucuucaggaacucugguuacuuuucuugucaagcuguuugagccucugccuguccaagggcugugugggcccccaagggagggagcuacgagcccagcccuccaguucuguggaagcagcuacggaggagucagccugaaguacauguucacaugggauggacaugaauuugcuucccuguaaauggucaucuacuuugauauagcaucuucucauugcaugggucaggaaggagggugggauuuauggguaccucuugugugccaggagcuucgcacacauccucuccuucaauccuccugaccacccucuggcauaggaauuggaauuccuaugggggccugagcaucuagauggggaccugaacuucuggaaugagacaugguuuucccaagcugcacagcuagaaguaucagagcugggacuggaacucugacucuuagaaccuacaagggcuuuuucugcuaugcuucacuggcuauaaaaccucuuccuuuuuuaaauuaaaaaaccucucggcucacgccuguaaccccagcacuuugggaggccgaugugggcagaucacuugaggucaggaguucgagaccagccuggccaacauggugaaacccccucucuacuaaaaauacaaaaauuagcuggguguggcagugcacgccuguaaucccagcuacucgggaggcugaggcaggagaacugcuugaaccugggaagcagagguugcagugagccgagaucacaucagugcacuccagccugggugacagaaugggaaaaaaaaaaacaacuuuuuuuuuuuaauagagaugaagucucacuauauugcccaggcugaucuugaacuccugggcucaagugauccuccaccucggccucccaaugugcugggauuacaggcaugagccaucacaccuggcccaaaaccucuucuuaacugaugugaaaggaauuaguuuaggcugugaucacucugcagacuggagugugccucuacuggaagaacauggccaccuucaacugugggccgggccaagcuuagcacaguugcugugccagguagcaacuccugggcuuggacaauugugugcaggugcacgagggccugaggcaacgucaagagaggauaugcuuuucuccagguugaugaauaaaugacaaaacuaagagcagagguccugagaguuugaguuagcgggagagaaguggcaagggcuggcaggcuggcuggccuuccauuggaaggagggauacucccuggguuuuccuguacgugaucuuuuuucucccuguuuuggucuuagccuacacucaacagcuucaugggccugggucaggcugccuggaaggaggcgagaguguucuugcagaacuugcugucugugagccaagccaggcucagagaugacaccgaacuucggaaguggugagaagcacguggucauaggggggaugaggggaugcagcaggggaggugaaggcugugugguuaucagugccauucugagucacggcuuggcagccuuaguguggccaagucagaccugcccucauccagccccugccugagcugccuauugaugggagggcuuugggaggacugggauugccuuggcgccuggaauggagcugcccaagcuaggccaggccaggcccauuggcccucucucuuacucaggcuguccucauuagcaucaucugugaccucaucugguuucuagaguaggaaagaguuuccacuugucuagucccauuuccuaggguagaauauagaaacggcuucaguggguggauguccucucagcugugaaagguucagcauagcucuggccccaggccagccagaaggugcccacuggagauuguggauaaucuuggggauggucugggcugagcccgugggugggaccgcgcuuugcugccuacuugacuuugaagccccugguucuguguuucagugcauucaucucccaggcuucugccacgaugcaccuuccagccaccauaggugagugcagucucuucaccaagauaagaacggagcagcuucgugggccaagagggcuggccaggugcuuugguucugcaucuguguggagggucccugcugguggggggagauggaggaggggcucuggggcuguuacccgcuccucaucacugaccuuucccagcauccaggcccggcauucacucaggcuauuaucuugccucagguagugaguugcagacugcucaaguucaugacuagccgcauggcucccugcacagcaaauugcuuuccuucccccaaaggcuaugggacaaauucucugagcucagucugugagucagcaguuuugaggauagaggccagagggcuaugaagggccccaguuugagcacguggcaggaugucugguuggagugucauucaggaaguuggagcuguugaaacucucaaccugaagcagagagagaggcuggcucagccugcggcccaaagcacagcccucuuccuugugcacaggucuccucugcugggcuaccugggcaccugugagcugaggggccaguugacccugccccugggguacacugccucucuggaacagcuccugcuguccggggagaguccuuugcugcugggcugcuugggcuaagcugacuggaggaugggguuggggacaggggccgagucaccugccuccucccagccccucucacuccccacucucauacacucaugggacugugcuauguuuuggcaaaccagcuguugugcaaaccauaugucuuucagggauaucaugucugguugacugauggugcccuuucuuguuuuuuuuuuuuuuuguuauggauuuauucuuuugaaaaaucucucagcuauuacuucugugcaaugggacugaagaugggaagcagcagcuaaggcuccaccugcccuguggacuguucuuccucuccucacccuucaccaugacuguugcuagucuaggcuguugguauugaugaauauccagcauuuuuuuuuuuugaggagacauuuaggaagauaaaacaggcagacugucccaacugguuuuucuuucagauuuuuaauucuccgaaugguagauaugccuacagcuugcuggcuagcccauucaguucaucauaaucaacaagcacugauaugcaucugcagugugcaagcccuuguccuuggcacucgggcagaguccaagaaaaugaggacugggcuggggcuguccuggaauguccacagucuagcaaagaugugcacacacauaacuggagcaccagugggaagcgaagccugccccagaaggauucaggggaggggauuuggagggggaagagauccugcuagagagagcagggagggcuucagggaggagcgggccucaaagaguugccaggauuugaauacacagggacaagggagaagucaaucaguauaggcguggugagggagccugugggaacucgggaauggcaguugugugugggaaaaguggggagccugagaagggaggugguaucagccacuugguguucacauuccacugucaguuucagaaagucuggacuccugauuucuuauuuguuucucagcugagggcucuaaaaacaaaucuucagugaggauauuuuauauugcauuuggugcugccauugcuggcugcaggcugagcucuggauguguaaacaguauugugugcacacucguggcuccagugcuuggaacaguccauucuuccugaggcauguggguugcugaugggaucuguugggucuuuccucugcaggagacuacacagacuucuauuccucucggcagcaugcuaccaacgucggaaucauguucagggacaaggagaaugcguugaugccaaauugguaugaacugggccaaaugucugcauaaguucaaagucuuucuuuucauuuccagcagcauauuugucucaggagcugccaaguucuucuuaaaguaaacuggggaggaaaagcaguuaugauguugcaaccucuggaagcaguggucucagcuucuggucuccugcucagcuuggcuuaggacuugcugugggaucgaagggcaagucccuuaaacuuccuuggacagcagggguuggaauuagauucccuuaaucccuaugcuccuucuggagucuuucauuuauaagcuguguauuauuguacuaugggcaagucuuagacucuagcaugcuccauacuuacauuuucugaugaaugagaauccucaaaugugcccagugcuguauauuccucaacaugugaucgguuucauucauuuguuugauccucguaguaguucucugaugucacaaggccaugauuguaagccccauuuuacagacaggaaaaugggcucagagaaggaucaacuugccugagcacaacagggccacagccugucucccagcccccagaucaggccauugaccaagcugaggaugcagagcugggauccuugcccuuuguucuguguuguccccuggaugugaugguuccuuggaacugaagagggccuggacucaguggcaggcauacacuccaggccccagugccaucagucacacacaggagcuggguuagggacggggcuuuacucucucucgagugagugucuccaguaggcuaugccaugaggggagggucuguuagaaccaagaugaggaagaaagaaagggagagagagcaguuccaagccagagauguugaacaacaaggccaagguugcagaaugaggcaggggugaaucugagaccagaacccaggcuccagguuccaggcuuccacgugagaugcgcaaauauuugagaaucuugcacuguacaggcuccaggcuguauuuguccccagccagcuucaacuugucuaucugaugggcugagugucuauaugaguguccuuggcagugaugacccaguggacugcccagccccagaagagcuggcugucaccugugugccaggaucccaguggccaaagggcaggggcaccaggaagugagaggagagccgggaccugggaaaugaguguugacugugucugaaaccgagugugggggccgcagccauccuugccccauguccuucugcagaauaagaguaaacaggccuucucuagccauguuugaugcaagauggcccacagcugugacuuuuuagcuuuauguacauagucuuuauuauaaagguaacauauauuuacuggaauuaacccaaacacuacagaaaauauguaaacauuuacaauuaaaaaugugucuacucuuugaccugcaaugcucacuuucaugcaucuauccuacagaaauaaaagcaccaguggguuguauccaagagcaaggauguuaauuagcagaguuucuaguggcccagaacuggaaguaaucugaaugcuuaucgguggaggaaugguugaaaaauuggucuauucacaauaugaaauguuuugcagcuagugaaagauuuagaucaagaaagaugugcacugaucuguguuaagugaaauagguaaacuauaggcaauuagguaaagugugucucacuuuuauaaaaaaagcacaaaaaauauauauguacauacacacuguauuaguuuucuguugcugcuguaacaaauuaccacaaacuugguggcuuaaaacacaaauauauucucuucuaguuccggaggccagaagucaaaaaucagucucacuggcuaaagucaaggugucagcagggcugguuccuucuggaggcucuaggagagaacccauuucuuugacuuuucagcuuuagagguugccuguaucccuugccuuuugaccccuuccucauaucacuccaaccacuugcuucugcuguuacauuuccuacuuccuccuuugaccuugccucugucuauaaggacccuugugauuacauuuaggguucacucaaauaaccagggacaguaucccuaucucaagaucccuaacuuaaucacaccugcaaaacucuuuuugccauguaauaauauccacaggcuccagggauuaggaucuggauaucuuuuggagggcuauuuuucagcuuaacacacacacacacacacgcauguacacaugcacacacacacacuuaugcauacauuaguuccauaggccgguaugagcauagagaaaggcaaaaaauauuagacuccagauuaacauugcuuuccucaggggaguggccggguggggagagauuacuaacuccuuuuuuucaucugaauuguuugaauuauuacaugccauguaauugcaugcaauggaauuuuauaauuuaauccaauaaaggaaccaagguggguaaaaaagggagcucuuccucagccacucaccagaggcaacuacuuugaacaaguuggaugugccgcuuccuguacuuugcuccagguuacacaugcaugaccacacguaugcacgcauacauaugcauuuuauuucuuuaguuaacaaaacgagggcaugcugaaauuugcuuuuuuuacuucaucauugacauaucuccauguagauaaguuuaaaucuaucucagucuuuuacaaaauaaguuuuuugggguagguaauacaagacaauuacacaguaaaauaucauuuuuauaaaaagauacaaaaauacaguacaguagggcugggcgcgguggcucacaucuguaaucccagcacuuugggaggcugagguggguggaucacaaggucaggaguuugagaccagccuggccaauauggugaaacccugucucuacuaaaaauacaaaaauuagcagccaggcgugguggcucacgccuguaaucccacaacuuugggaggccgagacgggcggaucaccugaggucaggaguuugagaccagccuggccaacauggugaaacccuaucucuacaaaaguacaaaaauuugcuggucaugauggcgggugccuguaauuucagcuacuugggaggcugaggcagaagaaucacuugaaccugggaggcggagguugcagugagcugagguugugccguugcacuccagccugggugagagagcgagacuccaucucaaaaaaaaaaaaaaaaaauuagcugggugugguggcgggcgccuguagucccggcuacuugggaggcugaggcaggagaaucacuugaaccucggagguggagguugcagugagcugagaucacaccacugcacuccagccugggcgacagagcgagacucugucucaaaccccaccccccaccaaaaaaaaaaaaagguacaguaauaaaaguguauagaaauauagggaaaugaggaccaugcugguuuccucuagggugaggggcaggaagggagggaaggagagugagaccagggagggaucccaaggaugcauuggacuggauaagugaacuguuauuucuuuagcuccuugguggugcauggugacuuguguuauuacauguuuuuguauaucauaaauauuacaaaauaauuuaucaaacauuuaaaaaauuaaaagcaacaaaaacagucaauauauauauacaugguugagaauucaaaagguacuuaaggguaaacaaugaaaaaaacagaacucaaccaccuaugggccaccauccaguucccuucuccagagacaaaacuguuaaucggugucauacauauauuuucuuuuucuuuuuuuuuugagacugggucuuacuuggucacccaggcuggagugcaguggcaugaccuuggcucacugcagccuugaccucccaggugaagccauccuccugccucagcccccuaaguagcugggauuaaaggugcacaccaccaugccuggcuaauuuuuguauuuuuuguagagauggguuuucgccauguugaucaggcuggucgcaaacuccuggacucaagugaucagcccaccuuggccugccuuagccccacaaagugcugggguuauaggcaugagccaccgugcccggccuucuuauauauuuuuucacagauguuuuugcauacucugccaguuuauauauacagucauuucucuauuauuaguuuacaagaguguuuuauaagugauagaaauuaacccuuuguugcaaugcauugcaaauauuuucucccaguauguuaucuuuuuucuuuguuugccagucuuucuagauacagaguuuugcauuuucuuuuuuuuuuuuuuuuuuugagacagagucuugcucugucgccauggcuagagugcaguggcaccaucucggcucacugcaagcuucgccucccagguucacgccauucuccugccucagccucccgaguagcugggaccacaggugccugccaccacucccgccuaauuuuuuguauuuuuaguagagacaggguuucaccuguuagccaggauggucucgaucuccugaccuugugauccacccgccucggccucccaaagugcugggauuacaggccugagccaccgugcccggccuagaguuuugcauuuucauaaagucaggcaugccaaucauuuuccuuauggcauuuacuuuuguguaauguuuagaaaggcuuucuccaccccaagaauuuggaaguuuuuuguguuuuuguguuuuuuuuuucuagugccuguaauagccuuuguuuguacauuuagaucuugaauccaucuggauuuccuuuuaugugugaggugugguaugggucuguauccauuuccuggggcugcuguaagaaaaagccacaacaacaggaauuuauccccucaguucuggaggccauaaaucugcaaucaaggugucaguaaggccaucuccuccugaagcuucuaggaccguccuuguccuugcugcuuccagcuucugggggcugcaggcguuccuuguggcugcaucacuccagucucugccucugucuucacguggccuucuccuccuuucuacaucuucucuucucuucugucucuuauaaggacauuucuaauuggauuuagggcccaccuggauaauucaggaugaucgugucucaaaauucuuaacuugauuacauguauaaagacucugggaguuaggacauggcuguaucuuuuuuuuuuuuuuuuuuugagauggagucuugcucuguugccuaggcuggagugcaguggugcgaucucaguucacugcaaccuccaccucucagguucaagcgauucuucugccucagccucccgaguagcugggacuacaggcgugcaccacuaugccuggcuaauuuuuguauuuuuaguaaagacgggguuucaccauguuacccaggcuguucucgaacuccuggccucaugugaucugcccaccucagccucccaaagugcugggauuacaggcgcgagccacugcacccagcccagaauuuucuuccuuuuugaggcugaauaauauuccacuguauguauguaccacaguuuguuuauccauucaucuguggauggaaacuuguaagcaccuguugauuuuugagccauguguauguggcgacucuuuguuucuaguuuuugaaguuuuuaaaguuaauugacaacauauaacagcucugaugcccugcauucucuugccuuccuuucucaggcugcacuuaccagugggcuaccauggccgugccuccucugucguggugucuggcaccccaauccgaaggcccaugggacagaugaaaccugaugacugugagugaccgcagcguccaggccuugcugguacccagcucucuguucccacacagagaguucuguggccucacucacagcaccguuuuuuuuuuuuuucugguguuauuccagcuaagccucccguauauggugccugcaagcucuuggacauggagcuggaaaugguaagugagcuugauguuuuauugccaugggaucuauagacacccggcaggagagcccuuugggauggcuccccgcaccaugagccgcccacuccccuccucuucagccacaucggcagccgcucuguguccccaccuggccaucagaaggacaguugauccuuauuacuugcagauucuguauuugagaauucacaacuacuugcuaauauuuauuuguaaguccagaauuaauauucacagagcuuuugugggcauguguggacaugcgcagggcagugaaacauuugagcugccuggugagcauguuccuaggugaggcuggacaagguguuacucugccuucuugucucagcuuaugcuguaaacauguguccuuuguagucuauucggugccauguuuuuugcagaucugugcuuuuuuggcuguuucauuguuuuuuuauaaugaccccaagugcugugcuaaagugccgucuagugucccuagcacaggaagacugugacgugccuuauggagagaauaugcguguuaguaagcuuuguucaggcaaguuacagugcugcugccucagcucaauguucaugaaucaacaaaauauauuacauaaagcauuuuuaagcagaaacacacauaaaacaggcuauauaguuagguuuugauuaguugauaaaaauuuucugaccaaaggcuugaaggaaccuaauccuguguuuccucuaggaagucauucuauauuugcuaauucuguguucauggugacuuuauaaaaaauaauuaccuggccgggugugguggcucacaccuguaaucccagcacuuugggaggcugagguggauggaucaccugaggucaggaguucaauaccagccuggccaacauggugaaaccccgucucuacuaaaaauacaaaaauuagcuggggaugguggugggugccuguaaucccagcuacuugggaggcuggggcaggagaaucgcuugaacugaggaggcggagguugcagugagcugagaucgcgccaccacacuccagccugggugacagagcgagacucugucucaaaacaaaaaacaaaaaacaaaaacccaaaaauaauaauuaccacgagugacaagagucaaguguaucagccccauggcugggcccauacaaccucagaacuguggucacuuuaggcugcauacuuuuuuauuuguuuuuuguuuuguuuuguuuuguuuuguuuuucugagauggagucucacucugucacccaggcuggagugcaguggcacuaucucggcucacugcaagcuccgccuccuggguucacaccauucuccugccucagccucccgaauagcugggaccacaggcaccuuccaccaugccuggcuaauuuuuuguauuuuuaguagagacaggguuucaccauguuagccaggauggucucgaucuccugaccucgugauccaccugccucggccucccaaagugcuuggauuacaggcaugagccaccgcgcucggccagggcugcacacuuuuuuaaauuaaacuuuuuauuuugaggucauuguagacucacaugcaguugugagaaauaguacagagaucccaauacccuucacacagucucccccaguggcaacauccuucguaaccauggugcucuaucacaaccuggauguugauguugauacagucggucccaccaccugaggaucccucaugcugcccauuuuucagaggggacacugaaaucugggcagcccccaaggugaggggaccagggaagugauggaaaggaggagcugaccugggggaggcagcgcuccggggaccuggcagggucuucagcaucugcuggguugucugaugcccaagguuggagucagucuccgugugggaaaugcagacaggcagauggagggggcuuucccauagucagcaccuacaguuuuaggcguugccucaggaagcucugagugccucaucacugaugguguagaagaagcugucauggggccaccgagucaggcugagacagugggaagcccugguugguggaggcaggcugaaaggcccgucugcuuuucuggagcucccugucucuccugggcuucccugugauuucucuggauucaguccagaggagggaaaugagugggcacugccgaauagcccguggauagcagggcauucccugccagcccucugccuccuccugccuuagcaaggguacuaugugagacugcgggaggaggacccccagcugagauucaucagagcagggcaucugagcccugguuuggggccauggucuucucucugggagaacuaaggacucugcaggcagacacuucaccuguugagagggagagagaaaagacagagagucagcauguggagaaaugguuggggcagagagcccaggucaccuggacuagugcuuuuggguucuuuuuuucaucuugaugaaaaauuugcaauguuuaacuauugucacagaacaaauaaaauggugacuaaguuuugcaaaugucauggcugagucuauguuuuucaaagagauuuucccaaauuuuucuuucuaaugaugccuggcuagucugcugguucauggacaucacguuggugcuguuuuucuuuagagguagugggaugacagauagggguuagaggccguggggugugcucucucugguacuauuugcugcaugaaggaggcagucuuuugguuuuucauuuuucauuaaaaaaauuuauuuuuuauuuuuuauuuuuauuuuuaaauuuuauuauuauuauacuuuaaguuuuaggguacaugugcacaacgugcagguuuguuacauauguauacaugugccauguuggcgugcugcacccauuaagucgucauuuagcauuagguauaucuccuaaugcuaucccucccucuuccccccaccccacaacagacuggauuaagaaaauguggcacauauacaccauggaauacuaugcagccauaaaaaaugaugaguucauguccuuuguagggacauggaugaaacuggaaaccaucauucucagcaaacuauugcaaggacaaaaaaccaaacacugcauguucucacucauaggugggaauugagcaaugaaaauuuuuauuuauuuuauuuuuuuauuuuuugagacagggucuugcucugucacccaggcuggagugccguggcgugaucucggccugcugcagccuugaccucccuggcucaagcaaucuucccacauaagccucccaaguagcugggacugcggacaugugccaccaugccuggcuaauuuuguuuauuuuuuguagagguggggucucacuauguugcucaggcuugucucaaacuccgaggcucaagugauccuuccaccucagccucccaaagugcugagauuauagacgugagccacagugccuggccugguuuuucaugacaugaauacaaacccugauaguuucaguuuuacaagccucauguggcugucaagucuugaaaggcaaaggcuguaugggaugaagaggaaagagcagaguggccugggaugcacugaagggaggggaggcugcuuuggagcucaggggaguggaaggaaggccgauggcgggggcagggcacaccacugcacucugcuuuccugaggcguccaucugaccucugacuuagaaacacaguggauucaugccaggccccuguggcaguccugguccauggcuggaguuuggaaauaccugaccuuugcucucuaggugacaagugaccugggcggcagaucagcuccagauucuaaugaacucucccccauguaaggcuuuuuuuguaggcccuggaaacagauugggagagccgauccccauuuccaaggcccaugagcacauuuuuggaaugguccuuaugaacgacuggagugguaauuacuggagcucugcuccuguagagaugacggggaggaggcuggggacuuggggcaauuucauagaagcugaagaucuggugcaggucaaaaguggcaggugaugcagugacugagagugggggucuggguaucaaacagacuuucagcucuaagaacucgggccacucacuuaacuccucugagcuccaauuuucucgaguggcuagggacacggcugacaucauaacuaauauuuacugagcacuuaugugucaggcccugugcuuaacacccuucguauauucucccgcugaucccuacacgguaugugcaauauuaucuucccauuuuacagaugaggaacugaggcacagggagauuucaguuaguugcugaacuaagauuugaagcaaaacaguccagcuucugagccugagcucucaacccuuugccauacgugggaggaagauggcaccauaagccccagaaagugucucucucauaguuugagaaugagcuuccagccccuuccugggagauauccugaccaccguuuggucauccuucucuuugcuguaaccuggcacagugcccucaaaggaccucuguccuuggcauugaaugcucuugccccuuuguccuggggcagccugacuggggcugaucuuuguggagauggcagugcuaggugucucugcuccuuggucaagggcaggagggggucguugggagaugcccugaucagccuuuguaaguccuggcugugcccuucuucugcagcacgagacauucagaagugggaguaugucccucucgggccauuccuugggaagaguuuugggaccacugucucuccguggguggugcccauggaugcucucaugcccuuugcugugcccaacccgaagcagguaagcacauucucugcaggaagcucccaaacccagcccugcugccucugaggcugcuugcccacugaguggacaugccaggcaugcagaccaucaggagggaagcucugugcccacggcaugcccacagcagagugccugggaguuccuggccacgauuacuuccaggcagccagggcaucauucucccuugugguuucccuggcccuggcacaguucuuggagaaaacacagaauuuuguaaccuuaagaaucuugcaagacccgggggaucuggccaguuggcaggaggagucccugcagguaccaacauugcacaaccucccagguggccaucaaaucuuguucugugcaaauggcgccaccuggaccccaacucauagaaugcagcuuggagcccagcaacagggagucccugcagccucugguucccggcaccgcuuggucuaccacugggucuaggccuugaccccugguuccaguccucccuucucagccuguugcaaucugccccacuccaucacuggcaacaccuggccagagucaccugugacccgauagucagugucaugaccuuguguccccuucagcauggacuuccuguggccccucacucuuguuggcauucccucaccccuugguuucuggcaugugaccuguccucguucuccagugucucugaguccucacgaugccccucuccaauucugaccucccuguggggauccaggcugagcucccagccauuugcacauccucgcuugagcaucucaccacgcauuugcugggggccucuaccaacacccggugcugguccugcacccacacugcucucccaugcuccucugccucuggggucaucucauguuugcugugcuacaaacaacccugaggucuuuccuugcaagccaguucuagugaaguccuguggggcuuucacccucaucccuugcucucuccucgcugcucccuaccacagcacccccugcccacccuggucauuuucagucgccaggacuugacuuucucucuagcuggcagcggccuugucuagucucccuagggcugcaaggccacagccucucuuugcuuguccuccagucaucugccuucuuccgggucggucaucacaggguuuugccugccuuccucugugccagcccuuccccaacaccauuuagguacaacacuacuauucccccucugaacuauuauuuacuuaauguuuuccuucagaguggcucccaguuuaaacuuaauauauuaagaagggaacuuuauauuccuacuggcaucacuagcuacacuguuucauaaccauuaguaucaccaaaaacgaucucaugucccgugggugacucauguaccaugcuuuggaaaacacugcuuuuggccggagugcaggcguucuggcccagccauccaagcugccucccuagcuggcuccagcaccagccagggcugucuacuucuguugugaccccucugccuuccaggggcccugcaaugcgcuuucaggcccagccuuuccucacaggccaggcuuuguucuccaucucggccugucugcugcccaccuucccuuucucuccccuccuguggcuuucaggaacaucucugguuuggcuccugugaccuuugaccugcugaugccccuuccuuggcugcauuuccuagagacccacaguaugauccccccuacugcuauccagggacacagugcugggucccuggagagggaaugcuccugcugucucagacccucugccuaggggagcaggugcugcugggggccuggcugguaugggggcccagccgggugagcucagcccaccugccagugaccucugugcugugcuuugcccucucaggaccccaggccccugccguaucugugccaugacgagcccuacacauuugacaucaaccucucuguuaaccugaaagguauguuguagggggacugacauggccaggagcucugaggcaaugugugccugugugccuuguccugaaggcuccugagcuuuggcaagggugagggcacgugcuacagcccuggagauguguguggcucgucuaaaggaaagaggaggggaggggaggggacacccuggugcucacugggaaccuaacugggcccauagggcauuaacccugucacugagcucucagugguagggcugaaaggauggaguccgggacuuccaucuucugcuugaauccccuccccagccucuccaggggcugccuggcuccugcucacauaucgccacugacccucacuuccgugguggguggcacauuucauugagugccuguuugaaagcauguccuugugggucuguucgcuuggcugagccccuggggccacacagagccagcgcaucaagaccccagauucccaccaugggccagcccugagugucuugcagacagacccgagauccccacccugggccagcccugacauagacagggcccacaucucccuguggcugcucagcccgccuccgcgaacaggcccaauggggcguugguaauaaagagacuggcucugcaggccaugacucugcugcucagcugugggacuuugggcaaguugccaaaccuggccauguccucauuugucaucuaugaaaugggauaauagcggcguugaccucaugguguguugugaggaccaaacaugucaauucaugcaaaggucugggacagggucuguaccuagaaagagucaggugucauuuuccaaucccaacgggggcccucggauggggaggguuugccugguggccacacacagaccuccuagccacacucuggccaaaucuccuuuuuagcuccauuccauuccuuuuucuuuucuuuucuucuuuuuuuuucccccgagauggaguuucacucuucuugcccaggcuggagugcaauggugcgaucuuggcucaccacaaccucugccccuggguucaagcgagucuucugccucagccuccuguguagcugggauuacaggcaugcgccaccaugccuggcuaauuuuguauuuuuaguagagaugggguuucuucauguuggucaggauggucuugaacuccuaaccuuagguggucuacccaccuaggccuuccaaagugcugggauuacaggcgugagccaccaugcccggccagcuccauuucuuucuucugucugcucugucuguacacuccaggcuuugccaugucugucucacugucaguuccagggucucggcccuucaugaggugguuccugucaggaggcgcaguacacugcaggagcugucgccaugggagcaggaugcuccauggagaaagagcugucacagagagccuccuggcugcccagggcccucugggaagcugugcugggcccgcucuuucagguuccaggucaggaagcugaggcucagagaggaaaaggauucaccccgagccaccuaccuggcuaauggcagggcugggacucaauccaagugugucacaaguucuagguuggccuccugccacccacaaugcgugcuuggaguauacuuucuaucugguuuuguccucaguauuccuggcugccuagaggugaaccugcccgcccgggggaggccacugguagaaaagggacaagauuauccagaaagcacaguguccagagauguaguccugcauuugcaguucugauguucugaguugggaucugggcgaaagggucuggggaggagcagccuuggcagacccagaccucgcauggcugaagagcacaccuguucugugccaccucagaggggaaguuaggaccaagggaggaagccagguuuugagggagcagaggagcuuucuacuuauuagugcuguucagaaguggaacggcaacagcccgguaccuugcauguaguagauguuuaguaaauauuguuuaguacguugugaaguagcacacugcccaucacuggaggagcucggcaggggacagaugacccagcuauccagaggacuccugaggggacagcagguuauccuugaucaaaggucacaaguagcuuucaaauggcacacuaucuuuaguggauuugcgggugccaggaucacuguguuaagaaggauucugaggcuacauauggacucagagcaaacaugugcugugaucaauuaaugcugccugcuguaggcgugggaggaggaagugaugacuugugugcauguauuggccaacccuggaccucccagcucugauguccuaggagcuaauuguuucacagacucuaagugaaaucauguuggacaaugggaagcuucagccacagaacaauucuuuuuuuauuuuccucccugaugcauggaauuaaguuuucaucaauauugcuuuucuuuccaacaggagaaggaaugagccaggcggcuaccauaugcaaguccaauuuuaagguaagcuuugacgcugaucagacugcuuuuuagaauugagggaaagagagacuuuucuuccuggcaggaacaggaggagagcauuccuuuugggauaugaugaugggucagccugugggccuggagcuuccauggccugucucuuuuaggaguggccauggggucacagaguucucucgagauagaggcugcauaaauguggccagugauuuucuugggggaaaauagguguuccuguaaaggucuaguuccugguuuauccuguccugccaggggcuguauugaugagagugacuuauuuuuuaagugaacuuuuaauugaagcauaauauacauagauaaaaaugcacacauuacuguaaucccagcacuuugggaggccaaagugggaggaucgcuuaagccuaggaguuugagaccagccugggcaacauaaugagaccuugucucugcaaaaaguaaaaaaauuagccgggcgugguagcaugcaccuguggucccggcuacuugggaggcuaaggcaggaggaucgcuugagcccaggaggucgaggcugcagugagccaugaucacaccacugcauuccagcaugcgugacagagcaagacccuauuucaaaaaauaaaaauuaaaaaaagugcauauuauacauguacagcuugaagaauuuuccuaaaaugaacaucccugugcaaccagcacccagaucagaaauggaaaauuuccagcaccucagcagccccguggggcccuccaggucacuucaucacucccuccagcaaaggucacuccucuccugaccucugcuaccauguauuauuuuuuuucuguuuuucaguuuuauagaaauggcaucauaaaguagcauguauucuuuuguagcuggcaucuuuguuuuaguguuagaucugugagauucaacccuguugcucuuugcagugacagcucauuuuucucauugccuuauaguguugcacuguauaaauauuccacaacugacuuaauuuuuuuuuuuuuuugagauggagucucgcucguugcccaggcuggagugcaguggcgcgaucucggcucacugcaaacuccgccuccuggguucaugccauucuccugccucagccucccggguagcugggacuacaggugcccgccaccacgcccggcuaauuuuuuuuuuuguauuuuuaguggagaugggguuucaccauguuagccaggauggucucgaucuccugaccuugugauccgcccgccucagccucccaaagugcugggauuacaggcaugagccacugcgcccggccaacugacuuauuuuguaagucacaucaauuccacaaucgauggacauuugguuguuuccguuguuuuuggcuaucacagaguuacugugaacauuuuaguacacaccuuuuggugcacauaugugcacauuucuauugaguguauauccaguaauaggcuugcugggucauagaguacacauagacucagccuagggguacuuccaaacaguuuuuugaagugguuauaccaguauauacucccacuagcagcauguaagcauuuugccugcuccacauccucgucagcucuggugguguuugccuuuucguucaaaccgugccugggauugugacuucaguuugcauuucccuaaugacuaaugcagcugggcauguuagucauauguuuaugguucauuuguuucuuggccuuuugaauauccucugaaucauugaacuauuucuaguuucccuaauuucccuucuaauuuaauauuauucugggcuccuuagggcuaguaagaagaaauuaaggggccuccuugcaggggcucgugggcaagaauccaucuuuuggguuuccuaugccgggauguguggcuguaggaauggcaaugugagaagcuguggccugggacaggcaugggcgugcauugcaucugagcgucucggugggcacguggugccuuggcccccucugcccacagccugaccgcccacagcucucccucgcuccuuggccugcccugacaucguguuugaaucguucagcuccauugcccaguguccaucccaaggcccggcaugggagaaugggagcgagggcuuugcucacgagaagccucugcugugguguggacuuagauucucccaauacgggacuggaggguguucccagggcagaguggaguguuguacacaagggcauguugcaggcugagggacugagcaguaaggucagcccuuaggggaugcugcuuggagaagguggucagugugggcuugagguagcagaggagcugagguuggaguuugugaaggagauggaagagcuugggggaggucucugggcagcuccccaggaggacaauguguccuuacuauaagggacuggagagagcuggcugggggagcuggggaccggggaaaggccagggaaggcggucgugagcagggcaggcugugcccagcugccuccgggaugcuaggcuaagccugccgcugcucauuccaccucgcguccauugccugcaguacauguacuggacgaugcugcagcagcucacucaccacucugucaacggcugcaaccugcggccgggggaccuccuggcuucugggaccaucagcgggccggugaguaucuggcugcacugagggcugcccacgcagagcaucccugcuccccacacagccccaagggcccucagcucagccucgagaagagauuucaggcccgagguggguguaucucacaacucugucuuccucguagccuuucucucugggugcaggagggacuucucauccaaauucaaaccuaaagagacuggugugagaacggaagccugggucucugccucuguaggggagcagcgcagugacacguggggaggagucaggagacagugauagugucuugguugucaccaucucacacuacacccucccaggaugagguggccaugcugcugugccccuucccacccgcuugucccccuguaagccugcgggagucacagaaccuucagagaugaugaccuugggguggugcaugugucacucacuuccugcagggggcuggccgagcccucuuguuccuugagcugucgacaggaggguguuaagcaucacgauaucugggcaaacugcagccuccagagcagggaggggaugcugcagggggcacugggcacucuggucagggauucacugauuccuaaacaagcgauguccuuaguggaaccauugcuguccccacaggaagaaggggcagaguuccaugucucaaaggcaucucugcagugaucccaccaaggccgaggcagggucucugaggggcaugagggcccccugccacuucucgggacucccaggucuugcugagcaugguccaugccagagccaaggcauaaauucauguuauucuuucuucccuuuccugugaugaaggagccagaaaacuucggcuccauguuggaacugucguggaagggaacgaagcccauagaccuggggaauggucagaccaggaaguuucugcuggacggggaugaagucaucauaacaggugagggcugccaaacccagcagcucgucuuccuccuugcccgccaugcacuguucuagcugcggggcgcuccuaccuggccaugaagccaucuguucucacgcauccugacucugccucccagagucucugccugcuuguucuguccuuccccacagcuauggcuacccgggacuucaagugugagucucccuaggccagaaagacuguagacauucugcuuggucucccuucucccugagcauaguuauaaaauacuggcagguuccucaaggucuagacuuugcagcaaacgcccugugcagacacuuggugaccuaugacuaggaucaaggaagguucagcugaguuagugacugaggcuucgcagcagccuguuccaaggaggugagggugccucuuaauucuucugggggugccauucugccuaccacauuuuacuaauagagggaaagggcaccauaaugguuagcagcacacucuuuagagcuggaaagguucaaguugaacucccaggucccccaccagcugugugaccuucauuaaguuauuuagccuuucugagacucaguuuaccucaucuuuaauuauuuuuuuuguuuuugagucggagucuugcucucucauccaaucuggagugcaguggcacaaucucagcucacugcaaccuccaucucccagguucaagcgauucuccugugccuuagccucccgaguagcugggauuacaggcgcgcuaauuguguaugugucaguuuccgugcuuaacuaaaagcuuguguuaguuuccuguggcugcaguaacauaguaccgcaaacuuuguggcuuaaaacaacugaaauguauucucucacagcucuauaagguacaaguucaaaauccucguguuggcagugccauguuccuggaaacucuggggagcgucugucccuggccucuuccagcuucugguggaagccucuuugucuuguggccacaucacacugaucucugccuccacggucacauugucgccucgucuucugucucaucuccuuuaccucucucuuauaacacacaugugauagcauuuagagcccaccuagacaaucuccucauucuaagaucccaacuuaaucacaucuccagaaaauuuacuauauaagguaacauucacagguccuagggauuuggccguaauuuaguccacuccagagcucuuggagagcaaaguuuaguccaaguagcagccacauagugcaugcccaguguggcuguugguuaguucuuugaauaaaguggauuugguagagaagaugcaggcagagcucaaaacagcagaugauacccauuauuaaucaauaaauacccauuuugcucccauuucugcagccuaauuauaccucucuaauuugaauuugacuauuuacugaacaucugcuaggagccaaccauauugcaggcauguccaccuuccuuauuucauuuucuacucacaauagcccuuugaugauauaauaucauugcccccauuuugcagagucgaaaacuuaggcugauagaaggcagguuacuugacaaaagucccacaacuggggaagccagucugcaacugaggucuucugauuccccugccaaguuuguuucuagucuuucugcaaugcuugccagaccuaccgcaggccuuuggucacgguucuguggauugagugaaagcauuuucugaaguuuugauuuggggaaaggaaggaaagagaugguggcagaagagaaaaugauggcuuuaacucucuguugucagugugauaagggccccugacuaagccaugcuagaccaggcagcuguccagggccugggagaaaggaggcugguaucuagcaguuggaaugcacauguguucuugacauuugagccagagaaggaaggagaaaggagccaagaugccaugagagucauuuccauguuuguuuguguauacaacgccuuacuccggaaggauuuuuggaggccagcagaggaauucagggaaaggcaguuccuuggaucugaagaagcacauguuggcaagugaagagggaaaugggaacagaugggcaaaauccccuggaaccaagaaagaagaauuauaauuugcuaagaggagaggcauacauuauguguucauaaaaagaaaaaagagaauuucauacagaaggggaccacugaaaaacucaaaagaaugcauauugcuagaauuugggcuaagcaggggguaagcagaggagcgggcagguggagguggugugucagcuguguuaccuugugcaaagguuccccgcauuggcggacggcucugcccucaccuucuacgacuucacuggucacguggcccugcugagcugcuuucuugcuugaaagccacacaugguuucuucagcucuucccggcuuuccuccuccuucucugcaccugcucagaugccuuuauggcugccucucauuucccugcuugcucuucacggaugcuccuuccccaaaucaauuucuaaccauuggaaacgcgauagaacauucagaagugcuggcaucagccaacgccgcagcacuuacugcaggccagacacugugccaagugcuuuaccugcaauacauuuucuauuccaaacaaggcagcuacucuuacugucucuauuuuucagauguggaaacugaggcccagaaagaugcauacuuacccaggaucacacaggcgauaaaggguagagccaggguuugaacacaggcaguugggcuccaggagcugugcucugaacccuuguguccuguugccucuuuaaauggcgcgaugaaauucucauuucugagagaguccaaaaaccacaaaauguucagcaagagaacaggugaaguaaacaaaccaaaaauaucaacaaaaaucucugaucgucuugguuuaacucauccauccccuagucucgcucacaaaccccaucugguguugagcuugcaacuugcaaggauguguucucgcaggcauuugcacggauggcucugcacugcuggacacaugcauuucucacucuccuucagaucuuugauuuguugauaguuaugauuuguuguggauucuuucuugguaucugacauuauuuggaaacaauaucugagcaaaagucuuucguuucuugcccugcgucucucagugguggcgucuuucaccugguguuccugugucucuguuuauuccaguuucucuccccagcauuauugcuugccuugccuggcacagaauuccugcgcaaggcugaccaggggucccaggguguagaagcagugacccuucuccuucaggaccaugguugggagagacucuuuaaaaaugcugcaguuccgaguuaguuguuuugauagauguuuaauaaauuucugcugggagccaguuuuacuuuaauaggcuuuuuuuuucaccccagugguguggauauuucugagcauugagguggaaaagagacugacagaaaauaaugaaaaugagcaacagaauaggugaggucguugcucucgacaaagggcaucccugcauguugucagcaugugggucacggggcuucuuagggccccccaaaggacagccucacugaacagaugugacaaaugcaucucgugccugagugucugagccuuugcacguguucuucccucugucuggaauggcauuuucaugugucuucccuaaugaacuccuagcuacccgucaaggcccagcuaagauauccccccuuccugcucccuuucccuccaugcugcucgcucagcaccuuguaagcauuucucuguaucucucgucuggaccucccacucccucuaaguggaccccucucaagggcagagaugggcuucucucugcuuuuccaucauccuuguugaaauggaauuaaaugaaggaaacuaauauuuauuaguuucugagaugugcugggaauuucacugaaauauuuagucuaauccuuacaaccuugagagauaagcguuguuuuucuuguuugcagaugagggaggugaguucugaagucaaacagcuuguucccagccacccagcucauaaugguuguaaugacugacacuuacagggaauuucaaauagggacuggaggcuguucucagaguuuucuaugcauuugcucccaucauccuugcagcaguccugugcggugggcacuaucauaagauccauugcacagaugaagaaacugaggucuagagggacccaagguuacagagccaauaaguagaggagccaggcuuugaccucaggcauucuggcuucaggcuaauuggcagagcgaggauuugaacccaaacccauguggggagaguugaccacuguauuagucuguuuucacacugcugauaaagacauuccugagacuggguaauucauaaagaaagagagguuuaauggacucacaguuccacauggcuggggaggccucacaaucauaguggaaggcaaaaggcaugucuuacaugguggcaggcaagagagaaugagagccaagugaaaggagaaaccgcuuauaaaaacaucagaucucaugagacuucuucacuaccaugagaacaguauggaggaaaccgcuccaugauucaauuaucucccacuguguaccucccacaacacaugggaauuaugggagcuauaauucaaaaugagguuuggcgggggacagagccaaaccauauuagccacaggaaagcuguugagccuugcagugccucugaggaucccuggcuguggggugggcccggguucuaguccaagggcuccugcgugcaacucugcccagcuuccguggaggguuauucuuguguuuaagauaugugugugugauucugauggcaccuuccugccucgggccagcugugugcugacgggcacugccgcugccuagguguugguuccggugagcccagcaacuuugugacugauccuuguccuccucuguuccaggguacugccagggggaugguuaccgcaucggcuuuggccagugugcuggaaaagugcugccugcucuccugccaucaugagauuuucucugcucuucuggaaacaaagggcucaagcaccccuuucaacccugugacugggguccucccucgggcuguaggccugguccgccauucagugacaaauaaagccauugugcucugaggccugcacugccgcagaugcagcuguguccacuuaugaucgugauuugauccagugggucaagguguguaaagccucccugccagauauucauuaauauguuuucucacucuuauuagugaggucaggggucuuugugggauuuucuuauuagacaucccaggccuccugguauuccauggaauuugaaaagagacuggcaccuguaguagucagggcucuccagagaaauagaaccaaggagaaaga

SEQ ID NO: 61607 - RNA, 15827 nt, Homo sapiens
uuuccgcaguuaggggcugcuauuucaacgcagggagauaaaaagaaaaaaacacuugcucuucuaccccgcuaaaaacacucauccuagggagcacgccagcauuugcagcguucggggcagggccacucggccugcggccguugcacuggcuggaagcuggcaggcgaucacgguugauuggcucgggugcgguccaagggcagcaacgccuucggcgggccgccuagggugauuggcugcugcagcccacccccuagccgguuuggugggcggcgaagccuggauugguggagcuaagagcuggcucaguuucagcgcuggcucuucgugcauggcagagauggcgacugcgacucggcugcugggguggcguguggcgagcuggaggcugcggccgccgcuugccggcuucguuucccagcgggcccacucgcuuuugcccguggacgaugcaaucaaugggcuaagcgaggagcagaggcaggugaggagacugacccccuuccuggccccaaggccuccuuccugccugguccccaaggccuccuuccugccugguccccaucggcccagcgcccacccagccuuggcuuuugcccgugggccguugggagcgccagcgcgggggcgggacgcggggccuccgaccucggguccaguccucugaccucggccucacgucuguggagugaagauuugagaccgugggacaguacugcuggaaguagagaggaggagucgaggcugggagagcuccugagagacugaugguguuuugguggaggauuggccaggcuaccuaccgcuuguggcacaagggcccucaaucuguauguaguucacuuacaccugaacaggcugagguaugcuucucacaccuggguggucaucguaaucaccagggagucuuuuuuguauaaacaguuuggggguuuuaaaaagccacagugagcucuccugucgcucuucagcccauugggucaaaacacaaaaguugaacaaguacuugaaagaaguaguuggaggccaggcgccguggcucacaccuguaauccuagcacuuugggaggccgaggugggaggauuguuugagcucagggguuugagaucagccuaagcaacauagccagacccccaucucauaaaaaauagaaaagaagacgaaguaguauuuacaaauggagcagaaccagaguccuuccugagguuucacuuggaggcuggauggaguuggcggagguaugagccucccagcaacuccguaguuuauguuuauagccagcgagcgcucagagcuuccgugaaccaccucaaguggaaaggguucaaucccuauucucaagcuuuccuggcaagaggaguuucuuuucuuuuuucuuuuuuuuuuuuuuuugagacggaguuucacucuuguugcccaggcuggaguguaauggcgcgaucuccgcucaccacaacguccgccucccggguucaagugauucuccugccucagccucccagguagcugggauuacaggcaugcaccaccacgcccggcuaauuuuguguuuuuaguagagacggaguuucuccauguuggucaggcuggucucaaacucccaaccucaggugauccuccugccucggccucccaaagugcugggauuacaggcaugagccaccaugcccagccgccaagaggcguuucuaaucucuuuggguaaucagacccuuuuagccaaagguucgggggcuuaaaagagccugacaacuauugagaucuggcagcugccuggaaugcagcuggagcacagagggugggaggugggaaggugcuggggaagcuaggagagucagcuggggucagcuccugcagggccuaguaggccugggugagaagcuuguguuuuauucuaaguacaguggaaaccaauggaaugauuuuuauguaaagugugacguuuuaaaaauuaccaucaagcugucuaggcugaagaccuuaagaaagaggggugaagaucaucucugaggaggcauaaacuacugaggccucucaguuucagucugaugcuguuuggggaaguuacuuguggccuuuucucuugaaugugucuggguaguggagaugcugucugcaguggcaucuguuuaccucucuccuauuagcuucgucagaccauggcuaaguuccuucaggagcaccuggcccccaaggcccaggagaucgaucgcagcaaugaguucaagaaccugcgagugaguugggagguccgggcagucgggggcagucagggaguggggcugagcugcacugcugccuggaagagcucacacaguucugguaaaugaagccucucuaagaaugcagccccucucucugaaguguuugggucucauuguuccagccacaugugacuggcugccuuccccucaacacuuauuccacucugcuccauucuguuggcaggaauuuuggaagcagcuggggaaccugggcguauugggcaucacagccccuggugaguauagugucuuucccuaaaaagaacuuuucuuaugugcccuuuaagacaguucccaaaagaagcaggaagggaagggaaagauugugcuuaaagaaacccagaacugcaucuuuuggaccugugaaagcacccauugauugucagcccagagaacaggacacucuucuauuuuauuagacagugauguagagaaggcagagggauuaauuaggucauuguggcucacuuggaucaggaucaguccaacucuugaacucugcauacuuaauaggcucacccaggugauuugggaaguuuagaaaacucuggaucaagugguugucuucauaguaccucagucuuacugccuccccuaaucccuauaagcuuuguccuaccaguggccucucggcaggaacacucugggcaggugugucccugcagggacugccuguguccucuucugcuuaaaccuuggagcucauuugggagcagauagcggggggaguaggguaggggcugggcaggggagagagaugucuaucugggcuuccaggugagguggccagaugauguguuuaauaggcuguccggagggagaaggcagggagcuagcaggcucugguuuggaugauauuaacgucugaaagaggcccagacuggcuugcagugcccgguaaagagaugagccuaggccaggcgugguugcucacaccuguaaucccagcacuuugggaggccgaggcagguggaucaccugcggucgugaguucgagaccagccugaccaacauggagaaacucugucucuacuaaaaauacaaaauuagcuggucauggugguacaucccuguaaucccagcuacucgggaggcugaggcaggagaauugcuugaaccugggaggcggagguugcagugagcugagauugugccacugcacuccagccugggcaacggagcgaaacuccguuucaaaaaaaaaagcccagccugcuugggccuguauucacucugggcaugagaguaugaguggaacccaauauacuucuccuuacauccuagaaaguuauaucaccuuucauaaaaugaaaccacuugaagauuaauugaaaccaucuuaauguaaaagcauuaggggaaaggcugcuggguacuccuaagcaagacucuccuacuguguuuuggggguuuauguaccccacucccugcagacaauaugcuucugaaucagauuguauuuuacggaagaaagaggcaguuagaaaucagaugaaaauggccaggugugguagugggcuccuauaauccgagugacucgggaggccaaggcaggaggaucgcuugagcccaggaguucaaggcugcaaugagccaugguuacaccauugcaccccagccuggauaagagagugagagcccgccucuugaaaaaaaaaaagaaaagaaaucagaugaaaacucuuucaagggaaccugaaaaagaaagcugguuacaaguucugguuucugcaugaugucaugguggcuguuucuaaugucaccugccuucaggcuuuccuuccugcaguuguaggggcaggucaagguuuccuuagagccuagaacgagccugacuuauuggucagagugaacauguguauaggaccuugcuaggcuugacccaaucagcagggcugggggugguaucaggugucucagccacuuggaguuuggaucugcugccaaggaaaaaccguauauuuuaugaggaguucugaaauucucugccagcaucucaucugcccucugcuguacagcucaccucaagauuuucccugaggcuguggcucuccuguccugucaccaguccugcuucuuucuuuuuuuuuuuuuuuuuuugagacagaaucucacucugucgcccaggcuggagugcaguggcgcgaucucggcucucugcaagcuccaccugccagguucacaccauucuccugcuucagccucccgaguagcugggacuacaggcgcccgccaccaugcccggcuaauuuuuuguauuuuuaguagagacgggguuucaccguguuagccaggauggucuugaucuccugaccucgugaucugcccaccucagccucccaaagugcugggauuacaggcgugagccccaugccuggccuccaguccugcuucuuuggguucagcccuaugcuauaaaaucucaccuuccucaggccuuuugcagacacaucagauccucuggcuuuguaucuguucuuggugcuuuggacaccaccuccaccccaaugccuuuguuuuucuccaggcccucuuucuucauuuauucaucugccucugcauuucuguaacuuucugaguagugggugcucagguuguucacguaucuucaucaagaagucugucugggauaaagcagaaguugcaaugauugccuucugaaucaccccucagcugaggagcaccagcaggcaaaaccaguccacugagcuuguaagcaggucuguggcaucagcuuauucuuguugcuagagagaauuuggaguaggugcuacaaggugcuucccuucugccgucaaauguaagauucuuaaugaaugucccgauuuaaucugggcugcguuuuccacucccuuguaccacaccacucacaguucaguauggcggcuccggccugggcuaccuggagcaugugcuggugauggaggagauaucccgagcuuccggagcaguggggcucaguuacggugcccacuccaaccucugcaucaaccagcuuguacgcaaugggaaugaggcccagaaagagaaguaucucccgaaggugaggaaauggaaauguaauacacgcuaaucucacagugcaaccaccaacuaaaagauacccucuccccuugggggccagucagaccugcuuucuguagcaugcugccaugaaccaaaugugguuaggaaggggccauggauugcuuuaaaauacuugagccaaaaauaauaaaaauaggaccagaacucuugcauugaacaacagacagacaacauuugaagagaacucuaagaaauggaagaguaggacuagcuuccuuugcaaagggaauggaaaaaggagaggcauuuucagccuuguagccauugggcuuagaagagacuucuaggacuuuaccgacacccuggucugagagcgaaguuugaagggguuuaauguggacaggaagaggcaguaccagugagcugcucuaggguacucugagguuguaacaaggccuguuggggguuuuccuugcagcugaucaguggugaguacaucggagcccuggccaugagugagcccaaugcaggcucugauguugucucuaugaagcucaaagcggaaaagaaaggugaggccacucucaacuugggagccaaaaugggcagagguacagacauuaucaggauaauggagcaacaauuguggguggccccugcuggguuuccagaacuuucucaaagguggacagcuucuugcucagcagaaggucuauggccuggcugagacaggccaagauggcuugagcaaauagccaacauccugcccuuaggaaaucacuacauccugaauggcaacaaguucuggaucacuaauggcccugaugcugacguccugauugucuaugccaagacagaucuggcugcugugccagcuucucggggcaucacagccuucauuguggagaaggugaguauaggugggugcagggccaggaggcuucugccuccugacagugguaccagagauagcccguucacugaucucaaauggaaucaguguugugugcucugcaaggcccccagaggugggggugaggcagagagcagacugcaaggagggugaccaaaaguccaggaaguccagggcagaugggucacuucugaagacgguggagccguccucagcgccaggccacacaaagaggucuagaaaggggaggacuaaaaggaggucaggacaugacggucaggguaccauugguggaucugaugaauguggccaugggagacugaggugugggugggaugcaaguggagacugccccugcaacagccuugacaacagaagcaagaaggaagcagagcaggaguuccaaugaaaaguuaggaguuuggguuuguuuuuagaaaugagagaacugagcagauuuuuuggucagaaggaaaaaaaagggaagaaaaaagaaaauagagggagaaauugaaaagugugggaaugagugggcagaacacaauggugagcuggggcagaagagagaaggauggguuacaggugauggugcaggaaccacuugccuaacgaucaugaggaggaagccaggggcccugugaaggcuggggccacgagugggggaguuggcaagaguuucaugagcgaguauuguaaagguuugcgguacccuccauagagagggggaaaguagcugucuaggguuggagcaguagggaccuggcugagauuggaaaucucaagguugcgugaugccacccucauuacaggcugaaggcagcaugugccagcacuuugcuggucacuugccaaaacaugcugcaacccaguaguccaggucaaaguacagagggcucaguucagcccuagugggaucccuuuggguacagacaggagaacaacagaggauaagggaauugaccgggcuggugacagugucuuggaaguaauguccccugggggagggaaauaaggccaggggggucgggagggcucagggaacugagcauaucauugagaaagaaguguccccaugagaacuggggagaacacaagcuaguggcagaggaggcugggaucaaucuggggcguuagcaccggaaggucccggggggagcaugggacuaggaugcugccaugcugugcagguacagggacucaauaggaaggugagugccuucuucccagaggccuuuccuuuaccaggcccccuuggggcuaaucuguaaccaggaccaccuuuuguuuccuguaaaggguaugccuggcuuuagcaccucuaagaagcuggacaagcuggggaugaggggcucuaacaccugugagcuaaucuuugaagacugcaagauuccugguaaguagcaccgggaaucggggagccccucuccugacccccuuccaggcugaucuggcuguucucaaguugagaaagccucuggguuagagaggcuuggcauuguuagcgcuucagugacauguggcuaggcugugagcuggggcugcuggacagcgcuccuuccuggccagggcccugcagcggcaugccuaacuggcaucacacacuccgcauagggucuguacucaguagccggaggagaagggucagaccuacccuuucccauugauguccuucagucuuccuguacuuucgcccauccacugcaugugaguaacucauuaacucacguuuuuguaaaauauuuuaaaaaugaguuauucauuuuuagcauuaaugaugcuaagaaaaaaaaacaaaacaucugaauccacugauggaaucccgacucaguagagagaaggcaguucugcuugaguaugaguauuuucuccccugagguguaacugaaaucugacaugguggagcacugugggagagccagcacagccaucauguacuaaccagaccaggggcauggauuuguuguuugggguuuuuuuuuguuuuuuuuguuuguuuguuuguuuguuuguuuugagaaggagucuuggcucugucacccaggcuagagugcaguggcgugaucucagcucacggcagccuccaccuccuggguuccagugauucuccugccucagccucccgaguagcugggauuacaggcaugcgccacccugcccagcuaaauuuuuuguuuguuuuuuugagauggagugucgcucuuguugcccagggcuggagugcaauggcgcgaucuuggcuuacugcaaccuccgcccccuggguucaagugauucuccugucucagccuucugaguagcugggaugacaggcacacaccgcccagcuaauuuuguauuuuuaguagagacagaugggguuucaccauguuggccaggcugcucucgaacuccugaccucaggugauccaccugucucagccucccaaagugccaggauuauaggccugagccaccuugccuggccaggggcauggauuugaucaacaguuagguuugcugucugccucagccauauaccacgccuaucacugacagcccaaaaaaguguacuuuaauuacagggagcauccagggagggggagcugugcagcuccuucuuuguugacaggaaaaaauucagcuagcauuaaaggcaggucaguagugucaaccuguuuuccugcccacaccucccaaggccauccagucuccuggcuuuacuggguggagaggugcucagcagcuucugucacuagcucugaauggccugucuccuggacaaagaagcuuucacggacuacucugcagggaggugacauuggaccagagcugacuccaccugggggaaagaguaauucucugguuucuuuauaggugccuguguagaaagagucagggagggauugggugacuucuagaccaauuaacuuuucuucuuucccauccaagggaguccagagagggaagggaaagaucuaacaacucuagccuuugugguuggccucguggauggggugggaguccuggcagcuccacuucugacuggaagggguucacuugauccuuuucuuucaccuggaaccuuaguugaauaaaggucaagugacauauuuuagugccuuacuugagagccauguuuccaaaucuaguaccuuugauaaaagugaggaggcuguggacagcucucucccucugaccagcacuuauccuggcagcugccaacauccugggccaugagaauaagggugucuacgugcugaugagugggcuggaccuggagcggcuggugcuggccggggggccucuuggguaagugugagaggcuugagggaagcugggcucugucggccuccucggcaggugacccaccaugagcagcagcagccuuccccuugcggggccaaagggagcugccucuuggcccugcucucuccugggagaugaaaggaaccuccucuucccauguugaauuucuucccacaguggggaaauaucauuaaguaacagacaaaaggccugaggagcaggguggcuuacucggcugugaaacgacaccugggcugucacgccccugcaccucuggccagucagugccguaacuguggcaagacuuucugaaguugcuuuucuccucccugggauucuggccuucccacgcuagcauuuugccaccacacccgguggugggaugaggaggugcccacggggccuuucuccuuucugacaggcucaugcaagcgguccuggaccacaccauucccuaccugcacgugagggaagccuuuggccagaagaucggccacuuccaggugagccgagugcuuuugcugacauguacucuucaacugggcuaaaguuuucuuugaaaagagaggaagugaggugggcaccguggaugguuacugucuccucuagcaaauugagcuugacugcuuggaaugcagucuuccucagcaugcagccugacucuggaagucaucaggaaguucaccacauugccaccucgauuccugugugagguggaugaacuagacauuguaagguuggagagcaaagcgugcaaguugugggggcagaagggaaagagguugcuauuuguaguuagaccuucugguccgaagaagcugcuggaagguaauaagcauuggaguaaauggugccuugggagccaugccuuucggaggcagugauggccacuucggggugucaugcgggcuguggaacagccacucuguggcccuaacucccacaccugcccccaucuccaucauccugaguaaaucccaucuccucuccaugccccugcuuccucauccuuggcugucuuguugccauugcugaccugcuuuugguaacugagagaguguuccagcauguugaccugugacaucccuuugugcccaguugaugcaggggaagauggcugacauguacacccgccucauggcgugucggcaguaugucuacaaugucgccaaggccugcgaugagggccauugcacugcuaaggugagggccagccucagucggggagaggcgggggcaguggaccagcugcugagacuugcugucugcgugccucgcagggcccugcugaccccagcuuccucccguaggacugugcaggugugauucuuuacucagcugagugugccacacagguagcccuggacggcauucaguguuuuggugagugauccccacuucccagucccggggcucccucacuccuggggccuguggcugcuucagaaagcaguuucagggcgggcgugguggcucacaccuauaaucccagcacuuugggaggccgagguaggcagaucaccugaggucaggaguucaagaccagccuggccaacauggugaaaccgcaugccgggcaugauggugcaugccuguaaucccagcuacuugggaggcugaggcaggagaaucgcuugaacccgggaggcagagguugcagugaacaaagauugcaccauugcacuccagccuaggugacagagcgagaggcugucucaaaaaaaagcaauuuccucuccacuucuccacuccucacuaugugcuuaugcuaggcccagcugagcugggaccuucgggcucuuucugucccaguuacaaggaggaaauggaaagcaaaugagaaaacugcuagaugccaggaguugcugcugccuucggcaacaccccccucucauccuccccgccucauagaugcuaggaaaugggaaagggagauguggcugggcacaguggcucacaccuguaauuccaacacuuuaggagacugaggccagugaaucaccugagaucaggaguuugagaccagccuggccaacauggugaaacccuguuucuacuaaaaauacaaaaaaaaauuagccaagugugguggcaggagccuguaaucccagcuauuuggaaggcugaggcuggagaaucucuugaacccaggaggcggagguugcagugaccggagaucgcgccauugcacuccagccugagugacaagagugaaacuccgucucggaaaaaaaaaaaaaaaaaaaggccgggcacgguggcucacaccuguaaucccagcacuuugggaggccgaggcagguggaucaccugaggucaggaguucgagaccagccugaccaacguggugaaaccccaucucuacuaaaaauacaaaaauuagcugggugcaguggugcgcgccuguaaucccagcuacucaggaggcugaggcaggagaaucacuugaaccuuggaugcggagguugcagagagccaauaucaugccacugcacuccagccuaggccacagagcaugacuccaaaaaaaaaaaaaaaaaagcuaaauggaaauuucuagaaauaguucauaaguuucaaauccacaccauccugaauagcuugaaguguugugccaugcugcucugucauguuugguacgugaaucgucccuuugugcagccuaucuaugcuaugugggcuaccugcccguuaguagucaccuaggguauccaaucagcuguccugauaucagagugccuguguucaaguaacucuuauuuugcucaguggccccagauugcaagaguagugaugcuggcaugucauaauaguucuauuuuaguauuuguuauuauuguugaucuguuacuaugccuagcucauaaauuaaacuuucucauaaguauguauguauagggaaaaaaacaacauauauaugggguucgguacuaucuacgguuucaggcauccacuggggucuuggaauguauccuccaaggauaaggaaggacuaguguauuccccacaccccucccucuugcuaccuuuugcugcuuuucuuuaaucacccucuccuccuguggccuguuucuauauacuuggcauucuguuugcuuucuuuguuuugucaaucacuuccuuucuucucugcccaaacccugguugcagguggcaauggcuacaucaaugacuuucccaugggccgcuuucuucgagaugccaagcuguaugagauaggggcugggaccagcgaggugaggcggcuggucaucggcagagccuucaaugcagacuuucacuaguccugagacccuucgcccccuuuuccugcaccuaguggccuuucuugggaaguagagauguggcggcuuucccacccugcccacagcaggcccuccugcccagcugcucuugucagcccucuggccucuggaugagguugaguucuccacaacagcucccaagcaucaugggccucgcagccgggccugugccacggcuaguguugugugauuuaaaauggacucagcaggaagcauauugucuggggauuguugggacagguuuuggugacucugugcccuugcucucuaacuucugagcccaccucccaggguaggcaccugggggcaugcaggugcccaccucccaggguaggcaccugggggcaugcagguacccaccucuuucucuugggugaggcucuggcaaggagaucucucugcucaagcacagcagaaucauggccccucuccaugaauuggaacuugguacagguuaaguaucccuaauccugaaaucugaaacacuugugguuccaagcauuuuggauaaggcaaauucaacuuucagucucuuuucugggggaaaaaaauaauaaaccuagccuagccaggcgugguggcucaugcuuguaaucccagcacuucaggaggcugagauggguggaucaccugaggucaggaguucaagaccagccuggccaacauguggaaaccucgccucaacuaaaaauagaaaaaaauuaguugggcaugguggugggcaccuguaaucccagcuacuucaggaggcugaggcaggagaauuacuugaacccaggaggcggacguugcagugagccgagcuugugccauugcacuccagccugggcgacaagagcaaaacucuucaaaaaacaaaacaaaacaaaaaaacccuggcccuuguuucuuccaguuucuagagguaucagcuccuagcagcuuaugaacacauaugcuugcuuggccaggcaagguggugugugccuguaaucccagcacuuugggaggccaaggcagguggaucacuugcagucaggaguucaagaccagccuguccaacguggugaaaccccaucucuacuaaaaauacaaaaauuagccaggggugguggugcacgucuguaaucccagcuacucaggaggcugaggcaggagaaucacuugaacccgggagguggagguugcaaugagccaauaugacaccgcugcaguccagccugggccauagagugagacucugucucaaaaaaggaaagaaaaauaggcugggcacagugacucaugccuguaaucccaacacuuugggaggccgaggcagguggaucacgaggucaggaguucaagaccagccuggccaagaugguaaaaccucgucucuacuaaaaauacaaaaauuagccaggugugguggcaggcuccuguaaucccagcuacucaggaggcugaggcagagaauugcuugaacccgggaggcagaguuugcagugagccaagaucacaccacugcacuccagcuuggacgacagagcgagacucugucucaaaaaauaauaggccaggcaugguggcucaacgucuguaaucccagcacuuugggaggccgaggcgggcagaucacaaggucaggaguucgagaccagccugacgaccaacauggugaaaccucgucucuacuaaaaauacaaaaauuagccaggccugguggcacgcgccuguaaucccaguuacacagaagacugaggcaggagaaucgcuugaacgcaggaggcagagguugcaggagcugagaucgcgccauugcacuccagccugggcaacagagugagacucugucucaaaaaauaauaauaaaauaaaugaacacacaugcugcugaguccgcagggggggcagagcagaggacagcgugcuuuuguguacuguuggaagacuggcuccuccuguacagcaccucugagcccuugugcaccgcccugccacgggcaccauccaguccuggccgugugaccacccacagcugacugggcagcaggcacaggcccuacccgagcaggccggaguuggcucgcaugacuccagcugaggcugccuguguacauuucuccagauacccuauggcuaauuuuguuauaacugcacaguggcugcugccauuuuguauuaaauauauugugaaacaaaccuaucuggggagaagcaaucuacuugccgcugcuuccugucuggauccagcuuguguccuuggagaguggcuggcccagguccuauuccuguccuccagcccguucuuucaugagggacaggaagguaaaaucagcccuuaggagagaggucucagccucccuuucccagaucucccagugaguuuuaaaggaagcagggagcccagagugcuaaguucuuacagccagaaggaagcuuauagauuucugaaaaccgccccuuuguuuuuaaaaagaucaacacaauuugacuuucucaaggucaaaacgaacuagaauccagaucugcucauggcaaaaauggggguguucugagaauuccagcuuugggccgcacuguacagcagucuggauagagugugaucugagaagggaaugggucuggguuguuccaccccuuccgaguuccaaaaagagggaacugguuuucuugguucucagcccagcagcaccuauccuggcucuugguccuggccugcagccaagugcuguuccuagccugaggcuugagacaggugggguuggcuccucaccaaccccaguuccgucccauccugagggcaagauccugggcucauaggcagucccuuucacuuccuugucuugcucccugcuauguuggagaugaaugugacuaaaagggccaucuugcuggcuuaauguguggcuggagagaccagccuggagacaauguggcaaaauggggcgcuucauccagucugucuaagcccugucgacuuggggaggugauuucuuuccugguucuauaugugaagcaaaauaaauguuuuaaaauuaaaagcaaaaaaaacaaaaugaaccaug

SEQ ID NO: 61608 - RNA, 15827 nt, Homo sapiens; identical to SEQ ID NO: 61607

SEQ ID NO: 61609 - RNA, 3955 nt, Homo sapiens
ggaggagccagcggaaggacggugugcgggccggccagcccuggacgaaagaagagggccccuccaggccagucugggcacccugggauagcggcugcagguaggcagaggcgcugccagugcccagguggccuuucccuccauccggcccuucccaccuuccuauaaccuucccuccaccucccucaacuccuggccuccccacccuuuuacugccuucaaaucucucucccuaaacccugaccccuuccugcaccccaagcccgccccucucuccguaacucagccaucagcaggggcagacggcagguggccugguugcugcagcucccaggaucagcucugcccuccccgcaaacgccagccucgucaccgcuccagggcaccuccagcaguaacaggugguugcagcagguggcagccagccccuggaugagccaaggucucuuccccagccaggcauggccgacucugcacaggcccagaagcugguguaccuggucacagggggcuguggcuuccugggagagcacguggugcgaaugcugcugcagcgggagccccggcucggggagcugcgggucuuugaccaacaccugggucccuggcuggaggagcugaagacagguucuuguugggggagcuugugguggagaggguguggacgcuuccccaacccuucccaagcugggauccccaccccugcaguggaacagaugaugcugguuucuguccacauggaugggucgagugagucacauugggaacgugacuccaggguggaagaugaacccagccucuggccucuggccccagcucugacauggccuguguccuccaaccccggccagggccugugagggugacugccauccagggggacgugacccaggcccaugagguggcagcagcuguggccggagcccauguggucauccacacggcugggcugguagacguguuuggcagggccagucccaagaccauccaugaggucaacgugcagggugaggagcucuggacacuccuggccaucuugccuguuuguuccccacucugucuuuggccuugaccuccggugacuccccugggacaaguuguccuauugacagcccugcccccgccuccccugaccugucaugguuuucccuggaccugggauggggaggaggaagaugcagagagggaagaagcugcagcuuggauacgccuccuccucugccagguacccggaacgugaucgaggcuugugugcagaccggaacacgguuccuggucuacaccagcagcauggaaguuguggggccuaacaccaaaggucaccccuucuacaggugaguggcaggcccucuuguccucuaagagcccauuucccucagcauugagucuuccuucuccucccaccaggggcaacgaagacaccccauacgaagcagugcacaggcaccccuauccuugcagcaaggcccuggccgaguggcugguccuggaggccaacgggaggaaggugagcccagaaaaaggaggcgcagagauggggcuccugcccugcacacccccuuacccugccagcccaaggaggccggggccgagagcaagcugucgggucccaggucucagcaguaccugccuuugccaccagguccguggggggcugccccuggugacgugugcccuucgucccacgggcaucuacggugaaggccaccagaucaugagggacuucuaccgccagggccugcgccugggagguuggcucuuccgggccaucccggccucuguggagcauggccgggucuaugugggugaggacugggcuaggcagggggaggcugagaauauggcaggaggacuugcucuagaagggggcaggacccacauggcccugggagagaaguguggacucuggcuagaaaaauauggucuauacaugggccaagguagacugugauuaugucuccacagccugcagagaauacaggauccaugcaaguugggacauuaaaaaguguaucauaggcuacagagaagauugcagcuaugggagcagccauuccccaggagaggagaggagagggacaguguguacacagcacuaaaagggcuggguucaguggcucgcaucuauaaucccagcacuuuaggaggcugaggcgggaggauggccugagcccaggaguuggaggcugcagugagcuaugaccgcaccacugcacuccagccuggaugacagagacagacccugucucuaaaacuuuuuuuaaaggaaguagcaucuacacagggaauaaggucaccugccacuccauccugcaguccccaagccucucagggcccaccacgcagguccugguuucucuauccucuccccagguucuuugcagaugcaggcuggcccaggagagcaagugacuaccagggcgagggagaaggcagccuuucccaggcugcuguggggaugugggcggcaacuaccugggcccaaagaggggguggcccaggagagcagccucgaugugguguugcaagggcacucagggguguguccgccucucuuccgccaccggcaggcaauguugccuggaugcacgugcuggcagcccgggagcuggagcagcgggcaacccugaugggcggccagguauacuucugcuacgauggaucacccuacaggagcuacgaggauuucaacauggaguuccugggccccugcggacugcggcuggugggcgcccgcccauugcugcccuacuggcugcugguguuccuggcugcccucaaugcccugcugcaguggcugcugcggccacuggugcucuacgcaccccugcugaaccccuacacgcuggccguggccaacaccaccuucaccgucagcaccgacaaggcucagcgccauuucggcuaugagccccuguucucgugggaggauagccggacccguaccauucucuggguacaggccgcuacggguucagcccagugacgguggggcuggggccuggaggcccagauacagcacauccacccaggucccgagcccucacacccuggacgggaagggacagcugcauuccagagcaggaggcagggcucuggggccagaauggcuguccuugucguagagcccuccacauuuucuuuuucuuuuuugagacagggucuugcucugucacccagacuggagugcaguggugugaucauagcucacugcacccucaaccuccuggguucaagcaauccuccugccucagccuccugaacagcugggaccacaggugcacgccaccacaccuggcuuuuuuuuguuguuuuuagagacagggucucacuauauugcucaggcuggucuugaacuccugggcucaagugaucuucccacgugggccucccaaaacgcuggaacuacaagugugagccaccgcgccuggcccaagcccuccacauuuucaauccaggagccuugagucuguguuguguccugacaccuccaaguucuagggccgucaggacacgggaggguuuggggacagaguguccuuccucuguccucucaucccaguccugauggccgcuuggugagugucuggugcccugguggccugccccagcucucuucuggcuuucugagcaggaagcgagcagaggcuccacaggcuuacgcugcucuccugacagccacacgcgacccucggugcagagugcagaggcggcucugguuccuccagccaccucagucccucuuugggaggugauguucccauuguuuuucaaaggccucaccuucaacugucugucuuagaauuccccucuggagggcuauggccucccuaugcuuucacuucccaccucucuaccuaaguuccuucccagcacaucgccagcccugggccuggggauguccccaaugcuguaccuggcugaccccggauuaaaagccucauccacgaccgug

SEQ ID NO: 61610 - RNA, 3955 nt, Homo sapiens; identical to SEQ ID NO: 61609

SEQ ID NO: 61611 - RNA, 3955 nt, Homo sapiens; identical to SEQ ID NO: 61609

SEQ ID NO: 61612 - RNA, 5437 nt, Homo sapiens
aacuacagcucccagcaugccccggggcccgcaaccguccgccgcccggugcacuguggacgaugagucaggguuaggggcgccaggacgugggcgugcaggacgccagagcugggucagagcucgagccagcggcgcccggagagauucggagaugcaggcggcucggauggccgcgagcuuggggcggcagcugcugaggcucgggggcggaaggucugugugugacaagagggacggugggcagcggcccugggcaccgggccggcacugaacccccacuccccacagcucgcggcucacggcgcuccuggggcagccccggcccggcccugcccggcggcccuaugccgggggugccgcucagguaagucaccgcagccuuggcaagggggugugggagcggcgguccgcuucggcgcccgccaucggcagggaucucccucuuggugccagguaccugccuacugcucagucgccgaaaguaggggaaagggcaagccagggugcccuagggcgaaacuaggggaaaggucaccgcuucgcgccgccuccccgcgcggcucucgccuguucuccccuugacacagcggaagucccuucccugaacuugcuaaccgucucuuuucccagcuggcucuggacaagucagauucccaccccucugacgcucugaccaggaaaaaaccggccaaggcgguagguagccccgaggccagguggaccuuagccagacccaaccagagcccugaaauuugccucucucugcccaggaaucuaaguccuuugcugugggaauguucaaaggccagcucaccacagaucagguguucccauacccguccgguaagggaagggauaaucagagcuggguggggccagggugguuuccccugccagccuggccugaccagccugucccccacccucugcagugcucaacgaagagcagacacaguuucuuaaagagcugguggagccugugucccguuucuucgagguaaggaaugacucggggcuuggucccuggugagguguuuggagauguuaagcucaaaaggagccuggaugugggauccugugccuuccccaggaagugaacgaucccgccaagaaugacgcucuggagaugguggaggagaccacuuggcagggccucaaggagcugggggccuuuggucugcaagugcccagugagcuggguggugugggccuuugcaacacccaggugagggcgcccuaucgccacaucccaguaugccauaccccagcuuggcagacucagcucuuuugccauagaccuagagacuagggcuaaggucucuucuaagcaccugcccugggugccugugggauggauguuaacuguccaaacauaacacaauuuacaugcaguccccuaggccugagccaugggccucacccugguucccaaguccuuacaaaucucuaaguuggggauugccuaacaauagacugacuaguagcaagucacccuccuaccuagaccuaagacagaccagcauucucugcugugcccuuugcacaccccacuucuuuucuacacacuggggauggcccaggucaggcacugcccuaggucaggaacugcccuaggucaggaacugcccuguugcccacacucuccuguuaaggucaggucccccugcagccagugacaaccccagauuccugcuuccccuccaguacgcccguuugguggagaucgugggcaugcaugaccuuggcgugggcauuacccugggggcccaucagagcaucgguuucaaaggcauccugcucuuuggcacaaaggcccagaaagaaaaauaccuccccaagcuggcaucuggugaggcaacccuaggagagccagggauuggggggcacacugggcuuggcacagauuaggccaguuggcacuuagauuaucagauggcugagcauuucaguugggggaagguuuuggggaggcaucacagugugcugguugggacaugcaaaagaacuggauacucccagguguuaagggggaacugccugcuggagggauggggaagugggccgaggggacuuugaagcucaucagaacuugggguaaaguagcucucuccccaacaggggagacuguggccgcuuucugucuaaccgagcccucaagcgggucagaugcagccuccauccgaaccucugcugugcccagccccuguggaaaauacuauacccucaauggaagcaagcuuuggaucaggcaaccugccucccauuucuccccuucuccuccgcccaauuccaggccccacugcuccccguccuccacgcccugaauaucccauucuuccacaguaaugggggccuagcagacaucuucacggucuuugccaagacaccaguuacagauccagccacaggagccgugaaggagaagaucacagcuuuugugguggagaggggcuucgggggcauuacccagugagugaauuuggguugggggagcuuaggacugaggggcaggacugggcuccugggcagauggcuguugcaagucacccuggggacgugugcaaaagccaaagcagguggacugaauguggccuuugggacuaauauguaugcaacugagcuaaaguuuuggcuccagcaaccaaguccaacacaaaauaggacauagccaggccuccuuagcccucagggccugaggggaagugguggcuguagccucuaauagucuaguggucgucauuccucccuggugcauaaggagcgaaggagcaguuuuucccccagugacaaccuguugaacacaccucugcuuucccacacugcccugacacagugggcccccugagaagaagaugggcaucaaggcuucaaacacagcagagguguucuuugauggaguacgggugccaucggagaacgugcugggugagguugggaguggcuucaagguugccaugcacauccucaacaauggaagguuuggcauggcugcggcccuggcagguaccaugagaggcaucauugcuaaggcggugaguacccugcccgagucccuagguaacccaaacagaagucucacugucccccuugccaugugucccugaucacuugcaggcacucccuacacuagaaacuccuccccuaccagcagcccgacuugcuagcuuaggucuccauccagcguagacugaacucugguuguaugcaaaacccaucccucuggcgcaagcccagccccucuccuagggagacugcagaaccacacugaaccacagcgggauguguggacccucuuccagguagaucaugccacuaaucguacccaguuuggggagaaaauucacaacuuugggcugauccaggagaagcuggcacggaugguuaugcugcaguauguaacugaggugagggccucccaagccccucucccuggagcccuggggcuuucuucccagucgggucagacuacaacccccagcagcaccuggggcagugggucuccagcuuuacaccaaugcccuaggggaugcggggaggcauagucagcucagcuucugcgaagagagacagcaaugauguucugcucaggugccugccagcaguaccagaaguuaauucuaccucaucccuuacauccaccccuuuuaagaaaacaaauaccuggaagcaccugaugaacugacccagaacaaguaucugccugaccugacaagcuaggucagcccuuaucuuggagaucugggugaugaggccaagucugacaaagcccuuugcaauuuuccuucccaugucccaacuaugcaaccucaguccauggcuuacauggugagugcuaacauggaccagggagccacggacuuccagauagaggccgccaucagcaaaaucuuuggcucggugaggucccaggcaugcugggagggaguccaguuugggugcucagcucccaaaaccagucucaucuguucuuugucccuaggaggcagccuggaaggugacagaugaaugcauccaaaucaugggggguaugggcuucaugaagguacaggacggucuucugcagagccucggcugggccagggguggguaggcacaucucagcacgggcauauaauuuguguggcccugugcuaggaaccuggaguagagcgugugcuccgagaucuucgcaucuuccggaucuuugaggggacaaaugacauucuucggcuguuuguggcucugcagggcuguaugguaagacagagaauuggguggggguagagguggggaggacagugaguccugacugcuggacccucuucccccauaggacaaaggaaaggagcucucugggcuuggcagugcucuaaagaaucccuuugggaaugcuggccuccugcuaggagaggcaggcaaacagcugaggcgguaggcuuagggccagagccaggggagggcagggugguguauggcaacuaaccagucauucucccucuuccucucaggcgggcagggcugggcagcggccugagucucagcggacuuguccacccggaguugagucggaguggcgagcugguaaguggccagggguccaggagagccugcaucagggacugcagccgauggccccucugagccccgcacuguccccaucucuuaaggcaguacgggcucuggagcaguuugccacugugguggaggccaagcugauaaaacacaagaaggggauugucaguaagugagcucuacaccauuccgccccucccuuuccucuccuugagacuaaugcccccacccccacccccaccccaccuaccggacagaugaacaguuucugcugcagcggcuggcagacggggccaucgaccucuaugccaugguggugguucucucgaggugaggaggcaggcagggaaugccugagccgcagggggccugggccuggaucccagccggcccagauuuauuuucaucuccugcuuccugccagggccucaagaucccugagugagggccaccccacggcccagcaugagaaaaugcucugugacaccugguguaucgaggugagacucggggcugccaagcucaggugagggcuggaggugcaggcccaaccccuccuucccucuccccaggcugcagcucggauccgagagggcauggccgcccugcagucugaccccuggcagcaagagcucuaccgcaacuucaaaagcaucuccaaggccuugguggagcggggugguguggucaccagcaacccacuuggcuucugaauacucccggccagggccugucccaguuaugugccuucccucaagccaaagccgaagccccuuuccuuaaggcccugguuugucccgaaggggccuaguguucccagcacugugccugcucucaagagcacuuacugccucgcaaauaauaaaaauuucuagccagucau

SEQ ID NO: 61613 - RNA, 8143 nt, Homo sapiens
gucacuauacagagacaguccauguuggggggccuggccgcggcggcggguaaggggcucugacuucaucggaguuucguuccuccccuccguggguucucaccccuccccccuccgcaccccacuuuugcagggggggccaggauggggggaggggugagaggggaaggaggggguuggagaagggaaggggaggggagcgugggagggaggggaagggggcccuaaaaggggcuccccaguggaggggagggggcuuggggagcacaccccgauucucaggaggggcgggggcaccgggggcuggcagccccggaguucgggggcuggggcaugagcuggggugggggaggggaacuggauuucggggagccccgggguaggggggggucuugccaaacggccaggggcuaggggccguggcgggggagugggguggggggguuggaaacggcagcggccgagggagccguggagccgaagagggaaggggagagaggaggagagaggaagcagggggagggagggagggagcuaggagccagaauggggggggugccuuggcagaguuaacuccuucugugcuggcaggaacccggauaaugggaaaggagauagaagcagaagcacagaggccccugaggcaaacauggagaccuggccagccaccagcgaugacagcaaagacgaugaggcuggauuucauuucuuagagaaggaagcaucuauaguugggcugggagcacccacgguuauuugaauacgggagggaggccucucggcaggcgguagggggucgggugugagggaggagcugaaggaggcaaucccugggggccuaguucucccucagguuucucagggggaaaccuaaaaaguuaagcccuagacucuuuagugccugaaacuggggcagccaaagaaaacgaggaagaaagggagaguggguacaggaccacagagagugcauucucggugccccaagucccugggccacugacucaggcuuuugucagcagggcccccaagauuccagguaauauuagugauauuuggcucaccccuccagcccugccugccccucaggaaguuaggcgcucgcccccaccuccuuaccugacucucugagagggaagccucauaauaguccaggaugucugucacaggaacagaacugaguuaccuccccaccccaggccucuccaggcacaucaccccugucaucaccgcugcuggcuggcuggcaagggaggagcccuuucagccaaggcugguccacacucauggaggacaccauaggcaggacccugcauggugcuccagcuuggaccaaaugaucucugggcucccaaacagcccccgaaguucaguaauggcccuuggaggcccaggucccucagaaaacgggcuacucacccagcaaggccuggaagaggucgcuaugcagcacugugaggagugggggugcccaccgcagcagugggggugccaggagccagagggcugaccugggagcuagugagaugcaaggagaauugggacagggaagaugccaacacaggaagaugaacacacugucacuucaucuccccagacugugcccuucaccccagccccuacggaaagauuuggggagaaggaucuccgagccccagccccccacuucgcucccagaccuccccuccacaaggagcccuguuuuucaccucuuggucucugggacaucucucucuucucucacuuuaaucucccuaauccuccaggauuggaguugagcugcuucuccccacuaaauuccagcugugaguaaaguaggccgucucugagccgaccagcugucccauucccccaggucccaaggcaccagcaccgccaccaucuugcuccacacacccuggcccccucuucccauaggcaggcagaaccuagccacgcucuccugagaagccagcaaagagggccuccucacagagggcuccagcagcucaaaaagaagcugagcccagcucucucuccuccugggccuccucucaccccaaugagaauugcagaaaaagggguagaaauuguuugggacuuccugcccuagggcuagagaaguugggguuuuacggguaagaggcaggagaauuccugcaguuccucucaggcccgggaggaauccaucugccugggcacauggucucuggaaggaacagagggcaaagacagaagggaauguucaggaaggucucagaggcuuuacuaagggaggggcagugaaucugggggggucuuccuacugugaaacuguagcuguuccaagaguuagugaauggccuacaucucagaagaauacacuuaggguacucacacccuagcuugggugccccccaccacuguacccucccuuuuguguuggccgagauagauuucaucaggaacccuagagucugucuuuccaugucucugccucugccaucuaccuuacacuucucuuucccuacuuuucccuucuaaccccaccggagaagcccucccuucaguccaccuccaucccucuggcugcagugacuuaagccccuuccucuucugucccauccuaucccaucaccccgucggaggacuagacucuaggucggacgggcgggauuaaggaguuugggggagacgagggacgcuuggagaucccucuaagucagcggaacgcagggccgggcuccagggaacuacagcucccagcaugccccggggcccgcaaccguccgccgcccggugcacuguggacgaugagucaggguuaggggcgccaggacgugggcgugcaggacgccagagcugggucagagcucgagccagcggcgcccggagagauucggagaugcaggcggcucggauggccgcgagcuuggggcggcagcugcugaggcucgggggcggaaggucugugugugacaagagggacggugggcagcggcccugggcaccgggccggcacugaacccccacuccccacagcucgcggcucacggcgcuccuggggcagccccggcccggcccugcccggcggcccuaugccgggggugccgcucagguaagucaccgcagccuuggcaagggggugugggagcggcgguccgcuucggcgcccgccaucggcagggaucucccucuuggugccagguaccugccuacugcucagucgccgaaaguaggggaaagggcaagccagggugcccuagggcgaaacuaggggaaaggucaccgcuucgcgccgccuccccgcgcggcucucgccuguucuccccuugacacagcggaagucccuucccugaacuugcuaaccgucucuuuucccagcuggcucuggacaagucagauucccaccccucugacgcucugaccaggaaaaaaccggccaaggcgguagguagccccgaggccagguggaccuuagccagacccaaccagagcccugaaauuugccucucucugcccaggaaucuaaguccuuugcugugggaauguucaaaggccagcucaccacagaucagguguucccauacccguccgguaagggaagggauaaucagagcuggguggggccagggugguuuccccugccagccuggccugaccagccugucccccacccucugcagugcucaacgaagagcagacacaguuucuuaaagagcugguggagccugugucccguuucuucgagguaaggaaugacucggggcuuggucccuggugagguguuuggagauguuaagcucaaaaggagccuggaugugggauccugugccuuccccaggaagugaacgaucccgccaagaaugacgcucuggagaugguggaggagaccacuuggcagggccucaaggagcugggggccuuuggucugcaagugcccagugagcuggguggugugggccuuugcaacacccaggugagggcgcccuaucgccacaucccaguaugccauaccccagcuuggcagacucagcucuuuugccauagaccuagagacuagggcuaaggucucuucuaagcaccugcccugggugccugugggauggauguuaacuguccaaacauaacacaauuuacaugcaguccccuaggccugagccaugggccucacccugguucccaaguccuuacaaaucucuaaguuggggauugccuaacaauagacugacuaguagcaagucacccuccuaccuagaccuaagacagaccagcauucucugcugugcccuuugcacaccccacuucuuuucuacacacuggggauggcccaggucaggcacugcccuaggucaggaacugcccuaggucaggaacugcccuguugcccacacucuccuguuaaggucaggucccccugcagccagugacaaccccagauuccugcuuccccuccaguacgcccguuugguggagaucgugggcaugcaugaccuuggcgugggcauuacccugggggcccaucagagcaucgguuucaaaggcauccugcucuuuggcacaaaggcccagaaagaaaaauaccuccccaagcuggcaucuggugaggcaacccuaggagagccagggauuggggggcacacugggcuuggcacagauuaggccaguuggcacuuagauuaucagauggcugagcauuucaguugggggaagguuuuggggaggcaucacagugugcugguugggacaugcaaaagaacuggauacucccagguguuaagggggaacugccugcuggagggauggggaagugggccgaggggacuuugaagcucaucagaacuugggguaaaguagcucucuccccaacaggggagacuguggccgcuuucugucuaaccgagcccucaagcgggucagaugcagccuccauccgaaccucugcugugcccagccccuguggaaaauacuauacccucaauggaagcaagcuuuggaucaggcaaccugccucccauuucuccccuucuccuccgcccaauuccaggccccacugcuccccguccuccacgcccugaauaucccauucuuccacaguaaugggggccuagcagacaucuucacggucuuugccaagacaccaguuacagauccagccacaggagccgugaaggagaagaucacagcuuuugugguggagaggggcuucgggggcauuacccagugagugaauuuggguugggggagcuuaggacugaggggcaggacugggcuccugggcagauggcuguugcaagucacccuggggacgugugcaaaagccaaagcagguggacugaauguggccuuugggacuaauauguaugcaacugagcuaaaguuuuggcuccagcaaccaaguccaacacaaaauaggacauagccaggccuccuuagcccucagggccugaggggaagugguggcuguagccucuaauagucuaguggucgucauuccucccuggugcauaaggagcgaaggagcaguuuuucccccagugacaaccuguugaacacaccucugcuuucccacacugcccugacacagugggcccccugagaagaagaugggcaucaaggcuucaaacacagcagagguguucuuugauggaguacgggugccaucggagaacgugcugggugagguugggaguggcuucaagguugccaugcacauccucaacaauggaagguuuggcauggcugcggcccuggcagguaccaugagaggcaucauugcuaaggcggugaguacccugcccgagucccuagguaacccaaacagaagucucacugucccccuugccaugugucccugaucacuugcaggcacucccuacacuagaaacuccuccccuaccagcagcccgacuugcuagcuuaggucuccauccagcguagacugaacucugguuguaugcaaaacccaucccucuggcgcaagcccagccccucuccuagggagacugcagaaccacacugaaccacagcgggauguguggacccucuuccagguagaucaugccacuaaucguacccaguuuggggagaaaauucacaacuuugggcugauccaggagaagcuggcacggaugguuaugcugcaguauguaacugaggugagggccucccaagccccucucccuggagcccuggggcuuucuucccagucgggucagacuacaacccccagcagcaccuggggcagugggucuccagcuuuacaccaaugcccuaggggaugcggggaggcauagucagcucagcuucugcgaagagagacagcaaugauguucugcucaggugccugccagcaguaccagaaguuaauucuaccucaucccuuacauccaccccuuuuaagaaaacaaauaccuggaagcaccugaugaacugacccagaacaaguaucugccugaccugacaagcuaggucagcccuuaucuuggagaucugggugaugaggccaagucugacaaagcccuuugcaauuuuccuucccaugucccaacuaugcaaccucaguccauggcuuacauggugagugcuaacauggaccagggagccacggacuuccagauagaggccgccaucagcaaaaucuuuggcucggugaggucccaggcaugcugggagggaguccaguuugggugcucagcucccaaaaccagucucaucuguucuuugucccuaggaggcagccuggaaggugacagaugaaugcauccaaaucaugggggguaugggcuucaugaagguacaggacggucuucugcagagccucggcugggccagggguggguaggcacaucucagcacgggcauauaauuuguguggcccugugcuaggaaccuggaguagagcgugugcuccgagaucuucgcaucuuccggaucuuugaggggacaaaugacauucuucggcuguuuguggcucugcagggcuguaugguaagacagagaauuggguggggguagagguggggaggacagugaguccugacugcuggacccucuucccccauaggacaaaggaaaggagcucucugggcuuggcagugcucuaaagaaucccuuugggaaugcuggccuccugcuaggagaggcaggcaaacagcugaggcgguaggcuuagggccagagccaggggagggcagggugguguauggcaacuaaccagucauucucccucuuccucucaggcgggcagggcugggcagcggccugagucucagcggacuuguccacccggaguugagucggaguggcgagcugguaaguggccagggguccaggagagccugcaucagggacugcagccgauggccccucugagccccgcacuguccccaucucuuaaggcaguacgggcucuggagcaguuugccacugugguggaggccaagcugauaaaacacaagaaggggauugucaguaagugagcucuacaccauuccgccccucccuuuccucuccuugagacuaaugcccccacccccacccccaccccaccuaccggacagaugaacaguuucugcugcagcggcuggcagacggggccaucgaccucuaugccaugguggugguucucucgaggugaggaggcaggcagggaaugccugagccgcagggggccugggccuggaucccagccggcccagauuuauuuucaucuccugcuuccugccagggccucaagaucccugagugagggccaccccacggcccagcaugagaaaaugcucugugacaccugguguaucgaggugagacucggggcugccaagcucaggugagggcuggaggugcaggcccaaccccuccuucccucuccccaggcugcagcucggauccgagagggcauggccgcccugcagucugaccccuggcagcaagagcucuaccgcaacuucaaaagcaucuccaaggccuugguggagcggggugguguggucaccagcaacccacuuggcuucugaauacucccggccagggccugucccaguuaugugccuucccucaagccaaagccgaagccccuuuccuuaaggcccugguuugucccgaaggggccuaguguucccagcacugugccugcucucaagagcacuuacugccucgcaaauaauaaaaauuucuagccagucau

SEQ ID NO: 61614 - RNA, 5437 nt, Homo sapiens; identical to SEQ ID NO: 61612

SEQ ID NO: 61615 - RNA, 5437 nt, Homo sapiens; identical to SEQ ID NO: 61612

SEQ ID NO: 61616 - RNA, 2797 nt, Homo sapiens
aacacaccucugccggcugagggugacacaacccuguucccugucgcucuguucccgcuuaucucucccgccuuuucggcgccaccaccuucuuggaaaugagacagagcaaaggggagggggcucagaccaccgccuccccuggcaggccccauaaaagcgacugucacucggucccagacaccagagcaagcucaagacccagcagugggacagccagacagacggcacgauggcacugagcucccagaucugggccgcuugccuccugcuccuccuccuccucgccagccugaccaguggcucuguuuucccacaacaggugagagcccaguggccuggguccuuagcagggcagcagggaugggagagccaggccucagccuagggcacuggagacacccgagcacugagcagagcucaggacgucucaggaguacuggcagcugaacaggaaccaggacaggcacgguggcucaugccuguaaucccagcacuuugggagguugaggcaggcagcccacuugaggucaguuugagaccagccuggccaacaugguaaaaccccgucucuacuaaaaauacaaaaguuagccaggcuugguggcaggugccuguaaucccagcuacucgggagacugaggcaggagaauugcuugaacccgcaagguggagguugcacagugagcugagauugcaccacugcacuccagccuggcaacagagcaagacuccaucuccaaaaaagaacagaaaucaaugaagcaccgagugacagggacuggaagguccuaauuccauggguauuuacggaaccccuacgccguguggagucuuauucuagacaguggggacgaggccaugaacaagguagaugagagaggagauuucuccauccuggucagggaauuuguuaaagacugaugaaaacaugaauaaauaauugugucuaguacauucuauucgugaaucucauaacagacagugguagagugaccgugacccauucgccacacaguagagucacuuuuuugguuuguuuuuuagagacagggucuuccucuguugcugaggcuggagugcaguggugcagucauaguucacugcagccucaaccuccugugcucaagcaauccucccaccucagcgucccaaguagcugggacagcaggcacaugccacggguugggggaccacaggcauggucaaggggcuggcagucaagcaaguguuucaugagaaagugacaguugaccuucgucuuggagggugagagauggaggcagcaaagaccuaaggagaggacaagccagcauagcccagggucaggcugaacaagaggagauggugggacuuggggauaaggcugaggggugggcagucccuaagucuugugggcaaccaugcagacacugauuuuuccuuggaauaaagaggaagcccccauaagcuuuuuuuuuuuuuucugagauagggucucgcucugucguucaggcuggugugcaguggcaucaucugggcucacugcaaccuccgccucccggguucaagcaauucuccugccucagcuucccgagcagcugggauuacaggcggcugccaccacgcccggcuaauuuuuguuuuuuuaguagagacaggguuucaccauguuggccagacuggucuugaacuccugaccucaggugauucucccaccucggcuucccaaagugcugggauuacaggcgugagccacugcgcccagccuccuguagguuuuuaaaauggagaaaaccacaaucucacuggccauguuuuaaaaaacuuaaucugccagucaggcaccauggcucacaccuguaaucccagaguuuugggaggccaagguaggaagaucaguugagcccaggaguucaagaccagcuugggcaacacaaccagaccccaccucuacaaaaaauuaaaaaauuagccgggugugguggcgugcaccugcugucccagcuacucgggaagcugaggcgggagcaucgcuugagcacaggaggucaaggcugcagggagcuaugacugugccacugcacucuggccugggcaacagaggaagacucugucuaaaaaacaaacaaaaaaagugacucugcuguguggcaaauggauugaggggcaagaaugcagggagguguguuaggaggcuggcacuggcauccaggcaggggaaggugauaucccaaagaagaguagcagcuguggaaagaggaggaggcggaucugggagguuuuuuuuuuuaggaaaagccgcccaugggaaggugagcagaagcaagaaagcaaggccccuccuaagaguccauuugagcucuggguuuaaaccacuuggagaggagcagguugccgggagccagucucagagguccacugggcccccugccauccucugcacccccuucugcuuucacagacgggacaacuugcagagcugcaaccccaggacagagcuggagccagggccagcuggauggugagcgcaacagugaugccuuuccuagcccccugcucccuccccaugcuaaggccgguucccugcucacauucccuuccuucccacagcccauguuccagaggcgaaggaggcgagacacccacuuccccaucugcauuuucugcugcggcugcugucaucgaucaaagugugggaugugcugcaagacguagaaccuaccugcccugcccccguccccucccuuccuuauuuauuccugcugccccagaacauaggucuuggaauaaaauggcugguucuuuuguuuuccaa

SEQ ID NO: 61617 - RNA, 23561 nt, Homo sapiens
accucccuccgcggagcagccagacagcgagggccccggccgggggcaggggggacgccccguccggggcacccccccggcucugagccgcccgcggggccggccucggcccggagcggaggaaggagucgccgaggagcagccugaggccccagagucugagacgagccgccgccgcccccgccacugcggggaggagggggaggaggagcgggaggagggacgagcuggucgggagaagaggaaaaaaacuuuugagacuuuuccguugccgcugggagccggaggcgcggggaccucuuggcgcgacgcugccccgcgaggaggcaggacuuggggaccccagaccgccucccuuugccgccggggacgcuugcucccucccugcccccuacacggcgucccucaggcgcccccauuccggaccagcccucgggagucgccgacccggccucccgcaaagacuuuuccccagaccucgggcgcacccccugcacgccgccuucauccccggccugucuccugagcccccgcgcauccuagacccuuucuccuccaggagacggaucucucuccgaccugccacagauccccuauucaagaccacccaccuucugguaccagaucgcgcccaucuagguuauuuccgugggauacugagacacccccgguccaagccuccccuccaccacugcgcccuucucccugaggaccucagcuuucccucgaggcccuccuaccuuuugccgggagacccccagccccugcaggggcggggccuccccaccacaccagcccuguucgcgcucucggcagugccggggggcgccgccucccccaugccgcccuccgggcugcggcugcugccgcugcugcuaccgcugcuguggcuacuggugcugacgccuggccggccggccgcgggacuauccaccugcaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacggugagcucggaggggcaggggagccgggaggggggcccccagggggcgccggagugccggggccacggguaggaagugacuggcagaagaaacuggcuggaggaagaggacaccccggggcaaagggaacgugugauggugggagggggguguccgaaagaggauggcacugagcccccuaccacccaggugucuggucuuggagaggaggagauagcgaaguggaccgcuucuagagugcgacagaaacaugcggggucgugggggcaguccccuagagggagacaagcaauagggggaggguagaaggcucccucuuccaggacgcguugaaugggggggggggucguggggugccaggugcagagaagggagccuggugugggagaagcgaagaccccagcauuugggaaaggagaggcgcuggagaaaguugacccagagcuuggggguccugagguggaaagauucaagaaggacagaaaagcuagaugaaggcaaccccagagggugccaggaaagugagagcggacccacuuccagaggcugccaggaacacgcgggaugcgggggugggggagagucguagaaagagaaacagaggugcgugugauaaauguggggagaaagggacgggagguuauuggaaggaggaggcaagcgggagaggagcggagacucgggagggcgcccgggaugcagagguguccucgguguuucacacagggacgugagggacagaguggggagcccagcggaggaaucgagcuuccagaagaccuagaguccugggucaugggaagggcuuuaccgagaggggagacaggcgugggaaagguggugugagcggggaggaggagagauacccagcgccauccacgcugcauuccccgcaggaugcaggggaaugggcugagcggaguccagccgcaggggaagugcuggguggggggugacucuacaagaccgaggugagaaaaccaagcugggaggagugagaaagccccacgugggugccacgcgcggggggaggagccugcgcuuccaccaaggggcaggaggaccccgcugcgcuaaacgcuggcagucuggaccccaaagucccaguuccucucaggguggcuggggaaaccccagcguccggcggccucaucccccucccuucccuuuccuucccaugcccccggcggaggcggggaucgcucgcggagcccggggcgagacggggcaggucugguccccgcccuccuggcugcggcgccucccgcccuccucaccccagcuacgggcggggcucccacucagccggccccgucggcauccaugcgaggacccaggcgucccgcgugguucagagccuuggggaagaucccucagguuucacugacucuugggcggugugggcuugcggguucccugcccauuucugcgccaguuuacagcuccagcccaaugacgcgcacuccgcacccaagucucagccuuaccuuaucuuccguggcuucaccuucguuguagagguuccuuuaacacugacaccuccaauccucuucuccccaacaaaugcacaugugucucgucucgcacgugucuccccaucugccucuuucuuuucgucuccguuagucuuucuguccacgcaugggucuccugguuuuugucucuccgacuauuuucucucccuuucuauuuuucuccuccacgguccuguugccucgucuccgucucugacaucuccccgccucucccucucugcaucacccuccaacccuuccucucccuccucucugucuuccucccuaucugucuuccccagccaaggcucugccuuuccuuugggguuugcugaguaaccuccgggccaagaauagggcuuacuggggcuggguggggagggagacuggggaggaggaggaggaucgaagggggccguaggggagggguuuccucugccuuucucaccagucucuuuucacacccccacuaugggaggcuggaagcaguugccccaguugauccagcaguucauggccuguucccucauccccauccccaaacuuuuccuaaacuagaaaauaccuuggcugggcgcgguggcucacgccuguaaucccagcacuuugggaggccaagguggguggaccaccugaggucaggaguuggagaccagccuggccaacauggugaaacccggucucuacuaaaaauacaaaaauuagcugggcgggguggcgggcggcgccuguaaucccagcuacuugggaggcugaggcaggagaaucgcuugaaccugggaggcagagguugcuaugagccaagaucgcgccacugcacuccagccugggcgacagaaacuccaucucaaaaaaaaaaaaaaaaaaagaaaagaaaacaccuuaauuccuuuucuccccacuacagccauuccuacccagaaugaacuucacuuucccuaaccagcuggggaagggaguuaaggguggaaaacuaauaauaaaaauaaguagaagaaucacuuagggguuaagagcacagucucuagcugggugggugugguggcucaugccugugaucucaacauauugggaggcugaggcgugaggaucccuugagcccaggaguuccagccugccgugagccaugguugugcuacugcacuuccgucugggggacagagugagacccugucucuugggggaagaaaaaaaaaaagcacagucucuggaaugagacagcuugaguuugaaucccagucugcagcuaugugaccuuggggcaaauuacuuaaucucggugccucaguuucucaucuauuaaacggguauaauaauaguauaagguugugagguuuaaaugucuucaucuuuguaaagugcuuuagauagcaucugguaaauagcgcuguuuugugguuuuuuguuguuguuguuuuugagacagagucuuacucugucacccaggcuggagugcaguggcgcaaucucggcacacuauaaccucugccucucagguucaagcgauucucaugccucaaccucccaaguagcugggauuagagccguccggcaccaugccuggccaauuuuuguauuuuuaguagaaacgggguuucaccauguuggccaggcuggucucgaacucccgaccucaaguaaucaauccaccucggccucccaaagugcugggauuacaggcgugagccacugcgcccagccagcacucuuagacguauacaugauugagugaccaguguaugcagaauuggugccacauggcuugaccugggucaucuaauuucccacuauaauacuggaauggguucuagagucacucugucuugucuuacaccuggcucagagagaggaauucacuugcccaagguuacacagcgcuuaaauuaggagagucugugugggaaugcagggagcuuaauguuauugcuguuuuucaaagaauaacaggaaacugacauucagaaagaggguguuaacugcccauggucacacagccaagaggcagcagaggcacuaucugaguccaaagccugugccuuugauccuuacucugcauuuuaggggcucuugcauuuggggcaaggaaggccagagcaaacagagugguuccccuuggugccagccuuagucgacuugagagaugaugcuacaugagagaggaaugugguuaggaccuauuuuacagaggaggaaacaaaccuagggggagaaaccacuuccucaaggucacacagcuaaaaaguaucacagucagggcugggcgugguggcucacaccuguaaucccagcacuuugggaggccgaggcggguggaucacgaggucaggagaucgagaccauccuggccaacauggugaaaccccaucucuacuaaaaauacaaaaauuagcugggcaugguggcaugagccuuuagucccagcugcucgggaggcugaggcaggagaauugcuugaacccuggaggcggagguugcagugagcagagauugcgccacugcacuccaagccugggugacagagcgagucuccgucucaaaaaaaaaaaaaaauucauuuaaauaaauaaauaaauaaauaaauaaauaaauaaauaaauaaaagguaucagagacugacuccaccccagagcugucagcuccaaaacuccuagaguugggagcaccagcuccccucaccucugccaaaccccugaucgccucccuucauuucucccugcuagaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccaggugaggacaugagccagaaggaaggucagggcaugggcuggagagggugagcugugaccaaggggguggcugugggucggcugguuacaagguccaccuagauggucccugaaggauagaagaacacaaaccauacaauccuagaacgcuuuuuuuuuuuuuuugagacagugucucacucuguugccaagcuggagugcagugguaugaccucagcucacugcaaucuccgccuccuggguuccagugauucuccugccucagccucccaaguagcugggauuacaggugugcgccaccacgcccagcuaauuuuuguauuuuugguagagaugggguuuuaccauguuggccaggauggucucgaucuccugaccucgugauccaccugccucggucucccaaagugcucagauuacaggcgugagccacugcgccuggccucuuuuuuuuuuuuuuuuuuuuuugagauggagucuugcucugucgcccaggcuggaguacaauggggugaucucggcucacugcaaccuccgccuccuggguucaagugauucuccugccucagccacccgaguagcugggauuacaggcaugugccaacacgcugggcuaauuuuuguauuuuuaguagagacagaguuuuaucauguuggccaggcuugucucaaacuccugcccucaagugauucuccuaccugagccucccagagugcugggauuacaggugugagccacugcacccggaaccuagagcacuuuuaaauguucagacucuuugcauccuaggauguuaaacacuuagaaggcuggaaucuuaggaguuggacucuuuaaggacacaggauucuugaaaguuggaaucucugaaaagguugggggcucuagaaucauucuguccaauaugacagccacuagucacauuuagcuugauuaaaauuuaaauuguuuaaaauuaaauuaaaaauuuagggccaggcauaguggcucacaccucuaaucccagaacuuugggaagccgaggcaggcagauugcuugagcccaggaguccgagaccagucugggcaacauguugaaacuucgucucuacaaaaaauacuaaaauuagccuguuauggugaugcgugccucuagucccagcuacucaguagucugaggugggaggauugauugagcccaggaggucgaggcuguagugaacugugauugcaccacugcauuccagccugggugauggagcgagaccgucucaaaaauauauauauauaggccaggcgugguggcucaugccugcaaucccagcacuuugggaggccaggguggguggaucacuugaggucaggaguucaagaccagccuggccaacaugacgaaacuccaucucuacuaaaaauacaaaaauuagccaggugugguggcaggcaccuguaaucccagcuacuugggaggcugaggugggagaaucgcuugaccccaggagguggagacugcagugagcggagaucauaccacugcacuccagccugggcaacagagcgagacucugucucaaaaaaauaaaaaugaaaaagaaauccucauucucacuggccauauuucuaguacucuauagucacaugugguuagcagcuacuauuuuggauguugcagauaaagcacauuuccagaaaguucuuuaggacagcacugcucuagaagauagggagcuuccaagaggacuggggcaucuggaagggcuggaggcucuagcaguuucuaugagcuagaauccauaucagagggaauguuaacucauaggaugguagauuucagacuuucacagugagagaacuuuguccuauguuagcuuggcuucuuggagucuggggaauucagcuuuauucugcagucccuggaguggacuauccagccccagaaaauucuucuuuuuuuugugugugugugugauggaguuuugcuccuguugcccaggcuggagugcaauggcaccaucuuggcucaccacaaccuuugcuuccuggguucaagcgauucuccugccucagccacccgagcagcugggauuacaggcaugcaccaccacaccuagcuaauuuuguauuuuuaguagagacgguguuucuccauauuggucaggcuggucucgaacuucugaccucuggugauccacccuccucggccucccaaagugcugggauuacaagcgugagcgacugugccuggcccagaaaauuauucuacacagauguuggguaccugcagcaucuaggugcggcauggcagacucuuggguuuauagaacauuagucuucuaaagcuucucaggcucuagaaguggaaaucuugggauauuaucaaacauuugaaucacaaaaugacuuuuuuuuuuuuugagacagagucucacucugucacccuggcuagagugcaguggugcaaucucggcucacugcaaccucugugucuuggguucaagugauucuccugccucagccuccugaguagcugggauuacaggcgugugccaccacgccuggcuaauuuuuguauuuuuaguagagacgagguuucacuuuguuggccaggcuggucuugaacuccugaccucaggagauccacccgccuuggccucccaaagugcugggauaacaggcgugagccaccgugcccagccggaaucauuagaaaugacuucuaaguuacugagaauucagggugucaaauuugcagaaccguaugcucaguaaaccccagaauguuugcagcagaauuuuauuuuauuuauuauuauuauuuugagacgaagucucguccugucgcccaggcuggagugcaguggcgugaucuuggcucacugcagucugugucucccgggcucaagcaauucuccugccucagccucccaaauaguggcgacuacaggcgugugccaccaugccuggcuaauuuuuguauuuuuaguagagaugggguuucacuauguuggccaggcuggucuugaacuccugaccucaagugauccacccaccuugggcucccaaagugcugggauuacaggcgugagccacugcgcccggcccagaauguuagcagcagaauuuuagcauugugggcuguccacgcugaguggggcuuagcauuucaccaaugaggaaacaggccucgagaaggcaagaaaacaccuucggcugagcugugugaaggugacuugaccgcagccugagcuuuuucuccaccccuccucucauggguacuguuggggaggaugggugccacaggaccacacagguggcugucugagaggguagugccugggaacuuucuggaagccuguuuggggaagcagauggggugaaggauucaguuaguguauguggggucgugacaccaucuacccacugucucucuccugccuucaucauccucuagaaauacagcaacaauuccuggcgauaccucagcaaccggcugcuggcacccagcgacucgccagagugguuaucuuuugaugucaccggaguugugcggcagugguugagccguggaggugaggauuacuugugugucccaccccuguuucucccugggguccaccccauuguuuguccuggggucacuuugccuaggaccccucuccgccccauacuggugugaaagugcugagaccuggcuccccucuguggcauggaaaccugagugauuggcuaaucuguuuccugagcaccucucugcccugcccugugaugggugaugccaaggacacagcaaugaccaaaacagccccauccuugcccucacagagcucauauaguccauuggcuagguagcuggggaacagaccuguaaggcagugaugacccagagugggugggacugggauggggagcccaaaggagguaccugacccagcccagaaucagggagggcuuccuggaggaggggcaccauagcugauguugaagggaugaguagaauggucaggaaaaggagagguguaagaguauucuggggcugggcaugguggcuuaugccuauaaucccagcacuuuugaaggccaaggaggauggaucacuggagcucaggaguuuugagagcagccugggcaacauggcgaaacccggucucuacacaaaaauacaaaaauuagccaugcaugcuguuacgugccuguaguuccagcugcuugggagacugaggugggagaaucaccugagccugggaggucgaggcugcagugagucauaaucacacuacugcaauccagccuacaugaaagagugagaucccaucucaaaaaaaaaaaaaaaaaaaagauuccaggcaaagggaacagccugugcaaaggccuggaggccagggagagccuaacuaacucauuugaucuguccaggagaugauugucucugucugguuucuggcagggcccauggugccccuaucucucucccucaccucccucucauuuaugcuuuuauucaauaauugcccacagguuccugcugugugccuggccaugugcuggguggugugggggacauagugauaaccaagacagcccucaguucugcccucauggggcccacagucacuucuggacaccuaagagaucuugucaaggccccaccaggcaggaaugaccuagaaugaucaagaaugggauggggaggcaccagcagggaggacaaggcugggacagggaggcaugcaggaugggggaacgcccuaagugcuguugggagcccagagaaggcaccuggacccaucuggggagucuaggagggcuugcugggugagggugauuguguggagacucacaggauaaauaguaguuuggccacaugaaaaaaaagggauuagggggccuggcaugguggcucacgccuguaaucccagcacuuugagaggccgagguggguggaucaccugagaucgggaguucgagaccagccugaccaacauggagaaaccccgucucuacuaaaaauacauaauuagcucggcguggugaugcaugccuguaaucccagcuacucgggaggcugaggcaggagaauugcuugaacccaggagguggagguuucagugagccaagaucgugccauugcacuccagccugggcaacaacagugaaacuccgucucaaaaaaaaaaaagaaaagaaaaagaaaaaauagggauuagggagcaggugggcacugggaggaguguccugggcuguucgacaaaggccuagaaggagcucaucugucuuggucaaugcugagucccaagcacacagcacaggcuucggcacauuguaggagccuagaaaacaucauucacucauucauucaagagauugaugcuggcugggugcaguggcucaugccuguaaucccagcacuucgggaggccagggcaggaggauugcuugagcccagccugggcaacauagugagaccucugucucuacagagaauuuaaaaaguagccguguaggccggaugcaguggcucaagccuguaaucccagcacuuugggaugccaaggcaggcggaucaccugaggucaggaguuugagaccagccuggccagcauggugaaaccccaucucuacuaaaaauacaaaaaauuagccgggugugguggcgcaugccuguuaucccagcuacuugggaggcugaggcaggagaaucguuugaaccugggagguggagguugcagugagcugauaucacgccacugaacuccagccugggcaacagagccagacuccaucucaaaaaaaaaaaaaaaauuagccaugcgugguagcacgcgccuguggucccagcuacucgggaggcugagaugggaggauugcuugggccuuggagauugaggcugcgagaccuugucucaaaaaaaaaaaaaaaaaaaaaaagagagagcugcagugagagggcagaguggggugggugggggaggcaggaaggaagccccugggguuugcuccuuccuuccucuuccuccaggggcugggugagcugcacucucagacuggcuucccucucgccacuccuacaggggaaauugagggcuuucgccuuagcgcccacugcuccugugacagcagggauaacacacugcaaguggacaucaacggugaggccugcuuccccggccaugcccaguugugacgugugugcguguguguguucccaucugccccacgccccacuuaucuaucccucugagaguguguguguauguccccuauccccugacucccacaccaaagcaggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucaggugagccuuguagccuggauggaggccuuccaggcugggggcaugacugccaucugcugaccaggugcuccagguuggacaccuggcugcugcugugcuugggcugagcaucugucuccuuuagcuuggagggcucaggggaugaggucuggguguaagaaccaggagucuugugccaggugcgguggcucacgccuguaaucccaacacuuugggaggcugaggcagguggaucaccugaagugaggaguuugagaccugucuggccaacauggugaaacccgucucuacuaaaaauccaaaaauuagccaggcguggugggcgccuauaaucccagccacaaaaaacaaaaaaagaacugggagucuuguaauguugggaucagguuccuuuuuuuuuuuuuuuuuuuuuuuuugagacagagucucgcucugucaccugggcuggagugcaguggcgcuaucuugauucacugcaagcuccaccucccggguucacacgauucuccugucucagccucccgaguagcuaggacuacaggcacgugccaccacgcccagcuaauuuuuuuguauuuuuaguagagaugggguuucacuguguuagccaggauggucuccaucuccugaccucgugauacacccaccucagccucccaaagugcugggauuacaggcgugagccaacgcgcccggccuaauuuuuuguaucuuuaguagagacuggguuucaccauguuagccaggauggucuugaucuccugaccucgugauccgccugccucagccucccgaagugcugggauuacaggugugagccaccacgcccagccuugcuuucuugcuggaguguuggaaucacagaauguuagaaaguugaacccugugauuguuggaauucaaaguuggaaggucaccaucuugaaucccuaaauuguuggcagguugagguucuagaaugcugggauucuagaaugcuagaauuugguguuaauuacugaaauggaaaaugucggacucaaggaaagcugaaacauuggaauccuagaauuuggggauucaaaaugggaagauggcccauguggaauuccugcaccacuggccaauuguggauaccaguguuggcagauuggaguccuugaauauugggcucacagugguagaauucuguuuugaaauauucacauccacaaauguuggaguuggagaaagcagaauauugguaucucagcauguuggaacucaguguuggaauguuagaauauuagaaugcugggauuuuauuaauagaaaguggcagcaggcugggcgcgguggcucacgccuauaauuccagcacuuugggaggcugaggugggcggaucccugaggucuggaguucaagaccagccuggccaacauggugaaaccccaucucuauuaaaaauacaaaaauuagccaggugugguggcuggcaccuguaaucccagcuacucggcugggauuacggcuauccagguacccaggcuggggcaggagaaucacuggaaccucggggguggagguugcagugaaccgagaucgcgccacugcacuccggccugggcaaugaugcgagacuccaucuaaaaaaaaaaaaaaaaaaaaaaaagaaagaaagugucaguuugaaccucuugagugauggcucagaacuuuggaauguugggaugcaauacuggcauacuggaauucaggaaugccaagauccucaaagguuggaaagggggaauccuagagaguugaagaugcugucagaauguuagaaucauaagaugcuggaaugcuaauacugcaaucuaagaaagcugaaauguuggauuccuagaaaguugaaauggagaguuagaauguuguaaauuuagagugaucaucugaccuuauuccucccuugcuuaaaauauuuugguccugucucugggcuuuguuaccggcuguuucccugccagaaaaucagcccugcucccaggcuccuucaccaccagaucuuagcgccaucagcccagcaacgcugucaaugaacaaauugaggucuuuuuugagacagagucucgcucuguugcccaggcuggagugcaguggcgugaucucggcucacugcaaccuccgccucccagguucaagugauucuccugccucagccuccugaguagcugggauuacaggcgugugccaccacacccggcuaauuuuugguuuuuuuaguagacacuggguuucaccauguuggucaggcuggucucgaacuccugaccucgugauccacccgccucggccucccaaagugcugggauuacaggcaugaaccacugcgcccggccacaaauugaggucuugagugccaacagcuccugacauuacaaagggagauagccagccaugucagccuccguagggagggacccaauguugccuaggaagucuuggcaaaaaaucaaaccugaaggccaggugcgguggcucaugccuguaaucccagcacuuugggaggccaaggcaggcagaucgcuugagcuuaggaguucaagaccagcuugugcaacauguuaaaacccugccucuguacaagaaauacaaaaaaacuagcuggcuggguggugugugccuguagucccagcuacuugggaggcugaggcaggagugcuugagccuaggagguuguggcugcagucagccaggaucacgccacugcauuucaggacagagcaggaccuugucucaggaaaaaaaaaaaaaaaucaaaccugaaucugaucaggacuguagauccuaacaguuuucuagaaagacaggaacagaggaaauggucagcaaaacucagacugcaagaaaccucacccaguuucuucaucaaauacaaugcaaagaaggggaaagcacacacacacacacacguaccccccaugcaaccaaaaauucacauacaaguuuugacuccccaaaaacuuaacuauuaauagccuacuguggacuggaauucugcuuuauccacaacauaaacaguugauuaauacuuuuuuuuuuuuuuggagacagagucucugucauucaggcuggagugcaguggugcggucucggcucacugcagcuucugccucccggguucaagugauucucuugcuucagccucccgaguagcugggaccacaggugcccaccgccacgcccagcuaauuuuuuguauuuuaguagagaugggguuucaccguauugcccaggcuggucuugaacuccugaggucaggcaauccgcccaccucagccucccaaagugcuaggauuacaggcaugagccacugcucccggccgaauaauacauauuuugcauguuuuauguauuauguccuauauccccuuuuuuuuuuuuugagacggaguuucgcuguugucacucaggcuggaguguaauggcacaaucucagcucacggcaaccuccaccucccggggguucaagcaauucuccugcuucagccuccugaguaguugggauuauaggcaccugccaccaugcccggcuaacuuuuguauuuuuaguagaggugggguuucaccauguuggccaggcuggucuugaacuccugaccucaagugaucuacccgccucagccucccaaagugcugggauugcaggggugagccacgcacccggccguauucuuuguuuuuuuuuuugagacagagucuagcugugucacccaggcuggagugcagugaagugaucucagcucacugcaaccuccgccucccagguucaagcaauucuccugccucagucucccaaauagcugugauuucaggcauccgccaucgcacccggguaauuuuuguauuuuuaguagagacgggguuucaccauguuggccaggcuggucuugaacuccugaccucaggugauccaucagccucggccucccaaagugcuggccuuacaggcuugaaccacugcucccggccuaugccugcauuuuaaaaauaagauagagaaaagaaaauguccuuaagaaaaucauaaggaagaggaaguauauuuuccauucauugaguggaaguggcuuaucauaaaggucuucauguugaguaggcugaggaggaggaagaaaagguguuggucuugcugucucagggcagagguggaagaaaaauucaccuguaaguggugaauuuuguaagaggacccauguaguucaaacccauguccaagggucagucuauauauaguugacccugaauauauauacagagagagagagagaugauuuuguagauuuugaaaaaaguccuaagagaggccagguaugguagcucacacccguaaucccagcacuuugggaggcugaggcagguggaucacuugaggucaggaguuggagaccagccuggccaacauggugaaacccugucuguacuaaaaauacaaaaaucaggccagcugucguggcucacaccuguaaucccagcacuuugggaggccaagguggguggaccaccugaggucaggaguucgagaccagucuggccaacguggugaaaccuccucucuacuaaaaauucaaaaaugagccaggcgugguggcgggcccuguaaucccagcuacucuugaggcugaggcaggagaacugcuugaacccaggaaguggagguugcagugagccgaggucgcgccauugcacuccagccugggcaacaagagugagacucccgucucaaaaaaauaaauaaauaauuaaaaauacaaaaauuagcaggguaugguggcaggcgccuguagucuuagcuacuugggagacugaggcaggagaaucacuugaaccugggaggcacagguugcagugacccgagauugcaccacuucacugcauccugggugacagagugagacuccaucucaaaaauuaaaaaaaaaaaaaaauccuaagagacauaucaaccaauugcaauguguagaccuuacuugaauccuuauuuacacaggcuuaaaaaaaaaagauauuuaugagacaguuggguaaaugugaacucugucuagauauuccucuagauaucaaggaauuguuaauuuucuuacaugguauugugacuguguuuuaaaguagucuuaauuagagauacauuugaaauauuuauggaugaagcaacacgguggauugcaugugcuuugagauaaaccauugucggcuggcugcaguggcucacagcuauaaucccaccacuuugggaggccaaggcaggaggauugcuugagccuaagaguuggagaccagccugggcaauauggugaaaccccaucucccaaaaaaaaaaauaugaaaaguagcugggccuggugguguguaccuuuugucccagcuacucaggaggcugaggugggagguuggcuugagccccaggagcuggaggccacagugagcugugauugcaccacugcacuccagccugggugacagagugagauccugucucaaaaaaaaaaaaaaaagagauaguggauagggguagagaugcaauggaaauuggccaugaguuggucauuguugaagcugcuuuuguguacaucugaaacuuuccagcuggacgcgguggcucacaccuguaaucccagcacuuuggaaggcugaggcggguggaucacaugaggucaggaguucgagaccagccuguccaacauggugaaacccugucucuacuaaaaauacagaaaaauuagcuggguaugguggugugugccuguaaucccagcuacuugggaggcugagccaggagaauugcuugaacuugggacauggagguugcagugagccaagauugcaccacugcacuccagccuggggcaacagagcaagacuccaucucaaaaaaaaaaaaaaaaaacuuucauaggaaaauuuguucuuaaggcagcucgaacacuaccuccuuccuaaccccuuucuccaacauccaagauggaugugaggccucugggcuccccuggggcccuaaguagaucuuugacucaacaaacagucucuguugggucuuuuauuuauaaaaaguuuuguagcgacagggucucacuaugcuccccaggcuggucuuaaacuccuugggcucaagcgauucaccggucuuggcuucccaaagugcugagauuacaggcgugagucacugcaccuggccuaggucuugagagacuggacggaagaggcuuggcaagggcaagggcuguggguaucccaaggcccggugcaggguaggccccgaaugugugcugaaaaaaugagucagaggaucaccuagacggcuuguucaacacggacuguuguucccaguccugcacacaauuucugauuucaguggccuggggugccaccugagaaucugcauuucccauaguucccaggugaugcugccgcugguccugggagcucacguggagagcugcugacuuggauaacaguaucacagauuguucaaauccuaggaucucagaaccccagcuaggguugaacugcauauuaaagaugauucugagccgggugcgguggcucaugccuguaaucccagcacuuugggaggccgaggugggugggucaccugaggucaggaguuugagaccagccugaccaacauggugaaacccagccucuacuaaaaauacaaaaaauuagccaggcaugguggcacaugccuguaaucccagguacuugagaggcugaggcaggagaauugcuugaacccgggagacggagguugcagugagcugagaucacaccaucgcacuccagccugggcaacaggagggaaacuccaucucaaaaaaaaaaaaagauuccggacacuaguucuuccccuuuugugaguucagaacuuccugugagaaagugaaagccaggacucuuuuucccagaaauacaugcauacauacacacaugugcauaugaucucaggcacucauggcccucccuaagccugcccaugauggccccuuggcccucagcuuaacaccuuauuuuaucuaguagcuccuaccucugaacagaugaggaaacugagguccaaccaaauugggugguacgggcugaguucacagggaucucaguuucuugacuuccuucucaggcuucuguggcucuuggaaaggcuuuaucuugccucuagguuauccggugccacuugaaguuggguucaagcgauucuccugccucagacuccccaguagcugggauuacaggugcccgccaccagguccagcuaauuuuugaauuuuuaguaaagacaggguccucaagucugccugcccuagccucccaaagugccgggaugacaggcgugagccaccgugccuggcuggccccaccaaucuaugagcagagguugcagugagccaagauugcaccacugcacuccagccugggugacggagcaagacucugucucaaaaaaaaaaaaaaaaaaaaaaggcauugucaacuuuuucuuuucuuuucuuucuuuuuucuuuucuuuucaagacagagucucacccuguugcccuggguggagugcaguggcacgaucuuggcucacugcaaccucugcuucuuggguucaagcagauucuugugccucagccuccugaguagcugggauuacagacaagcaccgccacacccagcuaauuuuuguauuuuuaguagagacgggguuucgccauguuggucaggcuggucucaaucuccugaucucaggugauccacccgccuuggccucccaaagugcugggauuacaggcgugagccacugcacccggccucuuugacaguucuaagaaguaaaauaaaccagaagaaggcaggcagagaguaauagauauugggaacuguuauuuuuccuauucugauuuaaauuccuuuauuauggaaaauuucaaauguauacaaaagcaaugaagauaaugaaugcccguaaacucucauccagcgucaucgguaauuaagauuuugccccauuucaaaugcagacauuuuuauauuuucuugcauaacugcaauaccguauugcacuaaauggaacuaacagucacuuggauauuuuggaaaggauggcucagaaagguaucucugaggaggugauguucagucauguaacugauauuuacuaguaccuacugcauuccagacacugcuuuaggaguuaagggucccugagugaaggacauuugagcuaagguuuaaaugaagugaaggggccaggugugguggcucaugccaguaaucccaaugcuuugggaggccgaggcgugcggaucguuugagcccaaguucgacaccagccucagcaacauagugagaccgugucucuaaaaagaauaacaaauuaaaaagaauaaauaggccagaugcaguggcucaggucuguaauaccagcacuuugggaggcugaggugggcggaucacaaggucaggaguucgagaccagccuggccaacauggugaaacccugucucuacuaaaaagacaaaaaaauuagccgggcaugguggcacacgccuguaaucccagcuacucggaaggcugaggcaggagaaucgcuugaaccugggaggcggagguugcagugagccgagaucaugccacugcacuccagccuggcagacagagugagacucugucucaaaaaaaaaaaaaaaaaaaaauagaaaaaaaaagaagaaaugaagugaaggaacaagcuggaguggguaucugugggacuagcaaggcaggcagagggaacagcagaugcaggagccccgaaauaagacugucugaggaacagacaggacgccaguguggcuggaguggaguaggcgugagagagggaguugagaucagccagauuugauagcaccuuguggcucacggugaggacuugggcauuugccgugagauggagccagguucagagcagaggagugacaagacaauuuauagcaugcccauggagggcagagauuucugucucuuuuuuaaaaaaauugaaaaaaaauuuuguagagacagggucuugcacuuuguuguccaggcuggcaugcagugguguuaucauaguucacugcaaccucgaacuccucgacuccagcgauccucccacuucauccucccaaagugcugggauuaaaggugugagccaccaugccuagccuauuucuaucuguuucauuuguccucaguccacaguagaucccagcccagcacacaguaguaguucaauaaacauuuguugcacaaauagagcagaucaguuuacauggagcuguguuauuuuguauguuccaggguguggcaugccaugauuuauuuagcccccccguggauggucaucuggcuucuuacaggcuugucuuaagcauugcgugaaauuaauuauuacauugcucuuagcacuggaggaagugcuuaaucuguguuagugauuaucaugacuauuuguguuguuauuaacacagugggugcaagggagacccagauggagauagggcugggggggcaaccuagggugacacacgcaccuggggaggaggggcauguggcuucuauggugguagccccucccugccccugacgcgucucuccugccugcagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguacgucuggcccaccgggcuacgagaugcgcuuggggggagccaggacggaggaagaggagagagaaagagaaguaaagucagagaggugaguuggcaggauggggagaaagagagggaugggguggggaggggaaugaauaaagagauggggagagaggcaggaagcuagagaggggcucugagcaggggccagagggagaugagcuaugaagacccacagagugaaguaacagagggaugggggugaaggggagaagagagacagggagauggaaggaaaaacgcagaaauggagagacaaaaugagagagacagauacagacacagaguuaggccaaggagagacaaagacagauacacaacaaggcaagaggcgaagaugaggagggacagagacugagaaagaaaaucaggcgggcgcggcggcucacgaugguaauaccaacacuuugggacgcugaagcaggaggaucgcuugagcccaggaguucgagaguagcccaggcagcagacugagaucccaucucuaccaaaaaaaaaaaaaaaaaaaaaaaaaaagcuaggagugguggcgcuugccugugguuggagcuacuccggaggcugaggcgggaggauggcuugcgcucaggagguugaggcugcagcgagccaugaucgugccacuauacuccagccuggguggcagagcgagacccagucucaaaacaaaaagaaaaucagacagguggggagagacagaauaagauaggauguuagaagauaagagagaccgaauuggagaugggaagaggggaugcggggagagacgaagugagagaggcuggcgcgguagcgggugggggauggggcaguggagggccguuuuccucccuccacgagcccugagcccugaccccgcccgccgcccgcagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggucccgccccgccccgccccgccccggcaggcccggccccaccccgccccgcccccgcugccuugcccaugggggcuguauuuaaggacacccgugccccaagcccaccuggggccccauuaaagauggagagaggacugcggaucucugugucauugggcgccugccuggggucuccaucccugacguucccccacucccacucccucucucucccucucugccuccuccugccugucugcacuauuccuuugcccggcaucaaggcacaggggaccaguggggaacacuacuguaguuagaucuauuuauugagcaccuugggcacuguugaagugccuuacauuaaugaacucauucagucaccauagcaacacucugagaugcagggacucugauaacacccauuuuaaaggugaggaaacaagcccagagagguuaagggaggaguuccugcccaccaggaaccugcuuuagugggggauagugaagaagacaauaaaagauaguaguucaggccaggcgggguggcucacgccuguaauccuagcacuuuugggaggcagagaugggaggauuacuugaauccaggcauuugagaccagccuggguaacauagugagacccuaucucuacaaaacacuuuuaaaaaauguacaccuguggucccagcuacucuggaggcuaaggugggaggaucacuugauccugggaggucaaggcugcag

SEQ ID NO: 61618 - RNA, 68836 nt, Homo sapiens
ggccauggucagcgugaacgcgccccucggggcuccaguggagaguucuuacgguaaguggggcugggggaagacuggacagggcgggacugcggucagcuuugggaggccaugggacaccuccccguguguuucuuacgggcccaaagcuccuccuggagcuccucuggaagggcaggaagccccacggaggcaaugugaccgcuucccuaagcucucaagccggggcauggccugcuuggugcgagaagugcugggaggggccgagaagcccuggggcagaggcuuggcucauuuugucuguccagaggccuuccugggaaugcaucucaggggucuuuccaaaaccccacagaggguggggcuuggaagcaccguccuguuucgaugcggggcaaauugagguccaccaggagaggcuugcugggccuaggucacguugcuggugcauuaucaagcugggcgugggaccgggcagcucggucgcuccgcaccuccguuggcucuggauaauggggaggagguagaaagcgccgcgcaggguggagcguuggaaaaugagaauaucuugugcggacgugugaaacucagaugcagggcuagaaagcauguguuacugagagugaaaggcucaggcucacuccuuagggugacccccacauuggaagcaacccaaugucccucagcagagggaagacggguaaauaaagcgugagacgucuuuacaguggaaugcuaucccauuguucaaggaaacaacgcacaucugugugugacagggaagaaccucucaguuaaauuaagugaaaacgguacacugaagaacuguguaguugcugauagcgaaacggauauagauguauauauguacacacgcguauacguguacauuccacgcauagaaaauucguggaaugacacaauaaaauuggugacagguuuguuucugaggagggaaauucaagagaauguuuuaucuuuuggggacacauuuuggauuuuuuaaaaguugggugccuuuuauaaaccuguucaaaucacacacccgcacagaacuuggucucuggaauccagcagaccucggggucuaguugugacucugucacacggcucaacauucacgugccucuugcuuucuuucugaaguggagacaggacuaggaugugucuuaagaucaugguggaugccguggggaacaaggauguaaagcccuugauaccacgugcauugcaaagacacaaucaacauuuaugucaucaauugcugaggacagagggccagggaaugacagaaucagggccugaucuccugacucuagucaggaagaaucuucuuugcuuugacccccaucaaacaggaauaugugaugcacuggaaauggcagaggcugaagaaaccaacagccugggaacccaucccacacaccagcugugugaccuugggcaagacauuuccccucucugaaccuauuuccucaucuguaaaaugaagauaacaacaggaccuaucucccagagagcggggagauuagaggagauagcauagaggagauuaagggugaggccacccuuaauccacaauuuuaagaccuggaguauagaugccaauggaugacuugguugaaccuguggcuaggggaagacauugucucucaaaggggccagacagcuucuggggaaggacagcccaggucauaaggcuaagcuaggggugaacagaaggccccacagugucucuuaaaggaugauacaauaauauaaccugacagccuuucacugucucccacgucucugcaccuuguaggauguccucaugucucuucaucucugcuccugugucauacucauuauauagcaaacauucagcaauuauuagaaugguugcuucuaucgacagguaggugggugaauggauggaugaauggguuagugaauguucuacuauuaucucucagacagcuguuucauuuuccaaacggcugucugagauaaauaauauuguaaucuccaaggacagaagaaaaaacuaagguucaagauuaaaaaaaaaacacaaacaaacaaaaaaugucaucugacucgagacuugacacaauccagcuguugcuggcccucugcucuaggccacagauauggcuggacagagaaaggagaacuccagugaccuugcaguacauccacaaaaaaugagcacuuuuguccuggggcaguggaacauucacugcaguguaugugugccuauguguaugugugugagaguggcugaaagacccugauuugauauuuuugauaaaauacaccuggguuagcauccuagaucuaccuuauuuaaaaaaaaaaaacaaaacaaaaaacuguguggucuugugagucaaaucauuaccccucucugagcuucacauguuuuaucuguaaaaugagcuacugaagucugcuggaaggcuccagaaaaaaaaaaaaaagaaaagaaaaauuugcuuucugagaaaagaaacaagugcuccgaggaaacaaaaccccucucccaggcugggugcaguggcucacgccuguaaucccagcacuuugggaggcugaggcgggcagauaacuugagauuaggaguucgagaccagccuggccaacauggcaaaaccccgucucuacuaaaaauacaaaaacuagccggguaugauggcacacgccuguaauuccagcuacuugggaggcugaggcaugagacucacuugaaccugggagguagagguugcauuaagcugagaucaugccacugccacuccagcuugggcagcagaacaagacucuaucucaaaaaaaacaaaacaaaacaaaaaaacaaaaaacaaacaaaaaaucuucuucugggguucucuaauggggauaacauuaaucaucuccuaagaugacuauaguagaggugcauuggugggucagggacauggcacauagcagagccucaguuagaggcagaggaagacauggcuguugugaggaucaaauggaaggauccaugagugcuuagaacaguccuggguccagagcaagcacgcaagaaauccucguugugguuucauguuuuugagcuuuagcaggauucuaaagagcugcucuuugguguggugaugcuggguggacuuggcccucccuggacuuccggugcuuccacggcacacugguuuuggcuuugcgguucucgucaucgcucugaucagauaguugcuggugugaauuguggugucuggcugccccaccagacuauaaacuccgugaguucugggaccuggguaguuuguucagccuuguuugucucacuaugucucacauggugacuggcacagaagaaaugcucaauaagcauuuguuggaugagugaaaugaugggcuuaaaacagcgcuacaaugaugaucaucaaugucagccagaucccacucucuugccuuccuuccucucugcccuccucacugcguugucuuugguccuuguauuugccccauuauaacccaaacuggcugucccagcuucagcugucaugucugcacuuacgugucugaagcuggaggcaggaggagaagagguuuuccucagugcccuuguuucuuuuauccaaaagcaaaacuuccccagaaaccuccuggcagacuccccuaguucaaggaaagcugggaagacaaguauguaguggaaagagaugggaaagccaagauggaccuagaccagugauuuuucucuugggguguggcacacuccugcuccaaacagaacugaggcucugguauaaaugaguuucucagccucagcacuguuaacuuucuggccuggaagauucucuguggugaggggcuguccugugcacuguaggauguuaagcagcaucccuggccuuuacuccccagaugccaguaacaucucuucccaucaguuuugccaaagaaaaaaugucuccagaaagccaaauguacccuggggcacauauaaccccacuguguuauaggagaacaagguaguucuggggagugucuaccacaauggaguagaguagacugugacucuuguguuguucugcuuugagugccaggaucuugcucagugccaaucugguacuacccugaguaacucugaggaugagaugcuaaacaugcauaucugugugcuaaccugacuccuggccuuauuacuuuucuacccuuauuuucccuuuaacaaguuucccuugguuauuuauuuugcuucuuugguaguugcucauuuccguaaguaccucgaaucuccuuaaaggaaaggucuguaucuaucucauucuuuuuguuauaguccagccuuccacagggccugaucccauguagaccuugauugaagauuaauuaaguggaugaaugaaugggaagauggauggaugaauaaauguauguuuagguggguggauaggugaauggacugaugaaugaaugugaugugaugaauggaugugauagauggguggagggaugcaugaauggaauagagggagaaauagcuggauggaugagacaaaugaaugaguaacuggggagauggcuggguggauagauggguggauggauuaauaaaaagauguuauggguggaugguuggguguggaggaugaugcauggauggguaaguagauggauggaaagauauguaggugcaugugauaaauggaugaauaaguagcuggauagauggguaggugguuaggggaaggauggauggacaaaugaugugaugaguggguugaugaaaagauggaugaauggauggauaagaaggggugggcugagguagccuggaauagcagcaucuucaagugcucuaaacaggacaagugaagagauaggggaugucaacaaucuuccaucagggcaauacuguauaucuguuuuuaagugccaggugagccuaauuuuuccuagcuauguaggccuagucccuuugaccaauagcaucagcuugaggacagaucagaggccauugucggagacaguuuggugauguggcucugccccuugaagcucuaugaugauggugcuuugcuucacuucucugguccucaguuucuucacccaucaaaugagccuugguuguugugaagauuccaugagcuaaugaaagagaaaagguaauagaagcuauaacaaacaugccguguccuugugaaggguggauaggcccaaaaucgaguaggaccccagaugcuggcuggcuaugggaccguguccaauaucaggcuauggcuguucccacccuucauucuuaaaauauggccccucuccagcccuuccccuaucuccccucccacaucaccuucccauccuacgucaauucagucuucagccccuaugauucacaaaccugguugcacauaggaaacuuuuuaaaacaauuuuggggcuccacuccagacccagugaaucagucuccuggggugaguuccaagagucuguaauuuuuugagcuccuugugugacuuaggguaugcaguucaguugagguauggaaaccauugccuuacuuucucccauuuaguaaacagaggaacuaaauauccagagugcaucuugccucaacccagaagccucccguauucauuaauucauuguucauuuguucauuucuucaacaaucuuccacuggaggcuuaugguauuuaagacauuuuguaaggcacuggggaaacacaggaggauaaaacuuugcuucacgugguggcucaugccuguaaucccagcacuuugggaggccaagguggguggaucaccugaggucaggaguuagagaccagguagaggcagagguugcagugagccaagaucacgccacugcacucuagccuggcgacaggagucagacuaugucucaaaaccaaaccaaaacaaaacaaaaccaaaaaaaaacaacaaaaaaaacaacuuugcuucagaucuuaaacugugcucaguuuggcaggaggacagacaagccagcagcaaccaaagacagagugccaugauaaggacagcaaaggcacugugggauacagagggacuuaggagaaggggaaggggucacagacuucuugaccuuggaggaguagacugauaucuaagcuggaaccucgguuuagcaggagucagccgggagaagagacgguggggaagaguguucccagcugagggaacagcauaugaaaaggccuggagccuggccacacacugcucugauuuuacuuauauuugacugcaauuaauuccauccuuuacugaaaguaucuugagacuugucugguuguuucaugauugauuaaucuuauuccuaaaagcaugcugaggcugggcaugguggcuuauuguggauuacacgccuguaaucccagcacuuugggaggcuaaggcggguggaucacuugaggucaggaguuccagaccagccuagucaacauggugaaacccugucucuacuaagcauacaaaaauuagcuggacguggugccaggcgccuguaaucccagcuacucgggaggcugaggcaggagaaucacuugaacgcaggugguggagguugcagugagccgagguuguaccacugcacuccaaccugggcaacagagggaaacuugucuuaaaaaaaaaaaaaaaaaaaaaaagcaugcugagaugcuuaagugaaggaauugugccuuccauuuuuccugacucauaugccuguagcauaaggaugggucaaugauaacgaaaggaauuuguuuucauuuaagccccuuuuauguaaugggcaagauguuggcuauuugauauguuuucucccuuuuaagccuugcaauaacccauccaaguaggaaauauuaucuccauuuuauaaacaaagaaauugagauucagaguuguuaagucacguuucccugcaucgccuugcaaauaggugauuaaaaucuagucugacaccaaaucuucauucuuucagcuauuaugucauaauagcauccaaggaguuuaccaccuucuaccaccuacuagcugugugaccuugagugaaugacucaauucucuuuuuuuuuuuuuuuugagacggagucuugcucugcugcccaggcuggagugcaaugguaugauccuggcucacugcaaccucugccuccuggguucaaacaauucuccugccucagccuccugaguagcugggauuguagcugggguuacaagcgccugccaccaugccuggcuaauuuuuuuuuauuuuuaguagagaugggguuucaccauguucgccaggcuaguuuugaacuccugaccucaagugaucugcccgccucggccucccaaagugcugggauuacaggccugagccacugcgcccggccgacccaaucuuuuuugccucaguuuccucaucugucaaaugggguugaugauaauaccauuuacuucacaggguuguugugagacauaaagucaauauuuguaaagugcugagugucuagcacauagaaagugcuaugugaauuugaacgauuauuauuauuauaccuauagugugugcaucuacuauaugcaaaggacuggaugcuuacuagguguuagcaucauuuuggcuguuguagaaacaacagagaugaguaaggaauagauaacuggucccaggaugcaacugucucuggcuggagacuaaggacaaggcuuuguugcaagccuucuggggcccugggaugcccagggucuccucuugggggugcugguucauagaugggggccuguguggcuccuucacagaggaggaggcagaugagaggcauagaaagggaggggacagaccuauccucaucagagaccugggagauggcucuggcccuggcccuggguagcuguuugugaccucacucaaguccuucuccugcuguuucuccaucuacucuuuuuuuuuuuuuuuuuuuuuugagacagagucucaaugucacccaguggcucuaucucugcucacuguaaccuccaccuccuggguucaagcaauucucaugccucagccucccaaguagcugggauugcacgugugugccaccacaccugacaaauuuuuguagucuugguagagauggguuucaccauguuggcuaggcuggacuccuggccucuugugauccucccaccucggccucccaaagugcugggauuacagguguaagccacagcacccagccuccauuuccucuuuugagaaauggagguaugacaaccaucuggcucagccauugucacacaguauucccuggguccuaagagucaggaaagaugcugcaggguucccuuugaggguaauguggguagggacguguucaaauggacuagggcuuagccucuccccacccuucaaccucuggcuccaucagagacacuucuuuuugacuuuuguauauuucuuuuuauuuuauuuuagagacaggggucucgcuauguugcccaggcuagccucaaacuccugggcucaagcaauccucccgccucagccucccagccccugggauuaccugcucaugccacugcacccggcacucuguuuugacuuuuaaaugaaauauuuaauggagggucuccacaguucaaaaauauuuggaaaaucagaagaccacaccaguguguuucaaacugcaaucuuaacccaggaauaggucaugcaauuuuuuuuuuauuuuuuuuuucuagauggagucuugcucugucacccaggcuggagugcagcggcacgaucuuggcucacugcaaccuccgccuccuggguucaagcaauucucugccucagcuuccugaguagcugggauuacaggugcccaccaccgcggccagcuacuuuuuguauuuuuacuagagacggacuuucaccaucuuggccaggcuggucuugaacuccugaccucgugauccaccugccccgaccucccaaagugcugggguuacaggugugagccaccgugcccagccgguccuucaauuuauugggauuauauuaguucagacaauauagcuuauguaacaagcaaaugcagacuuuaaguuagaaguuuauugaccucuguggcauagucauccagggaccccuaaggucacccuagcccagaaagacacuuucacuucuacucacauuccauuggugagaacuagucacauggcccuugccaaaugcaagggggucuggaagauguggucccuagcggggcgggacuagcuguaaaguuuguaaaggggagcgugaauuaguugguacacaguugaucgucugugcaguagggucaugcucacacgucccuccacacacacacguuaaauauguauaacaaguguaaauauacaauuuaaaaaaguaucuuuuuuuuuugguuuguuuuuguuuuguuguuguuuuugaaacagggucuugcucugucaugugggcuacagugagccacaaucaugguucacugcagccucaaccucccaagcucaagcaauccuuccaucuaagccucccaaguagcugggaccacaggugcaugccaccaugcccagcuaauuuuuuauuuuuauuuuuuuguagugacaggucuugcuguguugcacaggcugguuuccuacuccuguccucaaucuuccugcaucagccucccaaaaugccgggauuacaggugugagcuacugcaccuggccuuuacaauuuuuuacauaaaauguuucaauaaaaaagugcauagauagauacagagauagcaauaaagcaaaugugacagaaugcaaccaguuggugaauuuaggcgaagggauacaucagugcucacuauacuagucuuucaaacuuuaaaguuugaaauuuuucaaaguaaaauauuggagaaaaugaaauucuuaaaauuuacuagaccuauaaguagacuaaaacaauaaguuauaacuaaaguaagauuuggccggacgccguggcucaugccuguaaucccagcacuuugggaggcugaggugggugaaucacuugaccccaggaguucaagaccagccugggcaauauggcaaaaacccaccucuacaaaaaacacaaaaauuagcugggccuggugguacacgccuguagucccaccuacucgggaggcugaggcaagaggauugcuugagcccaagaggugaagguugcugugagccgagauuacaacaccacacuccagccugggugacacagcguaauccuagugcuuugggaggucaaggcagaaaaauugccaccacaccuggacuuaaaaaauauuuuuacugaaguauaacauucaaaacagaaaaaggcacaaaucaucaauguaucgcuuuaugaaauuucacauuuuaacaaaagaaugaaauaaaauaaaauagaaaauaucauagagcauuucauguaguaagaguaagauauguauguuuuugaaacuuuuguuuuauuuauguauauuuauggauuugugcuugauguugugauaauagcaaaaauuuauagaguacuuacuaggguuuuacacauauuaacuccuaauucucaaaaugucccuauuggccgggcgcaguggcacacgccuguaauccuaguacuuugggagcccaaggugggcggaucacuugaggucaggaguucaagaccagccuggccaacaugcugaaaucccaucucuacuaaaaauucaaaaauuagcugggcaugguggcacgcaccuguaaucccagcuacucaggaggcugaggcaggagaaucucuuaaacccaggagguggagauugcagugagccaagaucacgccacuguacuccaaccugggcaacagagcgagauccugugucaaaaagaaaaaaacaaaaaaaacagcauacuuuguauuaggugaacccacaaaguacaggggccaauuguagguaguccacaaacacuuuuaaaucuuugugcauuuauuguauguuagaaaaauuuauacauagcauauuaaagcauuaauauaaaauaucuuuuaaaaauuaagguauaucuucaaaagaaaggaaaacaucaaguaaacaauuauagauaaauaaaguacagguaaaaggcagaugugguaacaauuguaugaagaggaauacaagugucuagggcuugggggccacacacuaaaccuggcaucagaaggcccagaucugggacccggcucauuuguuuucuagcacuagguuguuuuucauccuuguauaacaccauggcccagguacuacucuaagcacuuuauaaaaauuaacuccuggccgggugcgguggcucacgccuguaaucccaacacuuuuggaggccaaggugaguggaucaccugaggucaggaguucaagaccagccugaccaacauggagaaaccccaucucuaccaaaaauacaaaauuagccaggagugguggugcuugccuguaaucccagcuacucgggaggcugaggcaggagaaucacuugaacccaggaggcggagguugcggugagccgagaucgcgccauugcacuccagccugggcaacaaaagcgaaacucugucucaaaaaaaaaaaaaaaaaauuaacuucuuggccaggcacgguggcuaacaccuguaaucccagcacuuugagaggccgaggcagacagaucaugaggucaagagauugagaccauccuggccaacauggugaaaugccgucuuuacuaaaauuacaaaaauuagcuggguguggcacauggcuguagucccagcuacucaggaggcugagacaggagaaucgcuugaacccaggaggcggagguugcagugagccaagaucgcaccacugcacuccagccugguaacagagcaacacuccgucucaaaaaaaaaaaaaaaauuaacuccuuggccagacaugguggcgcacacuuaaaucccagcacuuugggaggcugaggcaagaggcucacuuaagguuaggaguucaagaccagccugagcuacaaagugagaaaauaaauaaauaaauaaauuacuccuuuaauccucacaaccgucuauugagguagguacugucaucauacccauuucugagaaaacaaagucucagagagacuaaauagcuuacucaaaaccacgcagcgcaugagaggcggagcuagaauucaacaucaaggauuguauuagaaaaggcaauaccagcuuaucaacccaaaacacgagaggagaguuuaucucuccuucacgcaguuguccaggguccccaacuccuuccucccuagauggaagaugggcuuuuuuuuuuugagacauaaauauauauauauauguguguguguguguguguguguguauacauauauguguguguguguguauauacauauauauauauauauauauuuuuuuuuuuuuuuuuuuuuuuugagacagggucucacucuguggcccaggcuggagugcggugguaccaucuuggcucaucacaaccuccaccuccuggguucaaacaauucucgugccucagcuuccugaguggcugggauuacagguuugcauuaccacacccagcuaauuuuuauauuuuuaguagagaugggauuuugccauguuggccaggcuggugucgaacucaugaccucaagugauccaccugccucggccucccaaagugcugggauuauaagugugagccaccaggcccugccaggaagauggguuuuauuugaaccacugggcccuacugggauggguagaauuuucuguaucauucugggauccacauccuccucugaaaaugggguuaauaaugcuaguucuauuuaccccucaggguagcucugcugcucaaggggauagaggcaagaguguccugcaaacugcaaaaaguuccuugaauguaaaauguuaguauguauuguuaaugauauugaccaaagcuacauuaccauguuacagugaagauuaauugaaacagugcauggaaagaccuugguucacauacagacaaagucagcugugaguaauagccauaauaguaaugugguuaugcaauuuaaaauauugauuuaucuccaaauugggauauaguuguauaggaucuuucuuacuagcaaguuaacacauuacgucuauaacuaaaaaaucaagaagucuugauuucuugagaagucaguauaaccaugauguuuagaaauacaaacaagaggcugggcacgguggcucacgccuguaaucccagcacuuugggaggccgaggcgggcagaucacaaggucaggaguucgagaccagccuggccaacauggugaaacccugucucuacuaauaauaccaaaaaaauuagcugggcauaguggcgggcaccuguaaucccugcuacuguggaggcugaggcaggagaaucucuugaaugugggagguggagguuucagugagcugagaucacgccauugcauuccagccugggcaacaagagcaaaacuccaucucaaaaaaaaaaaaaaaaaaaaaaaaaaaaacugggccggccacaguggcucaaaaugcuguaauccuggcauuuugggaggaugaguggggggaucguuugaacccaggaggucgaggcuguagugaacaaacaucaugccacugcacuccagcuuggaugauagacugagacccugccucaaaaaaagagaaaggaaaauaaauaaauaaaugaaaauuuaaaaggaaaagaaaauauuuaaacgcuauuucaaacaaucucaaauguaccuggaaacaguugggacaggaagucaugaagggaauggggcagaguuagagaaggucagaguacagccauguuucacaucccagcugaaacuccuccaacagcuuuguaucgcccuucaaauacaaccugagcucuuuuucuuucuuucuuucuuuuguuuuucugaguuggagucucacucugucauccaggcuagagugcaguggcaugaucuuggcucacugcaaccuccgccucccaagaagcugggauuacaggcgcgugucaccaugcccagcaauuuuuguauuuuuaauagagucaggguuuuaccauguugccaggcuggucucaaacuccugaccucaagcgauuuguccaccuuggccucccgugagccgccgcgcccggcccugggcucuuuucuuugaccaaaaggcucucacaggcucugacucuugucugauggucucucgucuuucucccuuuggucacugcagucagccacacuggacuuuuguuuuuuuuguuuguuuguuuguuuugcgacggagucucacucuuucacccaggcuggagugcgguggcgcgaucucggcucacugcaagcuccgccucccggguucacgccauucucccgccucagcccccccaaguagcugggacuacaggcgcccgccacugcgcccggcuaauuuuuuguauuuuuaguagagacgggguuucaccguguuagccaggauggucucgaucuccugaccuugugaccugcccgccucggccucccgaagugcugggauuacaggcgugagccacaacgcccagccacacuggccuuuugacaauccuucaaucacgccaagcacacuccugccauugggccuuuguacuugcuguucucucugccaggaaugccucuuccccagaucuuugcauagcugauuucuucucauugucagggccuuaguucaaauguccuccacucagagcagccucccuugaacacccaaaucuaagccugccccaccuccaucccuugauagcaauuccauuauccucuacagcgcugaaauuacguauuccuugaucuguuuaucaucugucuccuucacagaaguuccaugacagcagggaguuaggcugucuuguccccugcuguauccccagcauguagaacagugcuugacacacaguaggcgccccauaaguauuugcggaaugagcaaauacagauggggacagcugagucaguagggugagcagcuggaugggccaguaguggagggaggaaacggcagccucugccugggccuugcccuggguaaacagaccucucucuccccagacagccacuguuugacgacugucugccaugggccuggcugagccugggccgccaaacugccaacgccucuguauucucugggacaagcaguggaggcagccauaccuccagcagaguuugugaaggagcaggucagaaaguugucaaaacaggcaugacgaagggcagaggagguggggagacagggagagagcaggcggcccugcccugggcagagccagagaaacuggagggaggccugggugcuccccugggcagcuucccaggcaaacccagcugccugcagggcucagcgcugggagcagguuguggucccagcucuagcccugacacacacaggaucucagguacuugacauuuguaggccuuagcuuccuuacuuguaaguuagaggcuaugggcagauuaguggcuuucaaacaauuuuuuuuguuguugcuuuuuguuuuugagacggagucucaaucuugucgccgaggcuggaaugcaaugguucgaucugggcucacugcaaucuccgccucccagguucaaguaauucuccugccucagccucuggaguagcugggauuacaggcgcgugccacuacugcccagcuaauuuuuguauuuuuaguagagacgggguuucgccauguuggccaggcuggucuugaacacagcaagauucugucucuacaaaaaauacaaaaauuagaggcugggcccgguggcucacaccuguaaucccagcacuuugggagguggaggugggcagaucacuugaggucaggaauucgagaucagcuuggccaacagugggaaaucccaucucuacuaaaaaugcaaaaauuagccaggcaugcuggagcacgccuguaaucccagcuacuuaggaggcuggggcaggagaaucucuugaacccaggagguggagauugccgugagccaagaucgccacugcacuccagccugggcgacagagcaagacccugucaaaaaaauaaauuaaagaaaaucccaacuuucaccuccuuuaaaaaaagugaaggucuagcaacacugauaccuaugagacaacagucuccuggagccacuuuagauucucaugcuuccucuaauuugccguaguccccacuauuccuuaguguccccauacggaaacuuauuaaugaacauaaaucaccauguuugcuguauuguuuuucuuagaggaacgugugaacuuugcucacacccuaucuguuccauuuauuucaguuacuucucuggguauugagggcacuugagugugggaccccugaucacugagaccaaagcagaguucauuuauuugcacgagcaaucuucuauuucauagauuuaccauguuuuuaagugacuacaagaaaaguuuaaauuaugucuguggcucacauucuauuucuauuggccagcacuggccgggucccucagauucuauagcaguguacgugugcuugcugcuaacucauucugccuccauuuuccauucuugcguagaccaaucccagucaaaucucuugggcuggugucuucuccccaccccacaguuaucuuuggugccuccacccugguuagcuggccaccugucuguccagaggauccaggcuccagaacuccaggcaugucuucuagaauucuccacaugggaaaucucacucccaggccccaucuggcagccauuguguuuucuuuaucagacauucacauaaaacaauagucaauuugaaagcuaaauacacauccauucuucugucuccagccuguaaauuuaccccaaauccaguaauuugggagguggaguuggugggaagagguuuuuuuuucccccucuucuccagggcaagucauauaguuuuucuggagaugagguggacugaguuugggggaagaacacagguccaucuacagugaaagcgcugacuuuguuuuuggagaagauggugucauggcuucucuggggagaugagaugagggaauccugaagacuuagggggccgggaggaaaaggaaucuuggcaaugaugaagacaccuucaaaugaaggggcuaauaggguaguggcugagaauuugugcugcagucgggagggcuuggguuagagcuacauccacaguaugaccuuggacaggugacuuuaucucucugauccucagucuccucaucuguaaaauaaggauaagaauagacuugacuuccacuucaacgagaagugaaacgagauauccuaccacugcgcuuugcacauaaaggcucuauaaaugucagcugucaucauaaagagccaaaaguggcauuuggaguaaaucugauuuguuuuuaagagauaggguuuugcugugucacccgggcuggagugcaguggcauagucaaaacccacuacagccucaaauuccugggcucaagccauccucucgccuaagccucacaaguagcugggacuacagacacacaccaccaugccugucuaacguuuacuuuuuaauuuuuuuaaguuuuaaaauuuucuguagagauggggucuuacuguguugcccaggcuggucucaaacuccuagccugaaaugauccuuccaacucagccucccaaagcacugggauuacagguguuagccaccacacccagccuaguuuaauucuuuuuuaaucauccuucucugcauuuuuguaauuccucuaccaugaaccugcuuuaguuaaguaagaaacaguuaacugggggaggagaaauaaaaccaaaccccuaaaaagccccuaauaaaccccuaaacgugggguccaacaugagguguuauggcugggaaaagguaagagaucaaacuauacacacccuuuuuuuuuuaaauuaaacuuuuuaguuuuuucagagacagucuugcuccauugcccaggcuagaauaauggcaugaucucggcucacugcaaccuccgccuccuggguucaagcaauucuccugccucagccuccugaguagcuggaacuacaggcacgcaccaccaugccuggcuucuuuuuguauuuuuaguagaggugggguuucaccauguuggccagccugaucucgaacuccugaccucuggugauccaccuaccucagccucccaaacugcugggauuacaggugugagccacugcaccaggccuuaauuaaacuuuuauuuuagauucaggggguacauguacagguuuguuacauggguauauugugugacacugaaguuuaggcuaugauugagcucaucacccaaguagugagcauaguacccaacagagaguuuuuuagcccuugcccuuccucuagaaguccgcagcgucuauuguuccucucuugaugucaacguguacccaauguuuagcuuccuuuuacaagugagaacaugcaguauuuguuuuuuuguuucuguguugauucacuuaggaugagguccuccagcuccauuccugguguggcaaaggacacgacuuuguucccuuuuuuauuuuuuugacacuguccuugaacuugguugagguuuuguucccuuuuauggcugcauacuauuccauaguguauauguaccacauuuucauuauccauuccacugcugaugggcacuuagguugauuccaugucuuucuacuguuuuguuuuguuugagauggagucucacucugucacccaggcuggagugcaguggcgcaaucucagcucacugcaaccucugccucccagguucaagccauucuccugucucagccucccaaguagcugggauuacaggcaugugccaccaugccuggcuaauuuuuguauuuuuaguagagacacaguuuuaccauguuagccagguuggucucgaacuccugaccucaggugauccgcccgccucggccucccaaagugcuaggauuacaggcgugagccacugugcuuggcugaugucuuucuauugugaauagugcuguguagaacauauaagugcaugugucuuuuugguagaagaauucauuuuccuuugguuauauaccaaaucaugaaauugcuaaauugaauggugguucuguuuuaaguucuuugagaaaucuccaaauagcuuuccacaguggcugaacuaauuuauauucccaccaacaguguauaaguguucccuuuuuuccacagccuugccaacaucuguuauuuuuuugacuuuuuaaugacagccauucuucagauaucaaggguggggacaaaaaaagaaacuuaauaaucauuuugacuagugugagaugguaucucacgauuucauuugcauuucucugaugauuagugauguugaacauuuuuucaucuuuguuggccgcuuguacaucuucuuuugagaagugucuguucaugugcucuauccacuuuuuguugggguucuuuguuuuuugcuuguugaauuguuuaaguuccuuguagguucuagcuccuuguagaauugcuaaguuccuuguagaccuuuguuggauucagaguucgcaaauauuuucucccauucuguagguugccuguuuacucuguugauaguuucuuuugcuguguagaggcucuuuaguuuaauuaggugucacuugucaauuuuugguuuuguugcgauugcuuuggaggauuuagucauaaauuuuuugccagggaaauguuuuuguuuuuuuuuuuugagacagggucuugcucugucacccaggguguuaauaacuuaacaaacugagaccccaagaggaaaggugauucggccaaagucauacaguaaguuaguggcagagccaagacuagaaugguggacuguggguguuggaagggaacuuugagguuguuagggcagccuuuccuaaggcgaggccccucagacaagaaggauucuauuguuagauguuugaaaacugcugaauuaaagaaagcugcacaaauuucauuauccgagaacuucucagaauucuuaacacaugacaauaccuuggccacuccaagaaaugccugcaguguauagggcccugaauuaguuucaagagucccuugaaggacauugacaccuaugcaagcucucccugcucucagacagagaaaugcuauaucuuagauauacuccuaguugcuuuuaaaaaauaggauucuagggccgggcaugguggcucaugccuguaaucccagcacuuugggagguugaggcaggcggaucacgagguuaagaguuugagaucagccugaccaacaugaugaaacucugucucuacuaaaaauacaaaaaaaauuagccgggcaugguaauuagccgggcaugguggcaugcaccuguaauccuagcuacucaggaggcugaggcaggagaauugcuucaacccgggaggcagagguugcagugagccgagaucaugccacugcacuccagccugggcaacagacugagacucugucucaaagaaaaaaauauauauauagauuucuagauuuuuauccacgguugcuugucauugugcaaauuguugucauugugcaaauuguaugauuuuuaaaauuauacuaccaaauugucugucgcugguauguaggaagaugguugacuuuuuuuuauaaucucauuucuccuuuuuuuaaaguaagaaauauuacaaauaugcagagaaguauagagaauaauauuaugaacauuuauguauccaccucucaauuuugucaaaucuuacuacaugaccauguuuucuuuggauguuguuuguuuguuuguuuguuuuaaugacaaauuaaacauuacacuuagaguugaagccccuugucuuccugaucccaucacccugccacccuuaucaguggugaucauggucaccauuugguauuuaucauguguauuugguauuuaucugguaaugugucauuaccagacacauuuucacaguucuaccauacguggcuauauaagcaaaguaaaauauuuugcuuaucuggaaaauuuauuuaaaugauauacuguacauauccugcagcaacuuccuuuuauuacuccucauaauaggucucuggaucuuuucaugaugauacaaguugcaccagaccacucauuuaaaaugcuguguaggcugggugcaguggcucaccuguaauuccaacacuuugggaggccgaggcaaguagaucacuuaagcccaggaguucaagagccagccugggcaacauggugaaacccugucucuaucaaaaaauaaaauaaaaaagaaauaaaauagauaaaaugcuguguauccaugaaguacuauacagucauaaaaaagaaugaaaucauguccucugcagcaacauggauauggcuggaaaccauuauccgaagcaaacuaaugcagaaacagaaauucaaauaacauauguucucaccuauacgugggggcuaaaccuuggguacacauggacauaaagaugggaacaauaggcacuggagaaaccaaagggguuagagagggagggggcaaauguugaaaaacuaccuauuggguaccaugcucauuaccugggugaugaauucauucauacuggaaaccccagcaucaugcaauauaccuuuguaacaaaccuauacguguaccuccugauucgaaaauaaaaguugaaauaacgggccaggcaauguuuaaaaacacaugcagccgggcgcgguagcucaugccuguaauccaagcacuuugggaggccgaggcggguggaucacuugagaucaggaguucgagacaagccugggcaacauggugaaacccuaucucuauugaaaauauaaaaauuaaccaggccugguggugggcaccuguaaucccagccacuugggaggcugaggcaugagaaucgcuuaaaccugggaggcagguaaaaaaaacaaaguugaaauaacaaaaaauaaaauaaaagugucuguaaauauccugaguauauuuauucuguuuuguuuauuuguuuguuuugagauggagucucacucuguuacucaggcuggagugcaguugcacgaucuuggcucacuaucucagaugaugcuccaaagacuauucuuauaccuguggaugagaguuucucuagguaacaugcagagauggaauuucuguaucuuagacaguggauaucaacacuuuuaagagauguugcuaaauugcucauucuugaaugccaacuuccacuuccaacaauaguuacagaguuuugguugcucuacaaccucaucagcacuugauuuuguaagauacugaauguaaaauuaugcuucacuuucaaauuuacauuuccucuauuacuagagaaggagaggcucuuuugccauuugagcuuccuacauuaugagugugcuuguuuguauccuuugaccauuuaucuauuguauuauuuaccuuuccuuaucaauuuguaggcauuuuuuagcacucuuagaaacaucuuuuaugcauguauuuuuuuuuuuuuuugaaacagagucuuacucugucgcccggcuggagugcaguggcgugaucucggcucacuacaaccuccaccucccagguucaagugauuuuucugccucagccucccgaguagcugggguuacaggcaugcaccgccgcacccagcugauuuuuguauuuuuaguagagacaggguuucacuauguugcccaggcuggucuugaacaccugaccaaaggugauccauccaccucagccucccaaagugcugggauuacaggugugagccaccacgcccagccgaccauuuuuaaacguacaguucagagacauuaaauauauucacauuguaauacaaccaucagcaccauccaucaccugaacuuuuuucaucuucccacacugaaacuguacccauuagaaaauagcuccccuugggaggcuaacauggagaaaccucgucucuacuaaaaauacaaaauaaauacuaaaaauacaaaaaaauuagccgggcgugguggugcgugccuguaaucccagguacucaggaggcugaggcaggagacucgcuugaacccgggaaguggagguugcagugagccgagaucgcaccacugcacuccagccugggccacagagagagaccccgucucaaaaaaaaaaaaaaaagaaaagaaaagaaaagaaaauaguucuccuuucuucccaggcccuggcaaaccccuucuacuuucugucucugugaauuugacuacuuuccuguaggcuaguggaaucauacaguauuuguucuuugugacuagcuuuuccccuagcauaaugcccucaggauccauccauguuguagcaugugucagaauuuccauccuuuuuaaggcugaauaauauuccauuguaugcauauaccacauuuuauugauccauucauccauugauugacacuuggguugccuguaccuuuuggcuauuaugaauaaugcugcuaugaacuugaguauacaaaucucucuuccagaugcuacuuuugguucuuuuggguauauacucgggaguacaauugcuagaucauaugauaguucuauuuuucauuuuuuaggaagccgccauacugcuugccacagaagcugcacuauuuuacguucccaccagcagugauaggaacguaaaaggguuacaauuucuccacaucuucaccaacacuuacuauugucuguuuuguuguuguuuuauaauauccauccuaaugggugugagguggucucuuauuguguguuuuguuuguuuguuugucuugguuuuuuuuggagacauagucuugcucugucgcccaggcuggagugcaguagugcagucucagcucacugcaaacuucuccuccaggguucaagcgauucuccugcuucagccucccagguagcugagauuacaggcaugugccaucacacccggauaauuuuucuuuuccuuuuuuuuuuuuuuuuuuuuugagacagagucucacuguguggcacagacuggggugcaguggcgcgaucuuggcucacugcaaccucugccucccagguucaagcgauucuccuaccucagccuccugaguagcugggauuacagaugcaugccaccaugcccggcuaauuuuuguauuuuuaguagagaugggguuucaccaugcuggccaggcuggucuugaacuccugaccucgugauccgcccgccuuggccucccaaagugcugggauuacaggcgugagccacugugccuggcccacacccagauaauuuuuauauuguuuaguagauuugggauuuugccauguuggccaggcuggucucaaacuccugaccucaagugauccacuugcccuggccucccaaagugcugggauuacaggcaugagccacugugcccagccucuuauugcaguuuugauuugcacuucccuaaugauuagugauguuaaguaucuuuuuaugugcuuaaugguuauuuguauaucuuccuuggagaaaugccuauucaaguccuuugccaauuuuuuuguuuucuugagacaggucuugcucugucacccaggcuagagugcagcagcaggaucguggcucaccacagccucaaacuccuugacucaagugguccucccaccucggccucccaaguaagcugggacuacaggugugcagcaugccuggcuaauuuuuaaauuuuucuguagagacaaaguuucacuauguugcccaggcuggucuuaaacuccugagcucaagcaauccuccugccucugccucacaaaguggugagauuacagacuugagccacuacaccuggccucuuuguccauuuuuaaaguuuuugguuguuguuauugaguuguaagaguucuuuauauauuucggacauuaaccccuuaucagauauaugauuggcaaauauuuucucccauucuguaaguugcuuuuucacucagucaaguguccuuuggugcacaaauuuuucuaauuuugauguaguccaauuuaucuaauuuuuaaaaauuuccugugcuuuuggugucauauccaagaaaucaucaccaaaucuaauaucaugaagcuuuucccuuauguuuuauuccaaagguuuuauacuuuuccgucaaacucauuuuuaguuaauuuucguauaugguguaaggaaagagucugauuucauucuuuugcauguggauauacaguuucccaaacaugaauuugguuuugauaguacuuuguuaauuaagacuuuugcaccugguagacgcucuuugaccucuaacccacuggaauccucucaccauccuucccugacaguugaccauuuagcuugggcuuaauacuuccaaugacggaauacucacuacuuaauaaagcagcuuuuccugugguagaacaauuguauuuuauagaaagaucuccauuuugagccucaaguuuccucccuguagcauccacauuuugguccucguucauucucugaagcuguaggaaucagugagagcuuuuuuuuuuuuuuuuuuugagacagaguuuuacucugucacccaggcuggagugcaguggcacgaucucugcucacugcaaccuccaacuccaggguucaaaugauucuccugucucacucuccugaguagcugggacuacaggcacaugacaccacaucuggcuuauuuuuguauuuuuaguagacgggguuucaccauguuggccacgugaaacuggucucaaacuccuggcuucaacugaucugccugccucagccccacaagugcugagauuacaggcgugagccacuucacccagccagugggcacucuuuuccaaaggaaaguacuuuguugccuuuuuuuugagacugagucucaaucuaucacccaggauggcgugcagcggcacgaucucagcucauugcaaccucugccucccagguucaagugauucuugugccucagccucccaaguagcugggauuacaggugacugccaccacgcccggcuaauuuuuguguuuuuaguagagacaggguuucaccauguuggucaggcuggucuggaacuccugaccucaagugauccacccaccucagccucccaaagugcugggauuacaggccugagccaccgcacccggcaggaaaguacuuugaauugaguaaauaacgcaacuauaugcugggcagcuaccugccagguuuauaagguuuaacacauuuacuccacaaagcaaucuaugaaaagguccuaucauugauuccuauuuuauagaugaagcaaauaaggcuugaagagcuuaugauuuuagcaagguccaacagcuauguaaauggcaccacugauauuucaaaggcaauggcccugaccacucugcuacaccaccuuucucuccucuucuccaauacccagcccaaaacucuuuuggaucuuugauuauucuucaaggggcauagcuuucuuucuuucuuucuuucuuuuuuuuuuuugagacgaacucucgcucugcugccgggcuagagugcgguggcgagaucucggcucacugcacccuccgccucccagguucaagcaauucuccugccucagccucccaaguagcugggacuacaggugcguaccacuacgcaaggcuaauuuuuguauuuuuaguagagauggaguuucaccauguuggccaacaugaucucgaucucuugaccucgugauccgcccgccuuggccucccaaagcgccaggauuacaggcaugagccaugccgcugcacucggccuaaggggcauagcuuucucauccucugccauccuaggaaaauuuuaaguauucauauuaaaaugaaaacuaaacacaauuguccauauaugcuccuuaggaguagaaugccaaggaccucuuagcuccucugaccugggaacuacauucucucuaaugauacauacgacuggguuagagguuugggcagcugccaccaaguaaaaccucuagaauuuugcuaugucacuuucugcuaagguagcuuuucccaucuacacuaaauaaauaaaucauccaggugauuuauuuuuaaccaaugcagaggauuuuuuacuuaucuccauggaguucaaacauuucuccaggcuggguggggugacucacgucuguaaucccaacacuuugaagacuaagaaggggcagauugcuugaacccaagaguuccagaccagccugggcaacauggugaaaucccauaucuacaaaauauagaaaaauuagccagggguggugguccacacauguagucccagcuacucuggaggcugagguaggaggaucaucugagccuggagacuuggaggcugcagugagcugugauggcgccacugcacuccagccugagugacagagacccugucucaaaaaaaacaaacaauaauucaccaaaucuauuuggaucuggauccugccaucauuuuauagguaaugccuccauagcacucacuaagugccaggcacacuucuaagcccuuuuuauacauuaacacaaauaauccccaccacgaccuaaugccauacacaucauuauggucacuauuuugcaaauaagaaaacagucacagagcaguucaguaacuuguccagggucacacagcuaguccaugacugaaccagaauuuaagcccaggaugucaaguuccagaauugguacacucagccucaauacugugcugccuucaaauauucugacaaucuuagacagcuuuggggauccaaaagauugagaaguacucuuggggaccucuuuuuuuuuuuuuuuuuuaaauacggagucucaacucucucccccaggcuggagugcagugguacaaucucagcucacugcaaccuccgccuccuggguucaagugauucuccugccucagccucccaagaggcugggauauuacaggcacaugccaucaugcccagcuaauuuuugcauuuuaaguagagacaggauaucaccauguuggcuaggguggucuugaacuccugaccucaagugaucugcccaccucagccccccaaacugcugggauuacaggcaugagccaccgcaccuggcucccauuuuuuuuuuaagacggaguuucacucuuguugcccaggcuggagugcaauggagcgaucucggcucacugcaaccuccgccucccagguucaagcaauucuccugucucagccuccugaguagcugggauuacaggcacaugccaccacacccggcuaauuuuuguauuuuuaguagagaugggguuuccucauauuggucaggcuggucucgaacuccugaccucaggugaucuucccaccucggccucccaaauuccugggauuacaggugugagccaucacgccuggccccuggcuccuuuuuuuuuuuuuuuuuuuuuuuuuuaaauaaagaccaaagguccagaggcuuugaaaggcaaauaguauuaagucaggauuugauaucaggauuucuuucauucuguuuauuuucucauugcuuucuacuuaugauacuguuucauuugguaguaauaauauuucuuucuaaaauaaauugaaguaaaaagaagugaguugauguaagaaaaauguuacagauaugaaaaaaucauaauggucauuaaaaaauuagugaaacuuuggaaagacuguguucagucaagugaagugaaguuagcuugcaaccacaaaaaaaccccuaagucucaaugguuugaacagcaaaguuaauugcucaccuauaguacacgcccagcaugggucggcagggggcgcuccgcguuguggaacgauucauaucuauacuugcuuccccaacaagggcagcacuggccuuuaaagcuucugcccaggugugacacagguuguuucugcucacaucucguuaccugaaacaaguaacauggucacaucucauuucaaaggaagcaagaaaauguaauccccaucaugugccggaaaggagagaaauagaauaguugagaacagcccucagagagacuauaaguaagggggcauaaaagaugggucuagagagauaggcugagucaugacucacugaauuugucugacguagaucaugauggcccaucccaccaaguggccaacauuuguucccagaaaagggagugugaugaucccccagaaagaacacagucugacaacauuauucugaugagcagacacaccucucaggcugccacucaggaguccuuuuggguggggagguggggaugcugauauuuccuaagugguuucagcugaacucugugaucuuuuuuuuuuuuuuuuuuuuuuuuuuuugccuauucccugaagggagaugaggcaauuugggcuuuggcugagcuaggguuugguucugucaccacuugcuaucuagggaaggguaauaauuggaaaggagaggaauucaaggagaggguccagguggguagggagccucacacaggguuuggugaucaggugauugagaggccuccuugaggaguuuucaaagugcggucugagggcaccugguaucagaagugcccagaagcucauuaaacacuugggccaggugcuccauggcuccugccuuuaaucccagcacuuugggaggcugauuugcuugaggcugggguucaagacaagccuggacaacauagcaagacaccuccccccgucucuauuuuuuaauuaauuaauuuguuuguuuauuaauuuauggacucucacucugucgcccaggcuggaguguaguggccugaucucuucucacugcaaccuccgccucccagguucaagcaauucuccugccccagccucccaaguagcugaaauuacaggcaugcaccaccacacccagcuaguuuuuguacuuuuaguagagacaagguuucaccauguuggccaggcuggucuugaauucuuagucuccagugauccaccugccuuggccucccaaaguguugggauuacaggcaugagccaccaugccccaccucuauuuauuaaauauuuucuuuuuuuuaaucugaugacuaggcccacuguugguccuggcaccuggagguaggaccccaggcaucugauuuuuuuuguuguuuuuuuuaaggcagggucucgcucuggcgcccaggcuggagugcaguggcacgaucuucacucacuggaaccuccaccucccagguucaagcgauucuccugcuucagccucccgaguagcugggauuacaggcaugcaccaucacgccuggcuaauuuuuuuuuuaauagagacaggguuucaccauguuggccaggcuggucuugaacuccugaacucaggugauccacccaccucccaaagugcugggauuacaggcgugagccaccgugcccagccaccaucugauuuuuuuuuuuuuuuuuuuuuuuuugagacagaguuuugcucuuguuaaccaggcuggagugcaauggcacgaucccggcucaccacaaccucugccucauggguuuaagugauuuuccugucucagccucccaaguagcugggauuacaggcaugugcuaccacgcucggcuaauuuuguauuuuuaguagagacgaggucucaccauguuuggcaggcuggucucgaacuccugaacucaagugguccaccugccucagccucccgaagugcugggauuacagguguaagccaccucgcccagcugccaucugaauuuuuaauaauggccccagaugauucuuauggacaccaagauuugagaagcauugaaugacugagagaaaauuucuuguaaggguagaagcccagcacagugguucucaguggagauaauuucaacccccaagggacauuuauaaaugucuggagauaguuuugauuaucacaccuugaggguagggaaaagugcugcugacaucuaguggcuagaggccagacaugcugccagggacaauguacaggacaguccccacgacaaagaauucucuagcccaaaugucauuagugcuuaggucaagaaacccugguuagccauuaagaguuugaaccuuucuaaauguuggagcacauacgauuuuuaaaucuucaauuuuuauuuuauuuuccaaaauuucuacuauaugcauagaauccuuuucauugaauaccuguuacgcaccgagcacuugaaguuuacaucacuaucaguuccucuugaaagaccuuuucagucauucauccaacaacuauccauuaaacacuuacuaaaauguauuccaggccaggugugguggcucaugccuguaaucccagcacucugggaggccgagguggguggaucaccugaggucaggaguuugagaucagccuggccaacauggcgaaaccccgucucuacuaaaaauuaaaaaauuagcuggguguggaucccagcuacucaggaggcugaggcaggagaauugcuugaaccugggaggcggagguugcagcaagccgagaucgugccauugcucuccagccugagugacaagagcgaaacuucaucuuaaaaaaaaaaaaaaaaaaaaaaaaagaaguauuccaggcagaggggaaaguauaugcaaaggcccccaagacaggaaagaaaaacuuuaaaauggcuaguaugccugcugcugauaggggugggggcaaguggaaugaaaugagguuggacacggagggauauaaaaacaagggcgugcauggccucacaguguuaagugggaguuguaugaguuuuguuauaaaugcauaggaagucauaaaaauuuaaguagaagaggaucugagccaauguacauuuguacaagaucacccuuggccccugagugaagaguaggggguagggaagccacaggagaaaaagugaaggggugggguggaggcaggcggggggggggggaggcggggggggcgguggagcgggggagauccccuccccaacccuggcagguuuaaaaaaaaaaaaagggaagaagugaaaagacuuuugcagaccuccagagaugaugcauaagguuggcugggguggagauggaaagauggaaaaucuagauucuguuuggaggguggcaagaacuggauuuucugaugaacuggaaggcaugagaaacacaacacaaagauugugacuugcaagauguuggcuugaauaauugagagaaggugggugaugauauaugacauguagauaugacuaucauucucuuuugacgacugaggaaggggaggugagucguccuacuucacaaagauaguauaugggcuccaggugugucuaacccaaagguuauaauuuuuccacacuccuauauccacacauuaauuuuuuuuuuuaaauugagacagagucucacucuaucacccaggcuggagugcaguggcgccaucguggcucacugcagccuccaacuccugggauccagcgauccucccaccuuggccaccuaaagcuggaguuacaggcaugcaccaucacgcccugccuaucuuaauuuucauaauggguaugacauuuacugauaguaauaucauuauacaugccccauacaugcuaacaucugcuuccacauggaagcagcacaaagccuggaaccuuccucaaagaccccccccacccccguacauuggaacaaggugcugggaacagaaguuuaguaggugguggaagggcagcggcugcuacccugggaacugguuuuaaaaucuuacguucugauugcugccguggccaugugcuggugugugauggggagauguucuuuuagguaacuaaauccaacgagcugugauuggugaucgaaccgagcaggccuccucuggauuuggagagacauagugcgucugggccugugauuggcgggauugcugugauuggugaagucccuaaggcuaucuaaguuucugaacaccaguuccugcguuggccacgaggaggagcccaggaagcgcaaagcgcagcacugcggagagucuuggccgccuccuccgggacgcccuccggcccagcgcggugccugcccugcccugcgcccuggggcaaccgcgggaugagguggggcggcaaagggugucagggcucccagcugcggcccggguggccacgcuucucugcacaguuccuuuggccucuuccccuggcucccagccccacagaagacauuggcugacccgagggguggggcugcggguucgcgaagguuugugaaggcccagauccaaguugcaaaacuguggagucuaucaagugagacuuagcagccccacucccucaggugcgccccuugcccuccucagaguccuucucucaaguuuagcagccuccaccgugcccuuuaagauccucaaagaacuuuugcaaaguggcaucucauuggagcuaaaaugaccugugcaggcaaaggccacuagcucaggggaucguccugcccauccccaggugcuaucacaucgcgcugugcgucuucacugcacuuaaccacuguuuguaauugacuucguuuuucauguauuuacuugcuuaugucugcaacccgccucuccaccaaaacgcaagcucugugagggaggguguaggguugcccgacacaacacaggacacccaguuucauaugagugucagaugaacaccacaguuuaaaaguauaagcaggucccaugcauuauuugggacacgcucauacuaacgaaguauuucuuguguaucuuaaauucacauuugacugggcauccuguauuuuuauuugcucaucugcaccccucugagggggauauuuugcccauggucuucccugcugcaucuccaccacccacaacgaugcacgcagaaggugcugaauaaauguugacuguuucgauggacgauuuccauccuuuauucacucaguuauucauccagccuauuuauaucaaguggguccugggaauacaaugguagaugggacacaguccaguggaggaggcacacaaccagucuaauuaccaucugacuaaacgaugaugauguaaagcuuugggggcuauggggggacagaggaggaccccggcguucuguuucccggaggaagaugacuaagaugggacuuggaggaugagaaggcaaagaaggaagugcgacagcucucugcuugagaccacgggguucuggaagcugcagggggcuggggagggcaaaugugcagugugggcguggcagucaggaaaaggugagaaggagacucacauucacuggauguuacuacccaccagccagcacaagagggaugccauguugcuauuauugugcccaucauacagaugaggaagcugaggcucagagaagugaaaugccucggcuaaguuuacagucguggagggaaaagcugagcuucaagcucaggucuggcagacucugaagccugcacucuucuagaaaagccacuggguuaaggauuacaaugccaauagggggauggagaaacacgcucagaaaggugauagggcucucccugugaauauggcucuguccaguugagcagaauacugaagcaaugcaagaguuaugguuuuuuccaagcccuccagagagacaacaggagggccagagcaggacccaggaguccagaccacugugucucccauuccuauugggguuggcucucuaggagccccuugcagagcccuggggcuaauuccuugcauggauccuggacaggucugcaguuuccauggagaccgccucccaccaucccugaaaucucauugugaccaguauuaagggauuaacucugcccagcggcccucgcagggucuggggugcugagaggggccagcaggagcucccucaaggaugaagagguugugcacugugcgggaccccauagcagcaggaggaggaugucggacuggggccagggcuucccccaggacccaccagguaugguccugacuccacaucugccuggaaggaaggaugggaugguaggagagagacacagaaccaagggggaggauuccagacugggagcaguguggaggauuuguacccucauccccuaacccaggaacguccauggcccugaugggugaaugacguuccaaucagagaaggagaauccagacgaccucaacaaggugagaggagccccguagaguauuagggguaguccaaggcugccuaaagaccagaucucuuaucucucucauuuugcaguuggggaaacugaggcacggagagggaaaaugacuugcccaaagccagugagucagcaaacugaagcaggucaagaauccagagggaacccugaaguucccugagcagaaaacaaucgguuaaaaucucauugccacuucugccuugaacuccaaauccuccuuccugagcuccaggcaugggguccccuccauccccucacccagagcuugucucaucggccaugcuucccucccugccucucauccuccuccugacuuccccugccacccgcaccaccugaggcuggcagagaguuccuggcagguucuccagugcugacgggcacagccaccaggcccccacuauuccauccaggggacaccuucccacugggucccuaucuggaugacuugggacauucuuuguucuacacuucauccucucuuugggauuucugaguccagacacagugaggaccccgacagccccccuccucaccucuuguccugggaaggccaggccugcauggcagagauguaaccagacuccaaagcuuucugggccgggcuucauggaaggccguaucggugcaggggcauaaacacaagcucuggagccagguagagauaguucuaacaccauugccuuggcucacugggaaaaugauguuucuucucugagccucaguuuccucaccugugaugggagacgagaacccuuccauccucaaagcuugcucucagcugcuauggaagcaucuccagguugugauauuaaaugaaccaaacaagauacagaacaguguaagagcagaggcuacucauguaugaucuuacaugcuaucuggucuguauaaagaaaccuuggcagauacaucuguaagggaugugguuccccauagugaggaagucaaggagaacaggugaacaggagacagcuggaagcaagacuucucaauuuacaccuuuuauguuuugauucugaaccaugcgaauguagcaccaauucaaaacuaaauguaaagauguucacaaauuaaguaaaauauuaaauaauaauaauaacacauaccucaauaauaugaccggugugcagucaagauuuaggcccagguacuagaaauugacucaaagcaacagaggaggccugucuucaagucaccgaauccuugaccuagaaaggcccuuuauuuugucaacgucaaauugcccauaacaacaauaauagucuugguagcaagaaucaggagcucccuacuuggggaacauggugccaagcacugucugaacauuaucucauuuaauuggcauuuugauuuugugaggaaacgaucaucauucccucuuuacagaugggaaaacugagccucgcugagguuuugacuaguaaguuguaguaagugauagaacuugaugccaucgaaggcuuuccagguucaaauuugaagccccccuacagugggucucaauauuggcugcacaaaaauauagacgccuggcaccuccccaccccuaccccaagauucgaucauugaucugugauagggacugggcaucugucuuuaauuuuaaaaaaucuuuuuaaaaaauagacauagggucucacuauguugcccaggcuggucucaaacuccuggguucaaguaaaccucccaucucagccucccaaagugcuaggauuauagguguaagccaccauguucggccaacaucuguauauuuuaaagguuucagaugauucuauuucaucuucagagaugagucucugcuuuguuagacaaaacuucuccaaugggaaaccaaggccagggagggaaaugaccuugcccaaggacacacaguggcuggaaccagagcuggggcaggacacccagcagcuuacaugaagcccuagggcaaauaagaaaaaggcaccccacucugggcaggcagagcuccaugggcacuucgcuuggcaaguggaacaagggcuggguuuccaucccuaccugcccucuuggcuggagaaccuuugugcagugagcaaccugcacaacuguacagggcaguaacucugaucugagccucaggacuuccaaacacuucaccuuagugaccuggcaaaucccuggggccccucagaacaagaguauggggagaccaaggguggcuucugggaugugggcucagcccucacuccccaaaccagagucugggucaggcaggggcucccaucagccuucaggccccacaagggccgggaaggccgcaucuaauucccaaggucaccccugcagauaaauucaggaacauaaacaggagggaugaacauaaacaggaggacagcaacacccucagcccagaugucauaagccaccuggcaggaggcagccugcggagaagcuccacccacacagauccaaguccuccuggcuuccuuccugaucauucuccagaccauacucucugcccuaccuccggagccuuacagucagcaucucccacagugcccugcucucugcccuucuccuggccaucucucacuggcaucccuggaagggaaggguagcccuggaguuagaggcacagacucuagagacagacugcccaaguuccaauuccacuucuuguuucucaucagcugugugagcauggguauauggcucaaccucccugugccucugguguguaaaaaauuggugaaaacauugccuaccucccagaguggcugggaggaucaaggaaguaacacaugcaaagcuccuaaaacagcugcauauccaguggccaugaugaucaauguguauauuuugcuucauuucauuuucaugacaacccuggaaguuaaguauuauaauucccaauuuacaggugaagaaacugaggcucagagagguggagagagucagggcagggcucuacaucuuuuuuugugauagggacugggcaucugucuuuaauuuuaaaaaaucuuuuuaaaaaauagacacagggucucacuauguugcccaggcuggucucaaacucuugggcucaaguaauccucccaucucagccucccaaagugcugaugccuccagagacaggacguggcugagauggauuauaacguagucuccgguuugcagugccuggcugcuggucauauccucacagggcccaugggacacagagccaggugcauuccccugacuugggucuuccaauggcucucaggcaccucucugcuuccagccagcccugggaggagggggagaacggcauggcaaggcguuugcagagccgucuuguucaccaaugucuuucaagacauugcccggguccacagagagcccaccauucauucccaugcuggcuggagccccugaauacccgaggugaccuucuguccuuggacaagucacuucccccucugaucuccaucuccccaucugugcaaugaggggauggggcugaaucagugguuuuccaacccucaaauaaaauauuaagacuacauguaaaagggagucgcugguugaagcugggccuguggaugcauacccuuggcuccugggagccucggaacccagcuugaaaaaccccagcccacauccuccuaaagauucuccuggcucugacacugcagaguucuagaaccccaagcucaaagcugccgcuucccaucccuguuuggaaagcucucccccagcugccuuuaucucucuuugguaacagagcaaauuugcucaggacccagcacagggggaacaagcagacuguugacucuugagcaaagccucuucuuuggagagcagccgagguggccgugggcuaugcguugggaggccagcggccucuugcauaacccuggaggccuccugcccacccaggccuuuucaggguuaggggugaggaaaaccgcaaacucaugcccaguuaauuuuuuaaggcaaaaucaacaggcucagcaaugauuagcagcuggguaaguuggucuuaaucaggcuaaggacagggagggaggaaggaggcccagggauggggcccaguuaucaguuaaccacaugaauguugcuuccuuccaaacccacuggccuucagccccaagcucccucaucuuccucucggaaauacuccugugacaagccaguggccacccaucaucgggugaacaagccaguggccacccaucaucgggugaacaaacacaaugccacucauggucugugaugaaguagaaagugcucguuguuaagacaaagcucacccaccaccgcugcguggacuugagcaagucccuuucacccucugaggcuccgugaggggccccaggucugggccccaagucuaugguucagucuguggccagcugccacuccccugacggccucaguguuuccguccacuaaauggguggguuagccaaggcaucuuuuccagucuugaagcuuugugggugccugauuugauuaagccacaguggccuuugccgagugcagagggugguaugaguggcauuuuaggagcucaaggaagagaaagggaggggaccuaccugguaucugccguugguaucagcaagugucagaucccagcuccaggaagagggcuguccucucagaugggaggcagggguccagugggguggcuguggcugcagggacagccuagcagagccucuugguggcccagacccccugucccuggaccuuggaagccgcuaaaggaagcagcaagaccaggccagcugguggcugccuggacuggaguuuggucagugguuggggaccuauauugugagauaguuaggacuuuguccacaaacuggaauuugaaauuucaaaggggcaaaacugaagggcccuaccccagaguagagauggcucuuggcuucuuuccuccacgacuuuuguucuuugucuugauaagucccaguuuucucugcaccucucccggagugguggguggggaagaaaagauaggagauaaugguguggugagcgccaaggggaagugaagaugccaagcagcccugggguggccaggcguguggaggaugccccugccccugccuauaccccgggauaaggugcuuuacuucucagguccuugaguuccccugcaagacugaggcagugaaaccaccagcuccagugccuuagaauuccgaaguccuuucagggauuccaggagucaugaugcaggcaaugcguagaggggugaagcccucaagcucuggaggcagacucggguucaaacaacagccccucccuuacgagcuguguggcuuugggcaagucacuucaccucucugagccucaauuucaucaucuuuaaaauggggaugacaauagccccuaucucaacaggcagauaauaugagaaggcuagaagguuuuuagcaccagggcuagcacaaaauuucucuguaaacauuagaccuuauuauaauguaaaagagaaacaaugugguucguaguggcagcucccuuaccaccguccacagcagaggcacaagcucccuacacaugccuccccaacugcagguugcccagggcaaucccuucccgucucaacugggucucucugugggcucugagguccucugcuauccccuggaaucugcugccucuugagcuggggcccgacagcaagugagcagagguaaagaacagcugcuaaauugauggcauugaggcuagugcuuguucauggcugggugugugguaccuggagcuguccugagcagggguccugauuccaacugauuauguggccagugugucaugcaaucaaugaccaaugacagugauugcuacuauuguacuguaugccuacacguggucauuuaaugcuugaaccaucccuacaaagaagguaucaacccaauuuuucugaugcuuaaacuaaggcugagaaaaguagaaguugaggucacagaguuugguacauuggcacugccuggauuuuaaccuagaucuaucugacccacaaggucugugguuuauuccccuaaagagaggucaggggaagagaggcuaagaagcuuaucuacucucucauuuaaucuucacgacaaacgacaaguuagaccccuuguacagaaggaguaaccaaggcuucgaaauaaaaacuugccuugugcagacagcuggcccugggcuuggaauauaaauagucacugguauacaggcaccagagaccaauacccacaggcuaacacccacucaguccacagaaagaagcuuaauauuuuuuauaagcauagaaauaaaaaccaaaccaauacugugacauuugcucugugacuuccuguauuuauuaugugcucauaugaaagcaccuaagcauugucaggauaauguucuuccucacuggagggcguuaugaaguugcuuucuuuuuuccacuaguuaaaaaaaaaaucccuuggaggaagggaaugaaacuuuuuauaauugauacauaauaauuguacauauauauggagcacauguauuuugauacaugcauaccaugcaaaguauuuaggauauccaucaccucaaacauuuaucauuucuuuguguuggguacauuucagaucuucucuucuggcuauuuugaaauauaaaguaaaugauuguuaacuauaaucgcucuacugugcuauaagaacuagaucuuauuccuucuaucucacuuauuuuuguacccaugaaccaacgucucuucauccccugaagaaaacauucuuuuuuuuuuuuuagacagagucuugcucugucacccaggugcaguggaacaaucucggcucacugcagcuuccaccucccagguucaagugauucuccugccucagccucccaaguagccuggacugcaggggcaugccaccaugccuagcuaauuuuugauuuuuguauuuuuaguagagacaggguuucuccauguuggccaggcuggucuugaacuccugaccucaggugaucugccugccucggccucccaagaugcuaggauuacaggugugagccccugugccuggccugaaacuuucaaggucucaagacacuguacauuuaaaguaccccaauguuuuccuuuuccaccucccguucuuucuccuuaucuaacaugaagaacauuguauuaaaucugauuuuuaaggaguuuuugucuguuauguguuaaggguuuguuugguaccccaaugaaaacauucugcauugcagaccaaagugugcuuauuucaggggcaugggaucauugcguucuuagccauugucacaaaauacauggagucauauuuaaaauguaaaguuguaacauacauauguuuaaaauggaaauacaaagcaaaaagauggauguacaaugucauguguauucaguucucuguacuuaguaaauguaacaaacuuucugucuauuacugaacuauaggugcaaggacacgucuccaguuacuuugcaucuguaauccacaaagauucugggcagcuguauuaucauagcuugguuuaaauaaacuauguaguaacaaugaacaacaagaacaaaagaaauaauagcuugccugaggucacagagccagcagaucuuauagguggugcgucauuuauaugaggaauguguaucuaggagauacuguuuggcguuggcuaaggguggaaugaaucauguauguaauagauuaugcaauuuacagugaugaguggauagauuuacuuaugggguagguuauaauguggugggaugugaaucuagaaugugccuccuaggcagucaugcagauugugcauuugguaagucagguaugucaugauucauguaucuaauagcucuucauuugcaguguccaccuaguagcucuuggauauaacgggucauggcuguggcauggugugguugaucuugguugaucguagaccuuauuuaauugaaucuaagaugucaucuauggaaaaaugcauuguuauuuuuguugccaaugaaauucugacaugacauugaucacauuccccguuaagcaauguggaacugugccucagaguggaagaggccauguauuccuggauuguguggggaguagcugugccuguggccugccauaggugccaggcagguggcagaggccugggcucagcccuuggaggcuccucccggagcugcccuccacaucucuucuguguuuaccccuuggucggaucuucuguuucuucccaccucugcacugcccccaaggccgguggagccaggucagauacuccugagguaggcaugggaggaacccgccgguauuuggucucuuucagccccuuaucaagucucauaguguggguugcagggggcugccucuugcucccucccucagagucuuguccuggcuaacagaaaacugagccaggaucaucuuucuauuuuacagagggagaaauugaagcccugagaagagacgauguaaauaaaguuaucggaauagugacugagcuaguuccuaaccccaggucuccugacaucaaaucuagccucucuuguccuccacaacaguugcucccucuccccuuucccuacaggcaauagcacuccccagucaucucagcuucagaggucagaucaaguggacagaauaaagcuaagcagggcagagaaagggcuucuagcaguggaaagaacaugaagaugccuccucauaccacucgaacacacaugcccugacucccgauuugcucacucauuaauccacccacacauucacucauucacucacucauuaauucacccacccauucacucauuaauucacccacccauuugcucacuuacucaguaauuuacccucauucguucauucacucacucauucaugcauucacucaacucacucauuaauucucccugucucuaauucacucacuccuaauucacccacucaucaauucccccacacacucacucauuaauuggugcucccacuaauucgcccacucuugcucacaggugucaccgaggcccuccaaccugcccuuccagccagcaguggaggacaggcucccaggccucccaagucucaggcuuuucuuccucugcccucacucucugccuucuacaucaagacuuuacuuccccagauugauuggcagcccuugaaaaugucugcacagaaggcaaugagggcuggagggagugagaagaacagagugcaccaugagcuucagacagccaggaccagcuguguaauuuucagggccccguccaaaacaaaaaugcacaaucccuuguucaaaagucaugaugaauuuuaggacaaccacagcagagcacugaaccaggaaccaggacuuucuaaggguuggguugccugugacugcacuggcgauacccccacaaagcccacucugaagguaggagacggguggagagaaacagggggauggcaagggggauacgaaacagggagagggaggagggggaagaggauggacgucuaccaggccccacuuggugcuugauuuaugccaucucauuuccuucucaaaccacccuuugaaguugauuguacauuuuacagaaaaggaaacugaggcucggagaggagaaucauuuacccaaggucccaguuaguagacgguaggugccugaauguaaauccaggucucugccugcuccgggagggggugggggugagggaaacaggagaaugugaugggaaaauccgagauggagccagccugggccagaaacacugggagcugugggagacggagaggggcagggugggaucacagggagcaggagcggggaauuggaggugaaucuggcccucccaaacuuccaguccauucugcucccaggggaaccgggaaacugcgggggaacuggaagggagcucccagaacaaggauccagaagauuggcaucuggggccugggauuuagguuucuaaaucgugggccauggggcagccuuaucucugcaaaagcauugaggguagaagucaaugauuugggaaguuauugaauuaggggaucucggagguaggcugucagugccugauaguaucaguuagaaugccugacuuggggugacaauggcuuggaggggugggugagucaagggucaaaugagugcccgugagucaugaugccugccuuguacaauugauaacugaacaucggugaguuagggccccagcaguuguaauuagcaccccgggugucagccagaaaccaacaaacagccaaaucccugcagccccgcccagccuauccaccggcgggggaccgauuaaccauuaacccccaccccuccccggcagagccuccaccccuucacagaggcuaggccaagacucccagcagaucuucccagaggacgguuugaaaggaaggcagagagggcacugggaggaggcagugggagggcggagggcgggggccuucggggugggcgcccaggguagggcagguggccgcggcguggaggcagggagaaugcgacucuccaaaacccucgucgacauggacauggccgacuacagugcugcacuggacccagccuacaccacccuggaauuugagaaugugcagguguugacgaugggcaaugguaggugggggcagaugugcccaggugugccagugggggcaggugugccuggguccaggagcagaucuuuggcacucaacuuuggggugggaggagaaugauacaaaaugguagguugguccuacaggccagcacagguguugccaagugaagcccaugugcccaggcacagugaucacaggcauucugggugaagggaggccugcaagggccaauuuccagcaaaagucgaucccggcuauuccucccaggcccuuccaguccucacugccucacaguggcucugcuuggcgcuuggcacagugacgugauggugagcucccccuuggugcccagcuccagcgauucagcccagcacggccccuucgugaaccccuugggccuagguucagagagacggcaagggauguuguaucccuggagauggugguuggagacauaaccgcauuucucggugucuuugggacuuuccuagggaaaugaaauuggcacuuagggaaaauggagcucucagggaaguuuugcuaacuacgaagccaacucagcacuguguguguugugugugcguucgugugugauagugaguuuccauguagguuguauggguggggugaugccuucaggaacccauuugcauauguguguucauuugucucugugugugaguucugggucuauuuuccuuuguauucauugagugggucuguguuugugucuuaggaguugcccguguugaucuugcuuauguauguaaguguguauguguguguacuugugucuguggauguuuguacaugugugcugugugugcgggucauagagcacaugcguuugugcaugcggaccuguuggagugcccuguucuuccugcaucuuuauccuguaugggcguuuugucgugugcccauauuuguaccugcuguguauauaugcaguucccugugcugcgggcgggggucagcggucucuggugugcacgacugcacagacccaaaugcaggacucuguuguugccacucaccaagugagauucauaucagcaacauguccguuugucucugagcagauuuuguugccgcugcgucucgccagauugaggcauccccuccgacaucacuggagcauaucuggagggguggacaguucuccacagggagguaggggaaaagaggaggcccggaaaccccuccuggagggaagagccccaucggucccaggccagccucagaggagagggggcaggcagcuggcugaggucagccugccacccugcuuccuucugugucuuggagccacucagccaguaugaggcugcagcuccagcugaggucuggaaucuuguggucagcucagcuagggugaggaggcagcugcugggcacugcuuguugucagcucagcaggugcucaccugccccugccguccagucacgugugaccuugggcaugucaccuccccuauccuggcuucuguaucuucuacaaaacaggcuucauucccccaggccugcuggcuggacggcuuuuaggccugucugaggaccacgccaggagcgcaaggcaaaaacacaccagagauagcaaacaagcugcugcugcacuagguggaguguuguguggccccacgaggaccacugcccugcccugggcugcuccccgcccccaucacuuuuuccaagcccaggaacugugugcuccugaggcagaggccaagccccugaacugggagucccaaagacaagaccaccuccagcucuggaaccagaaagaucugggcucaaauccggcauagauccuuccaaccugugugaauguggcaaggcaauuuccucucugagccucaguuuccucaccuauaaaaugggaauaaauaauagugucugucucccagggcuggccagaggauaaauaagaugaggugccugggugcuuagcccugguaaagggccuggccccaccaugggucaucucaagggcucugagcaucuguaagcaggguccccacauuccucacuggaguuugaaguggucugaauugggguuaugugaaguuguccucugaaguguuuugaguacauccugggcuggugucugaaaggcuccaaggauauuucucccccguccucuccccaccccaauggagcagcagcccuggguggcuccuuguucauuagaggcccagcagacaccucaacauguguggcacuggcuggaguagcccagcaagccuggaccauaaacccauggcucugcuucacgggaagcagugcgaugacaccaggaagccacuuuuccucucuaagccucaguguccucaucuguggaauagaggugcucggcugaccucagaggggagaugauagagcugacagcccccagcccauccugccucagaggugggagcuacuuccccagccuccugcugaauggccaggagcugugggggucagcucuccccgggggucgggggaggagaggccgagggagaaagggcacccacguggcuuaacaauuauccccaucuccaggaauaauucaccaaguggagggggcugcacuccuggggacaccugggagucugcgauggcagaaaugagaugcggcagugucugcuugugcaaggagccuggaaguccucugcuccgagaguuuuccuauguggaaaaguuuuuauuucaugaacacugauauagugcuuacuaugugccaagcacuucacauacacauaugagaauucaccgaauccccauaacgaaccuaggggaauaucacguuccccauuuuacaagugaggaaacaaaagcauagagaaguaaacgaacacagucaaugucacacggcuaaaaagugggcaagcuggaauugaacccugggcagaaggacuucagaggcugugcuguuaccuacagugcauggcccucucugggucuuaacuggaugccccugaggaauccaagguuggauucaggauuucuaugaauacacgugugugugugugugucuguguauguguguauguuugugcaugugagcauguguguguggacuguguguauguguauguauauguguggacuguaugugugcacacauuuguauauguguguguugauguguuuguauguaugcauguguguggacuaugugcaagugugugcaauguauguggacugugugcauguguggacuguguguaugugugugcauguguguggagcgugugugugcuuauguguggacucuguguucauguguguguacuguauguguacacauguguguauauaugugugugugugcgugugucugugugguguguggacuguguggugugugugaacuguggugugugugugcgugacuguguggugugugugcgcgugugugugacugcuuggugugugugaacugugguguguguggugugugugugcuuguguguggugugugugcgugugugggaacugugugguguguguggacugugguguguaaggugugugugugcuuguguguggugugugcguguguguggacuguguggugcgugugugugcuuguguguggacuguguggugcguguguguggacuguguggugcgugugugugcuugugcguagcgugugugcguguguguggacuguguggcacacacgcuugcauuuucccgggggcugacccauugcauuugucaucuucuucaaaggggucuaucuuugcugaaagauuugcugacaaauaaaggggguucagcugcugcuauuuuuuuaaauuuggaaacaaauuuuuuaaauuuuuuaaauuuuuuaaauuuggaaacagaccagucaaacugcugccuuuuaugguuagagaaaaugaggcccagaagaaauugaagcagggaaagcgaaguugcccaaguuuacaggcgaguuaguggcagcaucagcaguagugcccaggacuccuggcacccagcccaagauccucuuuccaccugccucuacggccccccucacauuuguguagaugcaguagcuuuugccugugggaugggagggaugggagauguguccagacccuccuaggaggccacaugagugugacuguucucggcccaagucuuucucguuccucagagaauuugcggggccccugggcacacaagcugagauccacccagcccuggucccuuggcaagaacugagggacaggaccugguucuggggaaaaugcaggggaauguuucucccuuccacagcccccuugcgaguuaggaggccggcucccaccccagaagguggccagguuuucaugccuuccuagagaaagcuggggcucguggccuccaccacaggaagacgcagacccucagaaacaagucugugaagucacaaccagccccaguuuacagaugugaaacugaagcuccaaaaagucaggaggucacugaguggggaggugauggagugggaacagcccccagaucuggcugaggccgaagcccuggagagauccccgcaaggcucccuuagaugccugacauucuguucuuccugaagccucacucccuucucuccuggcgcagacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcaggugaggagccucaauuucuucagcugggaaaugggcacacuugggcucauggccccaaggucugucuucucccugaguggguaggucccagagacagcugcccuucagggccuucaaggcucuucugguuuuguaaaagacuuugugaauccaagaagagcaucuauucuaggaaccacauuuacugaucaucaagcuacuggcugccguuuauugagcucuuaucauaugccaggcacaauacuaagucuuuguguguauuuacccauccccuugagcccauuguuguuuuucccauuccauggggccucuccugaagccucaguagaugagcccgucuuccagucuggugcuguuuuugggacaaauaggagauugaccccaggccguuccaccuaccccaggggcuuccaccaaccccaaagucuucccaaggccuuggagagcccucuuucgaaagcaucuccuguucuggguaaugacaauaauaaaaucauagcagcugucaauugcgagcacuugucauguacaaagacugugccccaucggcgcaugacuucauuucaccugucaacaccccugugagaugguuacuguuguuauucccauuuuauagaggaggaagcuguggcuuggagggcuaggcauuugcccaaggucaaccagcuugaaucacuggcagagccaggguuaacauucagggccccacccaucaccacgguguggcacugccucuacuuccuaucccccuccagagagaggcuuaugugaaccgaguauuaacucugagccauaaccaggagccugcuauggguucugagcuuuuauaggaugugguggaaauagcagggcucugguacuccagaggucaagguucccaacucagcucuaacaccaaccagcagagcgacccaggaccacauguugccucucugagccucaguuuucccauguuuagcaggacaggacugggcucuuagagaguucauagcaccuuuccagcuccugguggguucaagagagaacucccgggaugaagagaugagagcacugagguuggggggucaacuggauagccagggcccuaguucuguccuaagaggaggaaguugugucuucuccauccaaccauccaaagcccuccccagauuuagccggcagugcgugguggacaaagacaagaggaaccagugccgcuacugcaggcucaagaaaugcuuccgggcuggcaugaagaaggaaggugagccucggcccuccccgccccaccaccacugccccaccugcacccacagcuccccgacagucauuuacaacuguagccacacuuuaugacucaguggcaggccccagggugacuggcuaauggcugagaagagggagggccuggaaaucugaccauagggagcggcugggcuuggucuugagaaagauucagagagauaagcucccacucuuggcuccucaggcucccagcaaccaccaccccugccugccugucugcgccaccacaaagcagccacguuguguguguguguguguguguguguguguguguguuuaauauaauauuucgaacguuaggacaagcauagagaaugauauugcaaacaucugaguacucacuaucccaacuuuacaaaagggacagccagaggagcccgaugccugagcuuccggucccagggacaaaugccccaguucccuuaguauucauucguggguaucacgugaucuccaaagucuucacauucuagaaaaugggaacaagaccccagacccauccuggacaaaggaggagaagaccagagcacaacauuuauuaaggucuugccaggcuuccugcuaccagcagguaucagucacugggcugugcuuuuuccacacuucaguagguuggguucauuucauuuucaugacaacccuauaugggaaaauguugugaaaaugaaaugagcccagcccauugaaccuauuacaauuccucccuuuuuguggaugaaggaacugaggcccacaaugguuaagcaacuugccuagggccccacaacugauccuuggaagaucugaagucccagagcuucugcuauuuggaccacacuucagcacugucuauuauuuuaugcucuccagauaccagggacauuuaaaauuguuuucagcccaagcaagggaagcaaaaaucuuuuaacugcuuuaaaguaacuugaggccaggcgcagugaaucaggccuguaaucccagcacuuugggaggccgaggcaggcaaaucauuugaggucaagaguucgagaccauccugaccaacaugguaaaaccccgucucuacuaaaaauacaaaaaaauuagcugggcgugguggugcaugccuguaguccuagcuacucggaaggcugaggcaggagaauugcuugaacccaagaggaggcgguugcagugagcugagaucaugccacugcacuccagacugggcaagacagcgagacucucucaaaaaaaauaaaaaaguaacgaguucauuuucgaaucucuucauuuccugcuccucuaaacucaaccuuucccagcucugcgacuagucccagaccuucccuucuagcccacaguugugccguaccagccaaaccuuggucuaguccugcuaguucgguacaaacaccccucacccccaucaccccagcacaccccagaagcaggaacguaggacccagcuugcuccagggcccacugagaaggaggggaggggaggcuuugguagacucucuuuccccuguaucugcuccuggcccccuguuuucucugcccccucccuuggaaauaucuucuaugucucauccuuaugggaccuuagucugggcucaugagcugucuuggaaaaucugggcuugcugaucccgaugcaggagugggugguccccaaggccugcucugaacgcugcaauucuaacaucuagauaucagugguucuccaagggcaagaggggcuuuuuaagcugcaaauacucccuccucucccaaacccaguuuucaaugggguuaagccugucucauccacuucaacuuccauuuuguggacugggaaagauuaugaaugggaaccugaugcaugugugaacaguuggaggcaagaaaaagauugagaacuacagucuaagguuccaacauuucugugguuguauuagucagugauuccauuaucccaaaagccuaagauuuuaggcacuaugauuccucauaggugucauccagagggcacuguguuugagagaacagcucucucacagugaaaguucaggucugugacaggcagaugggagagggguuggcagcccuccugaguggauggcuacccaccuccacugcguguggccugguccugcguguggucaguuguuauaaaugucuuuuauuagacauccagagucauuuucacuuguguaauuuagggacauuucugucucuucugggcucuaguuuucccaucuauaaaaugaggacauuggauaaugaacccuucagcccuaugagucucgcuccucacucccugaccuaccugcacaagucacacugcccacuaggauggguguguuuguucccuggucccuucuuuuuuuuuuuuuuuuagauggaauuucgcucuuguugcccaggcuggagugcaauggcaguaucucggcucacugcaaccuccaccuccugggugugagugauucuccugccucagccucccaaguagcugggauuacaggcaugugccaccacaccuggcuaauuuuguauuuuuaguagagacaggguuucaccauauuggccaggcuggucuggaaccccugaccucaggugauccgccucggccucccaaagugcugggauuauaggcaugagccacugcgcccggccccuggcccuuucuugagcugcugcaaagccagcaaaccccuuacuaggcuccuggaagggggaugagagccccagaccauucagccuuagcucagccuugaaaauagcugcuugcuuccuggcccagggaaacggacaugcugcccggaggauaggagaguuggcugauggcgagugagcguggguuagucgaugcuaguguuuguuuacaugccuggguuaccuggaagaucaugacacaugcagucacuugguuguuuugagaacgggccagagugacaaaguguucaguugccacuguggucaagccauaggaaaugaggguauuccuagcugugccugucuucuaggccccaccaccccuccucagccugcugggaagcucccaaagccaaaagaaagucucgguggaagucucacuggccaggagaguugggacaaguuuuuauuucuuuuucuugaugaccuuaggagaauuugaggacugaaacccuaaaauagucccugagaaccagaaagugugagcuggaaagguaggauuucaagaccagcugagucuauaagaggucaucaaaucuaccugcuccccacuuuacagaagaggacacugaggcuagagaggugaugugacgggucagggguggagucaggucuagaacucaggcuccccagagcugagcagacaccaagcucccuggagugaaacuugcagugaucagcuugggaggcacauuucuugaucuagauggcugaaacuuucucucgaccacagagaggggcuucaggucucaugggccuauaagucucugccacaggauaguccaccauggcuggaaggggcucccuggaaggccaaagaauccagggagaacccugggggucagugggccaacagcaggucaagaauucuuuccugcaaccgaaagccagggagacagacaccugccuuggccuaagcugucaggcccaggacaaauauucggcuccuggcaucaaaaacccagcccagaaagcggacccagaguugcaggaggugagcguaggugaugggccaggggccaucugaagaggccuuccucggaagccccugcccugcuccccacagcccccuacccaggaguucccugggaagacaggcucaucaccucuccgccucugcccaggucgguuaauauucaauagaaguuacauuagguccccgacccugcuaauacugagcaaacauuuggaaaacaucauuccgugacugagcucgcgccgggcacugauaacgcccgccuaaccuugaggagcccuauccgcagcugcugacagcagcccuuucauuccgcccgccggccacucggcgcccugaugggugggugcgggugcuggcaggaggcugccgugggaggggugugggcgggugggguggacggcccggucagggaagccgugcucugagcuggccccguccacaugguggucugagaggagguugcuugccucuggacuucuguucuauccacugacucccgggcucaagugcaaaggauuugacuuuuauucucugauuuuaacaaugugucaacaucaagagaaaguugaauagcuggggugucaauguucccuggagaaauaggguucuuauaagaauuagaguuuaugaccagguguggugccucgcaccuguaaucccagcauuuugugaggcugaguggaucacuuaaagccagguuuucgagaccagccugggcaaccuaaugagaccccgucucucaaaaaaaaaaaaaaauuuagccaggcgugguggcacacgccuauaaucccagcuauucgggaggcugaggcaggaggaucgcuugagcccaggagguugaggcugcagugagcuaugauugcaccacugcaguccagccugggcaacaaaaugagaccccaucucgaaaaaaaaaaagaaaaagaauuagagcuugucucuuccaaugccuucguucucucacugcacaaauauucauugaguaccuacugugaaccaggcccuguucugguggcugggacuacagcagugaacuagagggauggaguuuuggccuucugaagcuuuccuucucagagagagacagauaguaaaggaaguaacaaauaauucuacaauaagugacuugaagaaaaauaaagcauggggggcagggccagggugggagucauguuguguuagacaggguggcuggagagggugucugaaaggcgacauuugugcagaggcaggagugaaaugaagaugcugcugcgcugugcaggaaagggaaccccaggcagugaccacagcagccuacaagcgugcggaugcguccagguggggaggcggguuuucgcggacagaguguguagggggaagccgguaaaaggugcgauccgagaggagaggaagggcccuggggacuugugagguuggaaggcacugguuuugagcagcaggcgacaugacuugaacggaucccucugucucugagaggaacacagacugcaggcgcaaggcagaagcagagcccaggaggaggcugaucuaauccaggagagacagcgggccugggagcagggagggagcagcaggucuguuugucaggaucacgacagcacuggggugugaggggaagccaaggaagguggccaggcuugaugccagucccugagacgagaaagagugcagggagccggcuggcagggaaaugccuacggguagggaaacugagccccagagagaggcugcgauugccaccggcacacagaguggcagguuccagacaggaagccgggucuggugcagcuucaaccucccuccuuucugaaucagccaagccucauuccacagugaggccucuuggacuccaagggcuaucccauccacugucgggaugguggaaggaucaucuucuaucucaggccaggacugacccagaugggagcaggcaguggagccuggggccccggugggcguaggcuccagaucccucagugccuggaacagagcagcagugggagggagggagacagcgccuggccuugcugaugcugagguuagucuggaguacaugcagcuccugcugauggacaaaaccaucaaggcaguuggagcccccagauccucuuguucaggaauccccaggccaucuccuugucacccagaguaauuuguuuugcuugcuuuacucacuuucauuuggaaagaaagggacccuuuuguagaccagagcuugaacaucuuuaagcuagucagauccccuccucaaugcucaagaccaauuuuaaacccauagccgagucuucacugucuugcgcgccccugcugauggguggaucacucuuauagccucuccauuguguugggggcaguugugauauguggaaaguucuuccaccagcugaguuagaggccaucuccccucauuccacaugcugaugugggccuguucucuggacaccccccaccuccugcucccacuccucaucagucacagacacccccacccccuacuccaucccuguucucccuccucaccucucugugccuccucacagccguccagaaugagcgggaccggaucagcacucgaaggucaagcuaugaggacagcagccugcccuccaucaaugcgcuccugcaggcggagguccugucccgacagguaccggggugauccugccacccacccagggaucccccacacuacagaggagcucaccuccuccaccuccauucuccccagccaggcccuggagcagcugacgggaggggccucagauauuacagaagggacacugaguccgguuucacauggcccaguuugcagcaagggcaggaaucgaaccuggcgcccuggggcacuuucuaauucauccuacugccugcaucccacaggccaagcagagucuucaccuucacugagggccugcgaucagcucagcuccgagagaacagagcaguggcucaguggagagagguggcaaaguggggcccagcccuucccuugcugagugaccuugggcaagucacagcaccucucugagccaugguugccucauugucagaaaaggaugaugauuuuuugcccugcuucuccucuaaggcugacagacuccuuggggcucuaaagcugacagaggagggggcagggggcagguaacaggugaaggcacagagggagcccuucucccucaucccugccuccucccucccuccguuuuuacccugagcuuccuucagagcuggagggcacccacuauccagcccccuccccacaucugauuccagggagggggcucugugcaggggacagagagugcgggagggcccggacaucuccagcauuuucuucccuguaucucucgaagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccaggugaggaugggcguggauggugggcaguagugggcagugggcggggcagccagggggcugcuggcccaccugggauauagccguggacuggcuugauuuuauuuuauuuaacaaaauauguagugcacacacgugucugaaacuuuaaaucaccuuacaaauauuaacucaguuagcuccuccaacaacucuaugagguagguacuaagguacuauuauuacugccaucucauaggugaggagauuggggcacagagagguuaaguaaccugcucaaggucacauagcuacuauccagcauagcugggauuagaaccuggcaggaagcuccaaaguccaagcuccugaccauuguaccugaggcucucccagggggauguugacagggacccuaggacagggaucaggagauuuuggcuuaagcuauggcucuaagacugguugucugccuaauccugggcaaaugaguuccucucucugagccucaguguucucuuaucuguaaaguggaaaugauaauauccacuuuagagugugguugggaggauugaggacauuggugucugaaaaguacaaaaaucaggugauggggcaagcugcacaguggccagaccagagcuggucucccuaaacauuaguuucuuccuuguuucccaccaaaacgauugaacucagcaucguguuucccaccaaaacaauugaacugagcaucauauuucccaccguacauuuuuuuggaauacugaaaugucccuagggggaagaaaggguugaaggaagguggcgugugucugaggacagaugaauuucggagaugccaccuaugaagcuccugcccagagcaccccugggccuccaaagagauguuacccaucuggggaagaggagcugggcugggccaccuucucagcuucggagacagacucuggugcauucgcuuacccguuucgcaccuuugcauaagacacugacaaugcaugugagucugugaaagcuucugagaagucucguccaggcaguuguuugacuuugcagaggccgaggcuucucaaacuccuucggcaagauucuccuggaacaccuauuaauacugcacauugggacacugugaaaacgcugguuuggcuuguccccagccucauacaggggcuggacccggggcccucuuccaugguuccuccuuccauuagcagagucgacagggcaaggaucuuggacaauccgccccuacccucuccccuguuccuugugcucuggccccaguccccucugcuggagucucuacauuaauguuuaaucccuccuguuccuucccaggggcuuagcagggcaacaagauacccccaaccugagcaauuguuaaccucgauuucccacccaaaccucccuggcuggggcucagagcauucucagagagcaaugauggguggccaauaacacaggacaaucauuaacacaccaccccgaccucccggcccaccccccagaacagcugccauaucaggggguugaaccugggaucagaaggguucccagcuccccauuccugguauaugaggagcccagcuugcccaaugcagguggggcaucccugggaaagucgggggcauuguccuccaaagggcuucccaauuuuguugacauugccccagaaacuagauucccaguuggugugcuucuugggccuggauacaauugcagaaagagauuggggcuuagagagagacagaaauuugccugaagucacagagcaaguuagcgacagaacugggauucaaauccaggucuuccgcuucgcgaugugaaggccacuggagugacugaugaaagacuugcacagugcccagugcgcaggaggcgcuuggcaaucagcauccucggccucccuccauacuggucauggaaaguggauuuucccucccaggcaguuuccucuuuuucuguuuuccucacagguuucuauccauggggaauagaaggggcaaggacaaguggcugcccaggagcagcuagagcuagagaggaagucaagauguuugcucauucauucauucauuuccccuuuccuuccuucauucaaauauuuauugaaggcuuauuuugugccaaauaucuucagacaaaugccuucuuuccucuaacaacaauuucaccuccuuagaggccuucucugaccuccccaucuaacguagccauucuugccccauugcucucaccauccuuuccacuccccucccucccuccuucccuuccucccaccuuuucuccuuccuucuuuccuuuaugcugugaucacccuguguccucuguacuuauuuguucucuacuaucuguucauccucucuccuauaaauguuaguucgaugagauuagagaccuugucucucguuuuuaaacauugugccuccauugucuuaaaaagugucuggcauuuaguaggcauuuaggauuugauaacugaaagaaugaacaaucaaauuaaugaacaaacaaaggauuuuaaccuucuaguuuggcuugcuauggaaccuccaaacucccuaacccaaccuugaagaugagaagaugagauccuugaggcuaccagccuggugcuguuuuguuucaagccauccuuugguccucaggcaagcacuaaagcagauggcucucagugggcuggcuauguccuucugugagcuugcugggccccuaccuaugacuccagucuuagaagucuugccuuguacccccugcagagaaugguuucaucaagcugauucucugccaggggccagugcucauacauuugcucugagaaggaccagcccugagaccuaacauccacauccaaguucuuguaaugcccucucagaauccuggaguccugcaaugucgaucccuggagggaucugccagaccaaugauuucccaaacagaauugcacuucagagucaacuauggagcuuuuuaaacacagaucccugggcccacccuaaacauacaaaaucaggaucagaaucucagggccuaagaaucuguauuuucaggccgggcgcagugguucacaccuguaaucucagcacuuugggaggcugaguugggcugaucaccugaggucaggaguucgagaucagccuggcaauauggugaaaccccgucucuacuaaaaauaaaauuagccaggcaugguggugcacgccuguagucucagcuacucuggaggcugaggcacgagaaucacuugaaccugggaggcggaagcugcagugagccgagaucaugccacugcacuccagccugggugacagagugagacucugucucaaaaaaaaaaaaaaaaauagaaucuguauuuuuacaaagcacccuucauaauucuccauagcugguccaugggugggaauuugggacccacaguuuuggaacuuuuugggaucauagaccuuuuugagaaucucaaaaaagaaaaaaaaagcacacagaauguugcuuacaguuucaucaggcacacagaagaggcccagcacgaagcaguuucuugcccaaggacacagcaguucaaggacagagucagcgcgaggucucucagcucugagcacauguucuuuccccuuccagguuucuaguuuuauggguaguaguuuuaugaugcccauuucacaguucaggcagguagaggcagaggggagcauuaagcugacuugcccagcgucacugaguuggcuacgggcagccuucccaaggguacagauggcaaacacuguuccuucucucuuucagguggcccugcucagagcccaugcuggcgagcaccugcugcucggagccaccaagagauccaugguguucaaggacgugcugcuccuaggugaggcggcugccugcccuggccagggcuccagggaggguaugccuagcauggcacucacccaggcaaggagauucacaugguggcaugcaagggugagggagacuagucaggaguggcccuguccucaggcuugcauuagagggcuccaggacucaguuuucaacuggguaccccacucagaugcaaggaaauguggaugcaagucaccaaauucccagcauugaagucagagcacgaucaggguuaucccuggaauuaccugugcauccuuuuuucuuuugacagagucuugcucugucacucaggcuggagugcaaugaugugaucucggcucacuucagccuccacccgccacguucaagcaauucuccugccucacccuccagaguugcugggaccacaggcgugcaccaccacacccagcuaauuuuuguauuuuuaguagagacaggguuucaccauguugaccaggcuggucucaaacuccuggccucaaauaauccacccgccucagucucccaaagugcugggauuacaggugugagccaccgcgccuggccuaccugugcauucugauguucuuucuggaguaggagcaagaggugguuaagaauggcacaaagccccagcccgcgucaccugugccuucauggcauaguuauuauuuuaaacgcuuguacagcacacacugugugccagggacugugcucacugcuuugcaaacacuaccuauuuuaauauaacaaugcuaugagggaagcucgauuauuuauccucaucuuauagauaagaaaacugaggcacagagagguuaaguaacuuauccaacuauaaccagcuaucaggggcagagccauuuaagcagggcagugcaguuccagaaucugguccuuuaaccuugaugcuuuggugccuaucaggugaccuuugaaugucaucgaucuugugagucauguugguaaauggagcuugggucaugugaaagagguccuagaaagccaaguuccaagcucagccggaugacucaaggcagcuuaucuucugaaucugggccucagcuuccuuaccugugaaaugggagucaccaucccugcagguccuccucccacaggcaccagcuaucuugccaacuuaaaagccaaaacuagaggagaggggucaacccaaggugacuucccauccucccucccucccaacccuuccaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagguacagugcacaccuccuaagccaucccugacucucucuccagaacgcucugccagacuucuccuauuggguucuguacacugaguucacagccucaucucauguuaacgacagccaggagaggccguuuucauuuaacagaugaggcaagucaagauuugaagagacaauauggccgggcgcaguggcucacaccuguaaucccagcacuuugggaggcugaggcgggcggaucaccugaggucagggguucaagaugagccuggcuaacauggagaaaccccaucucuacuaaaaauacaaaaauuagccaggcaugguggugcacgccuguaaucccagcuauucgggaggcugaggcaggagaauugcuugaaccugggaggcggagguugcagugagccaagaucccgccacugcauuccagccugggugacuccaucucaaaaaaacaaaaacaaagggaggauaugacuugacagggcacccugacuccaaaggccugggcuuucccuucuuuuacuucuucccuccauccuucuuucucuuuacuucccaucuuccucuuuucuuucauauuugcuucuuuuccucaaaaaaauuuaucaaaauaauaucuagaaccggaugugguggcucacaucuguaaucccagcacuuugggaggcagaggcaggaggaucacuucaggccaggaguucgaggccagccuggccaacauaacaagaccucgucucuauagaaacuaaaaaaaauuagccagggauaguggugagcaccugcagucccagcuacucgggaagccaaggugagcaccugcagucccagcuacucaggaggccaaggugggaggaucucuugagcccaggagguggaggcugcugugagaugugauugcaccacugcacuccagucugggugacaaagcaagaccucaucuaaaaaauaauaauaaauaaauaaauaaaucuacacauacuuaaaaugcaaauacuucuccccauccuacuuuuccagcucuaagucuacuccccaagagaagcaugucugauuauuuuaauuguuucuucuggcaguuuccucaacaauucuaaaugaaagacaaagccuuauauuuguugaugcauccauuuuggaucauaauguuccuccuaggauggcagaggauuuugcuuuucuccaucaccauucccaucuuuucuuccccauuuuucccaauauauuuuuauugcuauuuuugagucucuguugcaaguuaugugcuuuuaucuuuccuuucuuguucuaucaacuguagacgguaucucccaacccuucacauugcaggaugaagaaaaagcauuccuacccucuccuguggcucuuggcucuccucuccccauucuguccacugacuuuugcaccugcauuuauacagaaugcauuugucaucagucuuuguacaaaacuugcuuuuguuucccagcaucaaaggugccugaacucuggaggcuugcuugccuucccugcuuacauguuagaggggaccuacugugugccaggcacuguccuucacgcugcaaauagauuaccucuaguaauaauaguaaugaaaaggcugggugugguggcucacgccuguaaucccagcacuuugggagacugaggcaggcagauuacuugacgucaggaguucaagaccagccuggccaacauggugaaaccccgucucuacuaaaaauacaaaaaucaguuguguguggugguccgugccuguaaucccagcuacucaggaggcugaggcaggagaaucgcuugaaccugggaggcggggguugcagugagccaagaucaugccauugcacuccagccugggcaacaagagcaaaacuucaucucaaaaaaauacauauauguguauauauauauaauauauauuauauauauauaauauauagugauauauauaguauauagugauauauuacguauaauauauauuauauauagugauauauauuuuauauauauauagugauauauauuauauauagagagagugaugaaguggaagaugagccccauguauugaaugcucccuaaagagcuguuuuuaaacacuuuauguggauugucuuacuuaccaacaugguaccugugaaguaggaauuauuauuaucuccauuuuacagauaaggaaacugaggcaugauuaacuugcucaaggucacacaaccggaaaauggcagagcuuggauuugaacuucagaccaccugucaaucccaauuucucucucucaagcccacauucuuaccuaccaccugcuaucccacacuuaccagagggugagauuucuaguucuaguucccuccacagccuggcccagccuguauccucuguagugcucaacacgaggcuggacuggcagaauuguucugcaaaaugggaaggaucacugaugcugagucagaggcagcagccuccagcaauuugaaggggcgggggaccuaguucaaggccuggcaugcaggaggugcucaauaaacauguguggccugaaugaacuaaugaauaagcaugauucaguggagacagcccacuagaaaugugggugaauguucuuucugccacuuccuuuguccaugaaagaggaaauaaaugcauuaccuccaugaagguugagauuaaauauuguaugaccgcuuaaguuccuuucuaggcuaaggaucuagaauuuauucacugauuuuuuuuucauucauucauccagccaucuaacaaaaaauauacauauaguuaucaauaaauauauauuuauauauaaauauauauuuuuuaaaauauauauauauauagucugucacccaggcuggagugcaguggcaccgucuuggcucacugcgaccuccaccucccaguuucaagcgauucucccaccucaccuccugagucgcugggauuacaggcaugugucaccacgccaggugaauuuuuguauuaucaguagagaugggguuucaccauauugaccaggcuggucucaaacuccugaccucaagugauccccccgccucggccucugacagugcugggcuuacaggcaugagccaccaugccuggcccuauucaauaaauauugacuaugcauggugcuagguggugaguuugaaaaggcaaaggccgggugcaguggcucacgccuguaaucccaacauuuugggaggcugaggcaggcagauuacuugaggucagaaguuugagaugagccugaccagcauggugaaaccccgucucuacuaaaauacaaaaauuagcugggugugguggugugugccuguaaucccagcuacucgggaggcugaggcaggagaaucgcuugaacccaggaggcagagguugcggugagccgagaucacgccacugcacuccaggcugggggucagagggagacucagucucaaaauaaaauaaaauaaaauaaaaauggcaaauaagacauacgcgugccccugccaaacucacaguuggauggcacaacaauuacauccuguguggucagcagugauggaggggccgcagagauuuggaaacaggagggacacaggauacagauauaggaggguagaaggcagacuuccuggaggaggugaaaccuaaccugagucccuaaggugauaggaagcaggaaccagggaaggggagccuauucuaacacaguagaagcagcaacugcugaggucuggaugaggggaccucaacuguggcccaaaaccccaaguucccauuguggcucugccaacaacuggcugugcgacccaggacaaguccuaucuuugcacugugucuggguuuccccguguguaagaugaggcgguugcuaggugcuuauuggaugcauuccucaagucccgcccuccaucuccuauuccccucucuucugguuuagugcuuuaggaaauguggcagaaaucuuuuucugccugugucuaggaaaucauaauucaugcuggcguacccugguuguugaggucccugaauccuugugcccacacugcugaagacuccuugugugauacaagucaggggacaucugggucuugacuccccagaugcuccagcuggacccugcugcccucccuugcccacccucuuccauuguagaugccaaggggcugagcgauccagggaagaucaagcggcugcguucccaggugcaggugagcuuggaggacuacaucaacgaccgccaguaugacucgcguggccgcuuuggagagcugcugcugcugcugcccaccuugcagagcaucaccuggcagaugaucgagcagauccaguucaucaagcucuucggcauggccaagauugacaaccuguugcaggagaugcugcugggagguccgugccaagcccaggaggggcgggguuggaguggggacuccccaggagacaggccucacacagugagcucaccccucagcuccuuggcuuccccacugugccgcuuugggcaaguugcuuaaccugucugugccucaguuuccucaccagaaaaaugggaacaaggcaauggucuauuuguucaggcaccgagaaccuagcacgugccagucacuguucuaagugcuggcaauucagcaaagaacaagaucuuugcccucggggaggcugugugugugugaguauguauggaugcguggauaucuguguauaugcccguaugugcgugcauguguauauaaagccucacauuuuaugauuuugaaauaaacagguaaua

SEQ ID NO: 61619 - RNA, 77045 nt, Homo sapiens
ggccauggucagcgugaacgcgccccucggggcuccaguggagaguucuuacgguaaguggggcugggggaagacuggacagggcgggacugcggucagcuuugggaggccaugggacaccuccccguguguuucuuacgggcccaaagcuccuccuggagcuccucuggaagggcaggaagccccacggaggcaaugugaccgcuucccuaagcucucaagccggggcauggccugcuuggugcgagaagugcugggaggggccgagaagcccuggggcagaggcuuggcucauuuugucuguccagaggccuuccugggaaugcaucucaggggucuuuccaaaaccccacagaggguggggcuuggaagcaccguccuguuucgaugcggggcaaauugagguccaccaggagaggcuugcugggccuaggucacguugcuggugcauuaucaagcugggcgugggaccgggcagcucggucgcuccgcaccuccguuggcucuggauaauggggaggagguagaaagcgccgcgcaggguggagcguuggaaaaugagaauaucuugugcggacgugugaaacucagaugcagggcuagaaagcauguguuacugagagugaaaggcucaggcucacuccuuagggugacccccacauuggaagcaacccaaugucccucagcagagggaagacggguaaauaaagcgugagacgucuuuacaguggaaugcuaucccauuguucaaggaaacaacgcacaucugugugugacagggaagaaccucucaguuaaauuaagugaaaacgguacacugaagaacuguguaguugcugauagcgaaacggauauagauguauauauguacacacgcguauacguguacauuccacgcauagaaaauucguggaaugacacaauaaaauuggugacagguuuguuucugaggagggaaauucaagagaauguuuuaucuuuuggggacacauuuuggauuuuuuaaaaguugggugccuuuuauaaaccuguucaaaucacacacccgcacagaacuuggucucuggaauccagcagaccucggggucuaguugugacucugucacacggcucaacauucacgugccucuugcuuucuuucugaaguggagacaggacuaggaugugucuuaagaucaugguggaugccguggggaacaaggauguaaagcccuugauaccacgugcauugcaaagacacaaucaacauuuaugucaucaauugcugaggacagagggccagggaaugacagaaucagggccugaucuccugacucuagucaggaagaaucuucuuugcuuugacccccaucaaacaggaauaugugaugcacuggaaauggcagaggcugaagaaaccaacagccugggaacccaucccacacaccagcugugugaccuugggcaagacauuuccccucucugaaccuauuuccucaucuguaaaaugaagauaacaacaggaccuaucucccagagagcggggagauuagaggagauagcauagaggagauuaagggugaggccacccuuaauccacaauuuuaagaccuggaguauagaugccaauggaugacuugguugaaccuguggcuaggggaagacauugucucucaaaggggccagacagcuucuggggaaggacagcccaggucauaaggcuaagcuaggggugaacagaaggccccacagugucucuuaaaggaugauacaauaauauaaccugacagccuuucacugucucccacgucucugcaccuuguaggauguccucaugucucuucaucucugcuccugugucauacucauuauauagcaaacauucagcaauuauuagaaugguugcuucuaucgacagguaggugggugaauggauggaugaauggguuagugaauguucuacuauuaucucucagacagcuguuucauuuuccaaacggcugucugagauaaauaauauuguaaucuccaaggacagaagaaaaaacuaagguucaagauuaaaaaaaaaacacaaacaaacaaaaaaugucaucugacucgagacuugacacaauccagcuguugcuggcccucugcucuaggccacagauauggcuggacagagaaaggagaacuccagugaccuugcaguacauccacaaaaaaugagcacuuuuguccuggggcaguggaacauucacugcaguguaugugugccuauguguaugugugugagaguggcugaaagacccugauuugauauuuuugauaaaauacaccuggguuagcauccuagaucuaccuuauuuaaaaaaaaaaaacaaaacaaaaaacuguguggucuugugagucaaaucauuaccccucucugagcuucacauguuuuaucuguaaaaugagcuacugaagucugcuggaaggcuccagaaaaaaaaaaaaaagaaaagaaaaauuugcuuucugagaaaagaaacaagugcuccgaggaaacaaaaccccucucccaggcugggugcaguggcucacgccuguaaucccagcacuuugggaggcugaggcgggcagauaacuugagauuaggaguucgagaccagccuggccaacauggcaaaaccccgucucuacuaaaaauacaaaaacuagccggguaugauggcacacgccuguaauuccagcuacuugggaggcugaggcaugagacucacuugaaccugggagguagagguugcauuaagcugagaucaugccacugccacuccagcuugggcagcagaacaagacucuaucucaaaaaaaacaaaacaaaacaaaaaaacaaaaaacaaacaaaaaaucuucuucugggguucucuaauggggauaacauuaaucaucuccuaagaugacuauaguagaggugcauuggugggucagggacauggcacauagcagagccucaguuagaggcagaggaagacauggcuguugugaggaucaaauggaaggauccaugagugcuuagaacaguccuggguccagagcaagcacgcaagaaauccucguugugguuucauguuuuugagcuuuagcaggauucuaaagagcugcucuuugguguggugaugcuggguggacuuggcccucccuggacuuccggugcuuccacggcacacugguuuuggcuuugcgguucucgucaucgcucugaucagauaguugcuggugugaauuguggugucuggcugccccaccagacuauaaacuccgugaguucugggaccuggguaguuuguucagccuuguuugucucacuaugucucacauggugacuggcacagaagaaaugcucaauaagcauuuguuggaugagugaaaugaugggcuuaaaacagcgcuacaaugaugaucaucaaugucagccagaucccacucucuugccuuccuuccucucugcccuccucacugcguugucuuugguccuuguauuugccccauuauaacccaaacuggcugucccagcuucagcugucaugucugcacuuacgugucugaagcuggaggcaggaggagaagagguuuuccucagugcccuuguuucuuuuauccaaaagcaaaacuuccccagaaaccuccuggcagacuccccuaguucaaggaaagcugggaagacaaguauguaguggaaagagaugggaaagccaagauggaccuagaccagugauuuuucucuugggguguggcacacuccugcuccaaacagaacugaggcucugguauaaaugaguuucucagccucagcacuguuaacuuucuggccuggaagauucucuguggugaggggcuguccugugcacuguaggauguuaagcagcaucccuggccuuuacuccccagaugccaguaacaucucuucccaucaguuuugccaaagaaaaaaugucuccagaaagccaaauguacccuggggcacauauaaccccacuguguuauaggagaacaagguaguucuggggagugucuaccacaauggaguagaguagacugugacucuuguguuguucugcuuugagugccaggaucuugcucagugccaaucugguacuacccugaguaacucugaggaugagaugcuaaacaugcauaucugugugcuaaccugacuccuggccuuauuacuuuucuacccuuauuuucccuuuaacaaguuucccuugguuauuuauuuugcuucuuugguaguugcucauuuccguaaguaccucgaaucuccuuaaaggaaaggucuguaucuaucucauucuuuuuguuauaguccagccuuccacagggccugaucccauguagaccuugauugaagauuaauuaaguggaugaaugaaugggaagauggauggaugaauaaauguauguuuagguggguggauaggugaauggacugaugaaugaaugugaugugaugaauggaugugauagauggguggagggaugcaugaauggaauagagggagaaauagcuggauggaugagacaaaugaaugaguaacuggggagauggcuggguggauagauggguggauggauuaauaaaaagauguuauggguggaugguuggguguggaggaugaugcauggauggguaaguagauggauggaaagauauguaggugcaugugauaaauggaugaauaaguagcuggauagauggguaggugguuaggggaaggauggauggacaaaugaugugaugaguggguugaugaaaagauggaugaauggauggauaagaaggggugggcugagguagccuggaauagcagcaucuucaagugcucuaaacaggacaagugaagagauaggggaugucaacaaucuuccaucagggcaauacuguauaucuguuuuuaagugccaggugagccuaauuuuuccuagcuauguaggccuagucccuuugaccaauagcaucagcuugaggacagaucagaggccauugucggagacaguuuggugauguggcucugccccuugaagcucuaugaugauggugcuuugcuucacuucucugguccucaguuucuucacccaucaaaugagccuugguuguugugaagauuccaugagcuaaugaaagagaaaagguaauagaagcuauaacaaacaugccguguccuugugaaggguggauaggcccaaaaucgaguaggaccccagaugcuggcuggcuaugggaccguguccaauaucaggcuauggcuguucccacccuucauucuuaaaauauggccccucuccagcccuuccccuaucuccccucccacaucaccuucccauccuacgucaauucagucuucagccccuaugauucacaaaccugguugcacauaggaaacuuuuuaaaacaauuuuggggcuccacuccagacccagugaaucagucuccuggggugaguuccaagagucuguaauuuuuugagcuccuugugugacuuaggguaugcaguucaguugagguauggaaaccauugccuuacuuucucccauuuaguaaacagaggaacuaaauauccagagugcaucuugccucaacccagaagccucccguauucauuaauucauuguucauuuguucauuucuucaacaaucuuccacuggaggcuuaugguauuuaagacauuuuguaaggcacuggggaaacacaggaggauaaaacuuugcuucacgugguggcucaugccuguaaucccagcacuuugggaggccaagguggguggaucaccugaggucaggaguuagagaccagguagaggcagagguugcagugagccaagaucacgccacugcacucuagccuggcgacaggagucagacuaugucucaaaaccaaaccaaaacaaaacaaaaccaaaaaaaaacaacaaaaaaaacaacuuugcuucagaucuuaaacugugcucaguuuggcaggaggacagacaagccagcagcaaccaaagacagagugccaugauaaggacagcaaaggcacugugggauacagagggacuuaggagaaggggaaggggucacagacuucuugaccuuggaggaguagacugauaucuaagcuggaaccucgguuuagcaggagucagccgggagaagagacgguggggaagaguguucccagcugagggaacagcauaugaaaaggccuggagccuggccacacacugcucugauuuuacuuauauuugacugcaauuaauuccauccuuuacugaaaguaucuugagacuugucugguuguuucaugauugauuaaucuuauuccuaaaagcaugcugaggcugggcaugguggcuuauuguggauuacacgccuguaaucccagcacuuugggaggcuaaggcggguggaucacuugaggucaggaguuccagaccagccuagucaacauggugaaacccugucucuacuaagcauacaaaaauuagcuggacguggugccaggcgccuguaaucccagcuacucgggaggcugaggcaggagaaucacuugaacgcaggugguggagguugcagugagccgagguuguaccacugcacuccaaccugggcaacagagggaaacuugucuuaaaaaaaaaaaaaaaaaaaaaaagcaugcugagaugcuuaagugaaggaauugugccuuccauuuuuccugacucauaugccuguagcauaaggaugggucaaugauaacgaaaggaauuuguuuucauuuaagccccuuuuauguaaugggcaagauguuggcuauuugauauguuuucucccuuuuaagccuugcaauaacccauccaaguaggaaauauuaucuccauuuuauaaacaaagaaauugagauucagaguuguuaagucacguuucccugcaucgccuugcaaauaggugauuaaaaucuagucugacaccaaaucuucauucuuucagcuauuaugucauaauagcauccaaggaguuuaccaccuucuaccaccuacuagcugugugaccuugagugaaugacucaauucucuuuuuuuuuuuuuuuugagacggagucuugcucugcugcccaggcuggagugcaaugguaugauccuggcucacugcaaccucugccuccuggguucaaacaauucuccugccucagccuccugaguagcugggauuguagcugggguuacaagcgccugccaccaugccuggcuaauuuuuuuuuauuuuuaguagagaugggguuucaccauguucgccaggcuaguuuugaacuccugaccucaagugaucugcccgccucggccucccaaagugcugggauuacaggccugagccacugcgcccggccgacccaaucuuuuuugccucaguuuccucaucugucaaaugggguugaugauaauaccauuuacuucacaggguuguugugagacauaaagucaauauuuguaaagugcugagugucuagcacauagaaagugcuaugugaauuugaacgauuauuauuauuauaccuauagugugugcaucuacuauaugcaaaggacuggaugcuuacuagguguuagcaucauuuuggcuguuguagaaacaacagagaugaguaaggaauagauaacuggucccaggaugcaacugucucuggcuggagacuaaggacaaggcuuuguugcaagccuucuggggcccugggaugcccagggucuccucuugggggugcugguucauagaugggggccuguguggcuccuucacagaggaggaggcagaugagaggcauagaaagggaggggacagaccuauccucaucagagaccugggagauggcucuggcccuggcccuggguagcuguuugugaccucacucaaguccuucuccugcuguuucuccaucuacucuuuuuuuuuuuuuuuuuuuuuugagacagagucucaaugucacccaguggcucuaucucugcucacuguaaccuccaccuccuggguucaagcaauucucaugccucagccucccaaguagcugggauugcacgugugugccaccacaccugacaaauuuuuguagucuugguagagauggguuucaccauguuggcuaggcuggacuccuggccucuugugauccucccaccucggccucccaaagugcugggauuacagguguaagccacagcacccagccuccauuuccucuuuugagaaauggagguaugacaaccaucuggcucagccauugucacacaguauucccuggguccuaagagucaggaaagaugcugcaggguucccuuugaggguaauguggguagggacguguucaaauggacuagggcuuagccucuccccacccuucaaccucuggcuccaucagagacacuucuuuuugacuuuuguauauuucuuuuuauuuuauuuuagagacaggggucucgcuauguugcccaggcuagccucaaacuccugggcucaagcaauccucccgccucagccucccagccccugggauuaccugcucaugccacugcacccggcacucuguuuugacuuuuaaaugaaauauuuaauggagggucuccacaguucaaaaauauuuggaaaaucagaagaccacaccaguguguuucaaacugcaaucuuaacccaggaauaggucaugcaauuuuuuuuuuauuuuuuuuuucuagauggagucuugcucugucacccaggcuggagugcagcggcacgaucuuggcucacugcaaccuccgccuccuggguucaagcaauucucugccucagcuuccugaguagcugggauuacaggugcccaccaccgcggccagcuacuuuuuguauuuuuacuagagacggacuuucaccaucuuggccaggcuggucuugaacuccugaccucgugauccaccugccccgaccucccaaagugcugggguuacaggugugagccaccgugcccagccgguccuucaauuuauugggauuauauuaguucagacaauauagcuuauguaacaagcaaaugcagacuuuaaguuagaaguuuauugaccucuguggcauagucauccagggaccccuaaggucacccuagcccagaaagacacuuucacuucuacucacauuccauuggugagaacuagucacauggcccuugccaaaugcaagggggucuggaagauguggucccuagcggggcgggacuagcuguaaaguuuguaaaggggagcgugaauuaguugguacacaguugaucgucugugcaguagggucaugcucacacgucccuccacacacacacguuaaauauguauaacaaguguaaauauacaauuuaaaaaaguaucuuuuuuuuuugguuuguuuuuguuuuguuguuguuuuugaaacagggucuugcucugucaugugggcuacagugagccacaaucaugguucacugcagccucaaccucccaagcucaagcaauccuuccaucuaagccucccaaguagcugggaccacaggugcaugccaccaugcccagcuaauuuuuuauuuuuauuuuuuuguagugacaggucuugcuguguugcacaggcugguuuccuacuccuguccucaaucuuccugcaucagccucccaaaaugccgggauuacaggugugagcuacugcaccuggccuuuacaauuuuuuacauaaaauguuucaauaaaaaagugcauagauagauacagagauagcaauaaagcaaaugugacagaaugcaaccaguuggugaauuuaggcgaagggauacaucagugcucacuauacuagucuuucaaacuuuaaaguuugaaauuuuucaaaguaaaauauuggagaaaaugaaauucuuaaaauuuacuagaccuauaaguagacuaaaacaauaaguuauaacuaaaguaagauuuggccggacgccguggcucaugccuguaaucccagcacuuugggaggcugaggugggugaaucacuugaccccaggaguucaagaccagccugggcaauauggcaaaaacccaccucuacaaaaaacacaaaaauuagcugggccuggugguacacgccuguagucccaccuacucgggaggcugaggcaagaggauugcuugagcccaagaggugaagguugcugugagccgagauuacaacaccacacuccagccugggugacacagcguaauccuagugcuuugggaggucaaggcagaaaaauugccaccacaccuggacuuaaaaaauauuuuuacugaaguauaacauucaaaacagaaaaaggcacaaaucaucaauguaucgcuuuaugaaauuucacauuuuaacaaaagaaugaaauaaaauaaaauagaaaauaucauagagcauuucauguaguaagaguaagauauguauguuuuugaaacuuuuguuuuauuuauguauauuuauggauuugugcuugauguugugauaauagcaaaaauuuauagaguacuuacuaggguuuuacacauauuaacuccuaauucucaaaaugucccuauuggccgggcgcaguggcacacgccuguaauccuaguacuuugggagcccaaggugggcggaucacuugaggucaggaguucaagaccagccuggccaacaugcugaaaucccaucucuacuaaaaauucaaaaauuagcugggcaugguggcacgcaccuguaaucccagcuacucaggaggcugaggcaggagaaucucuuaaacccaggagguggagauugcagugagccaagaucacgccacuguacuccaaccugggcaacagagcgagauccugugucaaaaagaaaaaaacaaaaaaaacagcauacuuuguauuaggugaacccacaaaguacaggggccaauuguagguaguccacaaacacuuuuaaaucuuugugcauuuauuguauguuagaaaaauuuauacauagcauauuaaagcauuaauauaaaauaucuuuuaaaaauuaagguauaucuucaaaagaaaggaaaacaucaaguaaacaauuauagauaaauaaaguacagguaaaaggcagaugugguaacaauuguaugaagaggaauacaagugucuagggcuugggggccacacacuaaaccuggcaucagaaggcccagaucugggacccggcucauuuguuuucuagcacuagguuguuuuucauccuuguauaacaccauggcccagguacuacucuaagcacuuuauaaaaauuaacuccuggccgggugcgguggcucacgccuguaaucccaacacuuuuggaggccaaggugaguggaucaccugaggucaggaguucaagaccagccugaccaacauggagaaaccccaucucuaccaaaaauacaaaauuagccaggagugguggugcuugccuguaaucccagcuacucgggaggcugaggcaggagaaucacuugaacccaggaggcggagguugcggugagccgagaucgcgccauugcacuccagccugggcaacaaaagcgaaacucugucucaaaaaaaaaaaaaaaaaauuaacuucuuggccaggcacgguggcuaacaccuguaaucccagcacuuugagaggccgaggcagacagaucaugaggucaagagauugagaccauccuggccaacauggugaaaugccgucuuuacuaaaauuacaaaaauuagcuggguguggcacauggcuguagucccagcuacucaggaggcugagacaggagaaucgcuugaacccaggaggcggagguugcagugagccaagaucgcaccacugcacuccagccugguaacagagcaacacuccgucucaaaaaaaaaaaaaaaauuaacuccuuggccagacaugguggcgcacacuuaaaucccagcacuuugggaggcugaggcaagaggcucacuuaagguuaggaguucaagaccagccugagcuacaaagugagaaaauaaauaaauaaauaaauuacuccuuuaauccucacaaccgucuauugagguagguacugucaucauacccauuucugagaaaacaaagucucagagagacuaaauagcuuacucaaaaccacgcagcgcaugagaggcggagcuagaauucaacaucaaggauuguauuagaaaaggcaauaccagcuuaucaacccaaaacacgagaggagaguuuaucucuccuucacgcaguuguccaggguccccaacuccuuccucccuagauggaagaugggcuuuuuuuuuuugagacauaaauauauauauauauguguguguguguguguguguguguauacauauauguguguguguguguauauacauauauauauauauauauauuuuuuuuuuuuuuuuuuuuuuuugagacagggucucacucuguggcccaggcuggagugcggugguaccaucuuggcucaucacaaccuccaccuccuggguucaaacaauucucgugccucagcuuccugaguggcugggauuacagguuugcauuaccacacccagcuaauuuuuauauuuuuaguagagaugggauuuugccauguuggccaggcuggugucgaacucaugaccucaagugauccaccugccucggccucccaaagugcugggauuauaagugugagccaccaggcccugccaggaagauggguuuuauuugaaccacugggcccuacugggauggguagaauuuucuguaucauucugggauccacauccuccucugaaaaugggguuaauaaugcuaguucuauuuaccccucaggguagcucugcugcucaaggggauagaggcaagaguguccugcaaacugcaaaaaguuccuugaauguaaaauguuaguauguauuguuaaugauauugaccaaagcuacauuaccauguuacagugaagauuaauugaaacagugcauggaaagaccuugguucacauacagacaaagucagcugugaguaauagccauaauaguaaugugguuaugcaauuuaaaauauugauuuaucuccaaauugggauauaguuguauaggaucuuucuuacuagcaaguuaacacauuacgucuauaacuaaaaaaucaagaagucuugauuucuugagaagucaguauaaccaugauguuuagaaauacaaacaagaggcugggcacgguggcucacgccuguaaucccagcacuuugggaggccgaggcgggcagaucacaaggucaggaguucgagaccagccuggccaacauggugaaacccugucucuacuaauaauaccaaaaaaauuagcugggcauaguggcgggcaccuguaaucccugcuacuguggaggcugaggcaggagaaucucuugaaugugggagguggagguuucagugagcugagaucacgccauugcauuccagccugggcaacaagagcaaaacuccaucucaaaaaaaaaaaaaaaaaaaaaaaaaaaaacugggccggccacaguggcucaaaaugcuguaauccuggcauuuugggaggaugaguggggggaucguuugaacccaggaggucgaggcuguagugaacaaacaucaugccacugcacuccagcuuggaugauagacugagacccugccucaaaaaaagagaaaggaaaauaaauaaauaaaugaaaauuuaaaaggaaaagaaaauauuuaaacgcuauuucaaacaaucucaaauguaccuggaaacaguugggacaggaagucaugaagggaauggggcagaguuagagaaggucagaguacagccauguuucacaucccagcugaaacuccuccaacagcuuuguaucgcccuucaaauacaaccugagcucuuuuucuuucuuucuuucuuuuguuuuucugaguuggagucucacucugucauccaggcuagagugcaguggcaugaucuuggcucacugcaaccuccgccucccaagaagcugggauuacaggcgcgugucaccaugcccagcaauuuuuguauuuuuaauagagucaggguuuuaccauguugccaggcuggucucaaacuccugaccucaagcgauuuguccaccuuggccucccgugagccgccgcgcccggcccugggcucuuuucuuugaccaaaaggcucucacaggcucugacucuugucugauggucucucgucuuucucccuuuggucacugcagucagccacacuggacuuuuguuuuuuuuguuuguuuguuuguuuugcgacggagucucacucuuucacccaggcuggagugcgguggcgcgaucucggcucacugcaagcuccgccucccggguucacgccauucucccgccucagcccccccaaguagcugggacuacaggcgcccgccacugcgcccggcuaauuuuuuguauuuuuaguagagacgggguuucaccguguuagccaggauggucucgaucuccugaccuugugaccugcccgccucggccucccgaagugcugggauuacaggcgugagccacaacgcccagccacacuggccuuuugacaauccuucaaucacgccaagcacacuccugccauugggccuuuguacuugcuguucucucugccaggaaugccucuuccccagaucuuugcauagcugauuucuucucauugucagggccuuaguucaaauguccuccacucagagcagccucccuugaacacccaaaucuaagccugccccaccuccaucccuugauagcaauuccauuauccucuacagcgcugaaauuacguauuccuugaucuguuuaucaucugucuccuucacagaaguuccaugacagcagggaguuaggcugucuuguccccugcuguauccccagcauguagaacagugcuugacacacaguaggcgccccauaaguauuugcggaaugagcaaauacagauggggacagcugagucaguagggugagcagcuggaugggccaguaguggagggaggaaacggcagccucugccugggccuugcccuggguaaacagaccucucucuccccagacagccacuguuugacgacugucugccaugggccuggcugagccugggccgccaaacugccaacgccucuguauucucugggacaagcaguggaggcagccauaccuccagcagaguuugugaaggagcaggucagaaaguugucaaaacaggcaugacgaagggcagaggagguggggagacagggagagagcaggcggcccugcccugggcagagccagagaaacuggagggaggccugggugcuccccugggcagcuucccaggcaaacccagcugccugcagggcucagcgcugggagcagguuguggucccagcucuagcccugacacacacaggaucucagguacuugacauuuguaggccuuagcuuccuuacuuguaaguuagaggcuaugggcagauuaguggcuuucaaacaauuuuuuuuguuguugcuuuuuguuuuugagacggagucucaaucuugucgccgaggcuggaaugcaaugguucgaucugggcucacugcaaucuccgccucccagguucaaguaauucuccugccucagccucuggaguagcugggauuacaggcgcgugccacuacugcccagcuaauuuuuguauuuuuaguagagacgggguuucgccauguuggccaggcuggucuugaacacagcaagauucugucucuacaaaaaauacaaaaauuagaggcugggcccgguggcucacaccuguaaucccagcacuuugggagguggaggugggcagaucacuugaggucaggaauucgagaucagcuuggccaacagugggaaaucccaucucuacuaaaaaugcaaaaauuagccaggcaugcuggagcacgccuguaaucccagcuacuuaggaggcuggggcaggagaaucucuugaacccaggagguggagauugccgugagccaagaucgccacugcacuccagccugggcgacagagcaagacccugucaaaaaaauaaauuaaagaaaaucccaacuuucaccuccuuuaaaaaaagugaaggucuagcaacacugauaccuaugagacaacagucuccuggagccacuuuagauucucaugcuuccucuaauuugccguaguccccacuauuccuuaguguccccauacggaaacuuauuaaugaacauaaaucaccauguuugcuguauuguuuuucuuagaggaacgugugaacuuugcucacacccuaucuguuccauuuauuucaguuacuucucuggguauugagggcacuugagugugggaccccugaucacugagaccaaagcagaguucauuuauuugcacgagcaaucuucuauuucauagauuuaccauguuuuuaagugacuacaagaaaaguuuaaauuaugucuguggcucacauucuauuucuauuggccagcacuggccgggucccucagauucuauagcaguguacgugugcuugcugcuaacucauucugccuccauuuuccauucuugcguagaccaaucccagucaaaucucuugggcuggugucuucuccccaccccacaguuaucuuuggugccuccacccugguuagcuggccaccugucuguccagaggauccaggcuccagaacuccaggcaugucuucuagaauucuccacaugggaaaucucacucccaggccccaucuggcagccauuguguuuucuuuaucagacauucacauaaaacaauagucaauuugaaagcuaaauacacauccauucuucugucuccagccuguaaauuuaccccaaauccaguaauuugggagguggaguuggugggaagagguuuuuuuuucccccucuucuccagggcaagucauauaguuuuucuggagaugagguggacugaguuugggggaagaacacagguccaucuacagugaaagcgcugacuuuguuuuuggagaagauggugucauggcuucucuggggagaugagaugagggaauccugaagacuuagggggccgggaggaaaaggaaucuuggcaaugaugaagacaccuucaaaugaaggggcuaauaggguaguggcugagaauuugugcugcagucgggagggcuuggguuagagcuacauccacaguaugaccuuggacaggugacuuuaucucucugauccucagucuccucaucuguaaaauaaggauaagaauagacuugacuuccacuucaacgagaagugaaacgagauauccuaccacugcgcuuugcacauaaaggcucuauaaaugucagcugucaucauaaagagccaaaaguggcauuuggaguaaaucugauuuguuuuuaagagauaggguuuugcugugucacccgggcuggagugcaguggcauagucaaaacccacuacagccucaaauuccugggcucaagccauccucucgccuaagccucacaaguagcugggacuacagacacacaccaccaugccugucuaacguuuacuuuuuaauuuuuuuaaguuuuaaaauuuucuguagagauggggucuuacuguguugcccaggcuggucucaaacuccuagccugaaaugauccuuccaacucagccucccaaagcacugggauuacagguguuagccaccacacccagccuaguuuaauucuuuuuuaaucauccuucucugcauuuuuguaauuccucuaccaugaaccugcuuuaguuaaguaagaaacaguuaacugggggaggagaaauaaaaccaaaccccuaaaaagccccuaauaaaccccuaaacgugggguccaacaugagguguuauggcugggaaaagguaagagaucaaacuauacacacccuuuuuuuuuuaaauuaaacuuuuuaguuuuuucagagacagucuugcuccauugcccaggcuagaauaauggcaugaucucggcucacugcaaccuccgccuccuggguucaagcaauucuccugccucagccuccugaguagcuggaacuacaggcacgcaccaccaugccuggcuucuuuuuguauuuuuaguagaggugggguuucaccauguuggccagccugaucucgaacuccugaccucuggugauccaccuaccucagccucccaaacugcugggauuacaggugugagccacugcaccaggccuuaauuaaacuuuuauuuuagauucaggggguacauguacagguuuguuacauggguauauugugugacacugaaguuuaggcuaugauugagcucaucacccaaguagugagcauaguacccaacagagaguuuuuuagcccuugcccuuccucuagaaguccgcagcgucuauuguuccucucuugaugucaacguguacccaauguuuagcuuccuuuuacaagugagaacaugcaguauuuguuuuuuuguuucuguguugauucacuuaggaugagguccuccagcuccauuccugguguggcaaaggacacgacuuuguucccuuuuuuauuuuuuugacacuguccuugaacuugguugagguuuuguucccuuuuauggcugcauacuauuccauaguguauauguaccacauuuucauuauccauuccacugcugaugggcacuuagguugauuccaugucuuucuacuguuuuguuuuguuugagauggagucucacucugucacccaggcuggagugcaguggcgcaaucucagcucacugcaaccucugccucccagguucaagccauucuccugucucagccucccaaguagcugggauuacaggcaugugccaccaugccuggcuaauuuuuguauuuuuaguagagacacaguuuuaccauguuagccagguuggucucgaacuccugaccucaggugauccgcccgccucggccucccaaagugcuaggauuacaggcgugagccacugugcuuggcugaugucuuucuauugugaauagugcuguguagaacauauaagugcaugugucuuuuugguagaagaauucauuuuccuuugguuauauaccaaaucaugaaauugcuaaauugaauggugguucuguuuuaaguucuuugagaaaucuccaaauagcuuuccacaguggcugaacuaauuuauauucccaccaacaguguauaaguguucccuuuuuuccacagccuugccaacaucuguuauuuuuuugacuuuuuaaugacagccauucuucagauaucaaggguggggacaaaaaaagaaacuuaauaaucauuuugacuagugugagaugguaucucacgauuucauuugcauuucucugaugauuagugauguugaacauuuuuucaucuuuguuggccgcuuguacaucuucuuuugagaagugucuguucaugugcucuauccacuuuuuguugggguucuuuguuuuuugcuuguugaauuguuuaaguuccuuguagguucuagcuccuuguagaauugcuaaguuccuuguagaccuuuguuggauucagaguucgcaaauauuuucucccauucuguagguugccuguuuacucuguugauaguuucuuuugcuguguagaggcucuuuaguuuaauuaggugucacuugucaauuuuugguuuuguugcgauugcuuuggaggauuuagucauaaauuuuuugccagggaaauguuuuuguuuuuuuuuuuugagacagggucuugcucugucacccaggguguuaauaacuuaacaaacugagaccccaagaggaaaggugauucggccaaagucauacaguaaguuaguggcagagccaagacuagaaugguggacuguggguguuggaagggaacuuugagguuguuagggcagccuuuccuaaggcgaggccccucagacaagaaggauucuauuguuagauguuugaaaacugcugaauuaaagaaagcugcacaaauuucauuauccgagaacuucucagaauucuuaacacaugacaauaccuuggccacuccaagaaaugccugcaguguauagggcccugaauuaguuucaagagucccuugaaggacauugacaccuaugcaagcucucccugcucucagacagagaaaugcuauaucuuagauauacuccuaguugcuuuuaaaaaauaggauucuagggccgggcaugguggcucaugccuguaaucccagcacuuugggagguugaggcaggcggaucacgagguuaagaguuugagaucagccugaccaacaugaugaaacucugucucuacuaaaaauacaaaaaaaauuagccgggcaugguaauuagccgggcaugguggcaugcaccuguaauccuagcuacucaggaggcugaggcaggagaauugcuucaacccgggaggcagagguugcagugagccgagaucaugccacugcacuccagccugggcaacagacugagacucugucucaaagaaaaaaauauauauauagauuucuagauuuuuauccacgguugcuugucauugugcaaauuguugucauugugcaaauuguaugauuuuuaaaauuauacuaccaaauugucugucgcugguauguaggaagaugguugacuuuuuuuuauaaucucauuucuccuuuuuuuaaaguaagaaauauuacaaauaugcagagaaguauagagaauaauauuaugaacauuuauguauccaccucucaauuuugucaaaucuuacuacaugaccauguuuucuuuggauguuguuuguuuguuuguuuguuuuaaugacaaauuaaacauuacacuuagaguugaagccccuugucuuccugaucccaucacccugccacccuuaucaguggugaucauggucaccauuugguauuuaucauguguauuugguauuuaucugguaaugugucauuaccagacacauuuucacaguucuaccauacguggcuauauaagcaaaguaaaauauuuugcuuaucuggaaaauuuauuuaaaugauauacuguacauauccugcagcaacuuccuuuuauuacuccucauaauaggucucuggaucuuuucaugaugauacaaguugcaccagaccacucauuuaaaaugcuguguaggcugggugcaguggcucaccuguaauuccaacacuuugggaggccgaggcaaguagaucacuuaagcccaggaguucaagagccagccugggcaacauggugaaacccugucucuaucaaaaaauaaaauaaaaaagaaauaaaauagauaaaaugcuguguauccaugaaguacuauacagucauaaaaaagaaugaaaucauguccucugcagcaacauggauauggcuggaaaccauuauccgaagcaaacuaaugcagaaacagaaauucaaauaacauauguucucaccuauacgugggggcuaaaccuuggguacacauggacauaaagaugggaacaauaggcacuggagaaaccaaagggguuagagagggagggggcaaauguugaaaaacuaccuauuggguaccaugcucauuaccugggugaugaauucauucauacuggaaaccccagcaucaugcaauauaccuuuguaacaaaccuauacguguaccuccugauucgaaaauaaaaguugaaauaacgggccaggcaauguuuaaaaacacaugcagccgggcgcgguagcucaugccuguaauccaagcacuuugggaggccgaggcggguggaucacuugagaucaggaguucgagacaagccugggcaacauggugaaacccuaucucuauugaaaauauaaaaauuaaccaggccugguggugggcaccuguaaucccagccacuugggaggcugaggcaugagaaucgcuuaaaccugggaggcagguaaaaaaaacaaaguugaaauaacaaaaaauaaaauaaaagugucuguaaauauccugaguauauuuauucuguuuuguuuauuuguuuguuuugagauggagucucacucuguuacucaggcuggagugcaguugcacgaucuuggcucacuaucucagaugaugcuccaaagacuauucuuauaccuguggaugagaguuucucuagguaacaugcagagauggaauuucuguaucuuagacaguggauaucaacacuuuuaagagauguugcuaaauugcucauucuugaaugccaacuuccacuuccaacaauaguuacagaguuuugguugcucuacaaccucaucagcacuugauuuuguaagauacugaauguaaaauuaugcuucacuuucaaauuuacauuuccucuauuacuagagaaggagaggcucuuuugccauuugagcuuccuacauuaugagugugcuuguuuguauccuuugaccauuuaucuauuguauuauuuaccuuuccuuaucaauuuguaggcauuuuuuagcacucuuagaaacaucuuuuaugcauguauuuuuuuuuuuuuuugaaacagagucuuacucugucgcccggcuggagugcaguggcgugaucucggcucacuacaaccuccaccucccagguucaagugauuuuucugccucagccucccgaguagcugggguuacaggcaugcaccgccgcacccagcugauuuuuguauuuuuaguagagacaggguuucacuauguugcccaggcuggucuugaacaccugaccaaaggugauccauccaccucagccucccaaagugcugggauuacaggugugagccaccacgcccagccgaccauuuuuaaacguacaguucagagacauuaaauauauucacauuguaauacaaccaucagcaccauccaucaccugaacuuuuuucaucuucccacacugaaacuguacccauuagaaaauagcuccccuugggaggcuaacauggagaaaccucgucucuacuaaaaauacaaaauaaauacuaaaaauacaaaaaaauuagccgggcgugguggugcgugccuguaaucccagguacucaggaggcugaggcaggagacucgcuugaacccgggaaguggagguugcagugagccgagaucgcaccacugcacuccagccugggccacagagagagaccccgucucaaaaaaaaaaaaaaaagaaaagaaaagaaaagaaaauaguucuccuuucuucccaggcccuggcaaaccccuucuacuuucugucucugugaauuugacuacuuuccuguaggcuaguggaaucauacaguauuuguucuuugugacuagcuuuuccccuagcauaaugcccucaggauccauccauguuguagcaugugucagaauuuccauccuuuuuaaggcugaauaauauuccauuguaugcauauaccacauuuuauugauccauucauccauugauugacacuuggguugccuguaccuuuuggcuauuaugaauaaugcugcuaugaacuugaguauacaaaucucucuuccagaugcuacuuuugguucuuuuggguauauacucgggaguacaauugcuagaucauaugauaguucuauuuuucauuuuuuaggaagccgccauacugcuugccacagaagcugcacuauuuuacguucccaccagcagugauaggaacguaaaaggguuacaauuucuccacaucuucaccaacacuuacuauugucuguuuuguuguuguuuuauaauauccauccuaaugggugugagguggucucuuauuguguguuuuguuuguuuguuugucuugguuuuuuuuggagacauagucuugcucugucgcccaggcuggagugcaguagugcagucucagcucacugcaaacuucuccuccaggguucaagcgauucuccugcuucagccucccagguagcugagauuacaggcaugugccaucacacccggauaauuuuucuuuuccuuuuuuuuuuuuuuuuuuuuugagacagagucucacuguguggcacagacuggggugcaguggcgcgaucuuggcucacugcaaccucugccucccagguucaagcgauucuccuaccucagccuccugaguagcugggauuacagaugcaugccaccaugcccggcuaauuuuuguauuuuuaguagagaugggguuucaccaugcuggccaggcuggucuugaacuccugaccucgugauccgcccgccuuggccucccaaagugcugggauuacaggcgugagccacugugccuggcccacacccagauaauuuuuauauuguuuaguagauuugggauuuugccauguuggccaggcuggucucaaacuccugaccucaagugauccacuugcccuggccucccaaagugcugggauuacaggcaugagccacugugcccagccucuuauugcaguuuugauuugcacuucccuaaugauuagugauguuaaguaucuuuuuaugugcuuaaugguuauuuguauaucuuccuuggagaaaugccuauucaaguccuuugccaauuuuuuuguuuucuugagacaggucuugcucugucacccaggcuagagugcagcagcaggaucguggcucaccacagccucaaacuccuugacucaagugguccucccaccucggccucccaaguaagcugggacuacaggugugcagcaugccuggcuaauuuuuaaauuuuucuguagagacaaaguuucacuauguugcccaggcuggucuuaaacuccugagcucaagcaauccuccugccucugccucacaaaguggugagauuacagacuugagccacuacaccuggccucuuuguccauuuuuaaaguuuuugguuguuguuauugaguuguaagaguucuuuauauauuucggacauuaaccccuuaucagauauaugauuggcaaauauuuucucccauucuguaaguugcuuuuucacucagucaaguguccuuuggugcacaaauuuuucuaauuuugauguaguccaauuuaucuaauuuuuaaaaauuuccugugcuuuuggugucauauccaagaaaucaucaccaaaucuaauaucaugaagcuuuucccuuauguuuuauuccaaagguuuuauacuuuuccgucaaacucauuuuuaguuaauuuucguauaugguguaaggaaagagucugauuucauucuuuugcauguggauauacaguuucccaaacaugaauuugguuuugauaguacuuuguuaauuaagacuuuugcaccugguagacgcucuuugaccucuaacccacuggaauccucucaccauccuucccugacaguugaccauuuagcuugggcuuaauacuuccaaugacggaauacucacuacuuaauaaagcagcuuuuccugugguagaacaauuguauuuuauagaaagaucuccauuuugagccucaaguuuccucccuguagcauccacauuuugguccucguucauucucugaagcuguaggaaucagugagagcuuuuuuuuuuuuuuuuuuugagacagaguuuuacucugucacccaggcuggagugcaguggcacgaucucugcucacugcaaccuccaacuccaggguucaaaugauucuccugucucacucuccugaguagcugggacuacaggcacaugacaccacaucuggcuuauuuuuguauuuuuaguagacgggguuucaccauguuggccacgugaaacuggucucaaacuccuggcuucaacugaucugccugccucagccccacaagugcugagauuacaggcgugagccacuucacccagccagugggcacucuuuuccaaaggaaaguacuuuguugccuuuuuuuugagacugagucucaaucuaucacccaggauggcgugcagcggcacgaucucagcucauugcaaccucugccucccagguucaagugauucuugugccucagccucccaaguagcugggauuacaggugacugccaccacgcccggcuaauuuuuguguuuuuaguagagacaggguuucaccauguuggucaggcuggucuggaacuccugaccucaagugauccacccaccucagccucccaaagugcugggauuacaggccugagccaccgcacccggcaggaaaguacuuugaauugaguaaauaacgcaacuauaugcugggcagcuaccugccagguuuauaagguuuaacacauuuacuccacaaagcaaucuaugaaaagguccuaucauugauuccuauuuuauagaugaagcaaauaaggcuugaagagcuuaugauuuuagcaagguccaacagcuauguaaauggcaccacugauauuucaaaggcaauggcccugaccacucugcuacaccaccuuucucuccucuucuccaauacccagcccaaaacucuuuuggaucuuugauuauucuucaaggggcauagcuuucuuucuuucuuucuuucuuuuuuuuuuuugagacgaacucucgcucugcugccgggcuagagugcgguggcgagaucucggcucacugcacccuccgccucccagguucaagcaauucuccugccucagccucccaaguagcugggacuacaggugcguaccacuacgcaaggcuaauuuuuguauuuuuaguagagauggaguuucaccauguuggccaacaugaucucgaucucuugaccucgugauccgcccgccuuggccucccaaagcgccaggauuacaggcaugagccaugccgcugcacucggccuaaggggcauagcuuucucauccucugccauccuaggaaaauuuuaaguauucauauuaaaaugaaaacuaaacacaauuguccauauaugcuccuuaggaguagaaugccaaggaccucuuagcuccucugaccugggaacuacauucucucuaaugauacauacgacuggguuagagguuugggcagcugccaccaaguaaaaccucuagaauuuugcuaugucacuuucugcuaagguagcuuuucccaucuacacuaaauaaauaaaucauccaggugauuuauuuuuaaccaaugcagaggauuuuuuacuuaucuccauggaguucaaacauuucuccaggcuggguggggugacucacgucuguaaucccaacacuuugaagacuaagaaggggcagauugcuugaacccaagaguuccagaccagccugggcaacauggugaaaucccauaucuacaaaauauagaaaaauuagccagggguggugguccacacauguagucccagcuacucuggaggcugagguaggaggaucaucugagccuggagacuuggaggcugcagugagcugugauggcgccacugcacuccagccugagugacagagacccugucucaaaaaaaacaaacaauaauucaccaaaucuauuuggaucuggauccugccaucauuuuauagguaaugccuccauagcacucacuaagugccaggcacacuucuaagcccuuuuuauacauuaacacaaauaauccccaccacgaccuaaugccauacacaucauuauggucacuauuuugcaaauaagaaaacagucacagagcaguucaguaacuuguccagggucacacagcuaguccaugacugaaccagaauuuaagcccaggaugucaaguuccagaauugguacacucagccucaauacugugcugccuucaaauauucugacaaucuuagacagcuuuggggauccaaaagauugagaaguacucuuggggaccucuuuuuuuuuuuuuuuuuuaaauacggagucucaacucucucccccaggcuggagugcagugguacaaucucagcucacugcaaccuccgccuccuggguucaagugauucuccugccucagccucccaagaggcugggauauuacaggcacaugccaucaugcccagcuaauuuuugcauuuuaaguagagacaggauaucaccauguuggcuaggguggucuugaacuccugaccucaagugaucugcccaccucagccccccaaacugcugggauuacaggcaugagccaccgcaccuggcucccauuuuuuuuuuaagacggaguuucacucuuguugcccaggcuggagugcaauggagcgaucucggcucacugcaaccuccgccucccagguucaagcaauucuccugucucagccuccugaguagcugggauuacaggcacaugccaccacacccggcuaauuuuuguauuuuuaguagagaugggguuuccucauauuggucaggcuggucucgaacuccugaccucaggugaucuucccaccucggccucccaaauuccugggauuacaggugugagccaucacgccuggccccuggcuccuuuuuuuuuuuuuuuuuuuuuuuuuuaaauaaagaccaaagguccagaggcuuugaaaggcaaauaguauuaagucaggauuugauaucaggauuucuuucauucuguuuauuuucucauugcuuucuacuuaugauacuguuucauuugguaguaauaauauuucuuucuaaaauaaauugaaguaaaaagaagugaguugauguaagaaaaauguuacagauaugaaaaaaucauaauggucauuaaaaaauuagugaaacuuuggaaagacuguguucagucaagugaagugaaguuagcuugcaaccacaaaaaaaccccuaagucucaaugguuugaacagcaaaguuaauugcucaccuauaguacacgcccagcaugggucggcagggggcgcuccgcguuguggaacgauucauaucuauacuugcuuccccaacaagggcagcacuggccuuuaaagcuucugcccaggugugacacagguuguuucugcucacaucucguuaccugaaacaaguaacauggucacaucucauuucaaaggaagcaagaaaauguaauccccaucaugugccggaaaggagagaaauagaauaguugagaacagcccucagagagacuauaaguaagggggcauaaaagaugggucuagagagauaggcugagucaugacucacugaauuugucugacguagaucaugauggcccaucccaccaaguggccaacauuuguucccagaaaagggagugugaugaucccccagaaagaacacagucugacaacauuauucugaugagcagacacaccucucaggcugccacucaggaguccuuuuggguggggagguggggaugcugauauuuccuaagugguuucagcugaacucugugaucuuuuuuuuuuuuuuuuuuuuuuuuuuuugccuauucccugaagggagaugaggcaauuugggcuuuggcugagcuaggguuugguucugucaccacuugcuaucuagggaaggguaauaauuggaaaggagaggaauucaaggagaggguccagguggguagggagccucacacaggguuuggugaucaggugauugagaggccuccuugaggaguuuucaaagugcggucugagggcaccugguaucagaagugcccagaagcucauuaaacacuugggccaggugcuccauggcuccugccuuuaaucccagcacuuugggaggcugauuugcuugaggcugggguucaagacaagccuggacaacauagcaagacaccuccccccgucucuauuuuuuaauuaauuaauuuguuuguuuauuaauuuauggacucucacucugucgcccaggcuggaguguaguggccugaucucuucucacugcaaccuccgccucccagguucaagcaauucuccugccccagccucccaaguagcugaaauuacaggcaugcaccaccacacccagcuaguuuuuguacuuuuaguagagacaagguuucaccauguuggccaggcuggucuugaauucuuagucuccagugauccaccugccuuggccucccaaaguguugggauuacaggcaugagccaccaugccccaccucuauuuauuaaauauuuucuuuuuuuuaaucugaugacuaggcccacuguugguccuggcaccuggagguaggaccccaggcaucugauuuuuuuuguuguuuuuuuuaaggcagggucucgcucuggcgcccaggcuggagugcaguggcacgaucuucacucacuggaaccuccaccucccagguucaagcgauucuccugcuucagccucccgaguagcugggauuacaggcaugcaccaucacgccuggcuaauuuuuuuuuuaauagagacaggguuucaccauguuggccaggcuggucuugaacuccugaacucaggugauccacccaccucccaaagugcugggauuacaggcgugagccaccgugcccagccaccaucugauuuuuuuuuuuuuuuuuuuuuuuuugagacagaguuuugcucuuguuaaccaggcuggagugcaauggcacgaucccggcucaccacaaccucugccucauggguuuaagugauuuuccugucucagccucccaaguagcugggauuacaggcaugugcuaccacgcucggcuaauuuuguauuuuuaguagagacgaggucucaccauguuuggcaggcuggucucgaacuccugaacucaagugguccaccugccucagccucccgaagugcugggauuacagguguaagccaccucgcccagcugccaucugaauuuuuaauaauggccccagaugauucuuauggacaccaagauuugagaagcauugaaugacugagagaaaauuucuuguaaggguagaagcccagcacagugguucucaguggagauaauuucaacccccaagggacauuuauaaaugucuggagauaguuuugauuaucacaccuugaggguagggaaaagugcugcugacaucuaguggcuagaggccagacaugcugccagggacaauguacaggacaguccccacgacaaagaauucucuagcccaaaugucauuagugcuuaggucaagaaacccugguuagccauuaagaguuugaaccuuucuaaauguuggagcacauacgauuuuuaaaucuucaauuuuuauuuuauuuuccaaaauuucuacuauaugcauagaauccuuuucauugaauaccuguuacgcaccgagcacuugaaguuuacaucacuaucaguuccucuugaaagaccuuuucagucauucauccaacaacuauccauuaaacacuuacuaaaauguauuccaggccaggugugguggcucaugccuguaaucccagcacucugggaggccgagguggguggaucaccugaggucaggaguuugagaucagccuggccaacauggcgaaaccccgucucuacuaaaaauuaaaaaauuagcuggguguggaucccagcuacucaggaggcugaggcaggagaauugcuugaaccugggaggcggagguugcagcaagccgagaucgugccauugcucuccagccugagugacaagagcgaaacuucaucuuaaaaaaaaaaaaaaaaaaaaaaaaagaaguauuccaggcagaggggaaaguauaugcaaaggcccccaagacaggaaagaaaaacuuuaaaauggcuaguaugccugcugcugauaggggugggggcaaguggaaugaaaugagguuggacacggagggauauaaaaacaagggcgugcauggccucacaguguuaagugggaguuguaugaguuuuguuauaaaugcauaggaagucauaaaaauuuaaguagaagaggaucugagccaauguacauuuguacaagaucacccuuggccccugagugaagaguaggggguagggaagccacaggagaaaaagugaaggggugggguggaggcaggcggggggggggggaggcggggggggcgguggagcgggggagauccccuccccaacccuggcagguuuaaaaaaaaaaaaagggaagaagugaaaagacuuuugcagaccuccagagaugaugcauaagguuggcugggguggagauggaaagauggaaaaucuagauucuguuuggaggguggcaagaacuggauuuucugaugaacuggaaggcaugagaaacacaacacaaagauugugacuugcaagauguuggcuugaauaauugagagaaggugggugaugauauaugacauguagauaugacuaucauucucuuuugacgacugaggaaggggaggugagucguccuacuucacaaagauaguauaugggcuccaggugugucuaacccaaagguuauaauuuuuccacacuccuauauccacacauuaauuuuuuuuuuuaaauugagacagagucucacucuaucacccaggcuggagugcaguggcgccaucguggcucacugcagccuccaacuccugggauccagcgauccucccaccuuggccaccuaaagcuggaguuacaggcaugcaccaucacgcccugccuaucuuaauuuucauaauggguaugacauuuacugauaguaauaucauuauacaugccccauacaugcuaacaucugcuuccacauggaagcagcacaaagccuggaaccuuccucaaagaccccccccacccccguacauuggaacaaggugcugggaacagaaguuuaguaggugguggaagggcagcggcugcuacccugggaacugguuuuaaaaucuuacguucugauugcugccguggccaugugcuggugugugauggggagauguucuuuuagguaacuaaauccaacgagcugugauuggugaucgaaccgagcaggccuccucuggauuuggagagacauagugcgucugggccugugauuggcgggauugcugugauuggugaagucccuaaggcuaucuaaguuucugaacaccaguuccugcguuggccacgaggaggagcccaggaagcgcaaagcgcagcacugcggagagucuuggccgccuccuccgggacgcccuccggcccagcgcggugccugcccugcccugcgcccuggggcaaccgcgggaugagguggggcggcaaagggugucagggcucccagcugcggcccggguggccacgcuucucugcacaguuccuuuggccucuuccccuggcucccagccccacagaagacauuggcugacccgagggguggggcugcggguucgcgaagguuugugaaggcccagauccaaguugcaaaacuguggagucuaucaagugagacuuagcagccccacucccucaggugcgccccuugcccuccucagaguccuucucucaaguuuagcagccuccaccgugcccuuuaagauccucaaagaacuuuugcaaaguggcaucucauuggagcuaaaaugaccugugcaggcaaaggccacuagcucaggggaucguccugcccauccccaggugcuaucacaucgcgcugugcgucuucacugcacuuaaccacuguuuguaauugacuucguuuuucauguauuuacuugcuuaugucugcaacccgccucuccaccaaaacgcaagcucugugagggaggguguaggguugcccgacacaacacaggacacccaguuucauaugagugucagaugaacaccacaguuuaaaaguauaagcaggucccaugcauuauuugggacacgcucauacuaacgaaguauuucuuguguaucuuaaauucacauuugacugggcauccuguauuuuuauuugcucaucugcaccccucugagggggauauuuugcccauggucuucccugcugcaucuccaccacccacaacgaugcacgcagaaggugcugaauaaauguugacuguuucgauggacgauuuccauccuuuauucacucaguuauucauccagccuauuuauaucaaguggguccugggaauacaaugguagaugggacacaguccaguggaggaggcacacaaccagucuaauuaccaucugacuaaacgaugaugauguaaagcuuugggggcuauggggggacagaggaggaccccggcguucuguuucccggaggaagaugacuaagaugggacuuggaggaugagaaggcaaagaaggaagugcgacagcucucugcuugagaccacgggguucuggaagcugcagggggcuggggagggcaaaugugcagugugggcguggcagucaggaaaaggugagaaggagacucacauucacuggauguuacuacccaccagccagcacaagagggaugccauguugcuauuauugugcccaucauacagaugaggaagcugaggcucagagaagugaaaugccucggcuaaguuuacagucguggagggaaaagcugagcuucaagcucaggucuggcagacucugaagccugcacucuucuagaaaagccacuggguuaaggauuacaaugccaauagggggauggagaaacacgcucagaaaggugauagggcucucccugugaauauggcucuguccaguugagcagaauacugaagcaaugcaagaguuaugguuuuuuccaagcccuccagagagacaacaggagggccagagcaggacccaggaguccagaccacugugucucccauuccuauugggguuggcucucuaggagccccuugcagagcccuggggcuaauuccuugcauggauccuggacaggucugcaguuuccauggagaccgccucccaccaucccugaaaucucauugugaccaguauuaagggauuaacucugcccagcggcccucgcagggucuggggugcugagaggggccagcaggagcucccucaaggaugaagagguugugcacugugcgggaccccauagcagcaggaggaggaugucggacuggggccagggcuucccccaggacccaccagguaugguccugacuccacaucugccuggaaggaaggaugggaugguaggagagagacacagaaccaagggggaggauuccagacugggagcaguguggaggauuuguacccucauccccuaacccaggaacguccauggcccugaugggugaaugacguuccaaucagagaaggagaauccagacgaccucaacaaggugagaggagccccguagaguauuagggguaguccaaggcugccuaaagaccagaucucuuaucucucucauuuugcaguuggggaaacugaggcacggagagggaaaaugacuugcccaaagccagugagucagcaaacugaagcaggucaagaauccagagggaacccugaaguucccugagcagaaaacaaucgguuaaaaucucauugccacuucugccuugaacuccaaauccuccuuccugagcuccaggcaugggguccccuccauccccucacccagagcuugucucaucggccaugcuucccucccugccucucauccuccuccugacuuccccugccacccgcaccaccugaggcuggcagagaguuccuggcagguucuccagugcugacgggcacagccaccaggcccccacuauuccauccaggggacaccuucccacugggucccuaucuggaugacuugggacauucuuuguucuacacuucauccucucuuugggauuucugaguccagacacagugaggaccccgacagccccccuccucaccucuuguccugggaaggccaggccugcauggcagagauguaaccagacuccaaagcuuucugggccgggcuucauggaaggccguaucggugcaggggcauaaacacaagcucuggagccagguagagauaguucuaacaccauugccuuggcucacugggaaaaugauguuucuucucugagccucaguuuccucaccugugaugggagacgagaacccuuccauccucaaagcuugcucucagcugcuauggaagcaucuccagguugugauauuaaaugaaccaaacaagauacagaacaguguaagagcagaggcuacucauguaugaucuuacaugcuaucuggucuguauaaagaaaccuuggcagauacaucuguaagggaugugguuccccauagugaggaagucaaggagaacaggugaacaggagacagcuggaagcaagacuucucaauuuacaccuuuuauguuuugauucugaaccaugcgaauguagcaccaauucaaaacuaaauguaaagauguucacaaauuaaguaaaauauuaaauaauaauaauaacacauaccucaauaauaugaccggugugcagucaagauuuaggcccagguacuagaaauugacucaaagcaacagaggaggccugucuucaagucaccgaauccuugaccuagaaaggcccuuuauuuugucaacgucaaauugcccauaacaacaauaauagucuugguagcaagaaucaggagcucccuacuuggggaacauggugccaagcacugucugaacauuaucucauuuaauuggcauuuugauuuugugaggaaacgaucaucauucccucuuuacagaugggaaaacugagccucgcugagguuuugacuaguaaguuguaguaagugauagaacuugaugccaucgaaggcuuuccagguucaaauuugaagccccccuacagugggucucaauauuggcugcacaaaaauauagacgccuggcaccuccccaccccuaccccaagauucgaucauugaucugugauagggacugggcaucugucuuuaauuuuaaaaaaucuuuuuaaaaaauagacauagggucucacuauguugcccaggcuggucucaaacuccuggguucaaguaaaccucccaucucagccucccaaagugcuaggauuauagguguaagccaccauguucggccaacaucuguauauuuuaaagguuucagaugauucuauuucaucuucagagaugagucucugcuuuguuagacaaaacuucuccaaugggaaaccaaggccagggagggaaaugaccuugcccaaggacacacaguggcuggaaccagagcuggggcaggacacccagcagcuuacaugaagcccuagggcaaauaagaaaaaggcaccccacucugggcaggcagagcuccaugggcacuucgcuuggcaaguggaacaagggcuggguuuccaucccuaccugcccucuuggcuggagaaccuuugugcagugagcaaccugcacaacuguacagggcaguaacucugaucugagccucaggacuuccaaacacuucaccuuagugaccuggcaaaucccuggggccccucagaacaagaguauggggagaccaaggguggcuucugggaugugggcucagcccucacuccccaaaccagagucugggucaggcaggggcucccaucagccuucaggccccacaagggccgggaaggccgcaucuaauucccaaggucaccccugcagauaaauucaggaacauaaacaggagggaugaacauaaacaggaggacagcaacacccucagcccagaugucauaagccaccuggcaggaggcagccugcggagaagcuccacccacacagauccaaguccuccuggcuuccuuccugaucauucuccagaccauacucucugcccuaccuccggagccuuacagucagcaucucccacagugcccugcucucugcccuucuccuggccaucucucacuggcaucccuggaagggaaggguagcccuggaguuagaggcacagacucuagagacagacugcccaaguuccaauuccacuucuuguuucucaucagcugugugagcauggguauauggcucaaccucccugugccucugguguguaaaaaauuggugaaaacauugccuaccucccagaguggcugggaggaucaaggaaguaacacaugcaaagcuccuaaaacagcugcauauccaguggccaugaugaucaauguguauauuuugcuucauuucauuuucaugacaacccuggaaguuaaguauuauaauucccaauuuacaggugaagaaacugaggcucagagagguggagagagucagggcagggcucuacaucuuuuuuugugauagggacugggcaucugucuuuaauuuuaaaaaaucuuuuuaaaaaauagacacagggucucacuauguugcccaggcuggucucaaacucuugggcucaaguaauccucccaucucagccucccaaagugcugaugccuccagagacaggacguggcugagauggauuauaacguagucuccgguuugcagugccuggcugcuggucauauccucacagggcccaugggacacagagccaggugcauuccccugacuugggucuuccaauggcucucaggcaccucucugcuuccagccagcccugggaggagggggagaacggcauggcaaggcguuugcagagccgucuuguucaccaaugucuuucaagacauugcccggguccacagagagcccaccauucauucccaugcuggcuggagccccugaauacccgaggugaccuucuguccuuggacaagucacuucccccucugaucuccaucuccccaucugugcaaugaggggauggggcugaaucagugguuuuccaacccucaaauaaaauauuaagacuacauguaaaagggagucgcugguugaagcugggccuguggaugcauacccuuggcuccugggagccucggaacccagcuugaaaaaccccagcccacauccuccuaaagauucuccuggcucugacacugcagaguucuagaaccccaagcucaaagcugccgcuucccaucccuguuuggaaagcucucccccagcugccuuuaucucucuuugguaacagagcaaauuugcucaggacccagcacagggggaacaagcagacuguugacucuugagcaaagccucuucuuuggagagcagccgagguggccgugggcuaugcguugggaggccagcggccucuugcauaacccuggaggccuccugcccacccaggccuuuucaggguuaggggugaggaaaaccgcaaacucaugcccaguuaauuuuuuaaggcaaaaucaacaggcucagcaaugauuagcagcuggguaaguuggucuuaaucaggcuaaggacagggagggaggaaggaggcccagggauggggcccaguuaucaguuaaccacaugaauguugcuuccuuccaaacccacuggccuucagccccaagcucccucaucuuccucucggaaauacuccugugacaagccaguggccacccaucaucgggugaacaagccaguggccacccaucaucgggugaacaaacacaaugccacucauggucugugaugaaguagaaagugcucguuguuaagacaaagcucacccaccaccgcugcguggacuugagcaagucccuuucacccucugaggcuccgugaggggccccaggucugggccccaagucuaugguucagucuguggccagcugccacuccccugacggccucaguguuuccguccacuaaauggguggguuagccaaggcaucuuuuccagucuugaagcuuugugggugccugauuugauuaagccacaguggccuuugccgagugcagagggugguaugaguggcauuuuaggagcucaaggaagagaaagggaggggaccuaccugguaucugccguugguaucagcaagugucagaucccagcuccaggaagagggcuguccucucagaugggaggcagggguccagugggguggcuguggcugcagggacagccuagcagagccucuugguggcccagacccccugucccuggaccuuggaagccgcuaaaggaagcagcaagaccaggccagcugguggcugccuggacuggaguuuggucagugguuggggaccuauauugugagauaguuaggacuuuguccacaaacuggaauuugaaauuucaaaggggcaaaacugaagggcccuaccccagaguagagauggcucuuggcuucuuuccuccacgacuuuuguucuuugucuugauaagucccaguuuucucugcaccucucccggagugguggguggggaagaaaagauaggagauaaugguguggugagcgccaaggggaagugaagaugccaagcagcccugggguggccaggcguguggaggaugccccugccccugccuauaccccgggauaaggugcuuuacuucucagguccuugaguuccccugcaagacugaggcagugaaaccaccagcuccagugccuuagaauuccgaaguccuuucagggauuccaggagucaugaugcaggcaaugcguagaggggugaagcccucaagcucuggaggcagacucggguucaaacaacagccccucccuuacgagcuguguggcuuugggcaagucacuucaccucucugagccucaauuucaucaucuuuaaaauggggaugacaauagccccuaucucaacaggcagauaauaugagaaggcuagaagguuuuuagcaccagggcuagcacaaaauuucucuguaaacauuagaccuuauuauaauguaaaagagaaacaaugugguucguaguggcagcucccuuaccaccguccacagcagaggcacaagcucccuacacaugccuccccaacugcagguugcccagggcaaucccuucccgucucaacugggucucucugugggcucugagguccucugcuauccccuggaaucugcugccucuugagcuggggcccgacagcaagugagcagagguaaagaacagcugcuaaauugauggcauugaggcuagugcuuguucauggcugggugugugguaccuggagcuguccugagcagggguccugauuccaacugauuauguggccagugugucaugcaaucaaugaccaaugacagugauugcuacuauuguacuguaugccuacacguggucauuuaaugcuugaaccaucccuacaaagaagguaucaacccaauuuuucugaugcuuaaacuaaggcugagaaaaguagaaguugaggucacagaguuugguacauuggcacugccuggauuuuaaccuagaucuaucugacccacaaggucugugguuuauuccccuaaagagaggucaggggaagagaggcuaagaagcuuaucuacucucucauuuaaucuucacgacaaacgacaaguuagaccccuuguacagaaggaguaaccaaggcuucgaaauaaaaacuugccuugugcagacagcuggcccugggcuuggaauauaaauagucacugguauacaggcaccagagaccaauacccacaggcuaacacccacucaguccacagaaagaagcuuaauauuuuuuauaagcauagaaauaaaaaccaaaccaauacugugacauuugcucugugacuuccuguauuuauuaugugcucauaugaaagcaccuaagcauugucaggauaauguucuuccucacuggagggcguuaugaaguugcuuucuuuuuuccacuaguuaaaaaaaaaaucccuuggaggaagggaaugaaacuuuuuauaauugauacauaauaauuguacauauauauggagcacauguauuuugauacaugcauaccaugcaaaguauuuaggauauccaucaccucaaacauuuaucauuucuuuguguuggguacauuucagaucuucucuucuggcuauuuugaaauauaaaguaaaugauuguuaacuauaaucgcucuacugugcuauaagaacuagaucuuauuccuucuaucucacuuauuuuuguacccaugaaccaacgucucuucauccccugaagaaaacauucuuuuuuuuuuuuuagacagagucuugcucugucacccaggugcaguggaacaaucucggcucacugcagcuuccaccucccagguucaagugauucuccugccucagccucccaaguagccuggacugcaggggcaugccaccaugccuagcuaauuuuugauuuuuguauuuuuaguagagacaggguuucuccauguuggccaggcuggucuugaacuccugaccucaggugaucugccugccucggccucccaagaugcuaggauuacaggugugagccccugugccuggccugaaacuuucaaggucucaagacacuguacauuuaaaguaccccaauguuuuccuuuuccaccucccguucuuucuccuuaucuaacaugaagaacauuguauuaaaucugauuuuuaaggaguuuuugucuguuauguguuaaggguuuguuugguaccccaaugaaaacauucugcauugcagaccaaagugugcuuauuucaggggcaugggaucauugcguucuuagccauugucacaaaauacauggagucauauuuaaaauguaaaguuguaacauacauauguuuaaaauggaaauacaaagcaaaaagauggauguacaaugucauguguauucaguucucuguacuuaguaaauguaacaaacuuucugucuauuacugaacuauaggugcaaggacacgucuccaguuacuuugcaucuguaauccacaaagauucugggcagcuguauuaucauagcuugguuuaaauaaacuauguaguaacaaugaacaacaagaacaaaagaaauaauagcuugccugaggucacagagccagcagaucuuauagguggugcgucauuuauaugaggaauguguaucuaggagauacuguuuggcguuggcuaaggguggaaugaaucauguauguaauagauuaugcaauuuacagugaugaguggauagauuuacuuaugggguagguuauaauguggugggaugugaaucuagaaugugccuccuaggcagucaugcagauugugcauuugguaagucagguaugucaugauucauguaucuaauagcucuucauuugcaguguccaccuaguagcucuuggauauaacgggucauggcuguggcauggugugguugaucuugguugaucguagaccuuauuuaauugaaucuaagaugucaucuauggaaaaaugcauuguuauuuuuguugccaaugaaauucugacaugacauugaucacauuccccguuaagcaauguggaacugugccucagaguggaagaggccauguauuccuggauuguguggggaguagcugugccuguggccugccauaggugccaggcagguggcagaggccugggcucagcccuuggaggcuccucccggagcugcccuccacaucucuucuguguuuaccccuuggucggaucuucuguuucuucccaccucugcacugcccccaaggccgguggagccaggucagauacuccugagguaggcaugggaggaacccgccgguauuuggucucuuucagccccuuaucaagucucauaguguggguugcagggggcugccucuugcucccucccucagagucuuguccuggcuaacagaaaacugagccaggaucaucuuucuauuuuacagagggagaaauugaagcccugagaagagacgauguaaauaaaguuaucggaauagugacugagcuaguuccuaaccccaggucuccugacaucaaaucuagccucucuuguccuccacaacaguugcucccucuccccuuucccuacaggcaauagcacuccccagucaucucagcuucagaggucagaucaaguggacagaauaaagcuaagcagggcagagaaagggcuucuagcaguggaaagaacaugaagaugccuccucauaccacucgaacacacaugcccugacucccgauuugcucacucauuaauccacccacacauucacucauucacucacucauuaauucacccacccauucacucauuaauucacccacccauuugcucacuuacucaguaauuuacccucauucguucauucacucacucauucaugcauucacucaacucacucauuaauucucccugucucuaauucacucacuccuaauucacccacucaucaauucccccacacacucacucauuaauuggugcucccacuaauucgcccacucuugcucacaggugucaccgaggcccuccaaccugcccuuccagccagcaguggaggacaggcucccaggccucccaagucucaggcuuuucuuccucugcccucacucucugccuucuacaucaagacuuuacuuccccagauugauuggcagcccuugaaaaugucugcacagaaggcaaugagggcuggagggagugagaagaacagagugcaccaugagcuucagacagccaggaccagcuguguaauuuucagggccccguccaaaacaaaaaugcacaaucccuuguucaaaagucaugaugaauuuuaggacaaccacagcagagcacugaaccaggaaccaggacuuucuaaggguuggguugccugugacugcacuggcgauacccccacaaagcccacucugaagguaggagacggguggagagaaacagggggauggcaagggggauacgaaacagggagagggaggagggggaagaggauggacgucuaccaggccccacuuggugcuugauuuaugccaucucauuuccuucucaaaccacccuuugaaguugauuguacauuuuacagaaaaggaaacugaggcucggagaggagaaucauuuacccaaggucccaguuaguagacgguaggugccugaauguaaauccaggucucugccugcuccgggagggggugggggugagggaaacaggagaaugugaugggaaaauccgagauggagccagccugggccagaaacacugggagcugugggagacggagaggggcagggugggaucacagggagcaggagcggggaauuggaggugaaucuggcccucccaaacuuccaguccauucugcucccaggggaaccgggaaacugcgggggaacuggaagggagcucccagaacaaggauccagaagauuggcaucuggggccugggauuuagguuucuaaaucgugggccauggggcagccuuaucucugcaaaagcauugaggguagaagucaaugauuugggaaguuauugaauuaggggaucucggagguaggcugucagugccugauaguaucaguuagaaugccugacuuggggugacaauggcuuggaggggugggugagucaagggucaaaugagugcccgugagucaugaugccugccuuguacaauugauaacugaacaucggugaguuagggccccagcaguuguaauuagcaccccgggugucagccagaaaccaacaaacagccaaaucccugcagccccgcccagccuauccaccggcgggggaccgauuaaccauuaacccccaccccuccccggcagagccuccaccccuucacagaggcuaggccaagacucccagcagaucuucccagaggacgguuugaaaggaaggcagagagggcacugggaggaggcagugggagggcggagggcgggggccuucggggugggcgcccaggguagggcagguggccgcggcguggaggcagggagaaugcgacucuccaaaacccucgucgacauggacauggccgacuacagugcugcacuggacccagccuacaccacccuggaauuugagaaugugcagguguugacgaugggcaaugguaggugggggcagaugugcccaggugugccagugggggcaggugugccuggguccaggagcagaucuuuggcacucaacuuuggggugggaggagaaugauacaaaaugguagguugguccuacaggccagcacagguguugccaagugaagcccaugugcccaggcacagugaucacaggcauucugggugaagggaggccugcaagggccaauuuccagcaaaagucgaucccggcuauuccucccaggcccuuccaguccucacugccucacaguggcucugcuuggcgcuuggcacagugacgugauggugagcucccccuuggugcccagcuccagcgauucagcccagcacggccccuucgugaaccccuugggccuagguucagagagacggcaagggauguuguaucccuggagauggugguuggagacauaaccgcauuucucggugucuuugggacuuuccuagggaaaugaaauuggcacuuagggaaaauggagcucucagggaaguuuugcuaacuacgaagccaacucagcacuguguguguugugugugcguucgugugugauagugaguuuccauguagguuguauggguggggugaugccuucaggaacccauuugcauauguguguucauuugucucugugugugaguucugggucuauuuuccuuuguauucauugagugggucuguguuugugucuuaggaguugcccguguugaucuugcuuauguauguaaguguguauguguguguacuugugucuguggauguuuguacaugugugcugugugugcgggucauagagcacaugcguuugugcaugcggaccuguuggagugcccuguucuuccugcaucuuuauccuguaugggcguuuugucgugugcccauauuuguaccugcuguguauauaugcaguucccugugcugcgggcgggggucagcggucucuggugugcacgacugcacagacccaaaugcaggacucuguuguugccacucaccaagugagauucauaucagcaacauguccguuugucucugagcagauuuuguugccgcugcgucucgccagauugaggcauccccuccgacaucacuggagcauaucuggagggguggacaguucuccacagggagguaggggaaaagaggaggcccggaaaccccuccuggagggaagagccccaucggucccaggccagccucagaggagagggggcaggcagcuggcugaggucagccugccacccugcuuccuucugugucuuggagccacucagccaguaugaggcugcagcuccagcugaggucuggaaucuuguggucagcucagcuagggugaggaggcagcugcugggcacugcuuguugucagcucagcaggugcucaccugccccugccguccagucacgugugaccuugggcaugucaccuccccuauccuggcuucuguaucuucuacaaaacaggcuucauucccccaggccugcuggcuggacggcuuuuaggccugucugaggaccacgccaggagcgcaaggcaaaaacacaccagagauagcaaacaagcugcugcugcacuagguggaguguuguguggccccacgaggaccacugcccugcccugggcugcuccccgcccccaucacuuuuuccaagcccaggaacugugugcuccugaggcagaggccaagccccugaacugggagucccaaagacaagaccaccuccagcucuggaaccagaaagaucugggcucaaauccggcauagauccuuccaaccugugugaauguggcaaggcaauuuccucucugagccucaguuuccucaccuauaaaaugggaauaaauaauagugucugucucccagggcuggccagaggauaaauaagaugaggugccugggugcuuagcccugguaaagggccuggccccaccaugggucaucucaagggcucugagcaucuguaagcaggguccccacauuccucacuggaguuugaaguggucugaauugggguuaugugaaguuguccucugaaguguuuugaguacauccugggcuggugucugaaaggcuccaaggauauuucucccccguccucuccccaccccaauggagcagcagcccuggguggcuccuuguucauuagaggcccagcagacaccucaacauguguggcacuggcuggaguagcccagcaagccuggaccauaaacccauggcucugcuucacgggaagcagugcgaugacaccaggaagccacuuuuccucucuaagccucaguguccucaucuguggaauagaggugcucggcugaccucagaggggagaugauagagcugacagcccccagcccauccugccucagaggugggagcuacuuccccagccuccugcugaauggccaggagcugugggggucagcucuccccgggggucgggggaggagaggccgagggagaaagggcacccacguggcuuaacaauuauccccaucuccaggaauaauucaccaaguggagggggcugcacuccuggggacaccugggagucugcgauggcagaaaugagaugcggcagugucugcuugugcaaggagccuggaaguccucugcuccgagaguuuuccuauguggaaaaguuuuuauuucaugaacacugauauagugcuuacuaugugccaagcacuucacauacacauaugagaauucaccgaauccccauaacgaaccuaggggaauaucacguuccccauuuuacaagugaggaaacaaaagcauagagaaguaaacgaacacagucaaugucacacggcuaaaaagugggcaagcuggaauugaacccugggcagaaggacuucagaggcugugcuguuaccuacagugcauggcccucucugggucuuaacuggaugccccugaggaauccaagguuggauucaggauuucuaugaauacacgugugugugugugugucuguguauguguguauguuugugcaugugagcauguguguguggacuguguguauguguauguauauguguggacuguaugugugcacacauuuguauauguguguguugauguguuuguauguaugcauguguguggacuaugugcaagugugugcaauguauguggacugugugcauguguggacuguguguaugugugugcauguguguggagcgugugugugcuuauguguggacucuguguucauguguguguacuguauguguacacauguguguauauaugugugugugugcgugugucugugugguguguggacuguguggugugugugaacuguggugugugugugcgugacuguguggugugugugcgcgugugugugacugcuuggugugugugaacugugguguguguggugugugugugcuuguguguggugugugugcgugugugggaacugugugguguguguggacugugguguguaaggugugugugugcuuguguguggugugugcguguguguggacuguguggugcgugugugugcuuguguguggacuguguggugcguguguguggacuguguggugcgugugugugcuugugcguagcgugugugcguguguguggacuguguggcacacacgcuugcauuuucccgggggcugacccauugcauuugucaucuucuucaaaggggucuaucuuugcugaaagauuugcugacaaauaaaggggguucagcugcugcuauuuuuuuaaauuuggaaacaaauuuuuuaaauuuuuuaaauuuuuuaaauuuggaaacagaccagucaaacugcugccuuuuaugguuagagaaaaugaggcccagaagaaauugaagcagggaaagcgaaguugcccaaguuuacaggcgaguuaguggcagcaucagcaguagugcccaggacuccuggcacccagcccaagauccucuuuccaccugccucuacggccccccucacauuuguguagaugcaguagcuuuugccugugggaugggagggaugggagauguguccagacccuccuaggaggccacaugagugugacuguucucggcccaagucuuucucguuccucagagaauuugcggggccccugggcacacaagcugagauccacccagcccuggucccuuggcaagaacugagggacaggaccugguucuggggaaaaugcaggggaauguuucucccuuccacagcccccuugcgaguuaggaggccggcucccaccccagaagguggccagguuuucaugccuuccuagagaaagcuggggcucguggccuccaccacaggaagacgcagacccucagaaacaagucugugaagucacaaccagccccaguuuacagaugugaaacugaagcuccaaaaagucaggaggucacugaguggggaggugauggagugggaacagcccccagaucuggcugaggccgaagcccuggagagauccccgcaaggcucccuuagaugccugacauucuguucuuccugaagccucacucccuucucuccuggcgcagacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcaggugaggagccucaauuucuucagcugggaaaugggcacacuugggcucauggccccaaggucugucuucucccugaguggguaggucccagagacagcugcccuucagggccuucaaggcucuucugguuuuguaaaagacuuugugaauccaagaagagcaucuauucuaggaaccacauuuacugaucaucaagcuacuggcugccguuuauugagcucuuaucauaugccaggcacaauacuaagucuuuguguguauuuacccauccccuugagcccauuguuguuuuucccauuccauggggccucuccugaagccucaguagaugagcccgucuuccagucuggugcuguuuuugggacaaauaggagauugaccccaggccguuccaccuaccccaggggcuuccaccaaccccaaagucuucccaaggccuuggagagcccucuuucgaaagcaucuccuguucuggguaaugacaauaauaaaaucauagcagcugucaauugcgagcacuugucauguacaaagacugugccccaucggcgcaugacuucauuucaccugucaacaccccugugagaugguuacuguuguuauucccauuuuauagaggaggaagcuguggcuuggagggcuaggcauuugcccaaggucaaccagcuugaaucacuggcagagccaggguuaacauucagggccccacccaucaccacgguguggcacugccucuacuuccuaucccccuccagagagaggcuuaugugaaccgaguauuaacucugagccauaaccaggagccugcuauggguucugagcuuuuauaggaugugguggaaauagcagggcucugguacuccagaggucaagguucccaacucagcucuaacaccaaccagcagagcgacccaggaccacauguugccucucugagccucaguuuucccauguuuagcaggacaggacugggcucuuagagaguucauagcaccuuuccagcuccugguggguucaagagagaacucccgggaugaagagaugagagcacugagguuggggggucaacuggauagccagggcccuaguucuguccuaagaggaggaaguugugucuucuccauccaaccauccaaagcccuccccagauuuagccggcagugcgugguggacaaagacaagaggaaccagugccgcuacugcaggcucaagaaaugcuuccgggcuggcaugaagaaggaaggugagccucggcccuccccgccccaccaccacugccccaccugcacccacagcuccccgacagucauuuacaacuguagccacacuuuaugacucaguggcaggccccagggugacuggcuaauggcugagaagagggagggccuggaaaucugaccauagggagcggcugggcuuggucuugagaaagauucagagagauaagcucccacucuuggcuccucaggcucccagcaaccaccaccccugccugccugucugcgccaccacaaagcagccacguuguguguguguguguguguguguguguguguguguuuaauauaauauuucgaacguuaggacaagcauagagaaugauauugcaaacaucugaguacucacuaucccaacuuuacaaaagggacagccagaggagcccgaugccugagcuuccggucccagggacaaaugccccaguucccuuaguauucauucguggguaucacgugaucuccaaagucuucacauucuagaaaaugggaacaagaccccagacccauccuggacaaaggaggagaagaccagagcacaacauuuauuaaggucuugccaggcuuccugcuaccagcagguaucagucacugggcugugcuuuuuccacacuucaguagguuggguucauuucauuuucaugacaacccuauaugggaaaauguugugaaaaugaaaugagcccagcccauugaaccuauuacaauuccucccuuuuuguggaugaaggaacugaggcccacaaugguuaagcaacuugccuagggccccacaacugauccuuggaagaucugaagucccagagcuucugcuauuuggaccacacuucagcacugucuauuauuuuaugcucuccagauaccagggacauuuaaaauuguuuucagcccaagcaagggaagcaaaaaucuuuuaacugcuuuaaaguaacuugaggccaggcgcagugaaucaggccuguaaucccagcacuuugggaggccgaggcaggcaaaucauuugaggucaagaguucgagaccauccugaccaacaugguaaaaccccgucucuacuaaaaauacaaaaaaauuagcugggcgugguggugcaugccuguaguccuagcuacucggaaggcugaggcaggagaauugcuugaacccaagaggaggcgguugcagugagcugagaucaugccacugcacuccagacugggcaagacagcgagacucucucaaaaaaaauaaaaaaguaacgaguucauuuucgaaucucuucauuuccugcuccucuaaacucaaccuuucccagcucugcgacuagucccagaccuucccuucuagcccacaguugugccguaccagccaaaccuuggucuaguccugcuaguucgguacaaacaccccucacccccaucaccccagcacaccccagaagcaggaacguaggacccagcuugcuccagggcccacugagaaggaggggaggggaggcuuugguagacucucuuuccccuguaucugcuccuggcccccuguuuucucugcccccucccuuggaaauaucuucuaugucucauccuuaugggaccuuagucugggcucaugagcugucuuggaaaaucugggcuugcugaucccgaugcaggagugggugguccccaaggccugcucugaacgcugcaauucuaacaucuagauaucagugguucuccaagggcaagaggggcuuuuuaagcugcaaauacucccuccucucccaaacccaguuuucaaugggguuaagccugucucauccacuucaacuuccauuuuguggacugggaaagauuaugaaugggaaccugaugcaugugugaacaguuggaggcaagaaaaagauugagaacuacagucuaagguuccaacauuucugugguuguauuagucagugauuccauuaucccaaaagccuaagauuuuaggcacuaugauuccucauaggugucauccagagggcacuguguuugagagaacagcucucucacagugaaaguucaggucugugacaggcagaugggagagggguuggcagcccuccugaguggauggcuacccaccuccacugcguguggccugguccugcguguggucaguuguuauaaaugucuuuuauuagacauccagagucauuuucacuuguguaauuuagggacauuucugucucuucugggcucuaguuuucccaucuauaaaaugaggacauuggauaaugaacccuucagcccuaugagucucgcuccucacucccugaccuaccugcacaagucacacugcccacuaggauggguguguuuguucccuggucccuucuuuuuuuuuuuuuuuuagauggaauuucgcucuuguugcccaggcuggagugcaauggcaguaucucggcucacugcaaccuccaccuccugggugugagugauucuccugccucagccucccaaguagcugggauuacaggcaugugccaccacaccuggcuaauuuuguauuuuuaguagagacaggguuucaccauauuggccaggcuggucuggaaccccugaccucaggugauccgccucggccucccaaagugcugggauuauaggcaugagccacugcgcccggccccuggcccuuucuugagcugcugcaaagccagcaaaccccuuacuaggcuccuggaagggggaugagagccccagaccauucagccuuagcucagccuugaaaauagcugcuugcuuccuggcccagggaaacggacaugcugcccggaggauaggagaguuggcugauggcgagugagcguggguuagucgaugcuaguguuuguuuacaugccuggguuaccuggaagaucaugacacaugcagucacuugguuguuuugagaacgggccagagugacaaaguguucaguugccacuguggucaagccauaggaaaugaggguauuccuagcugugccugucuucuaggccccaccaccccuccucagccugcugggaagcucccaaagccaaaagaaagucucgguggaagucucacuggccaggagaguugggacaaguuuuuauuucuuuuucuugaugaccuuaggagaauuugaggacugaaacccuaaaauagucccugagaaccagaaagugugagcuggaaagguaggauuucaagaccagcugagucuauaagaggucaucaaaucuaccugcuccccacuuuacagaagaggacacugaggcuagagaggugaugugacgggucagggguggagucaggucuagaacucaggcuccccagagcugagcagacaccaagcucccuggagugaaacuugcagugaucagcuugggaggcacauuucuugaucuagauggcugaaacuuucucucgaccacagagaggggcuucaggucucaugggccuauaagucucugccacaggauaguccaccauggcuggaaggggcucccuggaaggccaaagaauccagggagaacccugggggucagugggccaacagcaggucaagaauucuuuccugcaaccgaaagccagggagacagacaccugccuuggccuaagcugucaggcccaggacaaauauucggcuccuggcaucaaaaacccagcccagaaagcggacccagaguugcaggaggugagcguaggugaugggccaggggccaucugaagaggccuuccucggaagccccugcccugcuccccacagcccccuacccaggaguucccugggaagacaggcucaucaccucuccgccucugcccaggucgguuaauauucaauagaaguuacauuagguccccgacccugcuaauacugagcaaacauuuggaaaacaucauuccgugacugagcucgcgccgggcacugauaacgcccgccuaaccuugaggagcccuauccgcagcugcugacagcagcccuuucauuccgcccgccggccacucggcgcccugaugggugggugcgggugcuggcaggaggcugccgugggaggggugugggcgggugggguggacggcccggucagggaagccgugcucugagcuggccccguccacaugguggucugagaggagguugcuugccucuggacuucuguucuauccacugacucccgggcucaagugcaaaggauuugacuuuuauucucugauuuuaacaaugugucaacaucaagagaaaguugaauagcuggggugucaauguucccuggagaaauaggguucuuauaagaauuagaguuuaugaccagguguggugccucgcaccuguaaucccagcauuuugugaggcugaguggaucacuuaaagccagguuuucgagaccagccugggcaaccuaaugagaccccgucucucaaaaaaaaaaaaaaauuuagccaggcgugguggcacacgccuauaaucccagcuauucgggaggcugaggcaggaggaucgcuugagcccaggagguugaggcugcagugagcuaugauugcaccacugcaguccagccugggcaacaaaaugagaccccaucucgaaaaaaaaaaagaaaaagaauuagagcuugucucuuccaaugccuucguucucucacugcacaaauauucauugaguaccuacugugaaccaggcccuguucugguggcugggacuacagcagugaacuagagggauggaguuuuggccuucugaagcuuuccuucucagagagagacagauaguaaaggaaguaacaaauaauucuacaauaagugacuugaagaaaaauaaagcauggggggcagggccagggugggagucauguuguguuagacaggguggcuggagagggugucugaaaggcgacauuugugcagaggcaggagugaaaugaagaugcugcugcgcugugcaggaaagggaaccccaggcagugaccacagcagccuacaagcgugcggaugcguccagguggggaggcggguuuucgcggacagaguguguagggggaagccgguaaaaggugcgauccgagaggagaggaagggcccuggggacuugugagguuggaaggcacugguuuugagcagcaggcgacaugacuugaacggaucccucugucucugagaggaacacagacugcaggcgcaaggcagaagcagagcccaggaggaggcugaucuaauccaggagagacagcgggccugggagcagggagggagcagcaggucuguuugucaggaucacgacagcacuggggugugaggggaagccaaggaagguggccaggcuugaugccagucccugagacgagaaagagugcagggagccggcuggcagggaaaugccuacggguagggaaacugagccccagagagaggcugcgauugccaccggcacacagaguggcagguuccagacaggaagccgggucuggugcagcuucaaccucccuccuuucugaaucagccaagccucauuccacagugaggccucuuggacuccaagggcuaucccauccacugucgggaugguggaaggaucaucuucuaucucaggccaggacugacccagaugggagcaggcaguggagccuggggccccggugggcguaggcuccagaucccucagugccuggaacagagcagcagugggagggagggagacagcgccuggccuugcugaugcugagguuagucuggaguacaugcagcuccugcugauggacaaaaccaucaaggcaguuggagcccccagauccucuuguucaggaauccccaggccaucuccuugucacccagaguaauuuguuuugcuugcuuuacucacuuucauuuggaaagaaagggacccuuuuguagaccagagcuugaacaucuuuaagcuagucagauccccuccucaaugcucaagaccaauuuuaaacccauagccgagucuucacugucuugcgcgccccugcugauggguggaucacucuuauagccucuccauuguguugggggcaguugugauauguggaaaguucuuccaccagcugaguuagaggccaucuccccucauuccacaugcugaugugggccuguucucuggacaccccccaccuccugcucccacuccucaucagucacagacacccccacccccuacuccaucccuguucucccuccucaccucucugugccuccucacagccguccagaaugagcgggaccggaucagcacucgaaggucaagcuaugaggacagcagccugcccuccaucaaugcgcuccugcaggcggagguccugucccgacagguaccggggugauccugccacccacccagggaucccccacacuacagaggagcucaccuccuccaccuccauucuccccagccaggcccuggagcagcugacgggaggggccucagauauuacagaagggacacugaguccgguuucacauggcccaguuugcagcaagggcaggaaucgaaccuggcgcccuggggcacuuucuaauucauccuacugccugcaucccacaggccaagcagagucuucaccuucacugagggccugcgaucagcucagcuccgagagaacagagcaguggcucaguggagagagguggcaaaguggggcccagcccuucccuugcugagugaccuugggcaagucacagcaccucucugagccaugguugccucauugucagaaaaggaugaugauuuuuugcccugcuucuccucuaaggcugacagacuccuuggggcucuaaagcugacagaggagggggcagggggcagguaacaggugaaggcacagagggagcccuucucccucaucccugccuccucccucccuccguuuuuacccugagcuuccuucagagcuggagggcacccacuauccagcccccuccccacaucugauuccagggagggggcucugugcaggggacagagagugcgggagggcccggacaucuccagcauuuucuucccuguaucucucgaagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccaggugaggaugggcguggauggugggcaguagugggcagugggcggggcagccagggggcugcuggcccaccugggauauagccguggacuggcuugauuuuauuuuauuuaacaaaauauguagugcacacacgugucugaaacuuuaaaucaccuuacaaauauuaacucaguuagcuccuccaacaacucuaugagguagguacuaagguacuauuauuacugccaucucauaggugaggagauuggggcacagagagguuaaguaaccugcucaaggucacauagcuacuauccagcauagcugggauuagaaccuggcaggaagcuccaaaguccaagcuccugaccauuguaccugaggcucucccagggggauguugacagggacccuaggacagggaucaggagauuuuggcuuaagcuauggcucuaagacugguugucugccuaauccugggcaaaugaguuccucucucugagccucaguguucucuuaucuguaaaguggaaaugauaauauccacuuuagagugugguugggaggauugaggacauuggugucugaaaaguacaaaaaucaggugauggggcaagcugcacaguggccagaccagagcuggucucccuaaacauuaguuucuuccuuguuucccaccaaaacgauugaacucagcaucguguuucccaccaaaacaauugaacugagcaucauauuucccaccguacauuuuuuuggaauacugaaaugucccuagggggaagaaaggguugaaggaagguggcgugugucugaggacagaugaauuucggagaugccaccuaugaagcuccugcccagagcaccccugggccuccaaagagauguuacccaucuggggaagaggagcugggcugggccaccuucucagcuucggagacagacucuggugcauucgcuuacccguuucgcaccuuugcauaagacacugacaaugcaugugagucugugaaagcuucugagaagucucguccaggcaguuguuugacuuugcagaggccgaggcuucucaaacuccuucggcaagauucuccuggaacaccuauuaauacugcacauugggacacugugaaaacgcugguuuggcuuguccccagccucauacaggggcuggacccggggcccucuuccaugguuccuccuuccauuagcagagucgacagggcaaggaucuuggacaauccgccccuacccucuccccuguuccuugugcucuggccccaguccccucugcuggagucucuacauuaauguuuaaucccuccuguuccuucccaggggcuuagcagggcaacaagauacccccaaccugagcaauuguuaaccucgauuucccacccaaaccucccuggcuggggcucagagcauucucagagagcaaugauggguggccaauaacacaggacaaucauuaacacaccaccccgaccucccggcccaccccccagaacagcugccauaucaggggguugaaccugggaucagaaggguucccagcuccccauuccugguauaugaggagcccagcuugcccaaugcagguggggcaucccugggaaagucgggggcauuguccuccaaagggcuucccaauuuuguugacauugccccagaaacuagauucccaguuggugugcuucuugggccuggauacaauugcagaaagagauuggggcuuagagagagacagaaauuugccugaagucacagagcaaguuagcgacagaacugggauucaaauccaggucuuccgcuucgcgaugugaaggccacuggagugacugaugaaagacuugcacagugcccagugcgcaggaggcgcuuggcaaucagcauccucggccucccuccauacuggucauggaaaguggauuuucccucccaggcaguuuccucuuuuucuguuuuccucacagguuucuauccauggggaauagaaggggcaaggacaaguggcugcccaggagcagcuagagcuagagaggaagucaagauguuugcucauucauucauucauuuccccuuuccuuccuucauucaaauauuuauugaaggcuuauuuugugccaaauaucuucagacaaaugccuucuuuccucuaacaacaauuucaccuccuuagaggccuucucugaccuccccaucuaacguagccauucuugccccauugcucucaccauccuuuccacuccccucccucccuccuucccuuccucccaccuuuucuccuuccuucuuuccuuuaugcugugaucacccuguguccucuguacuuauuuguucucuacuaucuguucauccucucuccuauaaauguuaguucgaugagauuagagaccuugucucucguuuuuaaacauugugccuccauugucuuaaaaagugucuggcauuuaguaggcauuuaggauuugauaacugaaagaaugaacaaucaaauuaaugaacaaacaaaggauuuuaaccuucuaguuuggcuugcuauggaaccuccaaacucccuaacccaaccuugaagaugagaagaugagauccuugaggcuaccagccuggugcuguuuuguuucaagccauccuuugguccucaggcaagcacuaaagcagauggcucucagugggcuggcuauguccuucugugagcuugcugggccccuaccuaugacuccagucuuagaagucuugccuuguacccccugcagagaaugguuucaucaagcugauucucugccaggggccagugcucauacauuugcucugagaaggaccagcccugagaccuaacauccacauccaaguucuuguaaugcccucucagaauccuggaguccugcaaugucgaucccuggagggaucugccagaccaaugauuucccaaacagaauugcacuucagagucaacuauggagcuuuuuaaacacagaucccugggcccacccuaaacauacaaaaucaggaucagaaucucagggccuaagaaucuguauuuucaggccgggcgcagugguucacaccuguaaucucagcacuuugggaggcugaguugggcugaucaccugaggucaggaguucgagaucagccuggcaauauggugaaaccccgucucuacuaaaaauaaaauuagccaggcaugguggugcacgccuguagucucagcuacucuggaggcugaggcacgagaaucacuugaaccugggaggcggaagcugcagugagccgagaucaugccacugcacuccagccugggugacagagugagacucugucucaaaaaaaaaaaaaaaaauagaaucuguauuuuuacaaagcacccuucauaauucuccauagcugguccaugggugggaauuugggacccacaguuuuggaacuuuuugggaucauagaccuuuuugagaaucucaaaaaagaaaaaaaaagcacacagaauguugcuuacaguuucaucaggcacacagaagaggcccagcacgaagcaguuucuugcccaaggacacagcaguucaaggacagagucagcgcgaggucucucagcucugagcacauguucuuuccccuuccagguuucuaguuuuauggguaguaguuuuaugaugcccauuucacaguucaggcagguagaggcagaggggagcauuaagcugacuugcccagcgucacugaguuggcuacgggcagccuucccaaggguacagauggcaaacacuguuccuucucucuuucagguggcccugcucagagcccaugcuggcgagcaccugcugcucggagccaccaagagauccaugguguucaaggacgugcugcuccuaggugaggcggcugccugcccuggccagggcuccagggaggguaugccuagcauggcacucacccaggcaaggagauucacaugguggcaugcaagggugagggagacuagucaggaguggcccuguccucaggcuugcauuagagggcuccaggacucaguuuucaacuggguaccccacucagaugcaaggaaauguggaugcaagucaccaaauucccagcauugaagucagagcacgaucaggguuaucccuggaauuaccugugcauccuuuuuucuuuugacagagucuugcucugucacucaggcuggagugcaaugaugugaucucggcucacuucagccuccacccgccacguucaagcaauucuccugccucacccuccagaguugcugggaccacaggcgugcaccaccacacccagcuaauuuuuguauuuuuaguagagacaggguuucaccauguugaccaggcuggucucaaacuccuggccucaaauaauccacccgccucagucucccaaagugcugggauuacaggugugagccaccgcgccuggccuaccugugcauucugauguucuuucuggaguaggagcaagaggugguuaagaauggcacaaagccccagcccgcgucaccugugccuucauggcauaguuauuauuuuaaacgcuuguacagcacacacugugugccagggacugugcucacugcuuugcaaacacuaccuauuuuaauauaacaaugcuaugagggaagcucgauuauuuauccucaucuuauagauaagaaaacugaggcacagagagguuaaguaacuuauccaacuauaaccagcuaucaggggcagagccauuuaagcagggcagugcaguuccagaaucugguccuuuaaccuugaugcuuuggugccuaucaggugaccuuugaaugucaucgaucuugugagucauguugguaaauggagcuugggucaugugaaagagguccuagaaagccaaguuccaagcucagccggaugacucaaggcagcuuaucuucugaaucugggccucagcuuccuuaccugugaaaugggagucaccaucccugcagguccuccucccacaggcaccagcuaucuugccaacuuaaaagccaaaacuagaggagaggggucaacccaaggugacuucccauccucccucccucccaacccuuccaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagguacagugcacaccuccuaagccaucccugacucucucuccagaacgcucugccagacuucuccuauuggguucuguacacugaguucacagccucaucucauguuaacgacagccaggagaggccguuuucauuuaacagaugaggcaagucaagauuugaagagacaauauggccgggcgcaguggcucacaccuguaaucccagcacuuugggaggcugaggcgggcggaucaccugaggucagggguucaagaugagccuggcuaacauggagaaaccccaucucuacuaaaaauacaaaaauuagccaggcaugguggugcacgccuguaaucccagcuauucgggaggcugaggcaggagaauugcuugaaccugggaggcggagguugcagugagccaagaucccgccacugcauuccagccugggugacuccaucucaaaaaaacaaaaacaaagggaggauaugacuugacagggcacccugacuccaaaggccugggcuuucccuucuuuuacuucuucccuccauccuucuuucucuuuacuucccaucuuccucuuuucuuucauauuugcuucuuuuccucaaaaaaauuuaucaaaauaauaucuagaaccggaugugguggcucacaucuguaaucccagcacuuugggaggcagaggcaggaggaucacuucaggccaggaguucgaggccagccuggccaacauaacaagaccucgucucuauagaaacuaaaaaaaauuagccagggauaguggugagcaccugcagucccagcuacucgggaagccaaggugagcaccugcagucccagcuacucaggaggccaaggugggaggaucucuugagcccaggagguggaggcugcugugagaugugauugcaccacugcacuccagucugggugacaaagcaagaccucaucuaaaaaauaauaauaaauaaauaaauaaaucuacacauacuuaaaaugcaaauacuucuccccauccuacuuuuccagcucuaagucuacuccccaagagaagcaugucugauuauuuuaauuguuucuucuggcaguuuccucaacaauucuaaaugaaagacaaagccuuauauuuguugaugcauccauuuuggaucauaauguuccuccuaggauggcagaggauuuugcuuuucuccaucaccauucccaucuuuucuuccccauuuuucccaauauauuuuuauugcuauuuuugagucucuguugcaaguuaugugcuuuuaucuuuccuuucuuguucuaucaacuguagacgguaucucccaacccuucacauugcaggaugaagaaaaagcauuccuacccucuccuguggcucuuggcucuccucuccccauucuguccacugacuuuugcaccugcauuuauacagaaugcauuugucaucagucuuuguacaaaacuugcuuuuguuucccagcaucaaaggugccugaacucuggaggcuugcuugccuucccugcuuacauguuagaggggaccuacugugugccaggcacuguccuucacgcugcaaauagauuaccucuaguaauaauaguaaugaaaaggcugggugugguggcucacgccuguaaucccagcacuuugggagacugaggcaggcagauuacuugacgucaggaguucaagaccagccuggccaacauggugaaaccccgucucuacuaaaaauacaaaaaucaguuguguguggugguccgugccuguaaucccagcuacucaggaggcugaggcaggagaaucgcuugaaccugggaggcggggguugcagugagccaagaucaugccauugcacuccagccugggcaacaagagcaaaacuucaucucaaaaaaauacauauauguguauauauauauaauauauauuauauauauauaauauauagugauauauauaguauauagugauauauuacguauaauauauauuauauauagugauauauauuuuauauauauauagugauauauauuauauauagagagagugaugaaguggaagaugagccccauguauugaaugcucccuaaagagcuguuuuuaaacacuuuauguggauugucuuacuuaccaacaugguaccugugaaguaggaauuauuauuaucuccauuuuacagauaaggaaacugaggcaugauuaacuugcucaaggucacacaaccggaaaauggcagagcuuggauuugaacuucagaccaccugucaaucccaauuucucucucucaagcccacauucuuaccuaccaccugcuaucccacacuuaccagagggugagauuucuaguucuaguucccuccacagccuggcccagccuguauccucuguagugcucaacacgaggcuggacuggcagaauuguucugcaaaaugggaaggaucacugaugcugagucagaggcagcagccuccagcaauuugaaggggcgggggaccuaguucaaggccuggcaugcaggaggugcucaauaaacauguguggccugaaugaacuaaugaauaagcaugauucaguggagacagcccacuagaaaugugggugaauguucuuucugccacuuccuuuguccaugaaagaggaaauaaaugcauuaccuccaugaagguugagauuaaauauuguaugaccgcuuaaguuccuuucuaggcuaaggaucuagaauuuauucacugauuuuuuuuucauucauucauccagccaucuaacaaaaaauauacauauaguuaucaauaaauauauauuuauauauaaauauauauuuuuuaaaauauauauauauauagucugucacccaggcuggagugcaguggcaccgucuuggcucacugcgaccuccaccucccaguuucaagcgauucucccaccucaccuccugagucgcugggauuacaggcaugugucaccacgccaggugaauuuuuguauuaucaguagagaugggguuucaccauauugaccaggcuggucucaaacuccugaccucaagugauccccccgccucggccucugacagugcugggcuuacaggcaugagccaccaugccuggcccuauucaauaaauauugacuaugcauggugcuagguggugaguuugaaaaggcaaaggccgggugcaguggcucacgccuguaaucccaacauuuugggaggcugaggcaggcagauuacuugaggucagaaguuugagaugagccugaccagcauggugaaaccccgucucuacuaaaauacaaaaauuagcugggugugguggugugugccuguaaucccagcuacucgggaggcugaggcaggagaaucgcuugaacccaggaggcagagguugcggugagccgagaucacgccacugcacuccaggcugggggucagagggagacucagucucaaaauaaaauaaaauaaaauaaaaauggcaaauaagacauacgcgugccccugccaaacucacaguuggauggcacaacaauuacauccuguguggucagcagugauggaggggccgcagagauuuggaaacaggagggacacaggauacagauauaggaggguagaaggcagacuuccuggaggaggugaaaccuaaccugagucccuaaggugauaggaagcaggaaccagggaaggggagccuauucuaacacaguagaagcagcaacugcugaggucuggaugaggggaccucaacuguggcccaaaaccccaaguucccauuguggcucugccaacaacuggcugugcgacccaggacaaguccuaucuuugcacugugucuggguuuccccguguguaagaugaggcgguugcuaggugcuuauuggaugcauuccucaagucccgcccuccaucuccuauuccccucucuucugguuuagugcuuuaggaaauguggcagaaaucuuuuucugccugugucuaggaaaucauaauucaugcuggcguacccugguuguugaggucccugaauccuugugcccacacugcugaagacuccuugugugauacaagucaggggacaucugggucuugacuccccagaugcuccagcuggacccugcugcccucccuugcccacccucuuccauuguagaugccaaggggcugagcgauccagggaagaucaagcggcugcguucccaggugcaggugagcuuggaggacuacaucaacgaccgccaguaugacucgcguggccgcuuuggagagcugcugcugcugcugcccaccuugcagagcaucaccuggcagaugaucgagcagauccaguucaucaagcucuucggcauggccaagauugacaaccuguugcaggagaugcugcugggagguccgugccaagcccaggaggggcgggguuggaguggggacuccccaggagacaggccucacacagugagcucaccccucagcuccuuggcuuccccacugugccgcuuugggcaaguugcuuaaccugucugugccucaguuuccucaccagaaaaaugggaacaaggcaauggucuauuuguucaggcaccgagaaccuagcacgugccagucacuguucuaagugcuggcaauucagcaaagaacaagaucuuugcccucggggaggcugugugugugugaguauguauggaugcguggauaucuguguauaugcccguaugugcgugcauguguauauaaagccucacauuuuaugauuuugaaauaaacagguaauaugauagaguuuaacugaaaaggaauccucuuuagauaggggaggccacaggagaccucucugaaguggugacucuugugcuaagacccuaacggcugaaaggaaauggaaggcuuaaaagacaagagaggaauauuccaagaagaagaaacuacuucaagggcugcggauaggagagaguguuguguuugagaaagaagggcaagguugugagauggaggacguguaggaggugaagauggagauugggcagaaaccaaaucauaaacauauggcuuugucagccuuuucagaaauuuggauuuuauucucauugcaacuauuguaaggagagugaaaaccagacuaaguauuuuuauucuuugagacaaagucucccucaaucauccaggcuggagugcaguggcacaaucuuggcugacugcaaccuccaccucccgaguucaagcaauucuccugccacagccuccugaguaguugggauuacaggcgcccgccaccacgcccugcucauuuuuuuauauuuuuaguaaagacaggguuucacccuauuggccaagauggucucaaacuccugaccucaagugaucacccaccucagucucccaaagugcuggaaugacaggugugagccgccacacccaucccagacuaaugcuucaaacaaaccacucuguuggguagagagugaauugcagauuccugagaaugucacugucuccaaucaugugauggaugauggaggcuuggacccuggcaauggagcagugaagauaaaccugaucaucuauuuggaggaagagcccacacccacaggauuugcugauugaucagacauagggagugagagaaagaggaagagucaaggacaaagucuacauuuuugcuuugaguagcagaaaugacgauggaguaauuuacugaaaugaggaggacagaauaaacaacaagacacugggucugggggugguagugaggggugaccucagagauccauuguggacccucuuuucuuuuuuccuuuuuuuuuuuuuuuugagacgagaucucucucugccacccaggcuggagugcaguggcgcaaucauaguucacuguagccucaaccuuccaggcucaagagauccuccuaccccagccuuucaaguagcugggacuacaggugcgugccaccacacccagcuaauucuucauucuuauuuuuuauagagacaaggucucacuauguugcccaggcuggucuugaacuccuagccuuaagcaauccuuccgacuuggccucucaaagugcugggauuacaggugugagccaccaugcccagccucauuguggacuuucauuaagcaugagaugacuauuacaaauccaaguuaucaaggaggcuguugaauguaugagucuguugcucaagcacaagauuaaaggcagcucuguggaaucagggggaagauggagccauggagggaagggaagaagacuggccagagggguaggagaaaaccagggcaauuccagaauccaagagaagagcguguuugaaggacagaguguuuaaugguguuaaacucuacagagaaacagaaagaagcggggaagaaaggagaggugaagagaggaggggaagagagaggaaaggguccauuggauugacagcuggaggcucuuggcaauuguguugaaagcagcaucagagagcugggagaguggaaaccagauuggagagugcuccaaagagagugagugggaagguggagauagaguagauaacccuuugaaaugguuugacuaugaaggggaguaugaaggaguuaggaugacugcaagggagugauuagaaugauaggucauggagucugggcugcacucaaaaagaaauaaagauagaggccgggcacgguggcucacaccuguaauccuagcacuuugggaggccgaggcggguggaucacuugaggcuaggaguucaagaccaaccuggcaacacagcaaaacaccaucucuacuaaaaauacaaaaaaaaauuagccagacaugguggcaugcaccuguaaucccagcuacucgggaggcugaggcaggacaaucacuugaacccgggagauggagguugaagugagcugagaucaugacauugcacuccagcgugggcgacagaacaaggcucugucucaacaacaacaacaaaaggauggggugauagugaaaagagagugucagugaauugacagucucaguagggcugaagaauuuuugcagcgaugguauuagauuacgggagcuggaaggacaugaggugaagucaaaguggggauguugaauucgagauuuuggagguguuucagugacugaagaugacaaggcgagggugagguuucucaacauugguacuauugauacuuggaacuggacaauucuuuguuguguggggcuguccuguacauuguucagcugcaucucuguccuguacccauaaggugccaguagcacuucuccaguggugacaaccaaaaaugucuuuggauauugucaaaugucuccugaugggccaaaaucauccccaguugggaaucgcuguuaugugauagcucauuucauucucacuuugacccugugaacaugggguuauuaugaaucaggugucauugagaucaggaucaggagccuguggucuguugccaaauaauuaagagcucucugggcucaguugucucaucuguagaaugggcuaauaauaguauccauccuauaggauugcugugaggauuaaauuaugugaaacaugggaagugcuauacaacaguaccuggcacgugauaauuguuaauuaucaacaauuguuauuuaucacugaaauagauguacuguagagaucgcuugcaagcguugaaauuccaucaucgucauauuacucaccauaggcuauuauuaaaccauaucccaugugguauuuuuacucccugacauauguuugaagcgguuacuguguuccagacaaucugcuaggcccucaaagaaagaagaaaaauaccucugaaauuguaaugcucauagacagaagaagugguuguuccuaaaaguuguguuacagacaaauuacuaugagaaauccaaggaaggagaaucaggagaggcuucuaaagagaggaaauauaugagcugggauuugggcuuauggacauggaacagguuugggguggaaaaacaucucugacagaagcaacaacgugagcagaagcauagagauagaaaaacacaggggacacauagaugcuauaaguaggucaguuggcugcagcagagaugugggggaugaggcugaaaggugaggcgggaccaaaugguugaaggacuugcacuccaaggagcuuugagagccauugauuacauccauuauguuacuaugugaccaauacacuacucauuagaacauuuacgugaucucagagcuuccuuauaugcaccuuguuccuuucaacucacuuuuguucucuugguuuuuugggguccucuuaacacccucaugaagucuauagaugggaaugguacacccuaguuuacuaacccaggaauagguacccaacaggcacugccaauauuggaugggcugguugauuggccacgccugaggaagauggcgucccaaggccugaggucugcaucccagacucuccauccugaucgaccuucucuaccugcagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcaggugggcaaacucugggauuuuaccuugcaaagggugaggauggggcuuaagacaggaggcaggagaaaguggagucuagaagguagaaccaggaugcaacaguuuucuggguuccaggguagggaauaaagggcaagauuguccauuuguugaggcuguuuauucaguaaggugacugacagccuuuacugaaugaagccauuguugggaugaggcaauccacuggaugagguaacccauugggugaagauguucuugggugagaauuccauuaguugacauuguccauuaaguaaaaguggucauugaaguaaggcugcacaguuggguaaggcuauccauuagacaauuagaugagacuacccauugggucaggaugucugcugggcuagaccauccucugaaaccuccaaaguauaaacuugucauugggcaaagcucuucaaaggauaagauuaucaaugggaugaagugauccacugagauaagaugauauuuuacugacauuguucucagggaaaguuuuccauugaacaaagauggccaauugggucaaauuugcucuccaaaccugccaugagagugaggccaauuaguuucuauuacucaucuccuaaauauccaagaaaugguauuuuuugagccagcugguccgggguuucaucaacugcugcuccuucucccaggaaagacuaucccugucacccaucccauugccgcuggggacagccaggccugggccuugguuugggagaagcaguccaagucugcauaucaaauaaaugauggaggagaugggugguaggaccuuccagaccucauaaaacuuaggcuuuaugaucugggacucacagaagguugagcaauaaaagaccuuagggauuaucugguuuaauuaauucucucauuuuauagaggaagaaauuaagucaagguggggcagggugggaggggagaacuuucccgggccucuucauuuacucccacaaaggcuggaauuuugagcagccccugucugucuguuuguccuuccagccaccccugagaccccacagcccucaccgccagguggcucagggucugagcccuauaagcuccugccgggagccgucgccacaaucgucaagccccucucugccaucccccagccgaccaucaccaagcaggaaguuaucuagcaagccgcuggggcuugggggcuccacuggcuccccccagcccccuaagagagcaccuggugaucacguggucacggcaaaggaagacgugaugccaggaccagucccagagcaggaaugggaaggaugaagggcccgagaacauggccuaagggccacaucccacugccacccuugacgcccugcucuggauaacaagacuuugacuuggggagaccucuacugccuuggacaacuuuucucauguugaagccacugccuucaccuucaccuucauccauguccaacccccgacuucaucccaaaggacagccgccuggagaugacuugaggccuuacuuaaacccagcucccuucuucccuagccuggugcuucuccucuccuagccccugucaugguguccagacagagcccugugaggcuggguccaauuguggcacuuggggcaccuugcuccuccuucugcugcugcccccaccucugcugccucccucugcugucaccuugcucagccaucccgucuucuccaacaccaccucuccagaggccaaggaggccuuggaaacgauucccccagucauucugggaacauguuguaagcacugacugggaccaggcaccaggcagggucuagaaggcuguggugagggaagacgccuuucuccuccaacccaaccucauccuccuucuucagggacuuggguggguacuugggugaggaucccugaaggccuucaacccgagaaaacaaacccagguuggcgacugcaacaggaacuuggaguggagaggaaaagcaucagaaagaggcagaccauccaccaggccuuugagaaaggguagaauucuggcugguagagcaggugagaugggacauuccaaagaacagccugagccaaggccuagugguaguaagaaucuagcaagaauugaggaagaauggugugggagagggaugaugaagagagagagggccugcuggagagcauagggucuggaacaccaggcugagguccugaucagcuucaaggaguaugcagggagcugggcuuccagaaaaugaacacagcaguucugcagaggacgggaggcuggaagcugggaggucaggugggguggaugauauaaugcgggugagaguaaugaggcuuggggcuggagaggacaagauggguaaacccucacaucagagugacauccaggaggaauaagcucccagggccugucucaagcucuuccuuacucccaggcacugucuuaaggcaucugacaugcaucaucucauuuaauccucccuuccucccuauuaaccuagagauuguuuuuguuuuuuauucuccuccucccuccccgcccucacccgccccacucccuccuaaccuagagauuguuacagaagcugaaauugcguucuaagaggugaagugauuuuuuuucugaaacucacacaacuaggaaguggcugagucaggacuugaacccaggucucccuggaucagaacaggagcucuuaacuacaguggcugaauagcuucuccaaaggcucccuguguucucaccgugaucaaguugaggggcuuccggcucccuucuacagccucagaaaccagacucguucuucugggaacccugcccacucccaggaccaagauuggccugaggcugcacuaaaauucacuuagggucgagcauccuguuugcugauaaauauuaaggagaauucaugacucuugacagcuuuucucucuucacuccccaagucaaggggagggguggcaggggucuguuuccuggaagucaggcucaucuggccuguuggcaugggggugggacagugugcacagugugggggcaggggagggcuaagcaggccuggguuugagggcugcuccggagaccgucacuccaggugcauucuggaagcauuagaccccaggauggagcgaccagcaugucauccauguggaaucuugguggcuuugaggacauucuggaaaaugccacugaccagugugaacaaaagggauguguuauggggcuggaggugugauuagguaggagggaaacuguuggaccgacuccugcccccugcucaacacugaccccucugagugguuggaggcagugccccagugcccagaaaucccaccauuagugauuguuuuuuaugagaaagaggcguggagaaguauuggggcaaugugucagggaggaaucaccacaucccuacggcagucccagccaagcccccaaucccagcggagacugugcccugcucagagcucccaagccuucccccaccaccucacucaagugccccugaaaucccugccagacggcucagccuggucugcgguaaggcagggaggcuggaaccauuucugggcauuguggucauucccacuguguuccuccaccuccucccuccagcguugcucagaccucugucuugggagaaagguugagauaagaaugucccauggagugccgugggcaacaguggcccuucaugggaacaaucuguuggagcagggggucaguucucugcugggaaucuaccccuuucuggaggagaaacccauuccaccuuaauaacuuuauuguaaugugagaaacacaaaacaaaguuuacuuuuuugacucuaagcugacaugauauuagaaaaucucucgcucucuuuuuuuuuuuuuuuuuuuuuuuuggcuacuugaguugugguccuaaaacauaaaaucugauggacaaacagaggguugcuggggggacaagcgugggcacaauuuccccaccaagacacccugaucuucaggcgggucucaggagcuucuaaaaauccgcauggcucuccugagaguggacagaggagaggagagggucagaaaugaacgcucuucuauuucuugucauuaccaagccaauuacuuuugccaaauuuuucugugaucugcccugauuaagaugaauugugaaauuuacaucaagcaauuaucaaagcgggcugggucccaucagaacgacccacaucuuucugugggugugaaugucauuaggucuugcgcugaccccugagcccccaucacugccgccugauggggcaaagaaacaaaaaacauuucuuacucuucuguguuuuaacaaaaguuuauaaaacaaaauaaauggcgcauauguuuucuaa

SEQ ID NO: 61620 - RNA, 77045 nt, Homo sapiens; identical to SEQ ID NO: 61619

SEQ ID NO: 61621 - RNA, 68836 nt, Homo sapiens; identical to SEQ ID NO: 61618

SEQ ID NO: 61622 - RNA, 77045 nt, Homo sapiens; identical to SEQ ID NO: 61619

SEQ ID NO: 61623 - RNA, 77045 nt, Homo sapiens; identical to SEQ ID NO: 61619

SEQ ID NO: 61624 - RNA, 32240 nt, Homo sapiens
gggcggggcgggaggcggggcccggcccguuaagaagagcguggccggccgcggccaccgcuggccccagggaaagccgagcggccaccgagccggcagagacccaccgagcggcggcggagggagcagcgccggggcgcacgagggcaccauggcccagacgcccgccuucgacaagcccaaagugagcgcgcgcgggggcuccggggacggggguccggcgccugggcggcccgaggggcuuagcggggcccagcccggggcguccaaacccugggaacgaacgggggcuccugcaggcgaguucuuccuucggcuuaggccguggcuugcuugcgggcuaaucagggacaauggggcagagaagguccagaacccggaggccuccagagucugcuucugccccugacuugaccccucugggucucaguuucgcugucugucaagugggcauccuagcaccgcugagcgcugugugggccugggcagggacuugaggucucugaagcucagcuguaugaucaggcccgaugucuacgccggauaggcaccuagugcugugcccggcgccuacugagugcucagugaauggaagcagcuuuguacgccagcguuaugguggugagcgccaaggagcucagguuuguggaugcgccccggggaagaaccgugagcccugccagaaaggggagggaggggagcagagcaccccccuucccccgcgcgggaagaacaggagcuagguaggcccuggguuuggggcccuagcaggguucacucgaggccaagccauggccacuggccccaggggagaauccccuuguuucuccgcccaccagcuguggcgucuugggacuguuggggucagggagggucuggacccccuuggccugucgcagaguccgagaggaggggcccaggagucugccaagcagggugagucagccaguagggugugagagugguuggggaaggagucagcugcagucagccucaacuuacccuucuaagaaauaggugugaguggcccaggagguuggcucacgccuguaaucccagcacuuugugaggcugaggcgggaggaucauuugaguccaggaguuugagacuagccuggacaacaaaacuagaccccgucucuccaaaaaauaaaaaaaguuaggggaagugugugugguggugcacucccguagucccagcuacucaggaggcugaggcgggaggaucgcuugagcccaggagguugaggcugcagugaggugugauggugccacugcacuucagccugggagacagagcgagacccugucucaaaaaaaagagaagaaaaagaaaagaaaagaaauaggugugaaugaugaugacagcuaucacaaaagugccggugagaauccagugagugugcaugugucagugagggagacaggcuguggagagcccaccuaccuucugaggagggugaggccuggcccccacuacugaugcccccagcccagggaaaaugcucagcuacuccccgucagaagcuggaagcacugaggugcuguacaagcccuccuacccccaccccugccuccuucacgucuuacuggagcuggggcccaugauuggcgccuccccuuugcagucuuuuuauuaaaugcucugggcucccucugcccuugggcuggggacccacuguacccugaugugaauccuauggcaauagcaaagcucuuugauuggcggggugcaguggcucacgccuauaaucccagcacuuugggaggcaaagguggguggaucaugaggccaggaguucgagaccagccuggccaacauggcaaaaccccauuucuacuaaaaauauaaaaaauuagcugggcaugguggcgggcgccuguagucccagcuacgcagaaggcugaggcaggagaauggcauaaacccaggagguggagcuugcagugagccgagaucucgccauugcacuccagccugggugacagagugagacgcugucucaaaaaaaaaaaaaaaaaaaaaaaggcuccuugauugcgaacauguugggaguuauggagagaacagcagggcccacuucuagagcacuuguugcagacacccauuggauccuugcaguucuucuguaacagcccaucaagggaggggcucauauuauuauccccauuuuuuggccuugcucaguccucccaucugauucaagcuggcagaucauuuucccuauugggaccucaguguccacaccuggaggauggaacaucagcugcuuaugugggugucccguguccugagucccaaggccacaaggugaugcuugagagugaagguagaauguuaccugccauguguuugaggcgugacaaaucuuguaugauugugaggaggaacuugugugagcuggcaggagaagugggaaggagugugaaucucagagccacugugaccagagccagcucccugcccucuugugggagggacagaugacaguuauaauuauuagcauuacuagcugcagcuaauggaguguugauguuucugugccaggcaccguucuaaacacauuaucugcauuuuuuauuuaauccaggcacagagagguuaacuaggcccaagaucacacagcuaggaaauguccaaucugggguuugaguccaagggaggcuggcuucgaaaucccaugccucuaaccaucuuuccuaaacuaccucugcagaagccuuuggggauagaggugccagugccccaggugcaaaccuccugagacaggagccuuugcuguguccuucagcuucucauaccugccaccagcugaggccugggaccuggucagcuagaagaaagcagagcagggcagcgcuuuucaaacugcacucaaguggccugacuuuuaauguucacacugugauucugugugggucggguuggggccugcgaugcugcacugcugaccagcucccaggaaaugcuaaugucaacgauccaggaacacacuuugcuuagcaaggcccuaggcagcugccuucuguugugcgggaccccuauugacuccaauggauauagcaccagguucaagaggcuaccuucuuuggaagagguagcaaacaagauacgggguuuuacugggggcuuagacacagggaagagaguccaguggcggcagacugagcagaagaaccgcaaccacuugcaaaucaugcaguuuauguagcauuuucauuuaacaccuucucccaaccaucuccaccuaguaaccuucauuuaacccaaaacaaagggccucggucccuauaccccuguauggucagugucccgugggaaugggguggggcucagauguuccucauagauaacgacuggaucuccagguuggccacucuuggauuccuucgcucagaacucugaacacccauucaagugugccugccaugcagggucaucgucaggggaugcccaagucaaguuugcccugucgggugugccucccauacccccaccugguuugacuuagcaccugcugggcacuggaagaaguggaaagggggguugcagggguggcccuuaucagccuauguucacagguggcaccaggcacucaggcauucugcauccuggaggccagugcugaucacaugccuguuacaauaaucauaacaauagcuguccuugaaguaguccuggguaccaggugccuucagugacuuuuucuuuuuugccagaaucucacucugucgcccaagcuggagugcaguggcaagauuuugggucccugcaaccucugccuccuggguucaugcgauccuccugccucagccucccaaguagcugggacuacaggcgugugccgcagucucacucuguugcccaggcuggagugcaguggugugauccuggcucacuacaaccuccaccucccgaguucaagccauucuucugccucagccuccggaguagcugggauuacaggcguccaccaccacgcccggcuaauuuuuguauuuuuaguagagacaggguuucaccacguuagccagcuggucucgaacuccugaucucaggugauccucccaccuuggcuucccaaagcgcugggauuacaggugugagccacugugcccggcuaguaacuuuuaucucacggaauccucuggacgacuugacaaggcaugggucuucauccccauuuacagaugaagaaacugaagcuuagggaguggagggacuugccagggcuacacaaaaucugagagccuugaagcuguagacuggcaagugaacagguacaggcugggacagcaguuucuuucuuuuuuucuuuuuuuagacagaguuucgcucuuguugcccaggcuggagugcaauggcacgaccucggcucacugcaaccuucgccucccagguucaagugauucuucugccucagccucccaaguagcuggaauuacaggcaugcaccaccaugcccggcuaauuuuuuguauuuuuaguagagacgggguuucuccuuguuggccaggcuggucucgaacucccgacuucaggugauccgcccaccucagccucccaaagugccgggauuacaggcaugagccaccgcacccggccaagggacagcaguuucuaaacugucccucucugaugcagaggggaauuggggcuaaaucagcaaugugccuuuucugucucauauuugaaugucuacucugcacgaggcgcuguccugcuuugcauacagugacucauuuaauguuuaugucagcccucugaggaagguccuguccuauuauuaacuucacuuauuaugaggaaacugagacucagagaggggagggaacuugccaaagucacacagcuggcaagcagcagagcuagacuugaacccagaucugccugcacucaaguagaagcuguucauugcuuugcucauuugccaauuccacuuuaugcaaaaaagagggggcaguguggggggaagaguuagaaucaggguggcagggugggccagugcauuagcccugggcuucagauguacugggguugaauuccugccugccgcuuagcagcuaggguaccucagguagacaacuccugaaacucagcuucccccucuguaaaauggggugacaaaaccaagaucuugggguucuuggggaaacugacaugcugauugguuuuuguacagugccuggcugguaacagcaggcccucaggggugcguuuccuuccuggggacuggaguggggguugcaguagacucugggaggccucuccagcugcagaaucucccuccucccuccuccuuuuugucuuccugacacaaaacccaccagcugcacuucuuugggcuugcaguggcuuucaguuaccagagccaccuguuaaaacaaaaaugugccuaggaagagccugccuuacccauuuugacucacauggcaguuggugguggaggggaacaaaggagacugaguuucaucgaagccuuuugcuucggaggaggaagggaggaucagagagaggaaguggucuguguucacacagggaggcaggggaggccaggcagcuucccaauccugcauucaaccucagggugggcuugaccuggguggcugggggcccugugauccaggagagacuuguccaccugcucaggugucuugaaggggucccugugguacccccuggggcggggcaagguaguaggaccauggucuggcuggggagguggagaggagcaggcugugggcgcagagugagguuggaaucuguauuuacccaagguguuggggguaggcuugcccucagcccuuaauguucucaggccccugagcaguugugggggauaaccucugcacuccuagugaccagggagcuagaacagcaaggaauuugaacuuggacaccagcuggggucaggcucucugggucugaguccugauuucccacuuuccagcuagaggagcuugaaugagucauuuaacuucacggugccucaguuuccccucucuaaaaugagaauuauacccauacccaccucucaaacaccaagugcaggccuggcucagagcaggugcugcagcaauagcugccauuggucagcaucaucaucaugguugguaaugguccuacuuugacuuuugagacagagucucacucugucgcccaggcuggagugcaguggugcaaucucggcucacuacaaccucugccucccggguucaagugauucuucugccucagucucccaaguaguugggauuacaggugugcgccaccaugccuggcuaauuuuuguguuuuuaguagagacaggguuucaccauguuggccauaacaauggcuguccuugaaguaguccuggguaccaggugacuucagugacuuuuuuuuuuuuuuuuuuuuugagcuggagucuuccucugucacccaagcuggagugcaguggcacgauuuuggcucacugcaaccucugccuccuggguucaugcgauccuccugccucagccucccaaguagcugggacuugggauacacuugcccccgcugguccucccuuccaccucugugaagaggaggucucaaacuccuggccucaagugauccacccaccucagccucccaaagugcugggauuucaagagugagccaccgcaccuggccccuguuuagauguuagcaucagugacccagcaccuugcuauguggcaugcagggagcgugcugcuagaccuccggguuuagagucaaauagcuuccuggcugugguaugcauuagacuuucuaacucaagguccucccacucucugagccucagucuuguugccuuuaaaacgaguuuaagugugcugagucccuaugcuguggcuccacaggaauuuccccagguggaagacacaucuugccuucugugaaaccucucagcagcagagcugucaggccccgucagcaggagacacuguggggacugcucagucccuuccacuguguaccucggagcuggcggagccuagaugaggcugagcauagagggcuuccuggaggaaguggagcugaaacaguuucucagcccagggcugcucugucuccuggccucacacuaaaagucaguugagaggccauaguggcauaagucacugacccuggcacugcccagcucaucaccaaaagcagggcuagggagggaggggacauucgauuggcagugggcaccuguggcucaucuggguucuggccacggugcucagguucugugagcugaccaggcagcccuggcuccucugcccccguguggguucugccaggucccaugggggcaggucagccccuuccuuguugcagggagagcacccagcauugcugacaugggacagggaaacgaggaaauaacgguguggucauugaacacagagagcacuaggugcugugcgaggugcugaggacacgacaugaugacacagacaagguccccccucucagcaaacggcucaugagggagacagacauguuacauacaugaacccaaaaagucagacgaaaacaaaacagagcgauguguuugggaggcaaacccaacugccggaggcgagcagggcgucuaccuccaagguaaacccagucagauuaguuguccccaaggcucaccagggagaacuaaucugacuagguuugccuuggagguagacggcccugcucgcccuccagcaguugggaacguggaaacaugagucagaucugggaguaucugucccaggaguccaagaccuggguccucaugguagcucugccaccgacacacugagugaccuuggguaagugaacccaccgcccuggaccucucuggcacgcaucucuugagagcagggacuuagugcauuucccgagggccuccacggugccuggcacauaguggggcuuaguaaauauuuguugguaacugaggaugcuuccuguucacaucagcgcugggaggauuuccugcuguucagacaaaugcugggcuggcugugagucagccuugcagagagcaaaggcagugggaaggggcgugagauuccccucuggagaggucaggaggccaggcacugucucgacaugagugccagggaggggguguggccugugggcagggcuugggcugaggcagagggacuugaguuccacccuagcucuaccaccaucaauuuuguguaacucuggacaggccacugaacuucuccgggcuuagccuggcaaguccauuuccccaucuguaacaugggccgauauguacauugccuagggauuaaaugagauaaagggucugaaaacaguagguagcugcuuuaucauuauuauuauuucuguauuauugaugucugaggcuaggcccacagaggcaguacaguagagugguuaggagcucaagaaucagacuaggguucaaauucugacuccaucacugacuguuuugggguacuucuuugaaccucaguuucuucaucaguaaaaugggagugaagucucuaccuugcugguuguaaggaugaaauaagauaaugcauauagauggucuagcacauaguagauacucaaaaguuugaggccacugcugacccuuuucccugaaaggagacaggagagcggggucgccaccccauugucauugucaucuggaauaggcugacagacuucccaugguguguugcaguuuucuagaaaauucaguaggaggccugccugagcuugagccaccuguggagguggcuuccugccucugcuccacaccugaaacgcgucugggccucuucucaggcagccgugagaagggaugagugcuacuggucauggugggcagcuggcucugcuuucccccuucccagaggcgcuccugccuccugcccagcucccugaaccccuagcuucugcaccccggcacugucuggcuucugccccgcugagcacccacugucucugacgcugccuugaguacuucccgcauguuauucaaaucccaaucagaucuucccucccgcaguagcuggucuucuguucuggcuuccugccauccuguccuccacacagcagccgggaaagguuuuuuuaaaggggacucuccgauuuaacacacuuggguggaaaacccuuugcuucggccucugcaaucucccugcccccucuccacuuugcccuggccucauuucucaccacuaaccucacucugcacucuggccaacuccccgccugcuuccugauucagacacuaagcacacgcagcuccccugccuggagccauucucccucuccuucuuucuucucccuggcgaacucccccuuuaagugaucuuuucccaacacacuuucuaaauugcccccaccccagugugauuuuucuuuaucucauagcacuuggucugcuucuuaucacaguuugcaaggcugaguucagaaagguguguuugcucauucugaggcaggagaggcuaccuugugcugcugugguaacaaacagcccccaggucugaggggucugcagagacccagguugaccucauacugcuugucccuccagggccuccagugagguuucggcuccuuggaucacucagggccccaggcagaugggaagauuccacucugaacauugccaauuguugugccagaguaaagcagagcugggaggugggcucuugaauuggcauuuaaauacuuuugccaggcaggguaaggcagcucacgccuguaaucauaacacuuugggaggccuagguggguggaucaccugaggucaggaguucaaaaccagccuggccaacauggugaaacccugucucuacuaaaaguacaaaaauuagccgggcaugguggugggcgccuguaaucccagcuacuugggaggcugaggcacgagaaucccuugaaccugggaggcagaggcugcaaugagcugagaucuugccacugcacuccagccugggcaacagagccagacuccaucucaaaaaaaaaaaaacaacaacaacaaauaaauaaaugaauaaauacuuuagccagaaguagccaugcagaccuccccccaccagucccacccacaagcggacgugacuaccgcccccauucacugccugauccuccuguucucaggggcuccaaggccaggccugguuugaccuucugacuuucugacuuccuccuaccuucccaguaaccucaugcaacuccuuucacucagccucaaucauccccauggguguuuaaacuugcccaagacaugccccuuugaaaaagccugccauucucuugacccacaugcacguccugcccccuccaaggcugcuaguuccuuuaggggcaaaauugugaaagaguagucuaaaccuucuuccucuucuuaccuccacuucuuucuuaccuuauucccauguggauucuacccucacucaggccucuagaacgguuccucuacggcagugguucccaaucuugacuacguguuuuuuuaaaaaaaguccuccaccugggccugccaccaaggauuuuucuuuaauugaccucagaugggguugaggccuugggaacuggccagaacuucccgugcuccuaacuugcagccgggguuaagaacuacuccucugaagcccccagugccugcgcuuuuagcccgacggacaaguuucugcccuuccauccugugaccuccagcagggccugaccaugugaguuuucuguggcugccgugacaaguugccacacccugcauggcuucaaccaacagaaacgugugcccuggcaguucugggggccagaaguccaacaucaagauaucaucagagccacaugcccacugaaggcucucgggggaauccauuccuugccucuucugguugcugguggcucuaggcauuccuuggcuuguggcugcaucauuccagucucugccucugaggucacguugcugcuuccucuuguguguguuucucuuaaaacucucugcuucugucuuauaaggauacaugugauugcaucuagggcccaaccagauaauccaggauaaacucuuccugucaagacauuuaauaaucacacuuugccauauaagguaauuuuuuuuuuuuuuuugagguggaguuuugcacuuucacccaggcuggaguaaagugauuuaaucucggcucacuggaaucucugcccccagguucaagcaauucuccugccucagccuccugaguagcugggauuauagguaccugccaccaugcccagcuaacuuuuguauuuuuaguagacaugggguuucaccauguuggccaggcuggucucgaacuccugaccucaggugauccacccgccauaaguuaauauuuuuuuuuugagagggaguauugcucuguugcccaggcuggagugcuaguggcucaaucucggcucacugcaaccuccgccucccagguucaaaugauucuccuaccucagucuccugaguagcugggacuacaggugcaugccaccaugccuggcugauuuuuguauuuuuaauagagaggggauuucaccauguuggccaggcugguguugaacuccuaaccucaagugauccacccaccucagccucccaaaguguugggauuacaggcaugaaccaccacgcccgacccauauaagguaauauuuacagguucuggggauuaggauuagcauguagacagcuuugugggggccaccauucagcccacuaugcuaacccugugaaccguugcucgcuucuccuugacaucugacggccuggccuucugcauaccacacacccucccaccucucuggccacaguucuguaggcucagccuccuccguaaggccauuaagugcuugugcuggucaaaguuucauccuaggccuuuuccuuaccucccuugauauuuucucccuaggugagcuccuucaagcccacagcuucugugcuuacccacacuccuaccuacauucccagcuugggcuucucaggccagcucuagacucuuguaucccacuggguucuuccacuuaccuuuggauaucucaaaggcaucuccaguuggcugggcacgaugguucacaccuguaaccccagcacuuugggaggccgaggugggcagaucacuugaggucaggaguucaagaccagccuggccaauauggugaaaccccaucucuacuaaaaauacaaaaauuagcugggcaugguggugggugccuguagucccaacuacucgggaggcugaggcaggagaaucgcuugaacccgggagguggagguuuccgugagcugagcuggagccacugcacuccagccugggcaacagagugaaacuccgucuuaaaaaaacaaaaaacaaaaggugucucuaguguaacauaacuaaaaccaaaccaaucaugccucccucccccgcauccucccuccuggagggagcuccaggacuuggucuucucuuccagaguucucugucucaaacugcgggaauugcuccccacccaggccuaaccugaagugugagccuuggcaucucuuucuauccaccuguuuuuccucuaugcaccucacaacccugguccaagccaccgucaucuuucaaauggcugcaguagccucuaacuggccuuggaggagccauccucuuucucuaaccagcugccaacccugcaauggccucugugugcuuuccagauaaagccugacuccucguggcccgcacagcccugccugggugguccuauccugcagccucuccaguaccaugaacccucccuucucugaaccucuauuuaauccauuucauauaccccguuuucuccugccauagggccuugcacaugcuguuccuucugccuggaauuuucuuccugccucccuccgcaccccugccuuguguuguggguuccucgcuauccucuagcuuuucgcucaggcucauuguuggcccucuagauguauucacuucucuuguuuguuacccucugucauaggacuguguucguacuucccaaggagucgucuugguuugugacuguacauuuucccaugugacauuugcuuaaugccucucccacucuggggccuguacaagccccaggaacaggacuuggacccuccuguuuaacucuacaaucuagcauccagcaggagcgcaggccuucguugacuuuuauuuuauucuuauuuuuuauuuuugagaugcaguuucgcucuugucgcccaggcuggagugcaguggcguaaucucggcucacugcagccucugccucccagguucaggugauucuccugucucagccucccaaguagcugggauuacaggugugcgccaccacgccuggcuaauuuuuugcauuuuuaguagagaugggguuucaccauguuggccaggcuggucucaaacuccuggccucaggugauccacccaccucggccucccaaaguggcuggauuacaggcgugagcccccaugcccagccuucauugacuuuuaguugacaacuauuuagcauuugcuaugugccaagaacucccugccuacuaaugcaguuaacccucaugaagccuagaaggaaggacugccauucuccccacuuaacagaugaggaugccgaggcacaggaagugaagugacuuucucagggucaagcagggagugaguggaggagccgagauuccagcucuaaccgcaugaugcucuauacagugugacuccggcucucuggcugggcccucuccauagcccugugaggguuaaggauagaaaacagaggcucagagaguugaggucccuugccugaggucacacagcugguuggccguucccugggcuauaagcuucaguauucccaaugcugagcauauuuugagaacccgagaaacagacguuuggcugggugggaacugaacucauuuugucagggaauucaacaacuaaguuggcccugagacugggugugaagaccgcucuguccccugccagcuggaugaccucaggagagaucugaugacucugagguccugcugauaggaccucuggugucucuguucccugcuggccuccccugggccuggguuggguuuccucugcaggaggcagcucauguaugugcuccuagacgcccuugggccagcagcuccuuggcuguuccucccugagccagggcagccaacuuucuuauccagcucuccaugcuccccaccccagcaugagaugucagcugagaguuuucuggaucuccccuagcuagggggaaagcuuccaucauuuggaacaggaacagcaggaacagcaaagucccuuuccccaccaucucccacugccugcugugcuucuccuaacagcucaugguaaacacccugacugagcggcaggggcuguuuccuuugggcuauccauguccaccuacacugcccuuuuuaauccuuacaauuuuucuuggacacgggggcauaauauuccauuguuuuucaguugaggaaacugaggcucagagaggucaagugucuugucugaggucacacagcagaacugggagucaagccagaugggcugccuccaaggauccuacucuuaaacucuagaguacuagaaagaucuuccguugccuaauauugauuccugauaggcuaugcuugaguagcaucugcuuuugaaaauggagccugggucgguugcgguggcacauaccuguaaucccagcacuuugggaggcugagguggguggacaccugaggucaggaguucgagacuagccugagcaacauggugaaacccugucucuacuaaaaauacaaaaauuaacugggcgugguggcaccugccuauagucccagcuacuccggaggcugaggcacaagaauugcuugaacccaggagguggagguugcagugagaggagaucaugucacugcacuccagccugggagacagagcgagacuccauccgucucaaaaaaaagaaaacgaaaauggauccugaauuuugaaauaugcugugacucuucccuaguuugggacaucugggucaaucccuuuuguuaaaguaguuuauuuaguuggcugagagcgggagcugccuacgugaccuggagcacaagcuuuggaauugggcuuggguuagaauuccgccucugccacucaccagcugcgauuaagaacaaagauacuggguugggcuccugccucuauuacuugcaaucuguguggccuuggaugagauauuuaacaccuccgaaccucaguguccucaauugugaaagagaucgagauaacagcugaacccacaucccaggagcggauuaaaugagauagugcaguacagaguuuaccgaaguauauggggucagcagccagccaguaaaaugguggcuaaugguuaucaugauuaauguuaacauuaagcucugaaagguccuucgugaacucauagguauuuguucucucucucccuuucucucucucuucccccugcccccuugcagguggaacugcauguccaccuagacggauccaucaagccugaaaccaucuuauacuauggcagguaaguccauacagaagagcccucucucccugggauuugagugggguccccagcuccacccagaggccccuggggaauuccagggucacuguuccuuccugucucccugugggaaucaagccagcuccaggccagaagugggacugugaggacauggaggccucagcacugagcuggagacccgcagaccaacuccugagcuuucugggccucugagucuuguccuccuggugucaggugagccaggccugagccugcucuccccacccacccacauacgugcaugaagguaguucccagggcugaauccgucuuuuuuuuuuucuuuugagauagagucuugcucugucgcccaggcuggagugcaguggcaugaucucggcucacugcaaccuccaccuccuggguucaagugauucuccugccucagccuccugaguagcugggauuacaagcacaugccaccacauccagcuaauuuuuguauuuuuagcggagaugggguuucacauguuggccaggcuggucucgaacuccugaccucaagugauccacccagcuuggccucccacagugcugggauuacaggcaugagccacugugccuggcuccugucuuuugacuuaacugagagccuauauauagcaggugaugugcucacaugagaugccaguacaauuucuugagcaucuccuagagcugggcugggcuuuaucagcucauugaauuccuccacgcuuggaagaggaggauacgcucucugcauuuuacugaggagggaaugggcucagccaagacaguuguccacggucacacaaauuaauagcagaucaagaguugaacccaaggcugucugaccccuaaggcuuuacuacaucaucagggucauaaccugcuaggagucacggaaaaguggcuccccaacucugggccuaaaucucugcaucuuccaagugagaacacacuuccugccucagcucucagagaugcuagggggccagagggucccccuguuccccagcgaggaagguucuucccuuccuacccagaccucaagggcucacagcagcuccucucuuaggaccagcuuuuaagggcagggacuuuaaaggccaguggaucuggauucaaauuuggacauauuaucuccugucugcgaacuuggucucuaucaacugaggcuaagaacaggcccucccuagagagaugaccuaggagcuaggggcuccuuguccacccagcccugcccccgcagaccuguguuccucggauguuugcacaacacucauuuuguuuggagcugaaagaacucagccucucugucacagucuugaaauucagcucgggacccaaauuugaacauuucugcuccauaagccagaauccuguuauucagaggccugcccucauggagagaaugagggaucccgggggguugcccccaacucucgggagcaucuccaccaacucccugagagauuucugguaaguccacuauucuccaucuuuucgcacuuccagggaccuucuucugccccaggaagcugccauugauuuaauuccuauuuaacugcaaggcauaagcacaguagcaccuccugugugccaaacacuccuuuaagugcguuacccggguuaaguuauugaagccucacaacaauuuguaagauaggaacucuauugccgucauuuacagaugaggagacugagccgugguagguggaguaaggugcccaguaagcacagggcggagguuugaacccagauagucugcccccgaguccauggcccuggccauuacccccugucaguuagagguuuugguaagugacgcccguaaaaugcuuaguucagggccuagcacacauuaaugugcuccauaaaugucacuuaaugauaauauucuuauuaauuggagcuuauaucucuaaguggggugaaaccucuuggcuuaucucugccuggccuuugcccaugucaagccgccaacuugccacaaggccccuaaugaggucguucaguggggcaccaagaugagaucgaacccaggcacucauuaaggggucacggagggcucaucagcugcagccaggggcugggagcgccggguggggcuaagagaaaggggaaaggagccgccgggaggggcacuggucugaucguccauuccucacaccaccucugggccuuggagauggcgugcggcaggugccagcuggagcuuggccugaagucagcaggcaggggacuggggaguuugucacacucagauaugggugucuguaaaugcacacaaauaugggcuaagaauggaaggaggaggggagccccuggccugagcccugcuaggcccaauucaguggcccuuuuuccagcucugggacucaggccugccucauuaacuguccucacccauuucuccuuccuccaguucccaggauucuggccuuuucaggggccucuccaaccucuuucucagucuuguuuauaacccugucaacuauuucuacagagauucugaaacuggcugcucuuuccuccgaucacugcccuggucugggccaccacugccccucccuggugcuguggccuccugauuggucucagccaucuacucuggccuuccucucuacgggcccugcagugcuguaguuggagcaagagccuuaacccauggucuucccagcucauuccccagcuuccccaucucacucagagucaaagccaaaguccacacaugggccuuaaaguucugcaaagccugcauugccucucugaccucucuaaggcuccuugcuuaguccacacuggauguuuuucaaacaugccagaccuaggaaacagagagucuggguuacuugcccaaggucacacagccuuuaagucacagagcugggauucaaacccagaccacugggcuucagagucugcucuuucucaugacacacaaaguuucauuucuuccucugugcaccccuacauggaaaauauuauguuuuacugacaagggcaccaagggccuuagaggggagcgcuccugccugggaugaugugguaaauaggggugggagauggacuugaccugcaaccccugagcucauccucccucccucccugggcuccugauggugggcuucuugugacuguguugcccaccaaggccggaagaggaccagacagugccccagcacagcagcuguggcugaccagggaguagggaucaucuaagaacagagcgugcaugguggcucacgccuguaaucccagcacuuugggaggccaaggcggguggaucaccugaggucaggaguucaagaccagcguggccaacauggggaaaccccgugucuacuaaacauauaaaaaauuagccaggcaugguggugggcaucuauaaucccagcuacuugagaggcugaggcaggagaaucacuugaaccagggaggugaagguugcagugagucgaggucgugccauugcacuccagccugggcaacaagagcaagacuccgucucaaaaaaacaaaacaaaagaaaaaacagaggguggcccuaugaggagccuucgcuuguguggguggccagggacagcaagaggugccagggcccuaggaacagcucuuuccugcuucaacuuugggcuccagaugggcgcuuuccagcucagucugagcagcuucgggaagcugugucccaugggagacacugggaguccccugugcucuuugucuccugucgggcccccacauuagcucucuggccucagcucuggcuucccuccaauuuguuucccacgcagcagccagaggagcuuucaaaaagguaaauuauuucaugcuaguccccugcuugaaauccuacagugccuucccagugcuuucagccaaagccccagucccuuccuaagcccagccuggcccugccucccuggugcaucaucugcacaaaugccugcucucugaccuccagccacccugcacuuccaaugcccgcggcuuccugccugcagcuuuaguacagaccccuccccugcccagaacugcccccaccccaaggcuucugcugaaaugucaccuccucagagaggccuucccuggcugcucugucuaaacucuguguugagaaguuccuucuugaugguuguugaggagggaggcuggagaagaagaaucgaagaggagaaauagaaagcaaaauaauuuguucuaggggacgggcuggugcugggcacggggaggcgcccgucucuggugugggcagcuggguagauggaggagccguauuuggaaauguggaacccaggaagggagugaucuagagggaggggaaagguggcgcgagaugccugccucucaacagguagccagacacaugggucugucuuggucacugcuaucugcccagugcccagcacaucacaggcccucaguggugguguaugggcauagagaauuagaagcuguggaccucuggauccggagcugaaaaccaccaaaggagaugaguuggccuggccagguguguaaaaggcagagucugagagagaacgaccagagggcagagcccccgcagguggaguucugggggcuggagggagaccauuaggagaaucgcacauggcuggcgcagcaggucccaggcaaauguggccacuggguuuggcaauaugggagccagagcccuagugucaucucccugccuucuacccagcaguucccagagugauauccccaacaguguuugacaacugguacaggcucuucagcggccacaguuacugggcaaggccuugugagggugacuuuggggcagcuggccagcagugggaggggaagcagucucagggguaccugaggcacugagcuccgaccuccaggugccaaugccgcaccagggcaccguuccccugcaggcucuuacagggauuaggggcugguaaggagcagugauuaggggcugacuagcaggcuggugggcaccagcaugaccccuuggugguacccucugggcacucauggggacuugggcuaacagauggggaagggagcacauucagggggcuuaggaaacauauuuauguagggaagcauuuuaauauuuuaguaacagaagcuauuaaaggacuuacaaacuuacuuacauacacuaaaacacuauuuggucaaacuucuguuucuuuggcacuuuccuccuuuauucuuuuuuauuuuuuugagacagggucuugcucugucacccaagcuggagugcaguggugcaaucuuggcccgcaguagccuugacuuccaggcucaggugguccucccaccuuagccucccaaguagcugggacuacaggugcacgccaccacgccuggugaauuuuuguuuugaagggguuucacuguguugcccaggcugguuucaaacuccugggcuuaagugauccgccagccuuggcuucccaaaguacugugauuacagguaugagccacugcacccggccuccuauuuuucugcuucugcuuuguggauaauuggaugcuuggaccuccugauuuaaucuucuaauuuccuuaacuguuuacuccuauuuuucaucaucuugucuuuuuguucuacuuuguggaggauuucuucacuuuuagcuuccaguucuuuucuuacaucgugacaguugcugccgcauucucuuguaaauuuccgagggcucguucuuggguucugaauguucccuccuuucaaggaucuucucaucucuuugaggauauucaugucuuuuuuguuuugguucuuagguuuucaucuguucucugugcuguuuccucggagugcuuuugucuauucuguuguuuugucccucauguuagaagcauuucuuuuuuuuuucuuuuuuuuuuugugauacagagucuugcucugucaccaggcuggagugcaguagcaugaucucggcucaccacagccucugacucccugguucaagugauucuccugccucagccuccugaguagcugggauuacaggcacacaccaccacacccaacuaauuuuuguauuuuugguagagacgggguuucaccauguuggccaggauagucucaaucuccugaccucaugauccucgcaccuuggccugggaggccaaagugcugggauuacaggcgugagccaccaugcccagccuagaagcauuucuuaaugucugguguucucuggcuguuguaucuuaaaaaaaaaaggggggggaaacugaggcucgaggugaccuugugagcuggagcagagccgggaugggaugaggaggcaggagcgugugcagaagagagggagccccccugagcucgcacccugcuucccguggcugggaggggaggccgagaugcuuggggagaaauggaggcuccaagccagaggggcuguuuccagcacgcucuuacugagcgcugcuguaguccagcuugguguggcggcugugggcagggaggggagagaggucugagcuggcuggcggcccacugggccccuccccugagccuccaccggcccucucccagugcgcugggcugggcaagccucugaugugccagccagauggagggugaaguccugaugccugccccuacccugggaauugugaugcugcaguuacugccccugauaaccccugacugggcauaggaccagcuggcugagccagcuccuggggcugaggaggaagccaugaacuugaccuggcacuuuccuugucuccaagcaucagucaaccaaggauauggagggggugugugcaugugugcacacauacacacacacacacacacacacuucaaccuguuuaucccccuugagauuugcugacuugugcauuggggguagaaggugcuggaaaaauuccgguccugguucucaguuuccccaucuguccagugggagcagcuggacugagagacgcccaugucuccugcugugguccugcaaggaggcuggcgcuccugagucugcuccauccuggccugucaggccugccuggauccugccccggguugguccaccacucacuguuuuguuuccaggaggagagggaucgcccucccagcuaacacagcagaggggcugcugaacgucauuggcauggacaagccgcucacccuuccagacuuccuggccaaguuugacuacuacaugccugcuaucgcgugaguugcccccaacccacagguccuagggcagcauugaucccuaugacuaggaccaggccugucccucagccugugggggccagagaaguugcucugaaaccacagcugucuuucucaccauuguguacacuuagugagucucuccagugccuuuaggccucaguuuucccuucugagaugugggugugauggacugaaauugcuucaaguucuacagagaaauggcagaauaugggagcuaagaacacagggucagaggcagugcagggcuugaacccgggccaucuaucuccuaguucagggcuucguguugugaggggaggagaggccugaauauagggugggggcggggagauguggggaagauucuccaaaaggcuuuuucuuuuucuugucuugagucgccagggaacagcacuagguaccgaaaaggcccagaagggguaugggcgaguacuagagagaaauuuccaugacugcuuuauuuauuuauuuauuuauuuauuuauuuauuuauugagacagagucucacucuguugcccaggcugaagugcaguggugcgaucucagcucacugcaaccuccaccucccaguuuaagggauucuccugcuuuagccucccaaguagcugggaucacaggcacccaccaucacacccaacuaaugguuuuguauuuuuaguagagaugggguuuuacuauguuugccaggcuggucucgaauuccugaccucaggugaucugcccgccucggccucccaaaaugcugggauuacaggcgugagccacugcgccuggccuccauccucauccugaagaugcaagaacuucuggugaccccuucuccugagaguggccugaucuccccugggcagggcacuuucuucccacgcugggcucucccagcacuugugugccuucccucacacauucuaguaaccacuucauuuucacucuucauggugggaacuuccagcuaagcacaguccaccguuacgugaucaacacaguggcccuggcaggccaauuugugccuugcuucuggaacaaacaugcaguaauaacaacgaaaauguuuugagcauuuguccgcucugcuccaagcacugacccgggugggguuuaugaaguuugacucauuuguccccgcaauaacuccuugaccuaggugucagagggugacuaaccaggggucacacagcagauaagugugggcacaaggauccaaguccaugacuguaucccacgugucucccacauccaggcaucccucuggacuuguccagcuguguccuuuucucucauuucucuucccugccagccuuaacuccaucaccaacaaauauugggcuacucuguccuaggcaugguccucagcugagaggucgcagccaucccaagacagagggguccuugccacauggagacugcauucuaguagggaauacagcaaacuggcugauaagccauaugacacacaauguugaguagugauaaggaccugggagaaaaagaaagcccaggagaaugguggaggggccguuuuaagauaaggcggucugggccagguacaguggcucacgccuguauccccagcacuuugggaggcugaggugggcggaucaugaggucaggagaucgagaccauccuggcuaacacagcgaaacgcugucucuacuaaaaauacaaaaaauuagccgggcgugguggcaugcgccuguaaucccagcuacuugggaggcugaggcagacgaaucacuugaacccaggaggcagaggcugcagugagcugagauggcgccacugcacuccagccugggcgacagagcaagauucugucucaaaaaaaaaaaaaaaagauaagguggucagggaaggccucucugaggaggugaagcuucagcuggcucuaaaccaggggagcgggagagacgcaguguaggacaguaucggggaagagcaggccugugucuucuccgguggccucagggaaugagggagaaggaaggugcuggggaggcuggcaaggccuggaggaugcaggccuugugggcaggaccugggaguugcgaugucacucuccguggcaggaagcuacuggggcuucgaggggagaagugauaugcuuugauuuaccuucuuaaaagauugccccaacugcuggguggagaacaggaugacaggggcaagcauggagacagggaggccaguuagagauggcgugauucaggccaggauggaggggugagaacugguaugcaguuccaaaguagagcugauaggacuugcccagugucugggaucuuauccaguggaugcccagagcuugggucugggggaugaaguggguuuaaucugccaaggguuggggaugucauuugcuccuggagcucccaagggacuuggggaagguuguucccaaccccuuucuucccuucccaggggcugccgggaggcuaucaaaaggaucgccuaugaguuuguagagaugaaggccaaagagggcgugguguauguggaggugcgguacaguccgcaccugcuggccaacuccaaaguggagccaauccccuggaaccaggcugagugagugaugggccuggaaggggccaugcugaggguguggcugggaggcucagcucugagacuggaagggcgaacugcugggaaucccugacccaagcaagaccuuguucuugcccccagucugguccauggccucagaaagauggguuuaacucugucacaagagacgugguucccauccucccuuugccguuauguucuuaccuugggcacaaguguuuggcugugucuugcucuggccacaggccugcuguccaggaauguuaaccugcuuagccacccaggauuucugaggggucucccuugucacugaugcugaucagaucucuaaaggcccuaaagguccugcucuaacuucauaacugaagugagucuggcccauuucuagcccccugccugggcccccauggaucucuaagugguaucacaaaaccacccugccccauuuucugagccaugauucugauacauauagaaugugaacaucauggcaggcccaagcuuagcaaugcuguccaucuggggguggggagggccauguugacaccccacaccucccacuaagaucuaggagcacccagcugcuuuaagagcuagagggacauguuagggccugggggcaucucugccagucuuuccucugaggcagugggucagugggggaggaggguccuccccaaagccuccucuuccuccucugucccagucccagagcugcccuuuaggccuuccuuuugccucaggcccaucccuacuccucuccucacacagaggggaccucaccccagacgaggugguggcccuagugggccagggccugcaggagggggagcgagacuucggggucaaggcccgguccauccugugcugcaugcgccaccagcccagugaguaggaucaccgcccugcccagggccgcccgucucacccuggcccugaccuccuggccuagcaguggggcuguaccugaucuccccugugccccacagccccaugguguccccuugagcccacuggcaugaacuuggggcuucaugaaacaacuggagaccuccuaggcaggcucagaacuucuggagauguucuccccagggacaccaugccuuuauagccacccugcaggaagcucaacaccaaauaggaacguaacuauugaaaaaaaaaucuaggcuagauucugaucagcccauaguccucccucgagacccaguggaccaggccccauccugucugggccugaauaggucugauuuccaagauuucugaggggucucccuugucacugacgcagaucagaucucuagaguuugugccucauggugcacagccucacugugugauauugggcaggucacacugcugcucugguuaugcaccaagacaccucaguugugcacugucacaaggagaugaucacacuuacuucauuccucuacccucaggauuaguaagaaccaaagagcuaccugcacgcauuuccucuaauccucgcagcagccugcaaagcagaacuaccauugcuuagucccauuugacagaugaggaaacugagguggagugaggugcagccucuugcaaggcacaaacccuggauuuguauccggggacaucuaguuccaaagccuguguucauucauucuuucuuaaacacuucagaauaacuuuauugguuaagaguaccuaauacauuagcgagauacuucccaauacuagugugaguucuauuuuagaugacguguuaaacgguccuccguuuccucaucugcgcaugggaauaagccuaccaugaguguuguuggaaacaccaggugagagaaggguccgugucauuuacugagcucaggccccguccuuggugcuuuacacacauggccucggcaaagccuggccgugacccugugcaauagcuggcaggguucuuucugaaaagggcggaaacugaggccauaagcagagcaguuuuccgcaggccaugugguuaggacauagcaguuaggauuugaagacacugagcccuguuuugugcuggccucccaugggggguuugggugggacagcaggcagguaggcugggaggucucuccauggugcuggugacagagccugggugggcaucucgcccacagacuggucccccaaggugguggagcuguguaagaaguaccagcagcagaccgugguagccauugaccuggcuggagaugagaccaucccaggaagcagccucuugccuggacauguccaggccuaccagguggguccugugagaaggaauggagaggcuggcccugggugagcuugucucccacccauaguugggagaaaucacaagaaccagggaccauggugucuccugaguucugaagugugucuuuguugggucuuaaggcuuggaacuggaaucccccugggccaggcguggugguucaugccugugaucccagcacuuugggaggcgaggcaggaggauugcuugagccuaggaguuugagaccagccagggcaacauagugagauccaucucugcaaauacaaaaaaaaguagucaggcaugguggugcaugccuguagucccagcuacuugggaggcugaggugggagaauugcuugaguccaggaagucaaagcugcagugagcugugauaaugcgacugcacuccagccugggugacagagggagacccugucucaaaaaaaaaaaaaaggaagaaagaagaaagagaaaagaaagagaaagaaagagaggaaggaaggaaaaagaggaagggagggagggaggaaggaaggaaagaaggaaggaagggagagagaaagaaaagccuccacuugguguugggaguccugugcugagccugcuucuggcugugauuugcugugugaaccugggcaacacugugucuucucugggccucuguuucuucuauugggaugacugaguuggagccgacaucucaaaagucgcuuccagcgugaugaugaaugggccuccuguggagggugcagcaugguggagaagucagggcucuggagucccacugcccgggcucagagcuugguuccacacuuccugucugaccuuggucacauuacuugaaucuccugagcuucaguccuucaucauaaaaugggugggauaauaguugugaauauuagauaauguauacaagucacuucauauacuaccugacacaugguaacuggcuaaugagugacagcuaccacuuagauaaggacuuggaggguaaaagaccagguuuccccaugcuguugaagcaggcagcaugacuaggaugguucaaucuccacagcauggucaaggcagggccugccggggcccucccgcuagggcacccaugaccuggcucucccccuuccaggaggcugugaagagcggcauucaccguacuguccacgccggggaggugggcucggccgaaguaguaaaagaggugagggccugggcuggccauggggucccuccucacugccuccucccauacuuggcucuauucugcuucucuacaggcuguggacauacucaagacagagcggcugggacacggcuaccacacccuggaagaccaggcccuuuauaacaggcugcggcaggaaaacaugcacuucgagguaagcgggccagggaguggggaggaaccauccccggcugucccaacuuccuguauagagaggcagaaagcagggcgggucccaggaacucgagggguggccccaggcccagacauggggggaggaaucagcauggccuggggccaucccugccagccacacaccugcucuuccagaucugccccugguccagcuaccucacuggugccuggaagccggacacggagcaugcagucauucggugagcucuguuccccugggccuguucaauuuuguuccaggaaggccaaagagggaagaaacuuuagggauugggcaucagcccaugccgcgucuuuuagauaugaaaucucuucgacacccugggaagcaggcauugccguccucaucuuacaaaugaggaauccgaggcccagaugugcuguggcuugacugggauuacccagcugcuaaccagcagagcuggggcccuacagcucaucagcuggagcagaacgcuccauuacucugagggaagcuuccacacuuccaauucucccaacucugcccccugggcaucgcauaggaagcaggagucccucuggccagcauguucucucuuccugacaccuggcccuugggaccccugggcauuccccugagcgccaucuugaagcuuuccaccggagggucuguuccacccugccuggcucccauccuggagucuaaccagggucaaggcccuccuuccguccugucgccaagccacaggagcaguaucaggccuuaggaaaaagccgccuuccccaagacaaggacagcaagaacucagggugaccauggucaggccagcacuuauccaucugccaggcauaugagaaggggaggggcuucggcucugauguucugaugacaagggggucuuggggcuugccuuagggacacguggcaccuguggagguucuuggaggcauguggguauaccaugggcuggaaaaagauccaggagucaucugcacagauaugguggcugaaggagaagcaguggccccaggaggugguggagcaagaagggccuaggauagaacccagaaggacaaugguauuuaagggaccagcaaaagagacaaguaggaggaaagucaaaaguguggugucacagaaauccagggaaaagguuucaagaaacagucaacagugugaaauucugcuaugcaagucgauuauggucagagcuaggaaagauccauuagauacaacaagaugguggucagggaucgugccaagaacagcuuccaugguauguuggaguagccagcucccagugggacugaggaacaagcaggguagggugcagaggggaaggcuggagaggguggcagccggagggggauguugcuuucuuggcucccacccccacgcccccaccggcugccauucugccugguucccaugucuggccccucugcugccuuugcccagcucuggucuucaggaugggcuggauucuggacuuucugguuacauagacuugaacaagucaccuaaguucugaauuuauuucccccucugcacaaggaucagaucuuucagaucuguuugaggcugcugugaggaucaaaggcgggugaacgucaauguguucugacuauuuauguaagaguaaaaggaggcugauucucuccuccucccucuucugcaggcucaaaaaugaccaggcuaacuacucgcucaacacagaugacccgcucaucuucaaguccacccuggacacugauuaccagaugaccaaacgggacaugggcuuuacugaagaggaguuuaaaaggcuggugagugggugugagccauacuggccuugacucggguuugggaguaugguaucuacagguccaguccggggccuggaaucuuuggagagagggagugagucugccucaacaguccaagacaagcccaaccuagacacuuuccacagagaagacaucuuuguguugacguccugaccuaggaccagguuuuugauccuuugcuuggguugagugccuuuaaagaauccagugaaagcugucaacccucuccccagaaaggugugugcagcagcuaugaagucuugcacacucucuucagguuguucuuaaaucccaggcugaauaaguccauuccugcacgugucugcgaggugucucuggcccccuacaugccacccugucucucaaagguuucuccaacuuccuucucacagcccuuuuucauguaaugacaaauuaagaacacgaccucauggucucuacucuggcacuugcugccgugugacaguggacaaauccuucccccucuaagcguaucugcccauguugagugaagaggauggacuaucacuacauugcuaagagcugccuucuuuguucucugguuccauguugucugccauucuggccuuuccagaacaucaaugcggccaaaucuaguuuccucccagaagaugaaaagagggagcuucucgaccugcucuauaaagccuaugggaugccaccuucagccucugcagguagguuccugucugggcuucugggcaguugcccuguccuggccccaguguggcuuucugugggacuucuagcaagaugcccuuccauucuugggcagcgccaugaaugugugaugacucccugguuucugggcccuggcugggagcagcgucucauuagaucgguuuguuuucuauaaaaguucuugagaggcuguucuaaggggagacuuucugaagcccagucccaaaggucugggcaguuggggacaccuccauggcugcccaaagccaagggcagggagaggggcccaggccuguucugcuccuuucuuccuauguggucuuggcaaggcaucuucuugccaucauaggaaggaguuccuuucugguucugguguucuaugauuuuuacaacauccuggguacuacaaguugccugaucuuuuugcuucucugaaccaacgagcagggcagaaccucugaagacgccacuccuccaagccuucacccuguggagucaccccaacucuguggggcugagcaacauuuuuacauuuauuccuuccaagaagaccaugaucucaauagucaguuacugaugcuccugaacccuauguguccauuucugcacacacguauaccucggcauggccgcgucacuucucugauuaugugcccuggccagggaccagcgcccuugcacaugggcaugguugaaucugaaacccuccuucuguggcaacuuguacugaaaaucuggugcucaauaaagaagcccauggcugguggcaugcagca

SEQ ID NO: 61625 - RNA, 32240 nt, Homo sapiens; identical to SEQ ID NO: 61624

SEQ ID NO: 61626 - RNA, 32240 nt, Homo sapiens; identical to SEQ ID NO: 61624

SEQ ID NO: 61627 - RNA, 32240 nt, Homo sapiens; identical to SEQ ID NO: 61624

SEQ ID NO: 61628 - RNA, 28955 nt, Homo sapiens
gccucgugcccgcgccggucgguugguggcgccuuuguccuacggcgggcaggugggccgacgcggaggcggcagcggcgggccugaggcgaaggagcggccgggagcccgccgcgcugguagcggugagugccgggaagcgcuggccgucagccgaggcguggggcugacgggcaggccguuguggggggccuggccggacggggaggcugaggcgggaaggcccacucgacgcgcggccacggucucggcuccucuccgggugcgcgcggugcugcgcaugcccggugcggggcgcggccgccuccggcucccgucaggcccaggcccggccggccgaggcggccuacgguucucugugguggacgcaggucggcggcgucgcaucgcagccgccugucugugcacgaacggucggucacuaggaguccucaaggcuucucugguugagccgcacaucccgcacccccugucgaaacgguggagucgcucgcccgcggguccucagcgagucaguggcgcagucgggauucgaaccgggcccaaggcgucccguggcaccgggcguucuccaggcgugcagcgccgagcgguguacugagcgcugucccccgccaccgucucgcggccccugaccgcauucucggggugucuccuuguggugugacaccccacgcguuuuguaggcgcggaccucgggcccagagaacggggagaggaacuguucccggguuuaccacguagcucagcgccagcguccgauccggccggcuuuccaagcucccggcgcggggcacuguccgcuccccgccagcgggcgaggggcuucucuuaggacggcguugcacacguuucagucucgcguugcaccuuuauguccguggaccaucuguacugcuauuuaccaaauguuacauuuuuuaaaaaauucaaacugacucuuuuuuucuccuuaaauauauuuaaggcggcaacuucaaucacaaaccggguacuggaaagccaguuauuuuucuaaugcuuauaaaaaaaauaaauaucugucuguugaaauaaacagugcguccuuguuccuccugaaauuauucugcguuccacacuuugggaaacgcugcccgaggaguagcugauuaauugugguucuucuggcuugcacucugugcacagaauuuuuccugaggcaaagcagauucuaugaaugcccugggcucuucagggauaauguaacagcuuucuuguaaacuguucucuuuguugacuuaaaaguguuagucccagggaacugcaagaacuguguucacucaggugcacccggugugccugaauuuucuuacagcguugugaugucguagcccccuguuggcucauaaaaagauguuucuacaaaugcuggggaagcuuuugugaguuuugacaacucuuaauuuaauguuuucucuaugagucagucugggugugaaaacuaacuuugugucuacuuuuugcaaccaguaaagcccaugcuuugcauuguggauauuagaaaucacuuggcuauuuguuaacauccauuucuuccuuuauugugauuucuuugccuuucuuugagcucaucugucacucuucagauugccuuugaaaccucugacacuucucuuaaccuaaaacuuagaaacacugauuuuccuuguagaaugucccagcgaauccauauugcaaggcucauuggaaggaguuuuucuagauucaguuugcucaauguugcauaccugugaacaccacaaguuuaaaggaggcauugacagauuaacuuacuuguaaguuaauaguguguucauaagaucuguuuaugugaauguaagagcagauuuaauuuaaaucauugacaggaaagucccauaagucaguucaggcuuauucaaguuuucuuccccuccccucaaaggcuguguaaaaaaauauauauauauguauauguauauauauguguguguguguauguaucucucccccuguuaaaaacauguuucuuugggguuaccuugguaugaucacaauguagaauuuacguaaggcuaaggucauuuucuucacauuucugagaauuugauuuaagcccggcguccguuucagaacuucagcaaauggaaacucaucuaccagugcuugagagcuaagaaaaaacaacuuguuuguuuugguuuuguuuuuguuuuuucugagacagagcuucacucuuguugcccaggcuggagugcaguggugcgaucuuggcccccggguucaagcaauucuccugccucagucuccuaaguagcugggauuacaggcgugcgccaccacgcccggcuaauuuuguauauuuuuaguggagacgggguuucuccauguuggucaggcuagucucgaacucccaaccucaggugaucugcccgccucugccuccgaaagugcugggauuacaggcaugagccaccgcguccaaccagaauaaacaauuuuuggaaagacuuucguagucugaugagaaaagauuuauugguuugaaacuucauuuuaaauaaucauugcaagcaguccauguuuaugaccugcagauggcagugccuuuguguaauguuuuacuacugugaggauuaauaaaauuuaguugugcuuuuaagaauggaaaaucuucacaagaaauauauuaaacuuuuucuucccuucaguuuagguuguucucuuguuuuugacuccccacgugaagaaugaaacgucuauuccugaagucacuguuacucuuaguguaguaaugauaauaacauacagccaguagugcauaugguaaauacuaaaucauugcuccugcccgucaucuuaugagacugauaaacuaguuugaucuuuuuuauuuauagggaaaugaugacucaaagagguuagauuucuugccccagaucacauaauuaguagaacauauucaagacaucauuggagauaauugauuucagggucaagcaaaauugggaaauguugagauauagugguguccuuacuccaaaacuucucagaggcauuuaugugcuaaauaugugcaaugucaauaucugagagaggaaguuaucaugaugccuuucuccugcuauccucucaugaauauuuugaaguaauaguguuccucagaacugacuacucuuucuacuacgcuguauuuccucucuguaccuugugguuuauuaaugauuacugcauaucuuuaagacagcugcuuuuaaagcucaauaucagcuuuuuugugcaaaaauaguuguccugugaauagcacauauauuuguuuagaccauucugcuuaagcagaguuaaacugucaaaaaguuaaaagagcaaugacuaacagaauuauccuuuauguuacucucauuaaugagagucauuaaugacaggaucaggguaaagccacugucucaagcagcaguacauuagagaaauaugaaguauauugacagcuaaauauauaauaccagcaugcaugcugcuuuuuaaauggugguuuuguuaccaccagauaugaauauuuaugggaauggucaucuucauucuuuauccuuucacuuaaaaaaagagauaauaggucaucuggaccaauuuuauguuaaggaaauaguucaccucauaagaaucagaacuuuuccagacauccuauguaaagaccagacaacuuuaggcaaggaucagggcagcuuaaguugcauuagaaaacagagugucuugucuuauaccuuuagcucuguaaaguaucuuaaggcuggguacaguggcucacaccuguaaucccagcguuuggggaggcugaagugggaagaucccuuuugauagaaguuugagaccaaccugggcaacauggugagauccugucucuacaaaaaaaauuagccagggugguggugcaugcaccuguauuccuagcuacaugggagcccuuuauugaaaguaaaaucaugacuuuuucaauuuuuuucuccuucagugucaaaccaauggucuuugaagaauguuacuaaaaugggcaauauuuugaaugucuuacauuuaaauacucccucaccgcauuuggggauaauauacauaaaguuucguuaauuuggcuucauugagacucugugguaguucaguuuauagcccccaauagacccucuagccacuagauucuuccuuguccauagcaaaguguuuugcaaucuggaucuaguccaacucuugcuucauguuauuccucucucuuuuauuccuccuauccccguguucccaacaccaaacuuccuguaguuuuucuaauuuauuauguccuucacaccauuccuuuaccuuuguauguucugggaugacuuuucucuuucugguaaacucccacucauuccucaggacccaguuuaaauguuauuuuuaagccuucccugccuccucccaucccauucacccccacccccuccauacacacauucuuccuagucuccucucugcucuguuccuuucaccugccacacacauacacaaaauuaggacuccauuaucucugccauaaucccacuuuagauuguauuguaauuaucuguguacuugugccucuccuuuauuaaauaaacagugaacuccaggccaggcauggugacucaugccuauaaucccaacacuuugcggggcugaggugggaggaucacuugagcccagaaguucaagaccagccugggcaacauagggagacaguaucucaaaaaaaaaaaaauuagcugcgugugguggugcaugcgucuugucccagcuacucaggaggcugaggcaggaagaccgcuugaguucaggaguuugagacugcagugaguuaugaucgagccacugcacuccagccuggacaacagagcugagacccuuucuuuuuuaaaaaugaacuucuuuaaggcaaggacuuuagcugugucauuuccacauguguaaggccugggacaugugugacacauaguaggcauuugacauuaugaaucaaugaagcauucaauguauuaauuauaagcuauccuuuucaaauucaucacuuguucuccacuuguacaguuuaguugaaaauuugccaguuuuaaaucuguauuuuaaaauuuuaagcagcucagacucuuuuuuuguaguuuagauuagcucaaccuuugcaaauccaaaaucauuuuuucucagcugauuuuucuccuugagucaacauagcuaacacaggcagaauauccauuuugucagaaaggaaauauagauucagagaaaucaaaugacuggaguaaauuucccaaaguaaggaccacagcucagauuugcuauccccagccaaaugcccuuuccuuaaaagaauaagaaagguaggaaauuaaauguugauaauuuuugucggaagaguuguggugaauguuaauagcaaaccccagaaacacuguaguuugagguaauagaaacugaagucgucauugaauaaguagguucuacccuguugggugucucugggucauuuaagcaauggagugucuagcauagacuggaccuuuuccagguuccaucaguauuugaucagggaguccuagcaagaauauucuaaauggaaagcaugucuuuccacuccguuggaggcagcauagcauaauguuuaaguacuuugguguaagaaagaccugggucugagucucagcucugccuccugauaauuguguggccugucacuuaauuucucuaaacuucaaauuuucucauuugcaaaguagaaauuauagcaguauuuaauuccaagaguuguaaaaggauugaaugaaauaauacacauaauguucuuaguacacaggcucaggaacaaaauaagcauucuguaaguauaaacuauuguuucccccauuucuguucccaggaauaauauucuaauacaguuaaagauguaauaauuauuuuaguuggagaauaaaggagauaaucaaauauauagggaaaguauaguauucaaagugaacuuaaaggguugauuuagaaagagcaagcauaacauucucuuaucccugacuuguuacaauauaacucauuacaauaucccugauguugcaauauaucaucaaaguugucuucauaaauauaguuuagcgagaaguccugucauuuccccucccaauuugggggauuuaaugugugauauucucugucuugucaguaugguuuuccaacuggcauuaucuuuaucagcauguaaugccacuuuaguaauucuugauuguuaguugguuuucaacuaagccuuuuagagaguuuuaugucauuuguagucaguuauuaaaacaguauaggcuucuggguucuuugaacagcuaguggugguacugucacuaaguguuguaguucauguggcugucaaaagacaaaauuacagcacacuuaguuuagagaucuuaauugucuuuuauuugcaacucuagaauagggcaacaccucauucuauaaaauagaacaaguguuccaaugagcugagcagaggcguuuggcuuuauaaacagagaagggagcugaggaaagcagagacaaggagcaaaaagcggauuggucauuucagaguuacuuuucuugugaaggguaaagcagugcagacuuccuuuucaugcuggcuaaaacuggccuauuugugguuuuggccauuauuuaucuccugauuucgcagaacgucaggaaaagaucuuugucuuggcuugauagcguggaacuucaucaugaauuugguuuggucuuugggccuaguucaggagcucaguccaaagcaauggccuccuggaaauuuucuuugacaccgcucuuguuauuccuaguccucauuguuuucuguggcuguagcuuaugaacuauaaaaucugguuuuaaggugaaaagaguuguuuuaugauuguacaauuaaaaaauaaguagaacaaaguaguuuuugguacugugagugaaagaaacaugcauuuuuauuuauagcauuauccaaggaccauuuugugaccccugucuggcauauuagucuaaaauaaaauuguggauuagauauuguauauuuugggaguucuucaccccauccuuuuguaguuuauaaugguucugccauuuccagcauguuuucuagauuauuuuccaguucuuuuccuuguauguaaagcucuuuuucuugucuaaaaauucuuaacugagaagugcuuuuaacuguuuucagaccaccacuuggacacuauagauauucaggccaagauaaagcacuucauggugauuaugaugauuuugaauggcauucacauugcuaguauaauuaacaaaguauagaaguaucacccaaacugaaguggagaagacacugagagaugacuuuuggucuuaagggcaguuggccagaauaaaguauagcagaaggggaaagaaguaccguuucuucccuuuucuauucagaggagacauuagaccucuccuuggaagagauucccaaguugccacuucccucuuguugauuaauuuuucuccaaccagaguuccccaucugauguccagaaagaucuccaaauugucuuucuaccuuuuuuucccuucuuuacauuaacaccauuucuauuugcuugguguugauuauaucucucuauaaggauuuaggagaaaauaaucugauuauuuaauacaaaauaaaacuauagauuagauacugugucuuucuuugggaauucuucaccccauucuuuugugguuuaaaacaguucugucauuuccuacauguuuucuggauuauuuucugguuucuuccuuuuauguaaagccgugaguuggugcuuuagcauucucaauauuugcauuuucaaagaaaaucuuuuuuaaaugaacccucugcuuccaacugacagguuuucaaauucugugacaaaaaaaauaggaugagggaaguuuuuucuugacuucuugaaucuuugcucuccgugauuaguuccuuaaaguuauuuauucuucuguauuucugaacucauggauuucccaaaaguucuaugugcacauguguuaggauuuuuuggguguauggggauuggcaguaauguuggugguuguguuuuuacaacucucacugaaaacuccccagcccuacccuaaucugagcaauucuauuagauaggaaaaaaaaaaaaauccaggucucauuuucuccauacgucagcccagauggaaauuuaaggaacucuuaaauagagaugaauaaacagauacuugacauacuacacuaaaaguuuacuaaacccuaaaaugagacaauuaucugagaauucuuguuuuugcagaagaaacaucccaugcugucaaauauaaauacuuuggacuacccaaugaaaauagauacuacgaggcaaauuacaaucaaaaugguuuaaagauauaaucuugaauauucuuuaaucuuuuaaguaauuacaaaacgauuccaccagcuucaaaguaaaauauuuauguccuucauucuaacuagaacugguuuuguuccaaagauauaguauacaugaccaugugauuucuccaguucuguauguagaugcucacgaaacuggcuauaauuauacaguguaauauuccuuuucauauguagagagcaaauuauugguaauagaaaccuaccaauuaaaguaauacuauauguguuguacucuuaaccugaauguuugccaggucuagucaguguuuagaugugaguuuccuuuauucacaagaccauuuaauaauauaugaacuccugcugaaguuauguuauguauauuuuuuaucuuaauacacacccaguguauuccagagacaccuugaaaacuacuuaaaauacucaaagauauuauauuucucucugaaucauagccaaccuauauaauuagaaagugguacacaguaagugaacagacucaguaagucauaaaccugaacuaguauucuucacaauuacguauaauagaacuagauauucccuauaaggccugucauuauauaauuuguaauuuagaccauuauaaacuuuaagaguuguaaauugugaaaguacugcaugcaguagcaaagcuauggucagauauuacuggccaagucuuacauagaaaauauuuucagguuuuuuuuaaaauagaaggauuauaucuugugucugcuuaauugaaaagguaagaaucaauuuaagauauacuucacuauuuagcuuuauauuauuuucaguuuugucagaagccauuuuucuagacaaauuagagacuucugauuuaaaauggaauugaagauuaccuucauuugaucaggaacucaaaaguuggcaaaauagcagcauaaaaucucuaccagaccucuaaguuucuuguuauugcuguggucuuucaugugauaggaaucugguugggauuuuuaaaauacauaauuauuauuuuaaagcacucgaauuaugugaguacuuaauaccauuugaugucauuagauacacuauuaauuguuuaauacggaaaaaggggaacaaacucuacugcagcagaaagcacuuuuauuucuucauucaucugaaguaugaaauuuguaauguauuuauuuagcuuuaagucauaugaaaacugucagguauuauuuuggggcauagauuucuuaguacaugguauuuauuauucacuucaauuuuuguaaagcagguauucuugguuuuuagcaaagcaggcuuuagcuauacaaauuugcuuuucuuuaagcuuaugugauucuacuuuucucccauaucuaguucuauacgccagccuucucuaaugaaaacaacuuaggaggaguguuuuauuaccuaacccuacuauaccaaacgccaguccuuauucuugguuaucuguagauguuaacaggucauauucuuuguuuauuaaaaauaauaauaauaauuuucuuuccugcauguuauucuggaagauucuauccaguggaauucaacacaagacacacuaacaggaggcccugcuucaugggauauuggaaguuuuaagacaaugaaauccagcuauuacuucuuaguaacauaaaauagaauuauuugccuuugcucuuuuguuuuuuaaacucuccuuaucuucccccccacuuucuuccucacaaaaagaaucuuacagcugcuuucuaagaguuuagaaaacaaccuuuuccuccccuuggagggaaugugucaggucuaggucuuggcagcguguuaaagcauugacguaauuaguuuaagacaaauuacguguuaacuagaaaacgaagggacauuucuuaccaagccgugacaauguacuaccuuaacucaauaauaaaaauugcccaagugacagugugucucugcugaauggcuuuucuuacaccaucugguugucauuguaguuuuuguuguuguugcuuucauuugaaaugugcugaugaucuuguuuuuauuccguagcauugaacagauggguugauuauucuuuucagauauuaauaaggcagcggaaagaagaaauaugaauacggcuccaucaagacccagccccacacgaagguaaaguacccugaagccgugaguuaccuugggagaguugggcucuggggaguuaagcccagcuucguacaccaaaggucuuuucuuccccccaacaagugaaacgcucaagcaaacaauaagaacaugaacccugugugaagggccuugcugcuuuuuuuaaacauacaucaggagauacagaggaagcuuuguguuuucgguggcaaauccagcaaguucagcuugcaacaugaguugcaggcaauuggaagaggauaaaccucugucuguccccagcucacgugucauugggagccuccagagcagaaggagugccccagagucauugguguaugccaugcugcacugcagugggcagcagagauucgacucuucauuccaaauggcugccgguccagauguuaacccagguuuacggaaagugcugcuugagagauugccgcugugccugugcugcagauccccuguuugcuuacauacuuggguuaucuguuugaggggaaauaaaaagggcaaaacacuccagcucucgaaggucucccuuuuucuuagcuuucacggaaaucgaggguguuuucccaauguauucuuccuuccgguguauacaaaagagauaauccugguguguacccucaagauacacauuaaauuggucccuccucucaaagaagagcuuuauuaaugauaccauuuacaccaaaaauaaagauacuguauucaauuguucuggccccauaacagcacacaaguggaugcaguuuuguguagagggcagacagauaugauauauuucauacgaaugauauauuucauaucuggugucucuucaaggcccaaauggauuaauugauuuugccuugccucuaaguaaaaaagccaguuuuccccagaaacauaacuaaacuacguaccacaguaaacugcauuuccuacagugaacuggacagugcugcauacagugaauccucgucuguacugguagcuccacuggucaccuugugaacccaacuaacugagcauuacgcauaacauacagcuguccugcuuuuggacaaaaacaccuguauuuuguuaccugcuuauaugaaagaauguccacuguguguuucauguauauacuccuacuuggaugugaaguucuagcuaccgggaauagauuacgcaugcccacucugcaguuuaagcagacccuaagggcaaguaaugcugcugguuucauucaguuggagucuuuguccacucugccugugcagcagaguugaauccaauaccauagcuacagcuauauaccacagcugucguguggauucccuggccauucguugguuucacugcggaagugggcauguaaauugguauucugucuguucucucuaaagaaugcuugcagcuugcagguaaauacucuguugguugauuuguguguaugugugaguauccugaagaacauaaacaaauccugcagaacuucagcaguuccguauaaugucugcuuucauuagccuucaucuaaccaugccacagaucuugggcaguccuaucuguguugcuccuuauugucccagcacagaauggaauacagguggauaagaguugcaucuaaucuucagaaguacaggguucccauuggaaucuuuaguugccagguggcuugaaaggagauaagguguguauccaauuuccaaagagcgcuaacguguguguuuccuggugacuuaccaggaguguggaauuuguaacuauaaaagacacugacuccgcuaguaaaauccuaccccucucuguugucuccaugauacuuggugaucucuggauaaugucuguguguuucugcaggcaaaaacaacaacaacaaauaagccacauugcagaauagagaauagauccuguuucuguuauggauugagaaggguauuuuauaucauccuguuaaugauacuuaaccaaaugcuuuuaacauuucuaguugauuguagauauucaacaaacauugcaguguuggggaaugaccaacuucccugguugaaacccaguaauagccguugccagagcauuaaauuaaaaauauuaauuuaccccaaucuagaaauaguuuuaugcuuuuuuuaaauaauaguccccgcacaaacaaacauacagacagcacuggagagggccuuauaaaaugagcuucuagccaggcacaguggcccacaccugugaucccagcacuuugggaggacgaggugggcggaucacuugagcucaggaguuugagaccggccugggcaacauggcaaaaccccaucucuacaaaaaaauagccgggcgucauggcucuugccuguacucccagcuacuggggaggcauugaagcgggagaaucacuugagugcaggggguugaggcugcagugagccgugaucacaccacugcacuucagccugggcaacagagugagucccugucucaaaaaauaaaaugagcuccuuaccaacuauauaaauauacaggucaccuuuguaugccuuuuaaaauaucaccuuccucagaaaucaauuguaaaaugaggucauuuggugguguggauagggcagugacuuccugcuuuauuuacaaucaacaggagggacagcuaggcuaauucaaauuccauuaacaauccaucuuccccuuggugauauuucccuagcuggguuccucagcauguuauuuaacaugaugaaguuccauacagucauguuuauuugcuucagggaagaaugauggucaccauuaguaaccccaucuaaaaaccgaacuaagagucccaguuuuuuaccuuaaaaaaaaaaaaagacaaauuuaacauuguauucaaaaucccaguuuuuuaccuuaaaaaaaaagacagguuuaacauuguauucaaaauagcgagcacuaacauuuuaaucauuguccugaucauacuuuaucucuuaagauauaccaauagggcagacauaaauugcaaagaguaggugagacgggcaaguaauuaaucuggaaggggcaaaucauuuaacugagggugaacacuggguaccuccuuugggugcaugcuuccagucaaagccuugagauaacuccaaauguaucaauaguugacaacaacaaacugccuuuauuuggcagcccuaaucauuuuguaugcccccagccacagggggugcaucauucacaggggaaaaaaaacacuaccuauggcaaauauuuccuaaaguuauaccucuacauuuuuagcgcuuucuacguuuaauaagaauauugguauaagcauacuggcaagaccuuuauaacaccuuguuuugcuggacuuaacguagguaucuuugggaguuuuacaggauuaucaccucuucagauguuucaguaaaccacaguucugcuggcuuugcucucuauucaauaauaugacucccugaugacuccagcugucaguguguaauucugacaauauuggcccagccaagcacagaacucugcaugaggaaucucugcucuggaucacauuucagccugaauucuuaucaucuaacucuugagggccacuucauugaacuccugugaguaccuugcauaguuaccaugcaaguugucaagcaucgauacuaagcauuaguccuucuucaaagacaggaucaugauuccaguugugccuuagauaucucaguuaccaucuucagcucaacaccuugacaguccagaucuuguagcauaucuuuaugcagauguggccucuagguacaagaaguaagacuguacuucugaaugacuuaaagaagaacaaauagaauuaacuugucugcauccaacgcucugcagaggauuuuuccccauauauuugugaaagauguuaaaccugguaucucuuuggugaaagucauuggguaucggcucaucagaaauaaccuggcuguagacaaguuucuuauaugaccugaaaugcuuucugcuuauccacagggcccuaaugcuuuugauuauugcuugcucccugguugugagacagcccuugcucuaggugggccacaaagaaauuccagguugugauuaccucugcaguaacacuugaagaagucaucaguucucagcagcugccaccucuaccaauaagaaaguucuguuugugcuggagaagguugucagugcuuccuaaggaaaagcauggacauguguaaaauuugggucugugaggugugauaucucauugcacguccauauccuaccuccaccuaauggcaauauucuggacaagucuguugucuccauuucuaacaguagcaugaagcccuccugguggaggaucaacaucauacagcagccagccauuuagaugaugauauuuguggacaguauaucugugacagaaguuugaagagcuaaugaaggauuuuucagggucagaaagaggcuggcccucccaaggaagacauuccggugaacagaaaggaagaaaggagaugcugaccuuugcagaaaagaaagaaaaagacaggggucuuccucccugaccgucuguagaaccaaagccaaagaaaaccaucuuggaugugaaguuucagucucuugccaaagagaaauucaaaguccaucacaguuuuccaagaugaucaucuaucaguucuuacucuguaggcugucacaugccuggugcucugcacaccccuuuaguccucaggaagagacacauucuaccagaagcucaucacuugccaccagagccauuguuuuccccuucaccccuuucgcccuuacgucucaaauguuucccagcagugugacuauauuccccucaaggcaaagaguauuugccuuuuucccccuccugaauagaugaggaauuuacagcagaauuuuaguuguguuugccaccugccuucaguuuguggacuccagugcugaaauuuaaccacuguucaguuucuuuuuauccucuagugauguaguaccugaggguaugcugcauuugguuccuuuaguaaaacaccucuggugcugugggaugauauuguuaaccuuauuaugcuccagaaaccugauucuaacccacuuaucaucugagguccagcgucucccacaggaagcuuugucuucuugcacuuugauucgugcauacuacugcccuuuuguuagcuguagucuuguuuugaaaaauauguuggggccagcagcaggagcccuuuuguucugaggaguucuuuguuuggguccuaaagcaacccuaaaggguuuuuuguuuuguuuucgucuccagaagaacagcagucuaccauaguguuuaucuuuuggagaaaggaaaaaaggcuuugccuuuccuuuugagaaaauuauuaucuucuuugucccuacuuccaccaugccuuugguucuuuuuccuuuugugaauaucaccucuucuacauuuuuacccugaaggcacuugagagggaauuaguaguuuuguugcacauggacuucaaauuauuugagggaaaggguggggcuugcccucucagacuggaagauugaacccagacuuugcgaaucuagaguuuuagucaacuugcagggauggacuuugacagguaaguaagguuuuucaguggauucaaaagaaugaggaccaaucauaacauaacacuuauaauacuccgaaggugguaaauaacaugcuaugacaugccccaccccgauuuccaccagcccaaggcuuuguguguggucuguggucugucaggaucaugauaucucagcccugauugccaagaacacuugaaauuggauuccaccucuaaugacuacuucuaacugcuccccaaggcagguuuaucugccgaucauuaauccaaaaauacuuugcaguuguccuuucucuuuggaucuugaguguuugcccacauuacaugcuacaucagauguuacauguuaggaagauuauaugauguaauaaggaagguugaaguaagaaucuugguuagucuuuacuuuauucuaauaagaaaaauaaugcuuagcuauucucauuuaaagucccuggucuaugauauguuugcucucacaagucaggaaugcuggugaaccuuagaauauauaacaaauauuuuucauggaagcaaaauuggcauuuaaauuguuuuugcugugcccguguagcugaggugagguuuuccacaagcugaugacaucaugaugaauaccuaacguguguaaccaugguagacgacaaaaguaugagcaaaacaugcugccugcucuugagaggcuuacaguuuaguagaauaauucaauucauuaaacauuuacugaacuccuaugguguauccuagagcuacaaagccuucaagagaacuucuuauuugguagggaagccacguaaacaauuacagaacagugugguaagugcgguuauagaaguuuguacuggagcaagauucauucaacauacauauagagcaucugucguauaacagacauuguucuacauaguggguuuguagugcagaaucaaagugacauaguucuuguccuuguggcacuuguagucuaguagggcagacagacauuaaguaaauauguaaugucaauuugugauaaaugacaaaagugaaaacagugcuaugagagaauuuuaggggcagaaaguaaacuuugauugaaucuaacaaucagggaguaggggauauuuauaugcugagaccuggaagaggaguauagaucucuuccugcuacucacguaaagggaucaggaaagacguuggcuaggcagagcugaaaggccgguguggcaaagaguggugaacuagggagagggugugacaggguuagagaagacaggagccaagauuauacaggaccuucauggcauugguagagguuguagauugaauucuaaauacugugggagccuggcacaguggcacacaucuguaguuccagcuacuugguaggcugaggcaggaggaucacuugagcccaggaguucaaggcuguaguguuccgugaucccaccugugaauagccacugcacuccagccugggcagcauaggugagaucucaucccuauaaaaauaaauacauacugugggaaaccagggaagggcuuuacauacguaacagaucacuguagagugaucuuucuggagaaagauuuggaaagaggcaaaaacagaaaugaggagacugcuuuagaaggcucuugcugugguuugagggugagaugauuaugcgcuggccuucaguuuugccaaagaagguaaaggaaagugggcagaacugagaaagaauggagaaaauuuggaaaugugguuggaagggaggaugaggcuuuaagggaaagaugacauccaguuucguggcuugaguaacugaguaguuggaugugccauuuacugagaugggaaggacuggaggaggagcaugguuguuggggaagaucaagaguucagggcagguuuuacggagaagguaauccuuaaagcgggucagacauaagacauuguuguaaaaggguaaaugccagaucaagaugaguaauacagauagaaagugcccugagcugagcagaagagaucagcaguuaggaaggguagggaagguuucuuggaagacaugggacacgaacuugccuguguggauuggaugguacuuggauuagugcaggaaaaauauuccaaguauagaaaucaaauaaauaaaacuauugagauagauuauaucuugugaguuauaagaauuaaguagaacugaggagguugaauuagaaaugagagggagauaauagcugucagauuuauuaggcuuucuaacauagaaguuggcauuuuaggauaguuaguguauuuauguguugaaugaauugaaagcaaguagguugauuuuuaauuuuguguuuuggaaaccuguuggugucagaauagaaauaagggcuuggauuggacuuacaaauccaaugggaauggaaagaaaaagugaacgggacacaagugacuuuauugggaugggggaagaaaaagcauaguuaauauucaagaacuuaaaacuugauaaguggaaagaugauuuugucaaaaguggaaaaguggggaaugggacugaugggguugggguaagaaguuuuuaauuuuaaauauguugaagaggaguuuccaguggguugaaacgucucaugaagaacauugagucagagcagacaaagcauaucugugacuucacuguucagguuguuuuuuuguuuuguuuuguucucuuuuuuuuuuuuuuaaaccaucuugagcaaaauggaaucagcuucuacguaaacccucagauugagagauaccaauacucaauagcccugacaaaacagagaaacagauuguucuugguccuuuacuguauguaucuuauaguaauuuuuuccccuuaauuuuauuauccugccaagauacuucaagugcauuuuccguacuuuaaggacaguuccuuugaucacuuuuauaagauugugccauucgcucuuuuuuucuucaugagucuugccuccuuacucugucacuccaacuuuuuaccccuuguaaagucucuuucaagcaagucugguggaaagacacuuucacuuugaaagccugaugaauacuguuauccagucaaaaccuucaguuuuuggucaugcauucuuuugauguccuaaucuuuugagauuguggaaccucuagacuauuugcugaccagauggaugacuggccuuaaauguugagucauguucuguuuggcugcccuguuuuagagaagaaugcuuggaggguggggguuuucucauaugaagagcugauggguuggcuacuuucaauuucuuugucuuagcauuuucuugcuaccucccacagggauccauauggcuuuggagacagucgagauucaaggcgugaucgauccccaauucgaggaaguccaaggagagagcccagggauggcagaaauggccgggaugcccgggacagcagagacauucgagacccccgagacuugcgggaccacagacauaguagagauuugcgggaucacagagacagcaggagugugcgcgacguucgggacgugagggaucuuagagacuuucgugaucuaagagacucuagggauuuucgagaucagcgagaccccauguacgacagauacagagacaugagagacucccgagauccuauguacagguacauacguaguuacucugcuuguuuuuuccugaguucuuuuuauguauguucugcuaaacuaauugaaagcucuguaagagcagucauuuuaucagccuuuuauuucuggugacugucaagugauagaugugcugcugcucaauaaauuuugcugaauguaugaaugauuuucaacauuuuuaacagaaaauaacaguguuggaaagguauggagaaauugaaacucugagaaauuguagguaggaaugcaaauugguauagccacuauggaaaacaguuuggcaguuccuuaaaaaguuaaacauagaauuaccauaugaucuaucaguuccgcuccugaguauacacucaaaacaauugaaaagagggacucaguuguacaugaauaugcauagcaguacuauucacaauaaccaaaagguaaaaacacuccagaugucuaucagcagauuaauggauuuuuuuuuuuuuucuuugagacaaggugucauucuguuucccaggcuggagugcaguggcaugaucacagcucacugcagccuugaccucccaggcuuaaguacuucucccaccucagccucucaaguaacugggacuacaggcauaugccgccacaccuggcuaauuuuuuuguauagacguggagucucacuguguugcccaggcuggucuugaacuccugagcucaagguauccucccgccuuggcuucccaaagugcugagauuacagguguaagccacuguguggauuuguuuuuaagugguguauucauauaaugugguaucauucagccauaaaaugaaaugaaauucugaucugugguacagcaugaaggacguugaaaacauuaugcuaagugaaauaagccagacauaagacaaauauuguaugauuucacuuuaugugaaauaucaagaauacgcaaauuuauagagacagaaaauagauuaaagauuaccaguggcuggggagaggggaguuauuucacgaauacagaauuuauguuugaggugaugaaaaauuuuagauaauggugaugguugcacagcauugugaauauaaugccacugaauuguauacuuaaaaauuguuaggccaggcgcaguggcucacgccuguaaucccagcacuuugggaggccgaggugggcggauuggauugccugagcucaagaguucaagaccaaccuaggcaacauggcaaaacuccaucucuacuaaaaaaaaaauaauaauaauaauaaaaauuguuaaaauggcaaauuauuguuauaugcguuuagauauaauuuuaaaaagcacaagggagggacauguaauguuuccucaaaacuaguaucaauaauuccugccaguuauuuugcauuuaauauaugccaaagaccaugcuaagugcuuucuguacaucaucucagugagacagguuaacucuaucacagccacagagcugauaaugcagugagucccagauauaaaccucauuugucuaaucccagagaauucucuaggugacuuuuucaggauaagacacaguuuuaucuuuaugaaaauuuccuuaacuuuucaggagagaaggcucuuaugaccgauaccuacgaauggaugacuauugcaggagaaaggaugacucuuauuuugaccguuacagagauagcuuugauggacggggcccuccaggcccagaaagucagucucgugcaaaagguaaaguagcugaaacagucuauuccuauuauugauagaacacuuuacaaaagagagaggaaacuaauaaccaguacccccaucugaaaaagggcuagugccuuggccaagcaguguauaaaaagaagaaauauaaguagcuuauuaguggguaaagagcauuuggcuugaaaaugauuuuuaagaugcaaauuaguaccaucaucugguuuagucauccaacaagaagaaauaaauaugaaauuccagcaauaagaaaugaacaaaaugcuggucacuguggccaccaccuguaauccuagcacuuuggaaggccaaggccggcagaucacuugagcccaggaguucaagaccagcuuaagcaacaugauaaaaccccaucucuacaaaaaaaaauacaaaaauugucuuggugcaguggugcacaccuguagucccagcuacucggggggcugaggcaggaggaucgcuggagccuaggauguugaggucucagcaagccaugauugugccacugcacuccagccugggugacagagugagacccugucucaaaaaaaaaaaagagaaaaaugaacaaaagauuggagcugaagacauuaagugcuuguuuuuugccuacugaccaaguaacuaugacugacuaucugcauuaucuaggcaaaauagguuuuugguuuuuuuuauaacuuuuaccuaacagcaucucuuuuuuagaugaaggcaaacaugucuuuuuaaagccugguuuuucucaauacaucuuuaaagguucuuaaauuauuucauaccuggccaaguugaaaucuuuaagaaucucauuuuuaauuuuaauuuuuuaauuuuaaacuuuauacuugauuuuuuucuuuuaaaaaaagaacuuuuaaauuuuuaauuuuaaacuuuacuacuugauuuuuuccccaaaaaaaaagcaaaaaugcagauuagaauaauaauaauauucuuaucugucaaguuggcaagacuuaaaaagaaugacaguacucacuguugacuaagguguggagaaauaggcacuagaugaucuaccucuguggagguauaaauuaguaucagccuucucagggagcagcuuggcaguaaguaucagaugcagcauuaaaauggccacguccuuuaauccagcauuacauuuugguuaauuuauaauaguaaaaaauauuaauacuggcuguuuuuaggagauagaccagaggauugauucagaguauuaugaccuuugccuacaaguagcucaggauuuaaaaugaggguccaguccuuauuucaguuuacccuggugguguuuugcagagcguuugaaacgugaggaacggcguagagaagagcuuuaucgucaauauuuugaggaaauccagagacgcuuugaugccgaaaggcccguugauuguucugugauuguggucaacaaacagacaaaguaagaacccuuagauauuucuccccaguaaggagaagagucagagaaauucaggcuccuguuuagcaccucuauccacugaaucugagcuguguauucuugcauugcugugcgcuguuagccaggguucuuucaguuauaggugacagaaaacucaauucaaauugaggccaaaagggacauuuuucauuuaagcaaaaauuaacugggaaauugaggcacagccacauccaggaucaaaccaugucaucaaaauuggucucuguguuagucucuaagcacuguuuuccucagauuugccuuuguucucaggcagguuuugugcuugaagaggcagaauggcacuggcccugaacgugugucuucuuagcuuagcaagccaaguggaaagagaacuucucuuucccaguguuuccaccugaaguucugcaguucuuuuuagauugaccugacucacuuucccaucccugagccugucacuuuggcaggggugcuggguguucugauuggccagggcuaagucauguucccaucccaagagcuagaggugggauuagcccuguggaaccaugcagacugagaguggaagaggguguagccgcuggucaagcagaguaguauauacucccuucaugggacaacccaaaugcccaauacuuugggagacacgccucugcauuugucagccaagaaccaagucuuugugaaguaccauggccuugcagaacuguuacaugaccauguuaccaagcuagggcuuauagcauuguuucacugcaucccuguuuuacauuuucuccuugaagaggcagagcagagaagcagaaaggaguauagcagcuugcaggcuuggcaguagcuauguucccuuucccuaggugguacuaaguaaauaacuucauguauuuucuagcaguuugggguuaaagagcuaauuucaaggcagugacuagggaaauagguguugagacaccaagcaguaggcagaguucacaggcucuuggcugucuuguucagugauagaugcugcuuuuaacucuagagagcuuuuuuuggacacaugauaauagcuguuauuuucugagcaccuacuuuauguacuaccccauacuaggugccuuacauaaauuauuuuuaaucuucacaguaaucauaaaaaaugagcauucagcaaaucuuuuauacguaugguggauggcggguauuggggcuguauagccucauuccacugguggagcuuacacccaauggggcaggugacaaaagcauacaggugaugaguccuaugagaagagaaugucagagaucuaauuuagauuggagggaaggucaaaaaaaugacguaugaacugagccauguuacuccuguuuuauuaguaaagaaacugauguuuguaagagguaaauggacuugcuuaagcuucacaacuuugcaaauaaauuuuaagggcugggauccaaacccauguuucuagcguuaaacccaugaucuucccacuguguugugcagccuacccaaaaagagauaagugccacaagucuuagggagcaggauggucuuaaggaaggaccacagggcuagagaaucaagagaaggaccuggguaucauacugugcuacuggcaacuucugacgugaucucaagcaagucacaaccguucugagccaggguagagagagaguauuggucuagauacuuggauccugaauacgguacugggguagacuaagguuugaguuaucaguaggaacacacacaacuggcuugagacacacgaugcagauuuggaguuggucgcucaccuggaucuuauuuauuuuuacagagacuaugcugagucuguggggcggaaggugcgagaccugggcaugguaguggacuugaucuuccuuaacacagaagugucacugucacaagccuuggaggauguuagcaggggagguucuccuuuugcuauugucaucacccagcaacaccagauucaccgcuccugcacagucaacaucauguuuggaaccccgcaagguacagagucagaauaccggagguagucacuaguccauuauuaguccuuuaugccuuacucagaagaagcagguuuugggcaaaugacucuuauaucucaguucauauaugguagggccccucucuuaaguaccauggaagagucuugcauagucacuuacuuaucugauaguuucuuaguggaucucuguuacacuauacuuagccacuagguauauacaguggugugcuggcacacguguaacaacaaguuccaguguggggggagggcguuuauagcauuugcugaucuccaugguguaaauacucccaccauguuucaguucaagccaccaaccugaagucacugaagggagaguuggaaagaaauguacacaguuggcucuugccacugagaucuggcuccagcacaccucugccauguacuccacugaaugugacaaaauccuugcuucugccagcuuucuaauggaggacagagaauauaacaggcauuuaggguccuuuuuguaagugugcuggagaaguaaccagaggggcuaagaggccgugacccuguagaggcccaggcccaguucucgaaguccuccucagaaguagcuuuuaaugcauugagcccagaggauuaagaguccgccagcugauacccugcuccucacucuuacagcacagacuuaacccuuuucccacuauacgcaggaucucucuuugccucacccauuacccucauaaccauacaauuacauaaggaucuccagugggucauuugucugaggaauaguccucaagaugugugaggacaaaaguucuaaggaguccucucacuacccaguaaaccauguugcccaugggugaggagaggagguuauuuagggucacaguuugaucuuaaucuaugacuuuugaacugaugaauuaaaaaaugguaggccagcucuguccugaggagcacaguggagagcccugcuuuccagaggggccuguuggccuccugcugcuggucuagaggcuguugggccugccucccauggcuguuccccacguggucuguuugaaucugugggaggaugucauguuucuuugguuuuuacuacaagucugugaucuaggaauucccccaaagaaccagcuguauauaaaggugcaucuccucaccaaaaguguucguucacuucccuuccuggccuucaucucuccccccacaccaccccacucucaaucucaaggcuuuuugucaccaaaaugauuuucuugcugguaugagguuaggaaagacuugacagagugcagcaggugggcacuuaaauaugucauggaagaaaauaacucaugucauuuccuccuacagagcaucgcaacaugccccaagcagaugccauggugcugguggccagaaauuaugagcguuacaagaaugagugccgggagaaggaacgugaggagauugccagacaggcagccaagauggccgaugaagccauccugcaggaaagagagagaggaggcccugaggagggagugcgugggggccacccuccagccauccagagccucaucaaccugcuggcagacaacagguaccucacugcugaagagacugacaagaucaucaacuaccugcgagagcggaaggagcggcugaugaggagcagcaccgacucucugccuggugagcuacguggcagggccgaggugaaguucugacucugcauuucucuaauccccaggcucuguugggagggugucaggcccagggcucuuuggaguggguaagggaacuaaguccaucccuuggguucucccgugggccacccaugcugauauaauguuaauaauaacuuuauauuuggguacugaaugcugaucccuauaguuaaugugguggauugacuaguauugcuggcuccgugguagccaggauggaugcccuuuuguuuuuuagcaguucucuaggggaacuagccuauuguuuucuguaaacagcacauaucaugaagcggccucuuugggaaauugauguuaucgucuguguacuguaugauugaugugacucagugauuguuguucuuccuuuggcugcuaggccuccugcccuugggggguacuuugaaccagauaccucccucuucugucuuccaggcccgauuucccgccaaccacucggggcgaccucgggugccucgcugaagacacagccaagcucccaaccgcuccagagcggccaagugcuccccucugcuacacccacuccaucugcaccccccaccucccagcaagagcuucaggccaaaauccucagccucuucaauaguggcacagugacggccaauagcagcucugcaucccccucgguugcugccggaaacaccccaaaccagaauuuuuccacagcagcaaacagccagccucaacaaagaucacaggcuucuggcaaucagccuccaagcauuuugggacagggaggaucugcucagaacaugggccccagaccuggggcuccuucccaagggcuuuuuggccagccuuccagucgccuggcaccugcuagcaacaugacuagccagaggccugugucuuccacagguaucaacuuugacaauccaaguguacagaaggcucuggauacccugauccagaguggcccugcucucucccaccugguuagccagaccacagcacagauggggcagccacaggcccccaugggaucuuaccagaggcauuacugaagcuaaaucuuucaacucuccccaguccccucauccccuggccuccucccacuuacuuguucuaaauagagcuguuuggaggauguucucugcgcucccaggccggcaucgagugucaucaauuucuaccaccugcucucucuucugcccaaggcuguguugcuuauuccuuacaaaguuuauacugcauuuggggcuguaucuuuuuuuguuuuuuguuuuguagaaaauaaauaucuccgggggcaguacaggugucugggcuuguauuugaugggguuucuccggucccuguuucuacuggauuuggagccaggcccagcuagccaaguuuggaauggcauuugucaugucaguagccaccaccuuuguucauugugaaccuaccaaggcuuuccagcuucauacacauugaccagagcucaagcuccugccugcaacuccugccuagaguugaagaaaagcaaacuggccuuggcaggcacagugucaucauacccucaccccauauguuuggggucugcuugaggauucauaaaucagccacucuggauuguugaggaauggccauggcagccacagaaaaaagaauuuuucucucugagccaagguuguuuuuuguuuuuuucucuuuucuuuuuuguuuucauuucauuggaagaucuccaauggacugaacagcuccagucagcagcaguuaccacaaacugugaaucugggccccaccacucuucccuguuaaccaguucugucagcaucccccucuccagcagcacuuccaugaaguugguucugagacucuggccgugaacacccguuucuucagugauuuguuuugggcuuuuggcucaaaaccccaggcucuuguuuuugucuagacucuuauucuguuuccugagcagcaggagguagggaccacuuugaugucagacuucugguagcuggacauguucucgagauggguggcuguucgcgacuuuuguaccagagugaaauuguuagaaggaggguuucuggcugugguucuaaauggagccccaggaagcugcccucuccccaggguuugugcucaguagagcccuguggaucacagucuugagguccucuagcaggggugagggagagcagcgacuucagcugagucccugccagugguuaagcaaacaaugguuucaaaauucaagguccccaaauggcagcauuuuauguucugaccuguuuguguuauauagugguuuuuuuuuuccucuuuggaacucuuguguuguuaauaaaaugaaaugauuacuuuuuaauuaaaaugaaaaaaguaa

SEQ ID NO: 61629 - RNA, 31590 nt, Homo sapiens
gguuugaaaggaaggcagagagggcacugggaggaggcagugggagggcggagggcgggggccuucggggugggcgcccaggguagggcagguggccgcggcguggaggcagggagaaugcgacucuccaaaacccucgucgacauggacauggccgacuacagugcugcacuggacccagccuacaccacccuggaauuugagaaugugcagguguugacgaugggcaaugguaggugggggcagaugugcccaggugugccagugggggcaggugugccuggguccaggagcagaucuuuggcacucaacuuuggggugggaggagaaugauacaaaaugguagguugguccuacaggccagcacagguguugccaagugaagcccaugugcccaggcacagugaucacaggcauucugggugaagggaggccugcaagggccaauuuccagcaaaagucgaucccggcuauuccucccaggcccuuccaguccucacugccucacaguggcucugcuuggcgcuuggcacagugacgugauggugagcucccccuuggugcccagcuccagcgauucagcccagcacggccccuucgugaaccccuugggccuagguucagagagacggcaagggauguuguaucccuggagauggugguuggagacauaaccgcauuucucggugucuuugggacuuuccuagggaaaugaaauuggcacuuagggaaaauggagcucucagggaaguuuugcuaacuacgaagccaacucagcacuguguguguugugugugcguucgugugugauagugaguuuccauguagguuguauggguggggugaugccuucaggaacccauuugcauauguguguucauuugucucugugugugaguucugggucuauuuuccuuuguauucauugagugggucuguguuugugucuuaggaguugcccguguugaucuugcuuauguauguaaguguguauguguguguacuugugucuguggauguuuguacaugugugcugugugugcgggucauagagcacaugcguuugugcaugcggaccuguuggagugcccuguucuuccugcaucuuuauccuguaugggcguuuugucgugugcccauauuuguaccugcuguguauauaugcaguucccugugcugcgggcgggggucagcggucucuggugugcacgacugcacagacccaaaugcaggacucuguuguugccacucaccaagugagauucauaucagcaacauguccguuugucucugagcagauuuuguugccgcugcgucucgccagauugaggcauccccuccgacaucacuggagcauaucuggagggguggacaguucuccacagggagguaggggaaaagaggaggcccggaaaccccuccuggagggaagagccccaucggucccaggccagccucagaggagagggggcaggcagcuggcugaggucagccugccacccugcuuccuucugugucuuggagccacucagccaguaugaggcugcagcuccagcugaggucuggaaucuuguggucagcucagcuagggugaggaggcagcugcugggcacugcuuguugucagcucagcaggugcucaccugccccugccguccagucacgugugaccuugggcaugucaccuccccuauccuggcuucuguaucuucuacaaaacaggcuucauucccccaggccugcuggcuggacggcuuuuaggccugucugaggaccacgccaggagcgcaaggcaaaaacacaccagagauagcaaacaagcugcugcugcacuagguggaguguuguguggccccacgaggaccacugcccugcccugggcugcuccccgcccccaucacuuuuuccaagcccaggaacugugugcuccugaggcagaggccaagccccugaacugggagucccaaagacaagaccaccuccagcucuggaaccagaaagaucugggcucaaauccggcauagauccuuccaaccugugugaauguggcaaggcaauuuccucucugagccucaguuuccucaccuauaaaaugggaauaaauaauagugucugucucccagggcuggccagaggauaaauaagaugaggugccugggugcuuagcccugguaaagggccuggccccaccaugggucaucucaagggcucugagcaucuguaagcaggguccccacauuccucacuggaguuugaaguggucugaauugggguuaugugaaguuguccucugaaguguuuugaguacauccugggcuggugucugaaaggcuccaaggauauuucucccccguccucuccccaccccaauggagcagcagcccuggguggcuccuuguucauuagaggcccagcagacaccucaacauguguggcacuggcuggaguagcccagcaagccuggaccauaaacccauggcucugcuucacgggaagcagugcgaugacaccaggaagccacuuuuccucucuaagccucaguguccucaucuguggaauagaggugcucggcugaccucagaggggagaugauagagcugacagcccccagcccauccugccucagaggugggagcuacuuccccagccuccugcugaauggccaggagcugugggggucagcucuccccgggggucgggggaggagaggccgagggagaaagggcacccacguggcuuaacaauuauccccaucuccaggaauaauucaccaaguggagggggcugcacuccuggggacaccugggagucugcgauggcagaaaugagaugcggcagugucugcuugugcaaggagccuggaaguccucugcuccgagaguuuuccuauguggaaaaguuuuuauuucaugaacacugauauagugcuuacuaugugccaagcacuucacauacacauaugagaauucaccgaauccccauaacgaaccuaggggaauaucacguuccccauuuuacaagugaggaaacaaaagcauagagaaguaaacgaacacagucaaugucacacggcuaaaaagugggcaagcuggaauugaacccugggcagaaggacuucagaggcugugcuguuaccuacagugcauggcccucucugggucuuaacuggaugccccugaggaauccaagguuggauucaggauuucuaugaauacacgugugugugugugugucuguguauguguguauguuugugcaugugagcauguguguguggacuguguguauguguauguauauguguggacuguaugugugcacacauuuguauauguguguguugauguguuuguauguaugcauguguguggacuaugugcaagugugugcaauguauguggacugugugcauguguggacuguguguaugugugugcauguguguggagcgugugugugcuuauguguggacucuguguucauguguguguacuguauguguacacauguguguauauaugugugugugugcgugugucugugugguguguggacuguguggugugugugaacuguggugugugugugcgugacuguguggugugugugcgcgugugugugacugcuuggugugugugaacugugguguguguggugugugugugcuuguguguggugugugugcgugugugggaacugugugguguguguggacugugguguguaaggugugugugugcuuguguguggugugugcguguguguggacuguguggugcgugugugugcuuguguguggacuguguggugcguguguguggacuguguggugcgugugugugcuugugcguagcgugugugcguguguguggacuguguggcacacacgcuugcauuuucccgggggcugacccauugcauuugucaucuucuucaaaggggucuaucuuugcugaaagauuugcugacaaauaaaggggguucagcugcugcuauuuuuuuaaauuuggaaacaaauuuuuuaaauuuuuuaaauuuuuuaaauuuggaaacagaccagucaaacugcugccuuuuaugguuagagaaaaugaggcccagaagaaauugaagcagggaaagcgaaguugcccaaguuuacaggcgaguuaguggcagcaucagcaguagugcccaggacuccuggcacccagcccaagauccucuuuccaccugccucuacggccccccucacauuuguguagaugcaguagcuuuugccugugggaugggagggaugggagauguguccagacccuccuaggaggccacaugagugugacuguucucggcccaagucuuucucguuccucagagaauuugcggggccccugggcacacaagcugagauccacccagcccuggucccuuggcaagaacugagggacaggaccugguucuggggaaaaugcaggggaauguuucucccuuccacagcccccuugcgaguuaggaggccggcucccaccccagaagguggccagguuuucaugccuuccuagagaaagcuggggcucguggccuccaccacaggaagacgcagacccucagaaacaagucugugaagucacaaccagccccaguuuacagaugugaaacugaagcuccaaaaagucaggaggucacugaguggggaggugauggagugggaacagcccccagaucuggcugaggccgaagcccuggagagauccccgcaaggcucccuuagaugccugacauucuguucuuccugaagccucacucccuucucuccuggcgcagacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcaggugaggagccucaauuucuucagcugggaaaugggcacacuugggcucauggccccaaggucugucuucucccugaguggguaggucccagagacagcugcccuucagggccuucaaggcucuucugguuuuguaaaagacuuugugaauccaagaagagcaucuauucuaggaaccacauuuacugaucaucaagcuacuggcugccguuuauugagcucuuaucauaugccaggcacaauacuaagucuuuguguguauuuacccauccccuugagcccauuguuguuuuucccauuccauggggccucuccugaagccucaguagaugagcccgucuuccagucuggugcuguuuuugggacaaauaggagauugaccccaggccguuccaccuaccccaggggcuuccaccaaccccaaagucuucccaaggccuuggagagcccucuuucgaaagcaucuccuguucuggguaaugacaauaauaaaaucauagcagcugucaauugcgagcacuugucauguacaaagacugugccccaucggcgcaugacuucauuucaccugucaacaccccugugagaugguuacuguuguuauucccauuuuauagaggaggaagcuguggcuuggagggcuaggcauuugcccaaggucaaccagcuugaaucacuggcagagccaggguuaacauucagggccccacccaucaccacgguguggcacugccucuacuuccuaucccccuccagagagaggcuuaugugaaccgaguauuaacucugagccauaaccaggagccugcuauggguucugagcuuuuauaggaugugguggaaauagcagggcucugguacuccagaggucaagguucccaacucagcucuaacaccaaccagcagagcgacccaggaccacauguugccucucugagccucaguuuucccauguuuagcaggacaggacugggcucuuagagaguucauagcaccuuuccagcuccugguggguucaagagagaacucccgggaugaagagaugagagcacugagguuggggggucaacuggauagccagggcccuaguucuguccuaagaggaggaaguugugucuucuccauccaaccauccaaagcccuccccagauuuagccggcagugcgugguggacaaagacaagaggaaccagugccgcuacugcaggcucaagaaaugcuuccgggcuggcaugaagaaggaaggugagccucggcccuccccgccccaccaccacugccccaccugcacccacagcuccccgacagucauuuacaacuguagccacacuuuaugacucaguggcaggccccagggugacuggcuaauggcugagaagagggagggccuggaaaucugaccauagggagcggcugggcuuggucuugagaaagauucagagagauaagcucccacucuuggcuccucaggcucccagcaaccaccaccccugccugccugucugcgccaccacaaagcagccacguuguguguguguguguguguguguguguguguguguuuaauauaauauuucgaacguuaggacaagcauagagaaugauauugcaaacaucugaguacucacuaucccaacuuuacaaaagggacagccagaggagcccgaugccugagcuuccggucccagggacaaaugccccaguucccuuaguauucauucguggguaucacgugaucuccaaagucuucacauucuagaaaaugggaacaagaccccagacccauccuggacaaaggaggagaagaccagagcacaacauuuauuaaggucuugccaggcuuccugcuaccagcagguaucagucacugggcugugcuuuuuccacacuucaguagguuggguucauuucauuuucaugacaacccuauaugggaaaauguugugaaaaugaaaugagcccagcccauugaaccuauuacaauuccucccuuuuuguggaugaaggaacugaggcccacaaugguuaagcaacuugccuagggccccacaacugauccuuggaagaucugaagucccagagcuucugcuauuuggaccacacuucagcacugucuauuauuuuaugcucuccagauaccagggacauuuaaaauuguuuucagcccaagcaagggaagcaaaaaucuuuuaacugcuuuaaaguaacuugaggccaggcgcagugaaucaggccuguaaucccagcacuuugggaggccgaggcaggcaaaucauuugaggucaagaguucgagaccauccugaccaacaugguaaaaccccgucucuacuaaaaauacaaaaaaauuagcugggcgugguggugcaugccuguaguccuagcuacucggaaggcugaggcaggagaauugcuugaacccaagaggaggcgguugcagugagcugagaucaugccacugcacuccagacugggcaagacagcgagacucucucaaaaaaaauaaaaaaguaacgaguucauuuucgaaucucuucauuuccugcuccucuaaacucaaccuuucccagcucugcgacuagucccagaccuucccuucuagcccacaguugugccguaccagccaaaccuuggucuaguccugcuaguucgguacaaacaccccucacccccaucaccccagcacaccccagaagcaggaacguaggacccagcuugcuccagggcccacugagaaggaggggaggggaggcuuugguagacucucuuuccccuguaucugcuccuggcccccuguuuucucugcccccucccuuggaaauaucuucuaugucucauccuuaugggaccuuagucugggcucaugagcugucuuggaaaaucugggcuugcugaucccgaugcaggagugggugguccccaaggccugcucugaacgcugcaauucuaacaucuagauaucagugguucuccaagggcaagaggggcuuuuuaagcugcaaauacucccuccucucccaaacccaguuuucaaugggguuaagccugucucauccacuucaacuuccauuuuguggacugggaaagauuaugaaugggaaccugaugcaugugugaacaguuggaggcaagaaaaagauugagaacuacagucuaagguuccaacauuucugugguuguauuagucagugauuccauuaucccaaaagccuaagauuuuaggcacuaugauuccucauaggugucauccagagggcacuguguuugagagaacagcucucucacagugaaaguucaggucugugacaggcagaugggagagggguuggcagcccuccugaguggauggcuacccaccuccacugcguguggccugguccugcguguggucaguuguuauaaaugucuuuuauuagacauccagagucauuuucacuuguguaauuuagggacauuucugucucuucugggcucuaguuuucccaucuauaaaaugaggacauuggauaaugaacccuucagcccuaugagucucgcuccucacucccugaccuaccugcacaagucacacugcccacuaggauggguguguuuguucccuggucccuucuuuuuuuuuuuuuuuuagauggaauuucgcucuuguugcccaggcuggagugcaauggcaguaucucggcucacugcaaccuccaccuccugggugugagugauucuccugccucagccucccaaguagcugggauuacaggcaugugccaccacaccuggcuaauuuuguauuuuuaguagagacaggguuucaccauauuggccaggcuggucuggaaccccugaccucaggugauccgccucggccucccaaagugcugggauuauaggcaugagccacugcgcccggccccuggcccuuucuugagcugcugcaaagccagcaaaccccuuacuaggcuccuggaagggggaugagagccccagaccauucagccuuagcucagccuugaaaauagcugcuugcuuccuggcccagggaaacggacaugcugcccggaggauaggagaguuggcugauggcgagugagcguggguuagucgaugcuaguguuuguuuacaugccuggguuaccuggaagaucaugacacaugcagucacuugguuguuuugagaacgggccagagugacaaaguguucaguugccacuguggucaagccauaggaaaugaggguauuccuagcugugccugucuucuaggccccaccaccccuccucagccugcugggaagcucccaaagccaaaagaaagucucgguggaagucucacuggccaggagaguugggacaaguuuuuauuucuuuuucuugaugaccuuaggagaauuugaggacugaaacccuaaaauagucccugagaaccagaaagugugagcuggaaagguaggauuucaagaccagcugagucuauaagaggucaucaaaucuaccugcuccccacuuuacagaagaggacacugaggcuagagaggugaugugacgggucagggguggagucaggucuagaacucaggcuccccagagcugagcagacaccaagcucccuggagugaaacuugcagugaucagcuugggaggcacauuucuugaucuagauggcugaaacuuucucucgaccacagagaggggcuucaggucucaugggccuauaagucucugccacaggauaguccaccauggcuggaaggggcucccuggaaggccaaagaauccagggagaacccugggggucagugggccaacagcaggucaagaauucuuuccugcaaccgaaagccagggagacagacaccugccuuggccuaagcugucaggcccaggacaaauauucggcuccuggcaucaaaaacccagcccagaaagcggacccagaguugcaggaggugagcguaggugaugggccaggggccaucugaagaggccuuccucggaagccccugcccugcuccccacagcccccuacccaggaguucccugggaagacaggcucaucaccucuccgccucugcccaggucgguuaauauucaauagaaguuacauuagguccccgacccugcuaauacugagcaaacauuuggaaaacaucauuccgugacugagcucgcgccgggcacugauaacgcccgccuaaccuugaggagcccuauccgcagcugcugacagcagcccuuucauuccgcccgccggccacucggcgcccugaugggugggugcgggugcuggcaggaggcugccgugggaggggugugggcgggugggguggacggcccggucagggaagccgugcucugagcuggccccguccacaugguggucugagaggagguugcuugccucuggacuucuguucuauccacugacucccgggcucaagugcaaaggauuugacuuuuauucucugauuuuaacaaugugucaacaucaagagaaaguugaauagcuggggugucaauguucccuggagaaauaggguucuuauaagaauuagaguuuaugaccagguguggugccucgcaccuguaaucccagcauuuugugaggcugaguggaucacuuaaagccagguuuucgagaccagccugggcaaccuaaugagaccccgucucucaaaaaaaaaaaaaaauuuagccaggcgugguggcacacgccuauaaucccagcuauucgggaggcugaggcaggaggaucgcuugagcccaggagguugaggcugcagugagcuaugauugcaccacugcaguccagccugggcaacaaaaugagaccccaucucgaaaaaaaaaaagaaaaagaauuagagcuugucucuuccaaugccuucguucucucacugcacaaauauucauugaguaccuacugugaaccaggcccuguucugguggcugggacuacagcagugaacuagagggauggaguuuuggccuucugaagcuuuccuucucagagagagacagauaguaaaggaaguaacaaauaauucuacaauaagugacuugaagaaaaauaaagcauggggggcagggccagggugggagucauguuguguuagacaggguggcuggagagggugucugaaaggcgacauuugugcagaggcaggagugaaaugaagaugcugcugcgcugugcaggaaagggaaccccaggcagugaccacagcagccuacaagcgugcggaugcguccagguggggaggcggguuuucgcggacagaguguguagggggaagccgguaaaaggugcgauccgagaggagaggaagggcccuggggacuugugagguuggaaggcacugguuuugagcagcaggcgacaugacuugaacggaucccucugucucugagaggaacacagacugcaggcgcaaggcagaagcagagcccaggaggaggcugaucuaauccaggagagacagcgggccugggagcagggagggagcagcaggucuguuugucaggaucacgacagcacuggggugugaggggaagccaaggaagguggccaggcuugaugccagucccugagacgagaaagagugcagggagccggcuggcagggaaaugccuacggguagggaaacugagccccagagagaggcugcgauugccaccggcacacagaguggcagguuccagacaggaagccgggucuggugcagcuucaaccucccuccuuucugaaucagccaagccucauuccacagugaggccucuuggacuccaagggcuaucccauccacugucgggaugguggaaggaucaucuucuaucucaggccaggacugacccagaugggagcaggcaguggagccuggggccccggugggcguaggcuccagaucccucagugccuggaacagagcagcagugggagggagggagacagcgccuggccuugcugaugcugagguuagucuggaguacaugcagcuccugcugauggacaaaaccaucaaggcaguuggagcccccagauccucuuguucaggaauccccaggccaucuccuugucacccagaguaauuuguuuugcuugcuuuacucacuuucauuuggaaagaaagggacccuuuuguagaccagagcuugaacaucuuuaagcuagucagauccccuccucaaugcucaagaccaauuuuaaacccauagccgagucuucacugucuugcgcgccccugcugauggguggaucacucuuauagccucuccauuguguugggggcaguugugauauguggaaaguucuuccaccagcugaguuagaggccaucuccccucauuccacaugcugaugugggccuguucucuggacaccccccaccuccugcucccacuccucaucagucacagacacccccacccccuacuccaucccuguucucccuccucaccucucugugccuccucacagccguccagaaugagcgggaccggaucagcacucgaaggucaagcuaugaggacagcagccugcccuccaucaaugcgcuccugcaggcggagguccugucccgacagguaccggggugauccugccacccacccagggaucccccacacuacagaggagcucaccuccuccaccuccauucuccccagccaggcccuggagcagcugacgggaggggccucagauauuacagaagggacacugaguccgguuucacauggcccaguuugcagcaagggcaggaaucgaaccuggcgcccuggggcacuuucuaauucauccuacugccugcaucccacaggccaagcagagucuucaccuucacugagggccugcgaucagcucagcuccgagagaacagagcaguggcucaguggagagagguggcaaaguggggcccagcccuucccuugcugagugaccuugggcaagucacagcaccucucugagccaugguugccucauugucagaaaaggaugaugauuuuuugcccugcuucuccucuaaggcugacagacuccuuggggcucuaaagcugacagaggagggggcagggggcagguaacaggugaaggcacagagggagcccuucucccucaucccugccuccucccucccuccguuuuuacccugagcuuccuucagagcuggagggcacccacuauccagcccccuccccacaucugauuccagggagggggcucugugcaggggacagagagugcgggagggcccggacaucuccagcauuuucuucccuguaucucucgaagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccaggugaggaugggcguggauggugggcaguagugggcagugggcggggcagccagggggcugcuggcccaccugggauauagccguggacuggcuugauuuuauuuuauuuaacaaaauauguagugcacacacgugucugaaacuuuaaaucaccuuacaaauauuaacucaguuagcuccuccaacaacucuaugagguagguacuaagguacuauuauuacugccaucucauaggugaggagauuggggcacagagagguuaaguaaccugcucaaggucacauagcuacuauccagcauagcugggauuagaaccuggcaggaagcuccaaaguccaagcuccugaccauuguaccugaggcucucccagggggauguugacagggacccuaggacagggaucaggagauuuuggcuuaagcuauggcucuaagacugguugucugccuaauccugggcaaaugaguuccucucucugagccucaguguucucuuaucuguaaaguggaaaugauaauauccacuuuagagugugguugggaggauugaggacauuggugucugaaaaguacaaaaaucaggugauggggcaagcugcacaguggccagaccagagcuggucucccuaaacauuaguuucuuccuuguuucccaccaaaacgauugaacucagcaucguguuucccaccaaaacaauugaacugagcaucauauuucccaccguacauuuuuuuggaauacugaaaugucccuagggggaagaaaggguugaaggaagguggcgugugucugaggacagaugaauuucggagaugccaccuaugaagcuccugcccagagcaccccugggccuccaaagagauguuacccaucuggggaagaggagcugggcugggccaccuucucagcuucggagacagacucuggugcauucgcuuacccguuucgcaccuuugcauaagacacugacaaugcaugugagucugugaaagcuucugagaagucucguccaggcaguuguuugacuuugcagaggccgaggcuucucaaacuccuucggcaagauucuccuggaacaccuauuaauacugcacauugggacacugugaaaacgcugguuuggcuuguccccagccucauacaggggcuggacccggggcccucuuccaugguuccuccuuccauuagcagagucgacagggcaaggaucuuggacaauccgccccuacccucuccccuguuccuugugcucuggccccaguccccucugcuggagucucuacauuaauguuuaaucccuccuguuccuucccaggggcuuagcagggcaacaagauacccccaaccugagcaauuguuaaccucgauuucccacccaaaccucccuggcuggggcucagagcauucucagagagcaaugauggguggccaauaacacaggacaaucauuaacacaccaccccgaccucccggcccaccccccagaacagcugccauaucaggggguugaaccugggaucagaaggguucccagcuccccauuccugguauaugaggagcccagcuugcccaaugcagguggggcaucccugggaaagucgggggcauuguccuccaaagggcuucccaauuuuguugacauugccccagaaacuagauucccaguuggugugcuucuugggccuggauacaauugcagaaagagauuggggcuuagagagagacagaaauuugccugaagucacagagcaaguuagcgacagaacugggauucaaauccaggucuuccgcuucgcgaugugaaggccacuggagugacugaugaaagacuugcacagugcccagugcgcaggaggcgcuuggcaaucagcauccucggccucccuccauacuggucauggaaaguggauuuucccucccaggcaguuuccucuuuuucuguuuuccucacagguuucuauccauggggaauagaaggggcaaggacaaguggcugcccaggagcagcuagagcuagagaggaagucaagauguuugcucauucauucauucauuuccccuuuccuuccuucauucaaauauuuauugaaggcuuauuuugugccaaauaucuucagacaaaugccuucuuuccucuaacaacaauuucaccuccuuagaggccuucucugaccuccccaucuaacguagccauucuugccccauugcucucaccauccuuuccacuccccucccucccuccuucccuuccucccaccuuuucuccuuccuucuuuccuuuaugcugugaucacccuguguccucuguacuuauuuguucucuacuaucuguucauccucucuccuauaaauguuaguucgaugagauuagagaccuugucucucguuuuuaaacauugugccuccauugucuuaaaaagugucuggcauuuaguaggcauuuaggauuugauaacugaaagaaugaacaaucaaauuaaugaacaaacaaaggauuuuaaccuucuaguuuggcuugcuauggaaccuccaaacucccuaacccaaccuugaagaugagaagaugagauccuugaggcuaccagccuggugcuguuuuguuucaagccauccuuugguccucaggcaagcacuaaagcagauggcucucagugggcuggcuauguccuucugugagcuugcugggccccuaccuaugacuccagucuuagaagucuugccuuguacccccugcagagaaugguuucaucaagcugauucucugccaggggccagugcucauacauuugcucugagaaggaccagcccugagaccuaacauccacauccaaguucuuguaaugcccucucagaauccuggaguccugcaaugucgaucccuggagggaucugccagaccaaugauuucccaaacagaauugcacuucagagucaacuauggagcuuuuuaaacacagaucccugggcccacccuaaacauacaaaaucaggaucagaaucucagggccuaagaaucuguauuuucaggccgggcgcagugguucacaccuguaaucucagcacuuugggaggcugaguugggcugaucaccugaggucaggaguucgagaucagccuggcaauauggugaaaccccgucucuacuaaaaauaaaauuagccaggcaugguggugcacgccuguagucucagcuacucuggaggcugaggcacgagaaucacuugaaccugggaggcggaagcugcagugagccgagaucaugccacugcacuccagccugggugacagagugagacucugucucaaaaaaaaaaaaaaaaauagaaucuguauuuuuacaaagcacccuucauaauucuccauagcugguccaugggugggaauuugggacccacaguuuuggaacuuuuugggaucauagaccuuuuugagaaucucaaaaaagaaaaaaaaagcacacagaauguugcuuacaguuucaucaggcacacagaagaggcccagcacgaagcaguuucuugcccaaggacacagcaguucaaggacagagucagcgcgaggucucucagcucugagcacauguucuuuccccuuccagguuucuaguuuuauggguaguaguuuuaugaugcccauuucacaguucaggcagguagaggcagaggggagcauuaagcugacuugcccagcgucacugaguuggcuacgggcagccuucccaaggguacagauggcaaacacuguuccuucucucuuucagguggcccugcucagagcccaugcuggcgagcaccugcugcucggagccaccaagagauccaugguguucaaggacgugcugcuccuaggugaggcggcugccugcccuggccagggcuccagggaggguaugccuagcauggcacucacccaggcaaggagauucacaugguggcaugcaagggugagggagacuagucaggaguggcccuguccucaggcuugcauuagagggcuccaggacucaguuuucaacuggguaccccacucagaugcaaggaaauguggaugcaagucaccaaauucccagcauugaagucagagcacgaucaggguuaucccuggaauuaccugugcauccuuuuuucuuuugacagagucuugcucugucacucaggcuggagugcaaugaugugaucucggcucacuucagccuccacccgccacguucaagcaauucuccugccucacccuccagaguugcugggaccacaggcgugcaccaccacacccagcuaauuuuuguauuuuuaguagagacaggguuucaccauguugaccaggcuggucucaaacuccuggccucaaauaauccacccgccucagucucccaaagugcugggauuacaggugugagccaccgcgccuggccuaccugugcauucugauguucuuucuggaguaggagcaagaggugguuaagaauggcacaaagccccagcccgcgucaccugugccuucauggcauaguuauuauuuuaaacgcuuguacagcacacacugugugccagggacugugcucacugcuuugcaaacacuaccuauuuuaauauaacaaugcuaugagggaagcucgauuauuuauccucaucuuauagauaagaaaacugaggcacagagagguuaaguaacuuauccaacuauaaccagcuaucaggggcagagccauuuaagcagggcagugcaguuccagaaucugguccuuuaaccuugaugcuuuggugccuaucaggugaccuuugaaugucaucgaucuugugagucauguugguaaauggagcuugggucaugugaaagagguccuagaaagccaaguuccaagcucagccggaugacucaaggcagcuuaucuucugaaucugggccucagcuuccuuaccugugaaaugggagucaccaucccugcagguccuccucccacaggcaccagcuaucuugccaacuuaaaagccaaaacuagaggagaggggucaacccaaggugacuucccauccucccucccucccaacccuuccaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagguacagugcacaccuccuaagccaucccugacucucucuccagaacgcucugccagacuucuccuauuggguucuguacacugaguucacagccucaucucauguuaacgacagccaggagaggccguuuucauuuaacagaugaggcaagucaagauuugaagagacaauauggccgggcgcaguggcucacaccuguaaucccagcacuuugggaggcugaggcgggcggaucaccugaggucagggguucaagaugagccuggcuaacauggagaaaccccaucucuacuaaaaauacaaaaauuagccaggcaugguggugcacgccuguaaucccagcuauucgggaggcugaggcaggagaauugcuugaaccugggaggcggagguugcagugagccaagaucccgccacugcauuccagccugggugacuccaucucaaaaaaacaaaaacaaagggaggauaugacuugacagggcacccugacuccaaaggccugggcuuucccuucuuuuacuucuucccuccauccuucuuucucuuuacuucccaucuuccucuuuucuuucauauuugcuucuuuuccucaaaaaaauuuaucaaaauaauaucuagaaccggaugugguggcucacaucuguaaucccagcacuuugggaggcagaggcaggaggaucacuucaggccaggaguucgaggccagccuggccaacauaacaagaccucgucucuauagaaacuaaaaaaaauuagccagggauaguggugagcaccugcagucccagcuacucgggaagccaaggugagcaccugcagucccagcuacucaggaggccaaggugggaggaucucuugagcccaggagguggaggcugcugugagaugugauugcaccacugcacuccagucugggugacaaagcaagaccucaucuaaaaaauaauaauaaauaaauaaauaaaucuacacauacuuaaaaugcaaauacuucuccccauccuacuuuuccagcucuaagucuacuccccaagagaagcaugucugauuauuuuaauuguuucuucuggcaguuuccucaacaauucuaaaugaaagacaaagccuuauauuuguugaugcauccauuuuggaucauaauguuccuccuaggauggcagaggauuuugcuuuucuccaucaccauucccaucuuuucuuccccauuuuucccaauauauuuuuauugcuauuuuugagucucuguugcaaguuaugugcuuuuaucuuuccuuucuuguucuaucaacuguagacgguaucucccaacccuucacauugcaggaugaagaaaaagcauuccuacccucuccuguggcucuuggcucuccucuccccauucuguccacugacuuuugcaccugcauuuauacagaaugcauuugucaucagucuuuguacaaaacuugcuuuuguuucccagcaucaaaggugccugaacucuggaggcuugcuugccuucccugcuuacauguuagaggggaccuacugugugccaggcacuguccuucacgcugcaaauagauuaccucuaguaauaauaguaaugaaaaggcugggugugguggcucacgccuguaaucccagcacuuugggagacugaggcaggcagauuacuugacgucaggaguucaagaccagccuggccaacauggugaaaccccgucucuacuaaaaauacaaaaaucaguuguguguggugguccgugccuguaaucccagcuacucaggaggcugaggcaggagaaucgcuugaaccugggaggcggggguugcagugagccaagaucaugccauugcacuccagccugggcaacaagagcaaaacuucaucucaaaaaaauacauauauguguauauauauauaauauauauuauauauauauaauauauagugauauauauaguauauagugauauauuacguauaauauauauuauauauagugauauauauuuuauauauauauagugauauauauuauauauagagagagugaugaaguggaagaugagccccauguauugaaugcucccuaaagagcuguuuuuaaacacuuuauguggauugucuuacuuaccaacaugguaccugugaaguaggaauuauuauuaucuccauuuuacagauaaggaaacugaggcaugauuaacuugcucaaggucacacaaccggaaaauggcagagcuuggauuugaacuucagaccaccugucaaucccaauuucucucucucaagcccacauucuuaccuaccaccugcuaucccacacuuaccagagggugagauuucuaguucuaguucccuccacagccuggcccagccuguauccucuguagugcucaacacgaggcuggacuggcagaauuguucugcaaaaugggaaggaucacugaugcugagucagaggcagcagccuccagcaauuugaaggggcgggggaccuaguucaaggccuggcaugcaggaggugcucaauaaacauguguggccugaaugaacuaaugaauaagcaugauucaguggagacagcccacuagaaaugugggugaauguucuuucugccacuuccuuuguccaugaaagaggaaauaaaugcauuaccuccaugaagguugagauuaaauauuguaugaccgcuuaaguuccuuucuaggcuaaggaucuagaauuuauucacugauuuuuuuuucauucauucauccagccaucuaacaaaaaauauacauauaguuaucaauaaauauauauuuauauauaaauauauauuuuuuaaaauauauauauauauagucugucacccaggcuggagugcaguggcaccgucuuggcucacugcgaccuccaccucccaguuucaagcgauucucccaccucaccuccugagucgcugggauuacaggcaugugucaccacgccaggugaauuuuuguauuaucaguagagaugggguuucaccauauugaccaggcuggucucaaacuccugaccucaagugauccccccgccucggccucugacagugcugggcuuacaggcaugagccaccaugccuggcccuauucaauaaauauugacuaugcauggugcuagguggugaguuugaaaaggcaaaggccgggugcaguggcucacgccuguaaucccaacauuuugggaggcugaggcaggcagauuacuugaggucagaaguuugagaugagccugaccagcauggugaaaccccgucucuacuaaaauacaaaaauuagcugggugugguggugugugccuguaaucccagcuacucgggaggcugaggcaggagaaucgcuugaacccaggaggcagagguugcggugagccgagaucacgccacugcacuccaggcugggggucagagggagacucagucucaaaauaaaauaaaauaaaauaaaaauggcaaauaagacauacgcgugccccugccaaacucacaguuggauggcacaacaauuacauccuguguggucagcagugauggaggggccgcagagauuuggaaacaggagggacacaggauacagauauaggaggguagaaggcagacuuccuggaggaggugaaaccuaaccugagucccuaaggugauaggaagcaggaaccagggaaggggagccuauucuaacacaguagaagcagcaacugcugaggucuggaugaggggaccucaacuguggcccaaaaccccaaguucccauuguggcucugccaacaacuggcugugcgacccaggacaaguccuaucuuugcacugugucuggguuuccccguguguaagaugaggcgguugcuaggugcuuauuggaugcauuccucaagucccgcccuccaucuccuauuccccucucuucugguuuagugcuuuaggaaauguggcagaaaucuuuuucugccugugucuaggaaaucauaauucaugcuggcguacccugguuguugaggucccugaauccuugugcccacacugcugaagacuccuugugugauacaagucaggggacaucugggucuugacuccccagaugcuccagcuggacccugcugcccucccuugcccacccucuuccauuguagaugccaaggggcugagcgauccagggaagaucaagcggcugcguucccaggugcaggugagcuuggaggacuacaucaacgaccgccaguaugacucgcguggccgcuuuggagagcugcugcugcugcugcccaccuugcagagcaucaccuggcagaugaucgagcagauccaguucaucaagcucuucggcauggccaagauugacaaccuguugcaggagaugcugcugggagguccgugccaagcccaggaggggcgggguuggaguggggacuccccaggagacaggccucacacagugagcucaccccucagcuccuuggcuuccccacugugccgcuuugggcaaguugcuuaaccugucugugccucaguuuccucaccagaaaaaugggaacaaggcaauggucuauuuguucaggcaccgagaaccuagcacgugccagucacuguucuaagugcuggcaauucagcaaagaacaagaucuuugcccucggggaggcugugugugugugaguauguauggaugcguggauaucuguguauaugcccguaugugcgugcauguguauauaaagccucacauuuuaugauuuugaaauaaacagguaauaugauagaguuuaacugaaaaggaauccucuuuagauaggggaggccacaggagaccucucugaaguggugacucuugugcuaagacccuaacggcugaaaggaaauggaaggcuuaaaagacaagagaggaauauuccaagaagaagaaacuacuucaagggcugcggauaggagagaguguuguguuugagaaagaagggcaagguugugagauggaggacguguaggaggugaagauggagauugggcagaaaccaaaucauaaacauauggcuuugucagccuuuucagaaauuuggauuuuauucucauugcaacuauuguaaggagagugaaaaccagacuaaguauuuuuauucuuugagacaaagucucccucaaucauccaggcuggagugcaguggcacaaucuuggcugacugcaaccuccaccucccgaguucaagcaauucuccugccacagccuccugaguaguugggauuacaggcgcccgccaccacgcccugcucauuuuuuuauauuuuuaguaaagacaggguuucacccuauuggccaagauggucucaaacuccugaccucaagugaucacccaccucagucucccaaagugcuggaaugacaggugugagccgccacacccaucccagacuaaugcuucaaacaaaccacucuguuggguagagagugaauugcagauuccugagaaugucacugucuccaaucaugugauggaugauggaggcuuggacccuggcaauggagcagugaagauaaaccugaucaucuauuuggaggaagagcccacacccacaggauuugcugauugaucagacauagggagugagagaaagaggaagagucaaggacaaagucuacauuuuugcuuugaguagcagaaaugacgauggaguaauuuacugaaaugaggaggacagaauaaacaacaagacacugggucugggggugguagugaggggugaccucagagauccauuguggacccucuuuucuuuuuuccuuuuuuuuuuuuuuuugagacgagaucucucucugccacccaggcuggagugcaguggcgcaaucauaguucacuguagccucaaccuuccaggcucaagagauccuccuaccccagccuuucaaguagcugggacuacaggugcgugccaccacacccagcuaauucuucauucuuauuuuuuauagagacaaggucucacuauguugcccaggcuggucuugaacuccuagccuuaagcaauccuuccgacuuggccucucaaagugcugggauuacaggugugagccaccaugcccagccucauuguggacuuucauuaagcaugagaugacuauuacaaauccaaguuaucaaggaggcuguugaauguaugagucuguugcucaagcacaagauuaaaggcagcucuguggaaucagggggaagauggagccauggagggaagggaagaagacuggccagagggguaggagaaaaccagggcaauuccagaauccaagagaagagcguguuugaaggacagaguguuuaaugguguuaaacucuacagagaaacagaaagaagcggggaagaaaggagaggugaagagaggaggggaagagagaggaaaggguccauuggauugacagcuggaggcucuuggcaauuguguugaaagcagcaucagagagcugggagaguggaaaccagauuggagagugcuccaaagagagugagugggaagguggagauagaguagauaacccuuugaaaugguuugacuaugaaggggaguaugaaggaguuaggaugacugcaagggagugauuagaaugauaggucauggagucugggcugcacucaaaaagaaauaaagauagaggccgggcacgguggcucacaccuguaauccuagcacuuugggaggccgaggcggguggaucacuugaggcuaggaguucaagaccaaccuggcaacacagcaaaacaccaucucuacuaaaaauacaaaaaaaaauuagccagacaugguggcaugcaccuguaaucccagcuacucgggaggcugaggcaggacaaucacuugaacccgggagauggagguugaagugagcugagaucaugacauugcacuccagcgugggcgacagaacaaggcucugucucaacaacaacaacaaaaggauggggugauagugaaaagagagugucagugaauugacagucucaguagggcugaagaauuuuugcagcgaugguauuagauuacgggagcuggaaggacaugaggugaagucaaaguggggauguugaauucgagauuuuggagguguuucagugacugaagaugacaaggcgagggugagguuucucaacauugguacuauugauacuuggaacuggacaauucuuuguuguguggggcuguccuguacauuguucagcugcaucucuguccuguacccauaaggugccaguagcacuucuccaguggugacaaccaaaaaugucuuuggauauugucaaaugucuccugaugggccaaaaucauccccaguugggaaucgcuguuaugugauagcucauuucauucucacuuugacccugugaacaugggguuauuaugaaucaggugucauugagaucaggaucaggagccuguggucuguugccaaauaauuaagagcucucugggcucaguugucucaucuguagaaugggcuaauaauaguauccauccuauaggauugcugugaggauuaaauuaugugaaacaugggaagugcuauacaacaguaccuggcacgugauaauuguuaauuaucaacaauuguuauuuaucacugaaauagauguacuguagagaucgcuugcaagcguugaaauuccaucaucgucauauuacucaccauaggcuauuauuaaaccauaucccaugugguauuuuuacucccugacauauguuugaagcgguuacuguguuccagacaaucugcuaggcccucaaagaaagaagaaaaauaccucugaaauuguaaugcucauagacagaagaagugguuguuccuaaaaguuguguuacagacaaauuacuaugagaaauccaaggaaggagaaucaggagaggcuucuaaagagaggaaauauaugagcugggauuugggcuuauggacauggaacagguuugggguggaaaaacaucucugacagaagcaacaacgugagcagaagcauagagauagaaaaacacaggggacacauagaugcuauaaguaggucaguuggcugcagcagagaugugggggaugaggcugaaaggugaggcgggaccaaaugguugaaggacuugcacuccaaggagcuuugagagccauugauuacauccauuauguuacuaugugaccaauacacuacucauuagaacauuuacgugaucucagagcuuccuuauaugcaccuuguuccuuucaacucacuuuuguucucuugguuuuuugggguccucuuaacacccucaugaagucuauagaugggaaugguacacccuaguuuacuaacccaggaauagguacccaacaggcacugccaauauuggaugggcugguugauuggccacgccugaggaagauggcgucccaaggccugaggucugcaucccagacucuccauccugaucgaccuucucuaccugcagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcaggugggcaaacucugggauuuuaccuugcaaagggugaggauggggcuuaagacaggaggcaggagaaaguggagucuagaagguagaaccaggaugcaacaguuuucuggguuccaggguagggaauaaagggcaagauuguccauuuguugaggcuguuuauucaguaaggugacugacagccuuuacugaaugaagccauuguugggaugaggcaauccacuggaugagguaacccauugggugaagauguucuugggugagaauuccauuaguugacauuguccauuaaguaaaaguggucauugaaguaaggcugcacaguuggguaaggcuauccauuagacaauuagaugagacuacccauugggucaggaugucugcugggcuagaccauccucugaaaccuccaaaguauaaacuugucauugggcaaagcucuucaaaggauaagauuaucaaugggaugaagugauccacugagauaagaugauauuuuacugacauuguucucagggaaaguuuuccauugaacaaagauggccaauugggucaaauuugcucuccaaaccugccaugagagugaggccaauuaguuucuauuacucaucuccuaaauauccaagaaaugguauuuuuugagccagcugguccgggguuucaucaacugcugcuccuucucccaggaaagacuaucccugucacccaucccauugccgcuggggacagccaggccugggccuugguuugggagaagcaguccaagucugcauaucaaauaaaugauggaggagaugggugguaggaccuuccagaccucauaaaacuuaggcuuuaugaucugggacucacagaagguugagcaauaaaagaccuuagggauuaucugguuuaauuaauucucucauuuuauagaggaagaaauuaagucaagguggggcagggugggaggggagaacuuucccgggccucuucauuuacucccacaaaggcuggaauuuugagcagccccugucugucuguuuguccuuccagccaccccugagaccccacagcccucaccgccagguggcucagggucugagcccuauaagcuccugccgggagccgucgccacaaucgucaagccccucucugccaucccccagccgaccaucaccaagcaggaaguuaucuagcaagccgcuggggcuugggggcuccacuggcuccccccagcccccuaagagagcaccuggugaucacguggucacggcaaaggaagacgugaugccaggaccagucccagagcaggaaugggaaggaugaagggcccgagaacauggccuaagggccacaucccacugccacccuugacgcccugcucuggauaacaagacuuugacuuggggagaccucuacugccuuggacaacuuuucucauguugaagccacugccuucaccuucaccuucauccauguccaacccccgacuucaucccaaaggacagccgccuggagaugacuugaggccuuacuuaaacccagcucccuucuucccuagccuggugcuucuccucuccuagccccugucaugguguccagacagagcccugugaggcuggguccaauuguggcacuuggggcaccuugcuccuccuucugcugcugcccccaccucugcugccucccucugcugucaccuugcucagccaucccgucuucuccaacaccaccucuccagaggccaaggaggccuuggaaacgauucccccagucauucugggaacauguuguaagcacugacugggaccaggcaccaggcagggucuagaaggcuguggugagggaagacgccuuucuccuccaacccaaccucauccuccuucuucagggacuuggguggguacuugggugaggaucccugaaggccuucaacccgagaaaacaaacccagguuggcgacugcaacaggaacuuggaguggagaggaaaagcaucagaaagaggcagaccauccaccaggccuuugagaaaggguagaauucuggcugguagagcaggugagaugggacauuccaaagaacagccugagccaaggccuagugguaguaagaaucuagcaagaauugaggaagaauggugugggagagggaugaugaagagagagagggccugcuggagagcauagggucuggaacaccaggcugagguccugaucagcuucaaggaguaugcagggagcugggcuuccagaaaaugaacacagcaguucugcagaggacgggaggcuggaagcugggaggucaggugggguggaugauauaaugcgggugagaguaaugaggcuuggggcuggagaggacaagauggguaaacccucacaucagagugacauccaggaggaauaagcucccagggccugucucaagcucuuccuuacucccaggcacugucuuaaggcaucugacaugcaucaucucauuuaauccucccuuccucccuauuaaccuagagauuguuuuuguuuuuuauucuccuccucccuccccgcccucacccgccccacucccuccuaaccuagagauuguuacagaagcugaaauugcguucuaagaggugaagugauuuuuuuucugaaacucacacaacuaggaaguggcugagucaggacuugaacccaggucucccuggaucagaacaggagcucuuaacuacaguggcugaauagcuucuccaaaggcucccuguguucucaccgugaucaaguugaggggcuuccggcucccuucuacagccucagaaaccagacucguucuucugggaacccugcccacucccaggaccaagauuggccugaggcugcacuaaaauucacuuagggucgagcauccuguuugcugauaaauauuaaggagaauucaugacucuugacagcuuuucucucuucacuccccaagucaaggggagggguggcaggggucuguuuccuggaagucaggcucaucuggccuguuggcaugggggugggacagugugcacagugugggggcaggggagggcuaagcaggccuggguuugagggcugcuccggagaccgucacuccaggugcauucuggaagcauuagaccccaggauggagcgaccagcaugucauccauguggaaucuugguggcuuugaggacauucuggaaaaugccacugaccagugugaacaaaagggauguguuauggggcuggaggugugauuagguaggagggaaacuguuggaccgacuccugcccccugcucaacacugaccccucugagugguuggaggcagugccccagugcccagaaaucccaccauuagugauuguuuuuuaugagaaagaggcguggagaaguauuggggcaaugugucagggaggaaucaccacaucccuacggcagucccagccaagcccccaaucccagcggagacugugcccugcucagagcucccaagccuucccccaccaccucacucaagugccccugaaaucccugccagacggcucagccuggucugcgguaaggcagggaggcuggaaccauuucugggcauuguggucauucccacuguguuccuccaccuccucccuccagcguugcucagaccucugucuugggagaaagguugagauaagaaugucccauggagugccgugggcaacaguggcccuucaugggaacaaucuguuggagcagggggucaguucucugcugggaaucuaccccuuucuggaggagaaacccauuccaccuuaauaacuuuauuguaaugugagaaacacaaaacaaaguuuacuuuuuugacucuaagcugacaugauauuagaaaaucucucgcucucuuuuuuuuuuuuuuuuuuuuuuuuggcuacuugaguugugguccuaaaacauaaaaucugauggacaaacagaggguugcuggggggacaagcgugggcacaauuuccccaccaagacacccugaucuucaggcgggucucaggagcuucuaaaaauccgcauggcucuccugagaguggacagaggagaggagagggucagaaaugaacgcucuucuauuucuugucauuaccaagccaauuacuuuugccaaauuuuucugugaucugcccugauuaagaugaauugugaaauuuacaucaagcaauuaucaaagcgggcugggucccaucagaacgacccacaucuuucugugggugugaaugucauuaggucuugcgcugaccccugagcccccaucacugccgccugauggggcaaagaaacaaaaaacauuucuuacucuucuguguuuuaacaaaaguuuauaaaacaaaauaaauggcgcauauguuuucuaa

SEQ ID NO: 61630 - RNA, 31590 nt, Homo sapiens; identical to SEQ ID NO: 61629

SEQ ID NO: 61631 - RNA, 23381 nt, Homo sapiens
gguuugaaaggaaggcagagagggcacugggaggaggcagugggagggcggagggcgggggccuucggggugggcgcccaggguagggcagguggccgcggcguggaggcagggagaaugcgacucuccaaaacccucgucgacauggacauggccgacuacagugcugcacuggacccagccuacaccacccuggaauuugagaaugugcagguguugacgaugggcaaugguaggugggggcagaugugcccaggugugccagugggggcaggugugccuggguccaggagcagaucuuuggcacucaacuuuggggugggaggagaaugauacaaaaugguagguugguccuacaggccagcacagguguugccaagugaagcccaugugcccaggcacagugaucacaggcauucugggugaagggaggccugcaagggccaauuuccagcaaaagucgaucccggcuauuccucccaggcccuuccaguccucacugccucacaguggcucugcuuggcgcuuggcacagugacgugauggugagcucccccuuggugcccagcuccagcgauucagcccagcacggccccuucgugaaccccuugggccuagguucagagagacggcaagggauguuguaucccuggagauggugguuggagacauaaccgcauuucucggugucuuugggacuuuccuagggaaaugaaauuggcacuuagggaaaauggagcucucagggaaguuuugcuaacuacgaagccaacucagcacuguguguguugugugugcguucgugugugauagugaguuuccauguagguuguauggguggggugaugccuucaggaacccauuugcauauguguguucauuugucucugugugugaguucugggucuauuuuccuuuguauucauugagugggucuguguuugugucuuaggaguugcccguguugaucuugcuuauguauguaaguguguauguguguguacuugugucuguggauguuuguacaugugugcugugugugcgggucauagagcacaugcguuugugcaugcggaccuguuggagugcccuguucuuccugcaucuuuauccuguaugggcguuuugucgugugcccauauuuguaccugcuguguauauaugcaguucccugugcugcgggcgggggucagcggucucuggugugcacgacugcacagacccaaaugcaggacucuguuguugccacucaccaagugagauucauaucagcaacauguccguuugucucugagcagauuuuguugccgcugcgucucgccagauugaggcauccccuccgacaucacuggagcauaucuggagggguggacaguucuccacagggagguaggggaaaagaggaggcccggaaaccccuccuggagggaagagccccaucggucccaggccagccucagaggagagggggcaggcagcuggcugaggucagccugccacccugcuuccuucugugucuuggagccacucagccaguaugaggcugcagcuccagcugaggucuggaaucuuguggucagcucagcuagggugaggaggcagcugcugggcacugcuuguugucagcucagcaggugcucaccugccccugccguccagucacgugugaccuugggcaugucaccuccccuauccuggcuucuguaucuucuacaaaacaggcuucauucccccaggccugcuggcuggacggcuuuuaggccugucugaggaccacgccaggagcgcaaggcaaaaacacaccagagauagcaaacaagcugcugcugcacuagguggaguguuguguggccccacgaggaccacugcccugcccugggcugcuccccgcccccaucacuuuuuccaagcccaggaacugugugcuccugaggcagaggccaagccccugaacugggagucccaaagacaagaccaccuccagcucuggaaccagaaagaucugggcucaaauccggcauagauccuuccaaccugugugaauguggcaaggcaauuuccucucugagccucaguuuccucaccuauaaaaugggaauaaauaauagugucugucucccagggcuggccagaggauaaauaagaugaggugccugggugcuuagcccugguaaagggccuggccccaccaugggucaucucaagggcucugagcaucuguaagcaggguccccacauuccucacuggaguuugaaguggucugaauugggguuaugugaaguuguccucugaaguguuuugaguacauccugggcuggugucugaaaggcuccaaggauauuucucccccguccucuccccaccccaauggagcagcagcccuggguggcuccuuguucauuagaggcccagcagacaccucaacauguguggcacuggcuggaguagcccagcaagccuggaccauaaacccauggcucugcuucacgggaagcagugcgaugacaccaggaagccacuuuuccucucuaagccucaguguccucaucuguggaauagaggugcucggcugaccucagaggggagaugauagagcugacagcccccagcccauccugccucagaggugggagcuacuuccccagccuccugcugaauggccaggagcugugggggucagcucuccccgggggucgggggaggagaggccgagggagaaagggcacccacguggcuuaacaauuauccccaucuccaggaauaauucaccaaguggagggggcugcacuccuggggacaccugggagucugcgauggcagaaaugagaugcggcagugucugcuugugcaaggagccuggaaguccucugcuccgagaguuuuccuauguggaaaaguuuuuauuucaugaacacugauauagugcuuacuaugugccaagcacuucacauacacauaugagaauucaccgaauccccauaacgaaccuaggggaauaucacguuccccauuuuacaagugaggaaacaaaagcauagagaaguaaacgaacacagucaaugucacacggcuaaaaagugggcaagcuggaauugaacccugggcagaaggacuucagaggcugugcuguuaccuacagugcauggcccucucugggucuuaacuggaugccccugaggaauccaagguuggauucaggauuucuaugaauacacgugugugugugugugucuguguauguguguauguuugugcaugugagcauguguguguggacuguguguauguguauguauauguguggacuguaugugugcacacauuuguauauguguguguugauguguuuguauguaugcauguguguggacuaugugcaagugugugcaauguauguggacugugugcauguguggacuguguguaugugugugcauguguguggagcgugugugugcuuauguguggacucuguguucauguguguguacuguauguguacacauguguguauauaugugugugugugcgugugucugugugguguguggacuguguggugugugugaacuguggugugugugugcgugacuguguggugugugugcgcgugugugugacugcuuggugugugugaacugugguguguguggugugugugugcuuguguguggugugugugcgugugugggaacugugugguguguguggacugugguguguaaggugugugugugcuuguguguggugugugcguguguguggacuguguggugcgugugugugcuuguguguggacuguguggugcguguguguggacuguguggugcgugugugugcuugugcguagcgugugugcguguguguggacuguguggcacacacgcuugcauuuucccgggggcugacccauugcauuugucaucuucuucaaaggggucuaucuuugcugaaagauuugcugacaaauaaaggggguucagcugcugcuauuuuuuuaaauuuggaaacaaauuuuuuaaauuuuuuaaauuuuuuaaauuuggaaacagaccagucaaacugcugccuuuuaugguuagagaaaaugaggcccagaagaaauugaagcagggaaagcgaaguugcccaaguuuacaggcgaguuaguggcagcaucagcaguagugcccaggacuccuggcacccagcccaagauccucuuuccaccugccucuacggccccccucacauuuguguagaugcaguagcuuuugccugugggaugggagggaugggagauguguccagacccuccuaggaggccacaugagugugacuguucucggcccaagucuuucucguuccucagagaauuugcggggccccugggcacacaagcugagauccacccagcccuggucccuuggcaagaacugagggacaggaccugguucuggggaaaaugcaggggaauguuucucccuuccacagcccccuugcgaguuaggaggccggcucccaccccagaagguggccagguuuucaugccuuccuagagaaagcuggggcucguggccuccaccacaggaagacgcagacccucagaaacaagucugugaagucacaaccagccccaguuuacagaugugaaacugaagcuccaaaaagucaggaggucacugaguggggaggugauggagugggaacagcccccagaucuggcugaggccgaagcccuggagagauccccgcaaggcucccuuagaugccugacauucuguucuuccugaagccucacucccuucucuccuggcgcagacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcaggugaggagccucaauuucuucagcugggaaaugggcacacuugggcucauggccccaaggucugucuucucccugaguggguaggucccagagacagcugcccuucagggccuucaaggcucuucugguuuuguaaaagacuuugugaauccaagaagagcaucuauucuaggaaccacauuuacugaucaucaagcuacuggcugccguuuauugagcucuuaucauaugccaggcacaauacuaagucuuuguguguauuuacccauccccuugagcccauuguuguuuuucccauuccauggggccucuccugaagccucaguagaugagcccgucuuccagucuggugcuguuuuugggacaaauaggagauugaccccaggccguuccaccuaccccaggggcuuccaccaaccccaaagucuucccaaggccuuggagagcccucuuucgaaagcaucuccuguucuggguaaugacaauaauaaaaucauagcagcugucaauugcgagcacuugucauguacaaagacugugccccaucggcgcaugacuucauuucaccugucaacaccccugugagaugguuacuguuguuauucccauuuuauagaggaggaagcuguggcuuggagggcuaggcauuugcccaaggucaaccagcuugaaucacuggcagagccaggguuaacauucagggccccacccaucaccacgguguggcacugccucuacuuccuaucccccuccagagagaggcuuaugugaaccgaguauuaacucugagccauaaccaggagccugcuauggguucugagcuuuuauaggaugugguggaaauagcagggcucugguacuccagaggucaagguucccaacucagcucuaacaccaaccagcagagcgacccaggaccacauguugccucucugagccucaguuuucccauguuuagcaggacaggacugggcucuuagagaguucauagcaccuuuccagcuccugguggguucaagagagaacucccgggaugaagagaugagagcacugagguuggggggucaacuggauagccagggcccuaguucuguccuaagaggaggaaguugugucuucuccauccaaccauccaaagcccuccccagauuuagccggcagugcgugguggacaaagacaagaggaaccagugccgcuacugcaggcucaagaaaugcuuccgggcuggcaugaagaaggaaggugagccucggcccuccccgccccaccaccacugccccaccugcacccacagcuccccgacagucauuuacaacuguagccacacuuuaugacucaguggcaggccccagggugacuggcuaauggcugagaagagggagggccuggaaaucugaccauagggagcggcugggcuuggucuugagaaagauucagagagauaagcucccacucuuggcuccucaggcucccagcaaccaccaccccugccugccugucugcgccaccacaaagcagccacguuguguguguguguguguguguguguguguguguguuuaauauaauauuucgaacguuaggacaagcauagagaaugauauugcaaacaucugaguacucacuaucccaacuuuacaaaagggacagccagaggagcccgaugccugagcuuccggucccagggacaaaugccccaguucccuuaguauucauucguggguaucacgugaucuccaaagucuucacauucuagaaaaugggaacaagaccccagacccauccuggacaaaggaggagaagaccagagcacaacauuuauuaaggucuugccaggcuuccugcuaccagcagguaucagucacugggcugugcuuuuuccacacuucaguagguuggguucauuucauuuucaugacaacccuauaugggaaaauguugugaaaaugaaaugagcccagcccauugaaccuauuacaauuccucccuuuuuguggaugaaggaacugaggcccacaaugguuaagcaacuugccuagggccccacaacugauccuuggaagaucugaagucccagagcuucugcuauuuggaccacacuucagcacugucuauuauuuuaugcucuccagauaccagggacauuuaaaauuguuuucagcccaagcaagggaagcaaaaaucuuuuaacugcuuuaaaguaacuugaggccaggcgcagugaaucaggccuguaaucccagcacuuugggaggccgaggcaggcaaaucauuugaggucaagaguucgagaccauccugaccaacaugguaaaaccccgucucuacuaaaaauacaaaaaaauuagcugggcgugguggugcaugccuguaguccuagcuacucggaaggcugaggcaggagaauugcuugaacccaagaggaggcgguugcagugagcugagaucaugccacugcacuccagacugggcaagacagcgagacucucucaaaaaaaauaaaaaaguaacgaguucauuuucgaaucucuucauuuccugcuccucuaaacucaaccuuucccagcucugcgacuagucccagaccuucccuucuagcccacaguugugccguaccagccaaaccuuggucuaguccugcuaguucgguacaaacaccccucacccccaucaccccagcacaccccagaagcaggaacguaggacccagcuugcuccagggcccacugagaaggaggggaggggaggcuuugguagacucucuuuccccuguaucugcuccuggcccccuguuuucucugcccccucccuuggaaauaucuucuaugucucauccuuaugggaccuuagucugggcucaugagcugucuuggaaaaucugggcuugcugaucccgaugcaggagugggugguccccaaggccugcucugaacgcugcaauucuaacaucuagauaucagugguucuccaagggcaagaggggcuuuuuaagcugcaaauacucccuccucucccaaacccaguuuucaaugggguuaagccugucucauccacuucaacuuccauuuuguggacugggaaagauuaugaaugggaaccugaugcaugugugaacaguuggaggcaagaaaaagauugagaacuacagucuaagguuccaacauuucugugguuguauuagucagugauuccauuaucccaaaagccuaagauuuuaggcacuaugauuccucauaggugucauccagagggcacuguguuugagagaacagcucucucacagugaaaguucaggucugugacaggcagaugggagagggguuggcagcccuccugaguggauggcuacccaccuccacugcguguggccugguccugcguguggucaguuguuauaaaugucuuuuauuagacauccagagucauuuucacuuguguaauuuagggacauuucugucucuucugggcucuaguuuucccaucuauaaaaugaggacauuggauaaugaacccuucagcccuaugagucucgcuccucacucccugaccuaccugcacaagucacacugcccacuaggauggguguguuuguucccuggucccuucuuuuuuuuuuuuuuuuagauggaauuucgcucuuguugcccaggcuggagugcaauggcaguaucucggcucacugcaaccuccaccuccugggugugagugauucuccugccucagccucccaaguagcugggauuacaggcaugugccaccacaccuggcuaauuuuguauuuuuaguagagacaggguuucaccauauuggccaggcuggucuggaaccccugaccucaggugauccgccucggccucccaaagugcugggauuauaggcaugagccacugcgcccggccccuggcccuuucuugagcugcugcaaagccagcaaaccccuuacuaggcuccuggaagggggaugagagccccagaccauucagccuuagcucagccuugaaaauagcugcuugcuuccuggcccagggaaacggacaugcugcccggaggauaggagaguuggcugauggcgagugagcguggguuagucgaugcuaguguuuguuuacaugccuggguuaccuggaagaucaugacacaugcagucacuugguuguuuugagaacgggccagagugacaaaguguucaguugccacuguggucaagccauaggaaaugaggguauuccuagcugugccugucuucuaggccccaccaccccuccucagccugcugggaagcucccaaagccaaaagaaagucucgguggaagucucacuggccaggagaguugggacaaguuuuuauuucuuuuucuugaugaccuuaggagaauuugaggacugaaacccuaaaauagucccugagaaccagaaagugugagcuggaaagguaggauuucaagaccagcugagucuauaagaggucaucaaaucuaccugcuccccacuuuacagaagaggacacugaggcuagagaggugaugugacgggucagggguggagucaggucuagaacucaggcuccccagagcugagcagacaccaagcucccuggagugaaacuugcagugaucagcuugggaggcacauuucuugaucuagauggcugaaacuuucucucgaccacagagaggggcuucaggucucaugggccuauaagucucugccacaggauaguccaccauggcuggaaggggcucccuggaaggccaaagaauccagggagaacccugggggucagugggccaacagcaggucaagaauucuuuccugcaaccgaaagccagggagacagacaccugccuuggccuaagcugucaggcccaggacaaauauucggcuccuggcaucaaaaacccagcccagaaagcggacccagaguugcaggaggugagcguaggugaugggccaggggccaucugaagaggccuuccucggaagccccugcccugcuccccacagcccccuacccaggaguucccugggaagacaggcucaucaccucuccgccucugcccaggucgguuaauauucaauagaaguuacauuagguccccgacccugcuaauacugagcaaacauuuggaaaacaucauuccgugacugagcucgcgccgggcacugauaacgcccgccuaaccuugaggagcccuauccgcagcugcugacagcagcccuuucauuccgcccgccggccacucggcgcccugaugggugggugcgggugcuggcaggaggcugccgugggaggggugugggcgggugggguggacggcccggucagggaagccgugcucugagcuggccccguccacaugguggucugagaggagguugcuugccucuggacuucuguucuauccacugacucccgggcucaagugcaaaggauuugacuuuuauucucugauuuuaacaaugugucaacaucaagagaaaguugaauagcuggggugucaauguucccuggagaaauaggguucuuauaagaauuagaguuuaugaccagguguggugccucgcaccuguaaucccagcauuuugugaggcugaguggaucacuuaaagccagguuuucgagaccagccugggcaaccuaaugagaccccgucucucaaaaaaaaaaaaaaauuuagccaggcgugguggcacacgccuauaaucccagcuauucgggaggcugaggcaggaggaucgcuugagcccaggagguugaggcugcagugagcuaugauugcaccacugcaguccagccugggcaacaaaaugagaccccaucucgaaaaaaaaaaagaaaaagaauuagagcuugucucuuccaaugccuucguucucucacugcacaaauauucauugaguaccuacugugaaccaggcccuguucugguggcugggacuacagcagugaacuagagggauggaguuuuggccuucugaagcuuuccuucucagagagagacagauaguaaaggaaguaacaaauaauucuacaauaagugacuugaagaaaaauaaagcauggggggcagggccagggugggagucauguuguguuagacaggguggcuggagagggugucugaaaggcgacauuugugcagaggcaggagugaaaugaagaugcugcugcgcugugcaggaaagggaaccccaggcagugaccacagcagccuacaagcgugcggaugcguccagguggggaggcggguuuucgcggacagaguguguagggggaagccgguaaaaggugcgauccgagaggagaggaagggcccuggggacuugugagguuggaaggcacugguuuugagcagcaggcgacaugacuugaacggaucccucugucucugagaggaacacagacugcaggcgcaaggcagaagcagagcccaggaggaggcugaucuaauccaggagagacagcgggccugggagcagggagggagcagcaggucuguuugucaggaucacgacagcacuggggugugaggggaagccaaggaagguggccaggcuugaugccagucccugagacgagaaagagugcagggagccggcuggcagggaaaugccuacggguagggaaacugagccccagagagaggcugcgauugccaccggcacacagaguggcagguuccagacaggaagccgggucuggugcagcuucaaccucccuccuuucugaaucagccaagccucauuccacagugaggccucuuggacuccaagggcuaucccauccacugucgggaugguggaaggaucaucuucuaucucaggccaggacugacccagaugggagcaggcaguggagccuggggccccggugggcguaggcuccagaucccucagugccuggaacagagcagcagugggagggagggagacagcgccuggccuugcugaugcugagguuagucuggaguacaugcagcuccugcugauggacaaaaccaucaaggcaguuggagcccccagauccucuuguucaggaauccccaggccaucuccuugucacccagaguaauuuguuuugcuugcuuuacucacuuucauuuggaaagaaagggacccuuuuguagaccagagcuugaacaucuuuaagcuagucagauccccuccucaaugcucaagaccaauuuuaaacccauagccgagucuucacugucuugcgcgccccugcugauggguggaucacucuuauagccucuccauuguguugggggcaguugugauauguggaaaguucuuccaccagcugaguuagaggccaucuccccucauuccacaugcugaugugggccuguucucuggacaccccccaccuccugcucccacuccucaucagucacagacacccccacccccuacuccaucccuguucucccuccucaccucucugugccuccucacagccguccagaaugagcgggaccggaucagcacucgaaggucaagcuaugaggacagcagccugcccuccaucaaugcgcuccugcaggcggagguccugucccgacagguaccggggugauccugccacccacccagggaucccccacacuacagaggagcucaccuccuccaccuccauucuccccagccaggcccuggagcagcugacgggaggggccucagauauuacagaagggacacugaguccgguuucacauggcccaguuugcagcaagggcaggaaucgaaccuggcgcccuggggcacuuucuaauucauccuacugccugcaucccacaggccaagcagagucuucaccuucacugagggccugcgaucagcucagcuccgagagaacagagcaguggcucaguggagagagguggcaaaguggggcccagcccuucccuugcugagugaccuugggcaagucacagcaccucucugagccaugguugccucauugucagaaaaggaugaugauuuuuugcccugcuucuccucuaaggcugacagacuccuuggggcucuaaagcugacagaggagggggcagggggcagguaacaggugaaggcacagagggagcccuucucccucaucccugccuccucccucccuccguuuuuacccugagcuuccuucagagcuggagggcacccacuauccagcccccuccccacaucugauuccagggagggggcucugugcaggggacagagagugcgggagggcccggacaucuccagcauuuucuucccuguaucucucgaagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccaggugaggaugggcguggauggugggcaguagugggcagugggcggggcagccagggggcugcuggcccaccugggauauagccguggacuggcuugauuuuauuuuauuuaacaaaauauguagugcacacacgugucugaaacuuuaaaucaccuuacaaauauuaacucaguuagcuccuccaacaacucuaugagguagguacuaagguacuauuauuacugccaucucauaggugaggagauuggggcacagagagguuaaguaaccugcucaaggucacauagcuacuauccagcauagcugggauuagaaccuggcaggaagcuccaaaguccaagcuccugaccauuguaccugaggcucucccagggggauguugacagggacccuaggacagggaucaggagauuuuggcuuaagcuauggcucuaagacugguugucugccuaauccugggcaaaugaguuccucucucugagccucaguguucucuuaucuguaaaguggaaaugauaauauccacuuuagagugugguugggaggauugaggacauuggugucugaaaaguacaaaaaucaggugauggggcaagcugcacaguggccagaccagagcuggucucccuaaacauuaguuucuuccuuguuucccaccaaaacgauugaacucagcaucguguuucccaccaaaacaauugaacugagcaucauauuucccaccguacauuuuuuuggaauacugaaaugucccuagggggaagaaaggguugaaggaagguggcgugugucugaggacagaugaauuucggagaugccaccuaugaagcuccugcccagagcaccccugggccuccaaagagauguuacccaucuggggaagaggagcugggcugggccaccuucucagcuucggagacagacucuggugcauucgcuuacccguuucgcaccuuugcauaagacacugacaaugcaugugagucugugaaagcuucugagaagucucguccaggcaguuguuugacuuugcagaggccgaggcuucucaaacuccuucggcaagauucuccuggaacaccuauuaauacugcacauugggacacugugaaaacgcugguuuggcuuguccccagccucauacaggggcuggacccggggcccucuuccaugguuccuccuuccauuagcagagucgacagggcaaggaucuuggacaauccgccccuacccucuccccuguuccuugugcucuggccccaguccccucugcuggagucucuacauuaauguuuaaucccuccuguuccuucccaggggcuuagcagggcaacaagauacccccaaccugagcaauuguuaaccucgauuucccacccaaaccucccuggcuggggcucagagcauucucagagagcaaugauggguggccaauaacacaggacaaucauuaacacaccaccccgaccucccggcccaccccccagaacagcugccauaucaggggguugaaccugggaucagaaggguucccagcuccccauuccugguauaugaggagcccagcuugcccaaugcagguggggcaucccugggaaagucgggggcauuguccuccaaagggcuucccaauuuuguugacauugccccagaaacuagauucccaguuggugugcuucuugggccuggauacaauugcagaaagagauuggggcuuagagagagacagaaauuugccugaagucacagagcaaguuagcgacagaacugggauucaaauccaggucuuccgcuucgcgaugugaaggccacuggagugacugaugaaagacuugcacagugcccagugcgcaggaggcgcuuggcaaucagcauccucggccucccuccauacuggucauggaaaguggauuuucccucccaggcaguuuccucuuuuucuguuuuccucacagguuucuauccauggggaauagaaggggcaaggacaaguggcugcccaggagcagcuagagcuagagaggaagucaagauguuugcucauucauucauucauuuccccuuuccuuccuucauucaaauauuuauugaaggcuuauuuugugccaaauaucuucagacaaaugccuucuuuccucuaacaacaauuucaccuccuuagaggccuucucugaccuccccaucuaacguagccauucuugccccauugcucucaccauccuuuccacuccccucccucccuccuucccuuccucccaccuuuucuccuuccuucuuuccuuuaugcugugaucacccuguguccucuguacuuauuuguucucuacuaucuguucauccucucuccuauaaauguuaguucgaugagauuagagaccuugucucucguuuuuaaacauugugccuccauugucuuaaaaagugucuggcauuuaguaggcauuuaggauuugauaacugaaagaaugaacaaucaaauuaaugaacaaacaaaggauuuuaaccuucuaguuuggcuugcuauggaaccuccaaacucccuaacccaaccuugaagaugagaagaugagauccuugaggcuaccagccuggugcuguuuuguuucaagccauccuuugguccucaggcaagcacuaaagcagauggcucucagugggcuggcuauguccuucugugagcuugcugggccccuaccuaugacuccagucuuagaagucuugccuuguacccccugcagagaaugguuucaucaagcugauucucugccaggggccagugcucauacauuugcucugagaaggaccagcccugagaccuaacauccacauccaaguucuuguaaugcccucucagaauccuggaguccugcaaugucgaucccuggagggaucugccagaccaaugauuucccaaacagaauugcacuucagagucaacuauggagcuuuuuaaacacagaucccugggcccacccuaaacauacaaaaucaggaucagaaucucagggccuaagaaucuguauuuucaggccgggcgcagugguucacaccuguaaucucagcacuuugggaggcugaguugggcugaucaccugaggucaggaguucgagaucagccuggcaauauggugaaaccccgucucuacuaaaaauaaaauuagccaggcaugguggugcacgccuguagucucagcuacucuggaggcugaggcacgagaaucacuugaaccugggaggcggaagcugcagugagccgagaucaugccacugcacuccagccugggugacagagugagacucugucucaaaaaaaaaaaaaaaaauagaaucuguauuuuuacaaagcacccuucauaauucuccauagcugguccaugggugggaauuugggacccacaguuuuggaacuuuuugggaucauagaccuuuuugagaaucucaaaaaagaaaaaaaaagcacacagaauguugcuuacaguuucaucaggcacacagaagaggcccagcacgaagcaguuucuugcccaaggacacagcaguucaaggacagagucagcgcgaggucucucagcucugagcacauguucuuuccccuuccagguuucuaguuuuauggguaguaguuuuaugaugcccauuucacaguucaggcagguagaggcagaggggagcauuaagcugacuugcccagcgucacugaguuggcuacgggcagccuucccaaggguacagauggcaaacacuguuccuucucucuuucagguggcccugcucagagcccaugcuggcgagcaccugcugcucggagccaccaagagauccaugguguucaaggacgugcugcuccuaggugaggcggcugccugcccuggccagggcuccagggaggguaugccuagcauggcacucacccaggcaaggagauucacaugguggcaugcaagggugagggagacuagucaggaguggcccuguccucaggcuugcauuagagggcuccaggacucaguuuucaacuggguaccccacucagaugcaaggaaauguggaugcaagucaccaaauucccagcauugaagucagagcacgaucaggguuaucccuggaauuaccugugcauccuuuuuucuuuugacagagucuugcucugucacucaggcuggagugcaaugaugugaucucggcucacuucagccuccacccgccacguucaagcaauucuccugccucacccuccagaguugcugggaccacaggcgugcaccaccacacccagcuaauuuuuguauuuuuaguagagacaggguuucaccauguugaccaggcuggucucaaacuccuggccucaaauaauccacccgccucagucucccaaagugcugggauuacaggugugagccaccgcgccuggccuaccugugcauucugauguucuuucuggaguaggagcaagaggugguuaagaauggcacaaagccccagcccgcgucaccugugccuucauggcauaguuauuauuuuaaacgcuuguacagcacacacugugugccagggacugugcucacugcuuugcaaacacuaccuauuuuaauauaacaaugcuaugagggaagcucgauuauuuauccucaucuuauagauaagaaaacugaggcacagagagguuaaguaacuuauccaacuauaaccagcuaucaggggcagagccauuuaagcagggcagugcaguuccagaaucugguccuuuaaccuugaugcuuuggugccuaucaggugaccuuugaaugucaucgaucuugugagucauguugguaaauggagcuugggucaugugaaagagguccuagaaagccaaguuccaagcucagccggaugacucaaggcagcuuaucuucugaaucugggccucagcuuccuuaccugugaaaugggagucaccaucccugcagguccuccucccacaggcaccagcuaucuugccaacuuaaaagccaaaacuagaggagaggggucaacccaaggugacuucccauccucccucccucccaacccuuccaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagguacagugcacaccuccuaagccaucccugacucucucuccagaacgcucugccagacuucuccuauuggguucuguacacugaguucacagccucaucucauguuaacgacagccaggagaggccguuuucauuuaacagaugaggcaagucaagauuugaagagacaauauggccgggcgcaguggcucacaccuguaaucccagcacuuugggaggcugaggcgggcggaucaccugaggucagggguucaagaugagccuggcuaacauggagaaaccccaucucuacuaaaaauacaaaaauuagccaggcaugguggugcacgccuguaaucccagcuauucgggaggcugaggcaggagaauugcuugaaccugggaggcggagguugcagugagccaagaucccgccacugcauuccagccugggugacuccaucucaaaaaaacaaaaacaaagggaggauaugacuugacagggcacccugacuccaaaggccugggcuuucccuucuuuuacuucuucccuccauccuucuuucucuuuacuucccaucuuccucuuuucuuucauauuugcuucuuuuccucaaaaaaauuuaucaaaauaauaucuagaaccggaugugguggcucacaucuguaaucccagcacuuugggaggcagaggcaggaggaucacuucaggccaggaguucgaggccagccuggccaacauaacaagaccucgucucuauagaaacuaaaaaaaauuagccagggauaguggugagcaccugcagucccagcuacucgggaagccaaggugagcaccugcagucccagcuacucaggaggccaaggugggaggaucucuugagcccaggagguggaggcugcugugagaugugauugcaccacugcacuccagucugggugacaaagcaagaccucaucuaaaaaauaauaauaaauaaauaaauaaaucuacacauacuuaaaaugcaaauacuucuccccauccuacuuuuccagcucuaagucuacuccccaagagaagcaugucugauuauuuuaauuguuucuucuggcaguuuccucaacaauucuaaaugaaagacaaagccuuauauuuguugaugcauccauuuuggaucauaauguuccuccuaggauggcagaggauuuugcuuuucuccaucaccauucccaucuuuucuuccccauuuuucccaauauauuuuuauugcuauuuuugagucucuguugcaaguuaugugcuuuuaucuuuccuuucuuguucuaucaacuguagacgguaucucccaacccuucacauugcaggaugaagaaaaagcauuccuacccucuccuguggcucuuggcucuccucuccccauucuguccacugacuuuugcaccugcauuuauacagaaugcauuugucaucagucuuuguacaaaacuugcuuuuguuucccagcaucaaaggugccugaacucuggaggcuugcuugccuucccugcuuacauguuagaggggaccuacugugugccaggcacuguccuucacgcugcaaauagauuaccucuaguaauaauaguaaugaaaaggcugggugugguggcucacgccuguaaucccagcacuuugggagacugaggcaggcagauuacuugacgucaggaguucaagaccagccuggccaacauggugaaaccccgucucuacuaaaaauacaaaaaucaguuguguguggugguccgugccuguaaucccagcuacucaggaggcugaggcaggagaaucgcuugaaccugggaggcggggguugcagugagccaagaucaugccauugcacuccagccugggcaacaagagcaaaacuucaucucaaaaaaauacauauauguguauauauauauaauauauauuauauauauauaauauauagugauauauauaguauauagugauauauuacguauaauauauauuauauauagugauauauauuuuauauauauauagugauauauauuauauauagagagagugaugaaguggaagaugagccccauguauugaaugcucccuaaagagcuguuuuuaaacacuuuauguggauugucuuacuuaccaacaugguaccugugaaguaggaauuauuauuaucuccauuuuacagauaaggaaacugaggcaugauuaacuugcucaaggucacacaaccggaaaauggcagagcuuggauuugaacuucagaccaccugucaaucccaauuucucucucucaagcccacauucuuaccuaccaccugcuaucccacacuuaccagagggugagauuucuaguucuaguucccuccacagccuggcccagccuguauccucuguagugcucaacacgaggcuggacuggcagaauuguucugcaaaaugggaaggaucacugaugcugagucagaggcagcagccuccagcaauuugaaggggcgggggaccuaguucaaggccuggcaugcaggaggugcucaauaaacauguguggccugaaugaacuaaugaauaagcaugauucaguggagacagcccacuagaaaugugggugaauguucuuucugccacuuccuuuguccaugaaagaggaaauaaaugcauuaccuccaugaagguugagauuaaauauuguaugaccgcuuaaguuccuuucuaggcuaaggaucuagaauuuauucacugauuuuuuuuucauucauucauccagccaucuaacaaaaaauauacauauaguuaucaauaaauauauauuuauauauaaauauauauuuuuuaaaauauauauauauauagucugucacccaggcuggagugcaguggcaccgucuuggcucacugcgaccuccaccucccaguuucaagcgauucucccaccucaccuccugagucgcugggauuacaggcaugugucaccacgccaggugaauuuuuguauuaucaguagagaugggguuucaccauauugaccaggcuggucucaaacuccugaccucaagugauccccccgccucggccucugacagugcugggcuuacaggcaugagccaccaugccuggcccuauucaauaaauauugacuaugcauggugcuagguggugaguuugaaaaggcaaaggccgggugcaguggcucacgccuguaaucccaacauuuugggaggcugaggcaggcagauuacuugaggucagaaguuugagaugagccugaccagcauggugaaaccccgucucuacuaaaauacaaaaauuagcugggugugguggugugugccuguaaucccagcuacucgggaggcugaggcaggagaaucgcuugaacccaggaggcagagguugcggugagccgagaucacgccacugcacuccaggcugggggucagagggagacucagucucaaaauaaaauaaaauaaaauaaaaauggcaaauaagacauacgcgugccccugccaaacucacaguuggauggcacaacaauuacauccuguguggucagcagugauggaggggccgcagagauuuggaaacaggagggacacaggauacagauauaggaggguagaaggcagacuuccuggaggaggugaaaccuaaccugagucccuaaggugauaggaagcaggaaccagggaaggggagccuauucuaacacaguagaagcagcaacugcugaggucuggaugaggggaccucaacuguggcccaaaaccccaaguucccauuguggcucugccaacaacuggcugugcgacccaggacaaguccuaucuuugcacugugucuggguuuccccguguguaagaugaggcgguugcuaggugcuuauuggaugcauuccucaagucccgcccuccaucuccuauuccccucucuucugguuuagugcuuuaggaaauguggcagaaaucuuuuucugccugugucuaggaaaucauaauucaugcuggcguacccugguuguugaggucccugaauccuugugcccacacugcugaagacuccuugugugauacaagucaggggacaucugggucuugacuccccagaugcuccagcuggacccugcugcccucccuugcccacccucuuccauuguagaugccaaggggcugagcgauccagggaagaucaagcggcugcguucccaggugcaggugagcuuggaggacuacaucaacgaccgccaguaugacucgcguggccgcuuuggagagcugcugcugcugcugcccaccuugcagagcaucaccuggcagaugaucgagcagauccaguucaucaagcucuucggcauggccaagauugacaaccuguugcaggagaugcugcugggagguccgugccaagcccaggaggggcgggguuggaguggggacuccccaggagacaggccucacacagugagcucaccccucagcuccuuggcuuccccacugugccgcuuugggcaaguugcuuaaccugucugugccucaguuuccucaccagaaaaaugggaacaaggcaauggucuauuuguucaggcaccgagaaccuagcacgugccagucacuguucuaagugcuggcaauucagcaaagaacaagaucuuugcccucggggaggcugugugugugugaguauguauggaugcguggauaucuguguauaugcccguaugugcgugcauguguauauaaagccucacauuuuaugauuuugaaauaaacagguaaua

SEQ ID NO: 61632 - RNA, 31590 nt, Homo sapiens; identical to SEQ ID NO: 61629

SEQ ID NO: 61633 - RNA, 23830 nt, Homo sapiens
augguccgaggggggcggggcugacgucgcgcugggaaugcccuggccgagacacugaggcaggguagagagcgcuugcgggcgccgggcggagcugcugcggaucaggacccgagccgauucccgaucccgacccagauccuaacccgcgcccccgccccgccgccgccgccauguacgacgcagagcgcggcuggagcuuguccuucgcgggcugcggcuuccugggcuucuaccacgucggggcgacccgcugccugagcgagcacgccccgcaccuccuccgcgacgcgcgcauguuguucggcgcuucggccggggcguugcacugcgucggcguccucuccgguaucccgcugggugcgucuggggacgcugcccgggcuccacgugcggagugggugcccccuaggccggggagcgggggauccccaggggucgcggggcccuggaggagcgggcaucggacgcggacacggcggggugcaucccgagggcccccuccgaggcagaugcuuccugcgggggcgcuguuccugggcccgggaagggggcguuggaaccccgagcgguccgggccgaagccugggacucucgugcguccccaccccuacccccaucaggcgcccgugcaugaagggagacccucaccuccggacugagagucggagcgucucggagcgacggggaguagggagcgggacccggggcggaggguagugcuggccccugcggacuccggguccccuguguccucucgggaggggcuggacgggcugagcugccgaggggccgauuugcccugggccggacaaagaguggggcuuuggccggucccccacggugggcuccuucccucuggggauugagggacucaagacaccccgcgccugcgcuuuucuuuucuuuuuuucuuuuuuuuuuuuugagacggaguuucgcucagucgcccaggcuggagugcaguggcgugaucucaacucacugcaagcuccaccucccagguucacgccauucuccugccucagccucccgaguagcugggacuacaggcgccagccaccaagcccggcuaauuuuuuguauuuuuuaguagagacgggguuucaccguguuagccaggauggucucgaucuccugaccucgugaucugcccaccucggccucccagaaugcugggguuacaggcgugagccacugcucccugcugccuacgcucucugggucgcagcccagccuucugggggcuggguagccucccagaagggcaacccugggcauccuccagggcaggcuaacuggagucuaguggggagggguaccuugaaagaggaaaguuguuuccuccuccuccuccuccuccaguguuugggacccuuccugggggcuggagugcaucccuggacaccccccaaucccauccucuucucuaguuuccacugaccuaggcccacccuccccucuccggcucaguacuccuggaaaugagauuccguacauuugaaucuuguccuaaugaaauauuuguccauguggguaccuguguguguguggugggggugcagacggaggguuuguuucucacuagcuggaacuacuggggugugguaugcuuccugggaauuugugugccacaguccuggaggcgaggaggggguugugagccaguaggcaggggcuggggcaaguagcauugugaagcuauugacacccagacguccccaggcaggagauuaugcccccauuagcccccuuuuaucugggcuuccuuaacaauggacucuuugcccugccugccagagccagcagggagugacuguucaguggugaggaagcgggcagaggaagcccugccauuggguaggagcagugggcagccccugggcugacugggagguggggauuagggauuagacaguccuggcugucugccuuccccuaagccagggggagaggagcaaagggcacgaaauguggccuccaggaggauuagaccgccacaugaucauuugcacacccugggguuuagcaacaauaaaagucagcuuuuuuguaucccaagguggccuguggacacccacauggacaaauguuuacacugggacagaauucaaaugcagaggucccaggagccuaaaguacacucacucugguauagaaaggauuccuuacugggcagaggacaggugcagccuggggcuuucccaggcaggacacagggaggcucaggaaccaccaagucccuggaagguggaucuggaggcguuggcaggagccacucccuggguuccagggcuccagguuccugcuuuaacccccugucucacagagggcugugcacuugggggcugcugagcaugucccagaggcugcauccuggacacagcaccucagugcaucugagcugaggcuaacuuggcaggagggacaggcagaaccugccagccacgugcaauuccaccccucuggccacucagggaaggagagcugugagucaagaucagauuugggucaggacaggcuggggccugccugucccugugcaucccaagauuuauggcuggccagggguugggcugggagggguggucuugcaugccaggagagugcagaucagccugagaggccaggccaguaagugaggucagaucuccugcaccugauagcauuaaggccaucuacaccaaagcucuaaugcugauauguuccuggccucuauguggggcauggagguggggcauggaggugaggccugcucgccugggcuucuggaagugggagacucauuccuguggcugaggccuacagcagugcugugugguaggaauacacuggaagccaugaugucauugugcauuuucuagaagccacauugaauaaaguaaaagacacagguagaauuaauuucauugagcccaauauauccaaaauaauaucauuuucacaucuauucaauauaaaaauuuacuaaugagauauuucauacuaagccacugaaauccaguuuguaucuuacacaucucaguuuugacgagccacauuucaagggcgugauagccacauguggcucccauaguagacaguacuggucuagagaaauguugguggcauccuugcugucugguuucuggccuugccaaaaguauuaccaucccagugugguacauucuuucauguauuugucuccuguccccagagcagacucugcagguccucucagaucuugugcggaaggccaggagucggaacauuggcaucuuccauccauccuucaacuuaagcaaguuccuccgacagggucucugcaaaugccucccggccaauguccaccagcucaucuccggcaaaauaggcaucucucuuaccagagugucugauggggaaaacguucuggugucugacuuucgguccaaagacgaagucguggauguaagcaguuugcuuaucuggacguugucaaguuagaaaagcuguuuugggaugggugugguggcucaugccugucaucccggcacuuugggaggccgaagcggguggguugcuugagcccaggagcucgagaccaacaugaugaaacccagucucuacaaaaauuacagaaaaauuagcuaggcaugguguugugggcccauagucccagcuacuagggaggcugaggcaggagaauugcuugagccugggagguggagguugcaguaagucaugaucaugccacuguacuccagcccgggugacagugagaugcugucuggaaaaaaaaaaaaaagaaagacuguuuuguuuuggaagcaacacaggcaguuguaggcccccugugccagagugacauaaacucuguacaccuccagugauuugguccauguuuguaaacccugaauguuccagggcaguuucuuuucuucacuuuuuaucucuuuuuuuugggugggggggcgggguacagagucuugcucugucucccaggcuggagugcaguggcgcaaucucaaccucccgaggagcugggacuacaggcacaggccaucacaccuugcuaauguuuguacuuuuuguagagacgggguuuugcccuguugcccaggcuggucccaaacuccugcacccaaguaaucugcccaccucugccuggcaguuacaauuucaaauaauuccucccuuuccuucaacacuuggcucaugaccguccaguccaaggaaccuguccugcaggugugccucucccgagcuuccucuaugcaucuuccauaaugaagaugccuucucacuggaaacccuacaagggugggaacgugccuuauuugccuguauccucagggucuagcagagagaagauaauuuguaauaccaaaacaccauuaaauucagcugaugcuuucauaagcgcuccuuggaggaaggacuccauuuacuugacagaucugugcaagacagcagccuggcgcgucuaaccugcagccaguugcauccucuguuuaaccuuguuugcggaagcuuucucuaaacagccagcacuugucuguucccacauggguccguucucccagugaaucaccguggugccugcugacugcucuguagcacagugcuucgcaaagugugauccugggaccagcagagcagcagcuccuuugagcuuauuggaauggcagacccucaggucccaccucugaccugcugcaugggaauucuggggagggacgcagaaucucugguuccacaggcucuccggugaugcuaaugaauaccggcauuugaacagcaccgaucuagccccuuucaguccaugagccaacaacccuugguccugucuguggugacccagugugacucucauggggagcaaggagaggaaguugaaguucacugacaggguuguuaaggggauuaugcaauagaugagacccaugggccugaaguccgaggguguauguuaguuccccguucuuuugacccauggauuaaccuacucugugcaaagggcauuuucaaguuuguugcccugcucacuuggagaaagcuuaugaaggaucaggaaaauuaaaagggugcucucgccuauaacuucucucuccuuugcuuucacaggccuugguauguuccugcuucauccccuucuacaguggccuuaucccuccuuccuucagaggcgugguaagucggcuuucucugcuagcgcugaguccugggggccucugaagugugcucacacaucuccugccugcagggcacuggugucgggcaccucagggucugucccaugguggagccccaugccucacugccuuucagacagaguagccacagcuggcccuauuuccaggcuacccgggcagcaaaacuuacugcauguguaauuaauuauuuggcuaucuguaagguaaacuggcugguucacuuaaucugcaccuuaagcaucagauagcuucucagugaucuaguuaaacuauaugauguuggccaggcgcgguggcucaugucuguaaucccagcacuuugggagccugaagcaggcagaucacuugaggucaggaguucgagaccagccuggccaacagugugaaacucugucucuccuaaaaauacaaaaauuagcugggcaugguggugugcaccuguaaucccagcugcucgggaggcugaggcaggagaauugcuugaacuugggaggcggaaguugcagugagccaagaucgcaccacugcacuccauccugggugacagagcgagacucuaucucaaaaagaaaaaaaaaaaaaagguaaauaaaguauaugacacugaagaaucuguuaccccuggaagguggagcuuuacucuuagggggaacuauaacagucauauauauauauuuuuuucuuuucuuuuuuuuuuuuuuugagauggagucuggcucugucgcccaggcuggagugcaguggugcaaucucggcucacugcaaccuccaccucacagguucaggcaauucuccugccucaaccucccgaguagcugggauuacaggugccugccgucacgccaagcuaauuuuuguauuuuuaguagagacaggguuucaucauauuggccaggcuggucuccaacuccugaccucaggugauccgcccgccuuggccucccaaagugcugagauuacaggcgugagccauggugcccggccaacaaucacauguguuguaaacaacaacaaaaaucugucagccuggucuaaccuagauuugugcuuuguuuuguuuugccacuuugugaugcacaggaggaaguuuaggcuguaaaauacuagccuuuuaggguaauuuuugaacucacaagagcagcagcggaaccuuugaugcaauccuguauguagcaccagcagagccacguggcagagggacucgcauuaggagccucccauuacagacuacgugcuccugugcguuaucuuauaggguccccacaaccaaggggagaugugauuauucauccuguguggcuguggggaacuugagagucauacuugcccaaagagcacggccagcgagcuugcacccaggucacucucugcuccucugucagaacagggcaugucuugguucacugcagggcggcucuucucauucucuguaguuugggguccaggauagugguccacggagccacuggagugcccagcuacugagugaccaaagcauauuuuggauuuccgacauugccacagcaugguugggcaucagcaggaccccaaccccuuguuaugcugguggcuuuaugugguuauuugaucuuccccagaacucagcaggagugcacccagcagcaccguagugaugcucucuggcuccccagugcacgguucuggcuuuccuuccuggucgagaguuucaagcccucuggguccuacucuguccuuuucagcccauagcuuuguucaaaagcugcuggcaguguucagauuuggcugaguucagugaauaugugcauuggcugauuucugagccaugccagggggauggagaagccgaagcaggaguguuuguucugcaggcucuggaguaggcauugggucugugccggcucacuugcuagucuugcauccuuccccaacccccucuggggaugucuggccacaucagaagacaguuuggguugucagaacugggggaguaccaggccgagguggguggaucaugaggucaggagaucgagaccauccuggcuaacacagugaaaccucaucucuacuaaacauacgaaaaaaauuagcugggcgugguggcgggcgccuguagucccagcuacucgggaggcugaggcaggagaauggugugaacccggggggcggagcuugcagugagcugagauccugccacugcacuccagccugggcaacaaagcgagacuccgucucacaaacaaaacaaaacaaaacaaaacaaaaucugggggagugccacuggcaucugauguauagaggcccgagaugcugugucaucacccguugagugcgcucauaggcaucuuccugacaauuagaacccauuauucuucaaauucaaugcaagcaaauucaaagcauuacuguguacauaccgcaugcuaaucaauugcaccacuggagcuccuaaauucaaaacauuacuauaaaaaaguucaaaaugcauggaaaaguuguacauggcaggagaauauuugggcuucugacuaccccuugaaugaagaugauccaccagccgccuuccuccuuggucuucacuccagauuccuagcauuucauucugugucucuuuaugcagugagguuuuuguuuguuuuuugagacagagucucacuguaucaccuaggccuggagugcaguggcgcgaucucagcucacugcaacccucggcuccuggguuuaagcgauucuccugccucagccucccgagcagcugagauuacaagcacacauccccaugcccagcuaauuuuuguauuuuuagcagagacaggguuucaccauguugcccaggcuggucucgaacuccuggccucaagugauccaugugccucagccuuccaaagugcugggauuacaggcgugagccaccaugcccagcuccuagugagguuuuugaugccuugcuacaucugcccuagaaauugugugacuacgauuuuggaaauguugcuguguaaacuugugaucauuucuggacuccaggcaagaaucuugauggcuaagguguggcugaacaugucugauucucuccuggaccuguuuuaggccaaacucugcucugaaauuccuccguguggaagggcgggcuggggagagccucccagcuggaaucuuuuggaugccuuucucuguggguaucugauggcuggcucugauggcuggcugugauggcuguggcuggaaaucauuguugacaugaguuucacagaugcaggcucuguccaaauuguagcaaaagcugccugccccagccgagcuaugggcaauaaggugguuuaaggauauagaugaaggaaaacucacccuuagaauaauuuauccaaaaugcugcuguguuguggguuagaggacauuuucugaggucccagguucauuguuucauuuaagucucaaaagucccuccagguguugguucuaauugucaaagcauggggggagaugggcucauggguuaaaggucuuaucccagauuucuguauccuccuugcaagcagcaaaggggucuggauuugaauccaugaccauguuucuccuuuggguuuccaucacacucuguccccgugcacugagcacccuuuaguucauaugacccccuuaggcauguuacaugggcacuccuauaggugcccaucuggcccuaggacuuggccaacacaacauggacuccaguuuccaucugccucuuugccaggcacuuuugugcagugcacacacuguacaacaguagacggcaacccugagagccagaguagagccuguccuagcaccggaaugcucgguaaggauuugucgcaggagugauuccaaagccaauguccucccuccauaucagccuguuuguggcucugagaagcucugcccacaugugaaagcuuguuaagcacuuaagcacuaacccagagcuucagacagugccaguccuuuuuccccuucuuuaaaagcgauauguggauggaggagugagugacaacguacccuucauugaugccaaaacaaccaucaccgugucccccuucuauggggaguacgacaucugcccuaaagucaaguccacgaacuuucuucauguggacaucaccaagcucagucuacgccucugcacagggaaccucuaccuucucucgagagcuuuuguccccccggaucucaaggugaguugguggugagggggcagguguucuggggugcagcucuucuuugccucccugauugccaggagcuaccaguuacugucugcacaaucaaacagaaauagaccuguccuugaugguuaacggaaauaaaaggcgcuugucccagaagcucaggugaggcaccacccugauuaugggaaucaccugggaacauauacccagaccuaaaacucagauccacuucccaggcugugguuauauagucaggggggugcaguauggguauuaggauuuuuuauuuuuuaguuauaaagauuuuuuuuugguuuguuuuugagacagggucuugcucugccgcuuaggcuggagugcaguggugcaaucauagcucacugaagccucagacuccuggguucaagcaguccucccaccucagccuccuaaggagcugggacccacaggcaugcagcaccacaccuggcuaauuuuuaaaaauuuuguggaguguugcccaggcuggucucacacuccuggccucaagcgauccucccaccccagccucccaauguguugggauuacaggcaugagccauuguacccagccacuaagaugauucuuauuuggaaacacggucaagaacaacugcguucgguaguuuaaccuuuuuugauuguggugguuuuaguaugccuuaccacucuaccauaguaagaaauuugcagaccauguacaccaaccuuuggugcuccuggggagaaagaaagaaggcuaugcaaugcaaugcaugcucacaguccaagggagagggaaagcugucuaacaggauugguuuucccgugugcuuuauaagcagaugaguagaggagacagcucuuauuguccuaguggcaauugggauaggcugcaaaguuuguuaggguggaggcuuauuccgggaccaagggagcccaaagaaacaagcuccugccaggcgcgguggcucacgccuguaaucccagcacuuugggaggcugaggcagguggaucaccugaggucaggaguuugagaccagccuggccaacauggugaaaccccgucuccaugaaaaauacaaaaauuacccgggcaugguggcgggcaccuguaaucccagcuacuagggaggcugaggcaggaaaauggcuugaaccucggaaguggagguggccguuagccgagaucacgccacugcacuccagccugggcaacagagcaagacucugccuuaaaaaaaaaaaaaaaaaaaagaaaaguaaaaggaaaaaaaagaggcucuggccugcuggggugccugcaaagucuccguggaagggugacauucaagccgagaccuccagggaacugucuccugggagcacagagcccuuugcucagcccccagguggcucagugcccccagccagcagacucagagcuugcaugauucuuuggugcucucugcggucuuccaaugaugcugaaauaaauggugcuuggugucucccugcuguaguccccuugcuugcuuugcucacaggugcugggagagauaugccuucgaggauauuuggaugcauucagguucuuggaagagaaggguauguaugggcugggaggaucagccaugcccuuuugacaagcauuuacuagcggucuugguaaagacuugagauuugccuuaguucuaacacuuagugcccaacgccuuccuuguguugcucaaccuacucaugagcccaggagauaggaaaucuccgucccauuguacagauggggaaacagaauuuuggaaaggagagccaagcagcacacaccccucccugaggggcagagccgagauuugaacugggaugucaugacuccagggcccucucccuccccaggguccccuuaucugaaggcgguuuuucuuuccagcucgaccucuugugacccuuaguuuaacaagggccgaaguuaaagaguuucugcgccuggaccccaaaugaagcaaucagauuucucaucuccagucagguguggguccaagcccacuagacaaguuugcucuucccagagcacauuucugccuucaagucauccuggcuugucagggcugggggaguucugcuguagaaauauuagaguggaaggaaaaagauguguugggagcuauuuuucuuuaauacuaaaaguugguugaugaauuugucguuggccaagaccaaggagacugcauuuuuaaggacauauguguauuuaucugcucagaaaauguucauugcugugugcuagggauacugcagugaacacagaggugugacccuugccagccuugugagagaagugagcagauaaguaagcagaagggugaugcugugucgaugggaaaguacaggugccaaugagaaggcacaggugucaaggagaagacacaggaugcuggaggcucaugcaggauggaucuccaaggcccaggggaagaagggccucucggaggacgugaauccacauuaagacuuuggggauaaguaggagcgccuuaggcauggggacccauggaugcgaggccuguaggacacagacaggauggcaugaaggccugugcaacuggagggguggggauggggacacuaagagauggcuggaaguguggggguggggacacuaagagaugacuggagaagagggggucaggaguggugaaaaaugggagaggagggcaggcugggccuuuuggauacagggggauugcauccugcagugguagggagccacugagggcugcugcaguaggagugaggggaucagaggagagcuuuggaagcccccuggaugcgggacaggaagcgagauaccagugucuaggaggccagugaggcagccacaggcuccaccaggaucagggcugcgagggucaugaggaggaaaccaauuugaaggaguccaggggaauaggacuuggaaaugaccgaugggacauuugggaagaggaagacagaagagcgcagucccggcuucuggcuuuagcaguugggcaaggggagauggggagaugugcccauggguugaggguugaggacauuaggagggagccgguauggcaggaagagcuggugugccagagaugcuggaagcagcaucugccugagaacagauaccuggcaauauuccuaagggaaagugacaucucggagggugaggagggcaucugauagggccuggaaagagccggggcaagcaugaaugugagguuaucuuggggggcaaggcucaggcguugaggagcagccccuggucucuucagccugaaguuggaagccagaguugggccaggugcagcugugguugucugaagucccccucccccagcccagugugccaaugcuguaagagcaagggccgcucacuggugcugguggcugagucccagcacccaggacagggccuggcacauacuggugcccaauccucccuucugggugcuucuuccaaggccuugugauggaagugaguacccucuucgacaucagacccagcuucaaauccuggcucugcuauguauuggcugcguggcuuuagacaagucuuuuaaccuugcugugcuucugauuucucagcugaaaaauggagaugaugauagugguuucuguaaggccuuauggugaagcaccuagcucagggccuggaaggcagguguaaccagugguucaguuguuauaaaccaacacuaacccucgccuuugcaccucaugaaaccagauauguagauggagcccacaaagcuagcaggagccaagcucacguguguccugcuuuaaagccccauaccccuuucuccgggugacaaacaccugugcucguucucuucccuuccccucuuccccuugcauuuggcuaauaacaggccagcugccugccucccugcaguuugguagauggguggguaacgaccaccacucccacguucgccugaugggcuuguuuuccgugcccuucacaggcaucugcaacaggccccagccaggccugaagucauccucagaagggauggauccugaggucgccaugcccagcugggcaaacaugagucuggauucuuccccggagucggcugccuuggcugugaggcuggagggagaugagcugcuagaccaccugcgucucagcauccugcccugggaugagagcauccuggacacccucucgcccaggcucgcuacagguacccacuccucggggugagcacgggcagcaccuuguuuucuuucuugugcauuauggaggaagaugguacugccacaugggagcgauagggugaggcaaccaugacaggugguugggaacaucuccuuccauguguacagccugggcugcugccaucacucccagcacagcccccaacccccccaauccuggaaccuugccaagucucccuucccauggggucaugaccaggaggaaaacaaacuccagcugagccccuugggguuccccauauaggcuccugccuguggcagcugggcccucuguaccccuuuccaacucugucucccuaacauggcaccugagcuccugccauccuggauuucauggaccccaaggauggggguccugcaucugggacuuggccuauuacucggagcuccuuuucagccgccucccuccaccuguccacccaccucaaggcuccuuucuugagaccucuccuaauuucucccuuccccuaaacccacaauuuugaaccuccaucgaauggugcuguauuuuauaaugucaucaaauaucaaauggagacagugcuaugguccaaaugauuguguaccccccagaauuugucuuuugaaauccuaacccccaacaugauggucuuaggagguggggccuuugggaggagauuaggucaugaggaaagggcugucaugaaugggauuggugcccuuauuaaacagacccaagagaggucccuugucccuucuacugugugaggacucagaagguggugucuaugaagaagcaggcccucaccagacaccaacaugucugcugccccuugaucugggaccuugcagccucuagaacucugaaaaaucgauguuuguuguuuuauaagccacucaguugguggcauuuuguuagaguagccugaacacggacuaagucaaacagaagaacccacaaaccagcuacagaguugggcauuuggagaaauucaaaaaugagucagacauaacuccuuauucuugaggugcccuaagagaugggacacagcagcugcccaggugcauuaguuuguucucacauugcuauaaagaaauaccugagacuggguaacucauaaagaaagagguugaauuggcucacaguugcacaggcuggacaggaagcauggugcuggcaucugcucagcuucuggggaggccucaggaaacuuacaaucauggcagaaggugaacgggaagcaugcacaucccaugacuggagcaggagugagagagagagggaaauagagggaaggugccauacacuuuuaaacaaccagaucucaugagaacacauucacuaucaagagaacagcaccaguggggaaauccgcccccaugauccaaucaccucccaucaggcuccgccuccaacacugggaauuacaauuugacaugagaugugggcagggacacagauccaaaccauaugaccagauuaauacgauuugaggcaucacgaggucauuaaagagagggaauaaaagacuggggcuccaggaagaaggcucuggaauccagcagagggucaaggaccagcuuguaaagcugguggugccugagaaguaccuaggagaacauagaugcugugacguuugauguagcuguuuuuuguuuuguguuuugguuuuugagacagagucucacucuguugcccaggcuggagugugcaguggcgugaucuuggcucacuggagccuccaucucccagguucaaaugauccucaugccucagccuccugaguugcugggauuacaggugcacaccaccacgccuggcuaauuuuuguguuuucaguagagacaggguuucaccauguuggccaggcuggucuugaacuccugaccucaagugauccaacaacuucagccucccaaagugcugggaugacaggcaugagccaccaugcccagccugauguagcuguuucugugcacauuauuugcugugggguauauucagauuucuuaauacaagaugauucuuugccucaugacuuacacaccauuuucuauuuaauuucagcuaugauauuggaaauggacaugucuuuucaaggaaaauaaaagcaggcuuucuggaauggcgacuuccaaacauauuugucaauuuaaaggagcugggaguggggacccuaugcuccguaagcacucucuuagcuguucuuggcugugcuccccgcuucagcuucacacugcccuugcugugaagggagcagccugggccgggcgcgguggcuuacaccuguaauccuagcacuuugggaggccgagguggguggaucaccugaggucaggaguucaagaccagccuggccaacauggugaaacuccaucucuacuaaaaauacaaaaaauuagcugggcaugguggcaggugccuguaaucccagcuacuugggaggcugaggcagaagaaucgcuugaacccaggaggcggagguugcagugagccgagauugcgccauugcacuccagccugggggcaacaagagcaaaacucugucuggaaaaaaaagaaaggagcagcuuggcaaaccccaccuugucgcuuuugugagugccucugacccuuuggcugccaggacgggcguauuuuauggaaaugcuaagcaccaacagaguaaagugguuugguuuuucacaguggugggagauaauagcuccaaauugucuuuuucagcacugagugaagaaaugaaagacaaagguggauacaugagcaagauuugcaacuugcuacccauuaggauaaugucuuauguaaugcugcccuguacccugccuguggaaucugccauugcgauuguccagaggugagcauuuuagguggcuccgugucuuccucacaggguugauaugaggaugaaacaagaugauagaucaugguggcauguagucugggaccuggauugucgugccacagaucacagcucacagucuaugugcaaugccccugaauguugcccaccuguccucaagccacacaugcaccuguaacucagugcaagcccagaaacuccccguggggacuccuagagcugucaguggccucacauagcagcugguccagucucuugugauugcccaaggaaacugaggccuggagagcuuggggucacugcucugaggccauagagaugccuaguagaagggccaggccuagaagcaggauccuugcugccccucugagcuguuuccauuuaaaaucacaugaaggccggcgccguggcucacggcuguaaucccagcauuuugggaggccaagguggguggaucaugugaggucaggaguuugagaccagcuuggccaacauggugaaaugccaucuguacuaaaaauacaaaaauuaguggagcaugguggcacgugccuguacucccagcuacuuggaaggcuggggcagaagaaucgcuugagccugggaggcagagguuguagugagccaagauuguaccacugcacuccagccugggugacaggagagaaacccuaucucaaaauaaaaugaaagguaaugaaaugaauaaaauaauaaaucaagucacggccgggcacgguggcucacaccuguaaucccagcgcuuugggaggccgagguggguggauaaugaggucaggaguucaagaccagccuggccaacauggugaaaccaugucucuacuaaaaauacaaaaauuagcugggcaugguggugcaugccuguaaucccagcuacuccggaggcuaaggcaggagaauugcuugaagcaggaccuaggaggcggagguugguugcagugagccgagaucaugccacugcacucuagccugggcuacagagcgaaacuccgacucaaaaaaaaaaaaaaaaaaaaaucaaaucacaugaaaguagaacauagggaauuccaucuuucguucuaggcauaguuuguuaauaugauucagagccagcaguuaggagaacacagugugacucuccuagaacuucuugauugggcuuccucugauuggguuuccucugauugggcuuccucugaaagugggggggaugggggguggggagcagaauggucagagcuuggcucagcagucagacugcucuucuucaaauccuggcugcauugcuuacuacagcugugugacuccagaugacugaauccaccucucugugcugcagcuucccgucuagagagaucaccuggagcagaggguggucaggagacucaaucugguuacugacucacagugcaggaguacucaucccauaguaagcauccagcuagagauguugauuucuauuuucagguaauaaugaugaucguaaaauuagagacagauaaaagguaugggcauuaggccagggcacugcaauuucuaagcugugugaccucaggcaaguuacucgacuucucugagccucagcgguuucauccgcaauauauggauaggaaaaccgaccucaguggguugucugacaguggagggcacuugauuaaaaaaaaaaaaauuacccuggucugaauauuacccuggacugaaagaaaaauauugagcuaauacaggcaucaggaauggggcugcagggaguccagggaagggagaacgaagagccugaaggugugaggaggugcgagugcugaucugucugcuacaaagaggcugcugagccuccuguggauguggcccuggacuuggcaguuuaauaccugagcuguuaaaauaaccucagaugcuguguucuuuaagggguaggauucagauuccugcugaaaugcuucugaaagggagggaaugagccagcccauccccaguugcuuuuuaagaucauugggaaguucuggucuugccauuugucccuggaccacucuuagguccuccugccccacuuccaucugggugugugcccugggcuguccaccacacagcuacauccugccaucuucccuccuggagccacugugccaugcauggaucuguagcuucauuuuucuuggcuuuucccugguuuuucuggagcagagucucuaguaaacucccaaggaagaaaacguuugacuuuauguguguugggaaacgugcuuuuuuucuauuacaucucagugauagguuggccaugucuagaauugcagguugaaaaucauuuccucucaguauauugguuagugagaagccugggacugagacagucacauucucacuucuuugcaggugagugcucuuaggacugucuuuuuaucccuuauacucugaaaugucauaugucuugguguaaguccuuauuucaguuauugagcuggacaaguacuggagaccccuucagucaaagccuucugucauucuccagcucuaggaaauuaucuucuauuguuauuucuguuauuccuucccuuccauuuucuuuuuucuuuuuuuuuuuuuuuuuuugagacagggucuuacucuggugcccaggcuggaaugcagugaccugaucaugguacacugcagccugaaccucccagacucaagugauccucccaccucaaccuccuaaguagcugggacugcaagcacacaucaccacacccaacaaauauuuuuuaaaaauuuuguaagaugggaucuuacuauguugcccagacuuuuucuuccucuuccuggggcucuuauuaggaagauguuugacuuccuggguuggauuccugucuccgugucugacuuucucucuuugucauauuuuucaucacucguugucuuuuugcgucugcucugacagauuuccucaaauuuugucuucuaguccuauccuacaguuuuuacuuucagcaaauauaauuuaaucuccaagaguacucucuuguucuuuuuucuuagcauucuguucuuguuuuauggauguaacauucucuuggaauauuugcuguccucuagaucaucccuucuccauuucuucuugggcuaguuuuucuguuucuucaucuuucucuuuuaugcuacuuauucugggcguguucuugguggguuuuuucccauauagcaacagaggacuuggagcucagggagaaaaggguaggugcaucaccuggcagagcucccagacagugacaggcaggcugcgggaaggaugucuacuuggcggugcuaccgcuuuccuagaaacccuuucccuggagcugguugaacuguuggguuuugcccugguggugaacgcuggcuccccgugcucugccuguuucaucaccagcccccuccccuucugccugggguccaguaaucuguugaaauauauaucuugcucauuggugagcuccugcuccuuccucguugcucuugcagauuuaucacuucucguaaggcugcgcuuguacuucgggauuuucucugugccacacugggaaacauagggugguugcaugcugcaguccugagcacuuauuucacucacaucuuuacacgaagauuugguggguguuuacuuuguuuuuaguaaguuagucugucauguccuuugauccuuuuuuuuuguuuuuugagauggagucucucuguguccuccaggcuggagugcaaugucgcgaucucagcucacugcaaccuccaccuccugggcucaagagauucuccugcuucagucuccugaguagcugggauuacaggcaugugccaccacaccuggcuaauuuuuguauuuuuaguagaggugggguuuggcauguuggccagccuggucucaaacuccugaccuccugaccugccugccuuggccucccaaagugcugggauuacaggugugagccaccacaccuggcccugauuaaucuuuuaaugcccagucucuccuucaaaagccggcuccuuucucucccucgccuuccuagauuccuucuccacuccccaggaucagccuccuccuccccaccccaccacugccggggggaugucuguggucaggcauuuaucagagacccugagguggggguccuuuaugugucugggggauggagagucuagaggagguagcguucagaccucuccauggugccucugcugggcucacaugugaccaagcacagcaaaccaugaggcaggggauggucuugaccaugagagcccuugcagcagcugccaugggccucagcuccucuccaagcugggaagagcccugaaaagccaagguguuuuuuuuucccucuuuauuucaguguaagucccuugagcuuucuugaaccagaagugggcucauuuugcuuuagagauuucaggugggcuuguccuuguccuagcaucccagauccaccuucugggaagucaucagauuggaggugauguuggcagcuuuuguaaacaaaggguaguguuguaagcuguugugucugccuauguguguguuuguguacuuggucucaucucugcagacuggugacauggcuuccagauaugcccgacgauguccugugguugcagugggugaccucacagguguucacucgagugcugaugugucugcuccccgccuccagguaaauacuuuggcugugggugugugggccggacgggcaccucucucaucugaugaggccucacacgacauucuagaaacagcuggcugaacaccaagcaaggagcuugcccuuggguguggggacccugucucaugggaggcagcugagucagucagagguccuggcacaccugcugagagcugccacccaggccaaccugaaccggagccugggaagacuucccgucggaugagucucuuugagugcagcauugaugguggaagagcagagaggccccagauaagcagggaaaggugcuucagacagaguggcugggaugaggacuggggagugucagauagcgcuggcgugucugagcgaaggagcucuggcacccauggcacaggaaggaggugggacccuggaggggcagggcuagcagagcuccucggagcguguggcuaggugccugguaaugcaagcccccuguccuccacccucuguuguacugagucacagucuccggggugaagccuagcagucugcguugacaggccccaggggaugccgcuacuuccugaauucugaauucuggaaacugagccggaguucagggccuggcucccauuaccaggguugggcguuauccugaaaaucauaggccuugguuuccucacuuggcuaacaggggugauccccauccccucaauggguuuccgugagcuccugagagcccguagcaugguacuuggcacaugcugggcaucaggagguauggccucucuugcuauuguuguuauugguagacacagaaggauuuaaaaguaggggaaugcaaagauccgauuugcuagggaagagggcaguaguggccaaguagaggguggauccugggcccuggcuggcagcaggcagcaaggggggcugccagggcccaggcagggacgaucuguagaccgagaggcuuccuaaggcucuuggacaggaggaggugucgguuccaagccuaaggaguggggcagcccuggugacugguggucaguggugccaggcggugggugguaggacacccuggcaggcaaguagguuugugugggggaaacugauaggccccuccagggauucguugguggacaacaccugugauguccagugggagguguccagguagcugggagggccacaggcuuggaagaccuagguggugacaucagcccagcacugagggcuagaagaagcugugucucuggcugugacggcacccuagaguguguguggugcccucuacuggccggcaauguggguccaccguagcucagacugcacacugcagcagcgggaacggccucuaagccaacuuccuccauguguuucaggucccaaaugccagugagcagccaacaggccuccccaugcacaccugagcaggacuggcccugcuggacucccugcucccccaagggcuguccagcagagaccaaagcagaggccaccccgcgguccauccucagguccagccugaacuucuucuugggcaauaaaguaccugcuggugcugaggggcucuccaccuuucccaguuuuucacuagagaagagucugugagucacuugaggaggcgagucuagcagauucuuucagaggugcuaaaguuucccaucuuugugcagcuaccuccgcauugcuguguagugaccccugccugugacguggaggaucccagccucugagcugaguugguuuuaugaaaagcuaggaagcaaccuuucgccugugcagcgguccagcacuuaacucuaauacaucagcaugcguuaauucagcugguugggaaaugacaccaggaagcccagugcagagggucccuuacugacuguuucguggcccuauuaauggucagacuguuccagcaugagguucuuagaaugacagguguuuggaugggugggggccuugugaugggggguaggcuggcccaugugugaucuugugggguggagggaagagaauagcaugaucccacuuccccaugcugugggaaggggugcaguucguccccaagaacgacacugccugucagguggucugcaaagaugauaaccuugacuacuaaaaacgucuccauggcggggguaacaagaugauaaucuacuuaauuuuagaacaccuuuuucaccuaacuaaaauaauguuuaaagaguuuuguauaaaaauguaaggaagcguuguuaccuguugaauuuuguauuaugugaaucagugagauguuaguagaauaagccuuaaaaaaaaaaaaaucgguugggugcaguggcacacggcuguaaucccagcacuuugggaggccaagguuggcagaucaccugaggucaggaguucaagaccagucuggccaacauagcaaaacccugucucuacuaaaaauacaaaaauuaucugggcaugguggugcaugccuguaaucccagcuauucggaaggcugaggcaggagaaucacuugaacccaggaggcggagguugcggugagcugagauugcaccauuucauuccagccugggcaacaugagugaaagucugacucaaaaaaaaaaaauuuaaaaaacaaaauaaucuagugugcagggcauucaccucagccccccaggcaggagccaagcacagcaggagcuuccgccuccucuccacuggagcacacaacuugaaccuggcuuauuuucugcagggaccagccccacauggucagugaguuucuccccauguguggcgaugagagaguguagaaauaaagac

SEQ ID NO: 61634 - RNA, 18 nt, Artificial Sequence
  Description of Artificial Sequence: Synthetic oligonucleotide
cauccaggccaucaucca

SEQ ID NO: 61635 - RNA, 18 nt, Artificial Sequence
  Description of Artificial Sequence: Synthetic oligonucleotide
cgcuucauccaggccauc

SEQ ID NO: 61636 - RNA, 18 nt, Artificial Sequence
  Description of Artificial Sequence: Synthetic oligonucleotide
gaaaacgcuucauccagg

SEQ ID NO: 61637 - RNA, 18 nt, Artificial Sequence
  Description of Artificial Sequence: Synthetic oligonucleotide
ccagcacaggaagcuagc

SEQ ID NO: 61638 - RNA, 18 nt, Artificial Sequence
  Description of Artificial Sequence: Synthetic oligonucleotide
ccuacccagcacaggaag

SEQ ID NO: 61639 - RNA, 18 nt, Artificial Sequence
  Description of Artificial Sequence: Synthetic oligonucleotide
ggcccccuacccagcaca

SEQ ID NO: 61640 - RNA, 18 nt, Artificial Sequence
  Description of Artificial Sequence: Synthetic oligonucleotide
caccaggcccccuaccca

SEQ ID NO: 61641 - RNA, 18 nt, Artificial Sequence
  Description of Artificial Sequence: Synthetic oligonucleotide
acgcacaccaggcccccu

SEQ ID NO: 61642 - RNA, 18 nt, Artificial Sequence
  Description of Artificial Sequence: Synthetic oligonucleotide
agcccacgcacaccaggc

SEQ ID NO: 61643 - RNA, 18 nt, Artificial Sequence
  Description of Artificial Sequence: Synthetic oligonucleotide
gggccagcccacgcacac

SEQ ID NO: 61644 - RNA, 18 nt, Artificial Sequence
  Description of Artificial Sequence: Synthetic oligonucleotide
cagcagggccagcccacg

SEQ ID NO: 61645 - RNA, 18 nt, Artificial Sequence
  Description of Artificial Sequence: Synthetic oligonucleotide
aagggcagcagggccagc

SEQ ID NO: 61646 - RNA, 18 nt, Artificial Sequence
  Description of Artificial Sequence: Synthetic oligonucleotide
ggagaaagggcagcaggg

SEQ ID NO: 61647 - RNA, 18 nt, Artificial Sequence
  Description of Artificial Sequence: Synthetic oligonucleotide
ccccaggagaaagggcag

SEQ ID NO: 61648 - RNA, 18 nt, Artificial Sequence
  Description of Artificial Sequence: Synthetic oligonucleotide
aagguccccaggagaaag

SEQ ID NO: 61649 - RNA, 18 nt, Artificial Sequence
  Description of Artificial Sequence: Synthetic oligonucleotide
gggaaagguccccaggag

SEQ ID NO: 61650 - RNA, 18 nt, Artificial Sequence
  Description of Artificial Sequence: Synthetic oligonucleotide
uuguguucuuaaucaggg

SEQ ID NO: 61651 - RNA, 18 nt, Artificial Sequence
  Description of Artificial Sequence: Synthetic oligonucleotide
guggcuuguguucuuaau

SEQ ID NO: 61652 - RNA, 18 nt, Artificial Sequence
  Description of Artificial Sequence: Synthetic oligonucleotide
ucugaguggcuuguguuc

SEQ ID NO: 61653 - RNA, 18 nt, Artificial Sequence
  Description of Artificial Sequence: Synthetic oligonucleotide
gggucugaguggcuugug

SEQ ID NO: 61654 - RNA, 18 nt, Artificial Sequence
  Description of Artificial Sequence: Synthetic oligonucleotide
gacuguugcucuggaggg

SEQ ID NO: 61655 - RNA, 18 nt, Artificial Sequence
  Description of Artificial Sequence: Synthetic oligonucleotide
gaugggacuguugcucug

SEQ ID NO: 61656 - RNA, 18 nt, Artificial Sequence
  Description of Artificial Sequence: Synthetic oligonucleotide
ggagggaugggacuguug

SEQ ID NO: 61657 - RNA, 18 nt, Artificial Sequence
  Description of Artificial Sequence: Synthetic oligonucleotide
ugaguggagggaugggac

SEQ ID NO: 61658 - RNA, 18 nt, Artificial Sequence
  Description of Artificial Sequence: Synthetic oligonucleotide
gcauuugaguggagggau

SEQ ID NO: 61659 - RNA, 18 nt, Artificial Sequence
  Description of Artificial Sequence: Synthetic oligonucleotide
uggaagcauuugagugga

SEQ ID NO: 61660 - RNA, 18 nt, Artificial Sequence
  Description of Artificial Sequence: Synthetic oligonucleotide
gccccuggaagcauuuga

SEQ ID NO: 61661 - RNA, 18 nt, Artificial Sequence
  Description of Artificial Sequence: Synthetic oligonucleotide
ucccugccccuggaagca

SEQ ID NO: 61662 - RNA, 18 nt, Artificial Sequence
  Description of Artificial Sequence: Synthetic oligonucleotide
ugagcucccugccccugg

SEQ ID NO: 61663 - RNA, 18 nt, Artificial Sequence
  Description of Artificial Sequence: Synthetic oligonucleotide
cccagugagcucccugcc

SEQ ID NO: 61664 - RNA, 18 nt, Artificial Sequence
  Description of Artificial Sequence: Synthetic oligonucleotide
uccuccccagugagcucc

SEQ ID NO: 61665 - RNA, 18 nt, Artificial Sequence
  Description of Artificial Sequence: Synthetic oligonucleotide
ggguuuccuccccaguga

SEQ ID NO: 61666 - RNA, 18 nt, Artificial Sequence
  Description of Artificial Sequence: Synthetic oligonucleotide
gcucuggacaacgcugga

SEQ ID NO: 61667 - RNA, 18 nt, Artificial Sequence
  Description of Artificial Sequence: Synthetic oligonucleotide
uaacagcucuggacaacg

SEQ ID NO: 61668 - RNA, 18 nt, Artificial Sequence
  Description of Artificial Sequence: Synthetic oligonucleotide
cuuucuaacagcucugga

SEQ ID NO: 61669 - RNA, 18 nt, Artificial Sequence
  Description of Artificial Sequence: Synthetic oligonucleotide
aagaacuuucuaacagcu

SEQ ID NO: 61670 - RNA, 18 nt, Artificial Sequence
  Description of Artificial Sequence: Synthetic oligonucleotide
acaguaagaacuuucuaa

SEQ ID NO: 61671 - RNA, 18 nt, Artificial Sequence
  Description of Artificial Sequence: Synthetic oligonucleotide
acucaacaguaagaacuu

SEQ ID NO: 61672 - RNA, 18 nt, Artificial Sequence
  Description of Artificial Sequence: Synthetic oligonucleotide
uuuugacucaacaguaag

SEQ ID NO: 61673 - RNA, 18 nt, Artificial Sequence
  Description of Artificial Sequence: Synthetic oligonucleotide
auaguuuuugacucaaca

SEQ ID NO: 61674 - RNA, 18 nt, Artificial Sequence
  Description of Artificial Sequence: Synthetic oligonucleotide
caggaauaguuuuugacu

SEQ ID NO: 61675 - RNA, 18 nt, Artificial Sequence
  Description of Artificial Sequence: Synthetic oligonucleotide
gccaccaggaauaguuuu

SEQ ID NO: 61676 - RNA, 18 nt, Artificial Sequence
  Description of Artificial Sequence: Synthetic oligonucleotide
gagcagccaccaggaaua

SEQ ID NO: 61677 - RNA, 18 nt, Artificial Sequence
  Description of Artificial Sequence: Synthetic oligonucleotide
cggcagagcagccaccag

SEQ ID NO: 61678 - RNA, 18 nt, Artificial Sequence
  Description of Artificial Sequence: Synthetic oligonucleotide
gacugcggcagagcagcc

SEQ ID NO: 61679 - RNA, 18 nt, Artificial Sequence
  Description of Artificial Sequence: Synthetic oligonucleotide
ccucagacugcggcagag

SEQ ID NO: 61680 - RNA, 18 nt, Artificial Sequence
  Description of Artificial Sequence: Synthetic oligonucleotide
gcucaccucagacugcgg

SEQ ID NO: 61681 - RNA, 18 nt, Artificial Sequence
  Description of Artificial Sequence: Synthetic oligonucleotide
guuucgcucaccucagac

SEQ ID NO: 61682 - RNA, 18 nt, Artificial Sequence
  Description of Artificial Sequence: Synthetic oligonucleotide
aguguguuucgcucaccu

SEQ ID NO: 61683 - RNA, 18 nt, Artificial Sequence
  Description of Artificial Sequence: Synthetic oligonucleotide
gcugcaguguguuucgcu

SEQ ID NO: 61684 - RNA, 18 nt, Artificial Sequence
  Description of Artificial Sequence: Synthetic oligonucleotide
cuugagcugcaguguguu

SEQ ID NO: 61685 - RNA, 18 nt, Artificial Sequence
  Description of Artificial Sequence: Synthetic oligonucleotide
aucaacuugagcugcagu

SEQ ID NO: 61686 - RNA, 18 nt, Artificial Sequence
  Description of Artificial Sequence: Synthetic oligonucleotide
aggaaaucaacuugagcu

SEQ ID NO: 61687 - RNA, 18 nt, Artificial Sequence
  Description of Artificial Sequence: Synthetic oligonucleotide
gucggaggaaaucaacuu

SEQ ID NO: 61688 - RNA, 18 nt, Artificial Sequence
  Description of Artificial Sequence: Synthetic oligonucleotide
cucaagucggaggaaauc

SEQ ID NO: 61689 - RNA, 18 nt, Artificial Sequence
  Description of Artificial Sequence: Synthetic oligonucleotide
gccuccucaagucggagg

SEQ ID NO: 61690 - RNA, 18 nt, Artificial Sequence
  Description of Artificial Sequence: Synthetic oligonucleotide
gccacgccuccucaaguc

SEQ ID NO: 61691 - RNA, 18 nt, Artificial Sequence
  Description of Artificial Sequence: Synthetic oligonucleotide
ugaaggccacgccuccuc

SEQ ID NO: 61692 - RNA, 18 nt, Artificial Sequence
  Description of Artificial Sequence: Synthetic oligonucleotide
auuuuugaaggccacgcc

SEQ ID NO: 61693 - RNA, 18 nt, Artificial Sequence
  Description of Artificial Sequence: Synthetic oligonucleotide
agcccauuuuugaaggcc

SEQ ID NO: 61694 - RNA, 18 nt, Artificial Sequence
  Description of Artificial Sequence: Synthetic oligonucleotide
aaaaaagcccauuuuuga

SEQ ID NO: 61695 - RNA, 18 nt, Artificial Sequence
  Description of Artificial Sequence: Synthetic oligonucleotide
aaaaaaaaaaagcccauu

SEQ ID NO: 61696 - RNA, 18 nt, Artificial Sequence
  Description of Artificial Sequence: Synthetic oligonucleotide
guaaaaaaaaaaaaaagc

SEQ ID NO: 61697 - RNA, 18 nt, Artificial Sequence
  Description of Artificial Sequence: Synthetic oligonucleotide
agccuguaaaaaaaaaaa

SEQ ID NO: 61698 - RNA, 18 nt, Artificial Sequence
  Description of Artificial Sequence: Synthetic oligonucleotide
agcaaagccuguaaaaaa

SEQ ID NO: 61699 - RNA, 18 nt, Artificial Sequence
  Description of Artificial Sequence: Synthetic oligonucleotide
gagggagcaaagccugua

SEQ ID NO: 61700 - RNA, 18 nt, Artificial Sequence
  Description of Artificial Sequence: Synthetic oligonucleotide
cuguggagggagcaaagc

SEQ ID NO: 61701 - RNA, 18 nt, Artificial Sequence
  Description of Artificial Sequence: Synthetic oligonucleotide
cagaccuguggagggagc

SEQ ID NO: 61702 - RNA, 18 nt, Artificial Sequence
  Description of Artificial Sequence: Synthetic oligonucleotide
aaacacagaccuguggag

SEQ ID NO: 61703 - RNA, 18 nt, Artificial Sequence
  Description of Artificial Sequence: Synthetic oligonucleotide
uucauaaacacagaccug

SEQ ID NO: 61704 - RNA, 18 nt, Artificial Sequence
  Description of Artificial Sequence: Synthetic oligonucleotide
cccuguucauaaacacag

SEQ ID NO: 61705 - RNA, 18 nt, Artificial Sequence
  Description of Artificial Sequence: Synthetic oligonucleotide
ccuuccccuguucauaaa

SEQ ID NO: 61706 - RNA, 18 nt, Artificial Sequence
  Description of Artificial Sequence: Synthetic oligonucleotide
uucucccuuccccuguuc

SEQ ID NO: 61707 - RNA, 18 nt, Artificial Sequence
  Description of Artificial Sequence: Synthetic oligonucleotide
acacuuucucccuucccc

SEQ ID NO: 61708 - RNA, 18 nt, Artificial Sequence
  Description of Artificial Sequence: Synthetic oligonucleotide
auuaaacacuuucucccu

SEQ ID NO: 61709 - RNA, 18 nt, Artificial Sequence
  Description of Artificial Sequence: Synthetic oligonucleotide
gcuucauuaaacacuuuc

SEQ ID NO: 61710 - RNA, 18 nt, Artificial Sequence
  Description of Artificial Sequence: Synthetic oligonucleotide
cacgagcuucauuaaaca

SEQ ID NO: 61711 - RNA, 18 nt, Artificial Sequence
  Description of Artificial Sequence: Synthetic oligonucleotide
cgcuucacgagcuucauu

SEQ ID NO: 61712 - RNA, 18 nt, Artificial Sequence
  Description of Artificial Sequence: Synthetic oligonucleotide
uggaacgcuucacgagcu

SEQ ID NO: 61713 - RNA, 18 nt, Artificial Sequence
  Description of Artificial Sequence: Synthetic oligonucleotide
ugcuauggaacgcuucac

SEQ ID NO: 61714 - RNA, 18 nt, Artificial Sequence
  Description of Artificial Sequence: Synthetic oligonucleotide
uucccugcuauggaacgc

SEQ ID NO: 61715 - RNA, 18 nt, Artificial Sequence
  Description of Artificial Sequence: Synthetic oligonucleotide
ugaccuucccugcuaugg

SEQ ID NO: 61716 - RNA, 18 nt, Artificial Sequence
  Description of Artificial Sequence: Synthetic oligonucleotide
gugccugaccuucccugc

SEQ ID NO: 61717 - RNA, 18 nt, Artificial Sequence
  Description of Artificial Sequence: Synthetic oligonucleotide
ucacugugccugaccuuc

SEQ ID NO: 61718 - RNA, 18 nt, Artificial Sequence
  Description of Artificial Sequence: Synthetic oligonucleotide
ccuccucacugugccuga

SEQ ID NO: 61719 - RNA, 18 nt, Artificial Sequence
  Description of Artificial Sequence: Synthetic oligonucleotide
aaacaccuccucacugug

SEQ ID NO: 61720 - RNA, 18 nt, Artificial Sequence
  Description of Artificial Sequence: Synthetic oligonucleotide
uaccaaaacaccuccuca

SEQ ID NO: 61721 - RNA, 18 nt, Artificial Sequence
  Description of Artificial Sequence: Synthetic oligonucleotide
ggcuauaccaaaacaccu

SEQ ID NO: 61722 - RNA, 18 nt, Artificial Sequence
  Description of Artificial Sequence: Synthetic oligonucleotide
ccaaaggcuauaccaaaa

SEQ ID NO: 61723 - RNA, 18 nt, Artificial Sequence
  Description of Artificial Sequence: Synthetic oligonucleotide
ugccaccaaaggcuauac

SEQ ID NO: 61724 - RNA, 18 nt, Artificial Sequence
  Description of Artificial Sequence: Synthetic oligonucleotide
ggaaaugccaccaaaggc

SEQ ID NO: 61725 - RNA, 18 nt, Artificial Sequence
  Description of Artificial Sequence: Synthetic oligonucleotide
gggaaaugccaccaaagg

SEQ ID NO: 61726 - RNA, 18 nt, Artificial Sequence
  Description of Artificial Sequence: Synthetic oligonucleotide
ggccccugggaaaacggg

SEQ ID NO: 61727 - RNA, 18 nt, Artificial Sequence
  Description of Artificial Sequence: Synthetic oligonucleotide
aggauggccccugggaaa

SEQ ID NO: 61728 - RNA, 18 nt, Artificial Sequence
  Description of Artificial Sequence: Synthetic oligonucleotide
agguguuuacgaggagcu

SEQ ID NO: 61729 - RNA, 18 nt, Artificial Sequence
  Description of Artificial Sequence: Synthetic oligonucleotide
ggaagagguguuuacgag

SEQ ID NO: 61730 - RNA, 18 nt, Artificial Sequence
  Description of Artificial Sequence: Synthetic oligonucleotide
ucaauggaagagguguuu

SEQ ID NO: 61731 - RNA, 18 nt, Artificial Sequence
  Description of Artificial Sequence: Synthetic oligonucleotide
ggcagucaauggaagagg

SEQ ID NO: 61732 - RNA, 18 nt, Artificial Sequence
  Description of Artificial Sequence: Synthetic oligonucleotide
uguuaggcagucaaugga

SEQ ID NO: 61733 - RNA, 18 nt, Artificial Sequence
  Description of Artificial Sequence: Synthetic oligonucleotide
gagaauguuaggcaguca

SEQ ID NO: 61734 - RNA, 18 nt, Artificial Sequence
  Description of Artificial Sequence: Synthetic oligonucleotide
cuuaagagaauguuaggc

SEQ ID NO: 61735 - RNA, 18 nt, Artificial Sequence
  Description of Artificial Sequence: Synthetic oligonucleotide
cuucccuuaagagaaugu

SEQ ID NO: 61736 - RNA, 18 nt, Artificial Sequence
  Description of Artificial Sequence: Synthetic oligonucleotide
agcagcuucccuuaagag

SEQ ID NO: 61737 - RNA, 18 nt, Artificial Sequence
  Description of Artificial Sequence: Synthetic oligonucleotide
auuauagcagcuucccuu

SEQ ID NO: 61738 - RNA, 18 nt, Artificial Sequence
  Description of Artificial Sequence: Synthetic oligonucleotide
aguaaauuauagcagcuu

SEQ ID NO: 61739 - RNA, 18 nt, Artificial Sequence
  Description of Artificial Sequence: Synthetic oligonucleotide
agucaaguaaauuauagc

SEQ ID NO: 61740 - RNA, 18 nt, Artificial Sequence
  Description of Artificial Sequence: Synthetic oligonucleotide
gggagagucaaguaaauu

SEQ ID NO: 61741 - RNA, 18 nt, Artificial Sequence
  Description of Artificial Sequence: Synthetic oligonucleotide
auguccaaaagaauaggg

SEQ ID NO: 61742 - RNA, 18 nt, Artificial Sequence
  Description of Artificial Sequence: Synthetic oligonucleotide
acauguccaaaagaauag

SEQ ID NO: 61743 - RNA, 18 nt, Artificial Sequence
  Description of Artificial Sequence: Synthetic oligonucleotide
aaccuacauguccaaaag

SEQ ID NO: 61744 - RNA, 18 nt, Artificial Sequence
  Description of Artificial Sequence: Synthetic oligonucleotide
gagacaaccuacaugucc

SEQ ID NO: 61745 - RNA, 18 nt, Artificial Sequence
  Description of Artificial Sequence: Synthetic oligonucleotide
aaagggagacaaccuaca

SEQ ID NO: 61746 - RNA, 18 nt, Artificial Sequence
  Description of Artificial Sequence: Synthetic oligonucleotide
uuuacaaagggagacaac

SEQ ID NO: 61747 - RNA, 18 nt, Artificial Sequence
  Description of Artificial Sequence: Synthetic oligonucleotide
auaaauuuacaaagggag

SEQ ID NO: 61748 - RNA, 18 nt, Artificial Sequence
  Description of Artificial Sequence: Synthetic oligonucleotide
gaaaaauaaauuuacaaa

SEQ ID NO: 61749 - RNA, 18 nt, Artificial Sequence
  Description of Artificial Sequence: Synthetic oligonucleotide
uguucgaaaaauaaauuu

SEQ ID NO: 61750 - RNA, 18 nt, Artificial Sequence
  Description of Artificial Sequence: Synthetic oligonucleotide
cgugcuguucgaaaaaua

SEQ ID NO: 61751 - RNA, 18 nt, Artificial Sequence
  Description of Artificial Sequence: Synthetic oligonucleotide
aacaccgugcuguucgaa

SEQ ID NO: 61752 - RNA, 18 nt, Artificial Sequence
  Description of Artificial Sequence: Synthetic oligonucleotide
gugucaacaccgugcugu

SEQ ID NO: 61753 - RNA, 18 nt, Artificial Sequence
  Description of Artificial Sequence: Synthetic oligonucleotide
uaacugugucaacaccgu

SEQ ID NO: 61754 - RNA, 18 nt, Artificial Sequence
  Description of Artificial Sequence: Synthetic oligonucleotide
ggcuauaacugugucaac

SEQ ID NO: 61755 - RNA, 18 nt, Artificial Sequence
  Description of Artificial Sequence: Synthetic oligonucleotide
ucuuuggcuauaacugug

SEQ ID NO: 61756 - RNA, 18 nt, Artificial Sequence
  Description of Artificial Sequence: Synthetic oligonucleotide
aagauucuuuggcuauaa

SEQ ID NO: 61757 - RNA, 18 nt, Artificial Sequence
  Description of Artificial Sequence: Synthetic oligonucleotide
cacggaagauucuuuggc

SEQ ID NO: 61758 - RNA, 18 nt, Artificial Sequence
  Description of Artificial Sequence: Synthetic oligonucleotide
gggaacacggaagauucu

SEQ ID NO: 61759 - RNA, 18 nt, Artificial Sequence
  Description of Artificial Sequence: Synthetic oligonucleotide
ugggagggaacacggaag

SEQ ID NO: 61760 - RNA, 18 nt, Artificial Sequence
  Description of Artificial Sequence: Synthetic oligonucleotide
agcugugggagggaacac

SEQ ID NO: 61761 - RNA, 18 nt, Artificial Sequence
  Description of Artificial Sequence: Synthetic oligonucleotide
gaacaagcugugggaggg

SEQ ID NO: 61762 - RNA, 18 nt, Artificial Sequence
  Description of Artificial Sequence: Synthetic oligonucleotide
gguaaagggagcagcggg

SEQ ID NO: 61763 - RNA, 18 nt, Artificial Sequence
  Description of Artificial Sequence: Synthetic oligonucleotide
gggcugguaaagggagca

SEQ ID NO: 61764 - RNA, 18 nt, Artificial Sequence
  Description of Artificial Sequence: Synthetic oligonucleotide
caggaaagaggagaaggg

SEQ ID NO: 61765 - RNA, 18 nt, Artificial Sequence
  Description of Artificial Sequence: Synthetic oligonucleotide
ccaggaaagaggagaagg

SEQ ID NO: 61766 - RNA, 18 nt, Artificial Sequence
  Description of Artificial Sequence: Synthetic oligonucleotide
caugcccaggaaagagga

SEQ ID NO: 61767 - RNA, 18 nt, Artificial Sequence
  Description of Artificial Sequence: Synthetic oligonucleotide
caggacaugcccaggaaa

SEQ ID NO: 61768 - RNA, 18 nt, Artificial Sequence
  Description of Artificial Sequence: Synthetic oligonucleotide
ucagucaggacaugccca

SEQ ID NO: 61769 - RNA, 18 nt, Artificial Sequence
  Description of Artificial Sequence: Synthetic oligonucleotide
ccagcucagucaggacau

SEQ ID NO: 61770 - RNA, 18 nt, Artificial Sequence
  Description of Artificial Sequence: Synthetic oligonucleotide
gugccccagcucagucag

SEQ ID NO: 61771 - RNA, 18 nt, Artificial Sequence
  Description of Artificial Sequence: Synthetic oligonucleotide
acucugugccccagcuca

SEQ ID NO: 61772 - RNA, 18 nt, Artificial Sequence
  Description of Artificial Sequence: Synthetic oligonucleotide
cacccacucugugcccca

SEQ ID NO: 61773 - RNA, 18 nt, Artificial Sequence
  Description of Artificial Sequence: Synthetic oligonucleotide
cagagcacccacucugug

SEQ ID NO: 61774 - RNA, 18 nt, Artificial Sequence
  Description of Artificial Sequence: Synthetic oligonucleotide
gaggccagagcacccacu

SEQ ID NO: 61775 - RNA, 18 nt, Artificial Sequence
  Description of Artificial Sequence: Synthetic oligonucleotide
cgggagaggccagagcac

SEQ ID NO: 61776 - RNA, 18 nt, Artificial Sequence
  Description of Artificial Sequence: Synthetic oligonucleotide
acccccgggagaggccag

SEQ ID NO: 61777 - RNA, 18 nt, Artificial Sequence
  Description of Artificial Sequence: Synthetic oligonucleotide
cacccacccccgggagag

SEQ ID NO: 61778 - RNA, 18 nt, Artificial Sequence
  Description of Artificial Sequence: Synthetic oligonucleotide
cggugcacccacccccgg

SEQ ID NO: 61779 - RNA, 18 nt, Artificial Sequence
  Description of Artificial Sequence: Synthetic oligonucleotide
gccagcggugcacccacc

SEQ ID NO: 61780 - RNA, 18 nt, Artificial Sequence
  Description of Artificial Sequence: Synthetic oligonucleotide
gggcagccagcggugcac

SEQ ID NO: 61781 - RNA, 18 nt, Artificial Sequence
  Description of Artificial Sequence: Synthetic oligonucleotide
agcucagaaaagucaggg

SEQ ID NO: 61782 - RNA, 18 nt, Artificial Sequence
  Description of Artificial Sequence: Synthetic oligonucleotide
aaacagcucagaaaaguc

SEQ ID NO: 61783 - RNA, 18 nt, Artificial Sequence
  Description of Artificial Sequence: Synthetic oligonucleotide
gagucaaacagcucagaa

SEQ ID NO: 61784 - RNA, 18 nt, Artificial Sequence
  Description of Artificial Sequence: Synthetic oligonucleotide
cuugagagucaaacagcu

SEQ ID NO: 61785 - RNA, 18 nt, Artificial Sequence
  Description of Artificial Sequence: Synthetic oligonucleotide
cuccccuugagagucaaa

SEQ ID NO: 61786 - RNA, 18 nt, Artificial Sequence
  Description of Artificial Sequence: Synthetic oligonucleotide
agcaccuccccuugagag

SEQ ID NO: 61787 - RNA, 18 nt, Artificial Sequence
  Description of Artificial Sequence: Synthetic oligonucleotide
aucaaagcaccuccccuu

SEQ ID NO: 61788 - RNA, 18 nt, Artificial Sequence
  Description of Artificial Sequence: Synthetic oligonucleotide
cucagaucaaagcaccuc

SEQ ID NO: 61789 - RNA, 18 nt, Artificial Sequence
  Description of Artificial Sequence: Synthetic oligonucleotide
guaaccucagaucaaagc

SEQ ID NO: 61790 - RNA, 18 nt, Artificial Sequence
  Description of Artificial Sequence: Synthetic oligonucleotide
guggaguaaccucagauc

SEQ ID NO: 61791 - RNA, 18 nt, Artificial Sequence
  Description of Artificial Sequence: Synthetic oligonucleotide
gggagguggaguaaccuc

SEQ ID NO: 61792 - RNA, 18 nt, Artificial Sequence
  Description of Artificial Sequence: Synthetic oligonucleotide
gaagcccccggugcaggg

SEQ ID NO: 61793 - RNA, 18 nt, Artificial Sequence
  Description of Artificial Sequence: Synthetic oligonucleotide
gaaggaagcccccggugc

SEQ ID NO: 61794 - RNA, 18 nt, Artificial Sequence
  Description of Artificial Sequence: Synthetic oligonucleotide
cccaagaaggaagccccc

SEQ ID NO: 61795 - RNA, 18 nt, Artificial Sequence
  Description of Artificial Sequence: Synthetic oligonucleotide
cauggcccaagaaggaag

SEQ ID NO: 61796 - RNA, 18 nt, Artificial Sequence
  Description of Artificial Sequence: Synthetic oligonucleotide
gggcacauggcccaagaa

SEQ ID NO: 61797 - RNA, 18 nt, Artificial Sequence
  Description of Artificial Sequence: Synthetic oligonucleotide
cagcagggcacauggccc

SEQ ID NO: 61798 - RNA, 18 nt, Artificial Sequence
  Description of Artificial Sequence: Synthetic oligonucleotide
gggaacagcagggcacau

SEQ ID NO: 61799 - RNA, 18 nt, Artificial Sequence
  Description of Artificial Sequence: Synthetic oligonucleotide
cagggucagacgcgaggg

SEQ ID NO: 61800 - RNA, 18 nt, Artificial Sequence
  Description of Artificial Sequence: Synthetic oligonucleotide
cccagggucagacgcgag

SEQ ID NO: 61801 - RNA, 18 nt, Artificial Sequence
  Description of Artificial Sequence: Synthetic oligonucleotide
cgcgccccagggucagac

SEQ ID NO: 61802 - RNA, 18 nt, Artificial Sequence
  Description of Artificial Sequence: Synthetic oligonucleotide
gcuggcgcgccccagggu

SEQ ID NO: 61803 - RNA, 18 nt, Artificial Sequence
  Description of Artificial Sequence: Synthetic oligonucleotide
ugagggcuggcgcgcccc

SEQ ID NO: 61804 - RNA, 18 nt, Artificial Sequence
  Description of Artificial Sequence: Synthetic oligonucleotide
cugggugagggcuggcgc

SEQ ID NO: 61805 - RNA, 18 nt, Artificial Sequence
  Description of Artificial Sequence: Synthetic oligonucleotide
agagccugggugagggcu

SEQ ID NO: 61806 - RNA, 18 nt, Artificial Sequence
  Description of Artificial Sequence: Synthetic oligonucleotide
agccgagagccuggguga

SEQ ID NO: 61807 - RNA, 18 nt, Artificial Sequence
  Description of Artificial Sequence: Synthetic oligonucleotide
gugugagccgagagccug

SEQ ID NO: 61808 - RNA, 18 nt, Artificial Sequence
  Description of Artificial Sequence: Synthetic oligonucleotide
uguccgagacugggcaag

SEQ ID NO: 61809 - RNA, 18 nt, Artificial Sequence
  Description of Artificial Sequence: Synthetic oligonucleotide
ggguuuguccgagacugg

SEQ ID NO: 61810 - RNA, 18 nt, Artificial Sequence
  Description of Artificial Sequence: Synthetic oligonucleotide
ccugaggguuuguccgag

SEQ ID NO: 61811 - RNA, 18 nt, Artificial Sequence
  Description of Artificial Sequence: Synthetic oligonucleotide
caggaccugaggguuugu

SEQ ID NO: 61812 - RNA, 18 nt, Artificial Sequence
  Description of Artificial Sequence: Synthetic oligonucleotide
guguccaggaccugaggg

SEQ ID NO: 61813 - RNA, 18 nt, Artificial Sequence
  Description of Artificial Sequence: Synthetic oligonucleotide
ggccaguguccaggaccu

SEQ ID NO: 61814 - RNA, 18 nt, Artificial Sequence
  Description of Artificial Sequence: Synthetic oligonucleotide
ugucaggccaguguccag

SEQ ID NO: 61815 - RNA, 18 nt, Artificial Sequence
  Description of Artificial Sequence: Synthetic oligonucleotide
ugggcugucaggccagug

SEQ ID NO: 61816 - RNA, 18 nt, Artificial Sequence
  Description of Artificial Sequence: Synthetic oligonucleotide
uguccugggcugucaggc

SEQ ID NO: 61817 - RNA, 18 nt, Artificial Sequence
  Description of Artificial Sequence: Synthetic oligonucleotide
augcauguccugggcugu

SEQ ID NO: 61818 - RNA, 18 nt, Artificial Sequence
  Description of Artificial Sequence: Synthetic oligonucleotide
gcguaaugcauguccugg

SEQ ID NO: 61819 - RNA, 18 nt, Artificial Sequence
  Description of Artificial Sequence: Synthetic oligonucleotide
acugggcguaaugcaugu

SEQ ID NO: 61820 - RNA, 18 nt, Artificial Sequence
  Description of Artificial Sequence: Synthetic oligonucleotide
gaggcacugggcguaaug

SEQ ID NO: 61821 - RNA, 18 nt, Artificial Sequence
  Description of Artificial Sequence: Synthetic oligonucleotide
ggcgagaggcacugggcg

SEQ ID NO: 61822 - RNA, 18 nt, Artificial Sequence
  Description of Artificial Sequence: Synthetic oligonucleotide
cgacaggcgagaggcacu

SEQ ID NO: 61823 - RNA, 18 nt, Artificial Sequence
  Description of Artificial Sequence: Synthetic oligonucleotide
ccagucgacaggcgagag

SEQ ID NO: 61824 - RNA, 18 nt, Artificial Sequence
  Description of Artificial Sequence: Synthetic oligonucleotide
uugucccagucgacaggc

SEQ ID NO: 61825 - RNA, 18 nt, Artificial Sequence
  Description of Artificial Sequence: Synthetic oligonucleotide
caggcuugucccagucga

SEQ ID NO: 61826 - RNA, 18 nt, Artificial Sequence
  Description of Artificial Sequence: Synthetic oligonucleotide
gcugucaggcuuguccca

SEQ ID NO: 61827 - RNA, 18 nt, Artificial Sequence
  Description of Artificial Sequence: Synthetic oligonucleotide
ccgcugcugucaggcuug

SEQ ID NO: 61828 - RNA, 18 nt, Artificial Sequence
  Description of Artificial Sequence: Synthetic oligonucleotide
cugugccgcugcugucag

SEQ ID NO: 61829 - RNA, 18 nt, Artificial Sequence
  Description of Artificial Sequence: Synthetic oligonucleotide
cugcucugugccgcugcu

SEQ ID NO: 61830 - RNA, 18 nt, Artificial Sequence
  Description of Artificial Sequence: Synthetic oligonucleotide
ucauccugcucugugccg

SEQ ID NO: 61831 - RNA, 18 nt, Artificial Sequence
  Description of Artificial Sequence: Synthetic oligonucleotide
agaggucauccugcucug

SEQ ID NO: 61832 - RNA, 18 nt, Artificial Sequence
  Description of Artificial Sequence: Synthetic oligonucleotide
gcugaagaggucauccug

SEQ ID NO: 61833 - RNA, 18 nt, Artificial Sequence
  Description of Artificial Sequence: Synthetic oligonucleotide
cagaagcugaagagguca

SEQ ID NO: 61834 - RNA, 18 nt, Artificial Sequence
  Description of Artificial Sequence: Synthetic oligonucleotide
gcccucagaagcugaaga

SEQ ID NO: 61835 - RNA, 18 nt, Artificial Sequence
  Description of Artificial Sequence: Synthetic oligonucleotide
cccgggcccucagaagcu

SEQ ID NO: 61836 - RNA, 18 nt, Artificial Sequence
  Description of Artificial Sequence: Synthetic oligonucleotide
cuggccccgggcccucag

SEQ ID NO: 61837 - RNA, 18 nt, Artificial Sequence
  Description of Artificial Sequence: Synthetic oligonucleotide
uccggcuggccccgggcc

SEQ ID NO: 61838 - RNA, 18 nt, Artificial Sequence
  Description of Artificial Sequence: Synthetic oligonucleotide
uuguguccggcuggcccc

SEQ ID NO: 61839 - RNA, 18 nt, Artificial Sequence
  Description of Artificial Sequence: Synthetic oligonucleotide
gccgcuuguguccggcug

SEQ ID NO: 61840 - RNA, 18 nt, Artificial Sequence
  Description of Artificial Sequence: Synthetic oligonucleotide
ucagggccgcuugugucc

SEQ ID NO: 61841 - RNA, 18 nt, Artificial Sequence
  Description of Artificial Sequence: Synthetic oligonucleotide
acgugucagggccgcuug

SEQ ID NO: 61842 - RNA, 18 nt, Artificial Sequence
  Description of Artificial Sequence: Synthetic oligonucleotide
ccaucacgugucagggcc

SEQ ID NO: 61843 - RNA, 18 nt, Artificial Sequence
  Description of Artificial Sequence: Synthetic oligonucleotide
uugguccaucacguguca

SEQ ID NO: 61844 - RNA, 18 nt, Artificial Sequence
  Description of Artificial Sequence: Synthetic oligonucleotide
uggcuuugguccaucacg

SEQ ID NO: 61845 - RNA, 18 nt, Artificial Sequence
  Description of Artificial Sequence: Synthetic oligonucleotide
gcagguggcuuuggucca

SEQ ID NO: 61846 - RNA, 18 nt, Artificial Sequence
  Description of Artificial Sequence: Synthetic oligonucleotide
ccgcagcagguggcuuug

SEQ ID NO: 61847 - RNA, 18 nt, Artificial Sequence
  Description of Artificial Sequence: Synthetic oligonucleotide
cucccccgcagcaggugg

SEQ ID NO: 61848 - RNA, 18 nt, Artificial Sequence
  Description of Artificial Sequence: Synthetic oligonucleotide
acuggcucccccgcagca

SEQ ID NO: 61849 - RNA, 18 nt, Artificial Sequence
  Description of Artificial Sequence: Synthetic oligonucleotide
ccagaacuggcucccccg

SEQ ID NO: 61850 - RNA, 18 nt, Artificial Sequence
  Description of Artificial Sequence: Synthetic oligonucleotide
gggccccagaacuggcuc

SEQ ID NO: 61851 - RNA, 18 nt, Artificial Sequence
  Description of Artificial Sequence: Synthetic oligonucleotide
caggcgggccccagaacu

SEQ ID NO: 61852 - RNA, 18 nt, Artificial Sequence
  Description of Artificial Sequence: Synthetic oligonucleotide
gguggcaggcgggcccca

SEQ ID NO: 61853 - RNA, 18 nt, Artificial Sequence
  Description of Artificial Sequence: Synthetic oligonucleotide
ggagagguggcaggcggg

SEQ ID NO: 61854 - RNA, 18 nt, Artificial Sequence
  Description of Artificial Sequence: Synthetic oligonucleotide
ggcugggagagguggcag

SEQ ID NO: 61855 - RNA, 18 nt, Artificial Sequence
  Description of Artificial Sequence: Synthetic oligonucleotide
cugagggcugggagaggu

SEQ ID NO: 61856 - RNA, 18 nt, Artificial Sequence
  Description of Artificial Sequence: Synthetic oligonucleotide
caaugcugagggcuggga

SEQ ID NO: 61857 - RNA, 18 nt, Artificial Sequence
  Description of Artificial Sequence: Synthetic oligonucleotide
gcugacaaugcugagggc

SEQ ID NO: 61858 - RNA, 18 nt, Artificial Sequence
  Description of Artificial Sequence: Synthetic oligonucleotide
uucaggcugacaaugcug

SEQ ID NO: 61859 - RNA, 18 nt, Artificial Sequence
  Description of Artificial Sequence: Synthetic oligonucleotide
ugaucuucaggcugacaa

SEQ ID NO: 61860 - RNA, 18 nt, Artificial Sequence
  Description of Artificial Sequence: Synthetic oligonucleotide
agcucugaucuucaggcu

SEQ ID NO: 61861 - RNA, 18 nt, Artificial Sequence
  Description of Artificial Sequence: Synthetic oligonucleotide
gcugcagcucugaucuuc

SEQ ID NO: 61862 - RNA, 18 nt, Artificial Sequence
  Description of Artificial Sequence: Synthetic oligonucleotide
gacuggcugcagcucuga

SEQ ID NO: 61863 - RNA, 18 nt, Artificial Sequence
  Description of Artificial Sequence: Synthetic oligonucleotide
ugccugacuggcugcagc

SEQ ID NO: 61864 - RNA, 18 nt, Artificial Sequence
  Description of Artificial Sequence: Synthetic oligonucleotide
uccccugccugacuggcu

SEQ ID NO: 61865 - RNA, 18 nt, Artificial Sequence
  Description of Artificial Sequence: Synthetic oligonucleotide
aucucuccccugccugac

SEQ ID NO: 61866 - RNA, 18 nt, Artificial Sequence
  Description of Artificial Sequence: Synthetic oligonucleotide
gaaaaaucucuccccugc

SEQ ID NO: 61867 - RNA, 18 nt, Artificial Sequence
  Description of Artificial Sequence: Synthetic oligonucleotide
uaaaagaaaaaucucucc

SEQ ID NO: 61868 - RNA, 18 nt, Artificial Sequence
  Description of Artificial Sequence: Synthetic oligonucleotide
gggcuuaaaagaaaaauc

SEQ ID NO: 61869 - RNA, 18 nt, Artificial Sequence
  Description of Artificial Sequence: Synthetic oligonucleotide
gagcagggcuuaaaagaa

SEQ ID NO: 61870 - RNA, 18 nt, Artificial Sequence
  Description of Artificial Sequence: Synthetic oligonucleotide
agaaagagcagggcuuaa

SEQ ID NO: 61871 - RNA, 18 nt, Artificial Sequence
  Description of Artificial Sequence: Synthetic oligonucleotide
cucagagaaagagcaggg

SEQ ID NO: 61872 - RNA, 18 nt, Artificial Sequence
  Description of Artificial Sequence: Synthetic oligonucleotide
ugguucucagagaaagag

SEQ ID NO: 61873 - RNA, 18 nt, Artificial Sequence
  Description of Artificial Sequence: Synthetic oligonucleotide
ucuuuugguucucagaga

SEQ ID NO: 61874 - RNA, 18 nt, Artificial Sequence
  Description of Artificial Sequence: Synthetic oligonucleotide
aggcaucuuuugguucuc

SEQ ID NO: 61875 - RNA, 18 nt, Artificial Sequence
  Description of Artificial Sequence: Synthetic oligonucleotide
auucaaggcaucuuuugg

SEQ ID NO: 61876 - RNA, 18 nt, Artificial Sequence
  Description of Artificial Sequence: Synthetic oligonucleotide
uaaauauucaaggcaucu

SEQ ID NO: 61877 - RNA, 18 nt, Artificial Sequence
  Description of Artificial Sequence: Synthetic oligonucleotide
cugaauaaauauucaagg

SEQ ID NO: 61878 - RNA, 18 nt, Artificial Sequence
  Description of Artificial Sequence: Synthetic oligonucleotide
agucacugaauaaauauu

SEQ ID NO: 61879 - RNA, 18 nt, Artificial Sequence
  Description of Artificial Sequence: Synthetic oligonucleotide
ccagaagucacugaauaa

SEQ ID NO: 61880 - RNA, 18 nt, Artificial Sequence
  Description of Artificial Sequence: Synthetic oligonucleotide
auaagccagaagucacug

SEQ ID NO: 61881 - RNA, 18 nt, Artificial Sequence
  Description of Artificial Sequence: Synthetic oligonucleotide
ugagcauaagccagaagu

SEQ ID NO: 61882 - RNA, 18 nt, Artificial Sequence
  Description of Artificial Sequence: Synthetic oligonucleotide
gcuucugagcauaagcca

SEQ ID NO: 61883 - RNA, 18 nt, Artificial Sequence
  Description of Artificial Sequence: Synthetic oligonucleotide
gacuggcuucugagcaua

SEQ ID NO: 61884 - RNA, 18 nt, Artificial Sequence
  Description of Artificial Sequence: Synthetic oligonucleotide
acgcagacuggcuucuga

SEQ ID NO: 61885 - RNA, 18 nt, Artificial Sequence
  Description of Artificial Sequence: Synthetic oligonucleotide
gccugacgcagacuggcu

SEQ ID NO: 61886 - RNA, 18 nt, Artificial Sequence
  Description of Artificial Sequence: Synthetic oligonucleotide
gacgugccugacgcagac

SEQ ID NO: 61887 - RNA, 18 nt, Artificial Sequence
  Description of Artificial Sequence: Synthetic oligonucleotide
caggagacgugccugacg

SEQ ID NO: 61888 - RNA, 18 nt, Artificial Sequence
  Description of Artificial Sequence: Synthetic oligonucleotide
cgcagcaggagacgugcc

SEQ ID NO: 61889 - RNA, 18 nt, Artificial Sequence
  Description of Artificial Sequence: Synthetic oligonucleotide
ugucacgcagcaggagac

SEQ ID NO: 61890 - RNA, 18 nt, Artificial Sequence
  Description of Artificial Sequence: Synthetic oligonucleotide
gcacaugucacgcagcag

SEQ ID NO: 61891 - RNA, 18 nt, Artificial Sequence
  Description of Artificial Sequence: Synthetic oligonucleotide
gcacugcacaugucacgc

SEQ ID NO: 61892 - RNA, 18 nt, Artificial Sequence
  Description of Artificial Sequence: Synthetic oligonucleotide
uuacagcacugcacaugu

SEQ ID NO: 61893 - RNA, 18 nt, Artificial Sequence
  Description of Artificial Sequence: Synthetic oligonucleotide
gccgauuacagcacugca

SEQ ID NO: 61894 - RNA, 18 nt, Artificial Sequence
  Description of Artificial Sequence: Synthetic oligonucleotide
cgggagccgauuacagca

SEQ ID NO: 61895 - RNA, 18 nt, Artificial Sequence
  Description of Artificial Sequence: Synthetic oligonucleotide
gcaagcgggagccgauua

SEQ ID NO: 61896 - RNA, 18 nt, Artificial Sequence
  Description of Artificial Sequence: Synthetic oligonucleotide
ggagagcaagcgggagcc

SEQ ID NO: 61897 - RNA, 18 nt, Artificial Sequence
  Description of Artificial Sequence: Synthetic oligonucleotide
cuccaggagagcaagcgg

SEQ ID NO: 61898 - RNA, 18 nt, Artificial Sequence
  Description of Artificial Sequence: Synthetic oligonucleotide
gcuugcuccaggagagca

SEQ ID NO: 61899 - RNA, 18 nt, Artificial Sequence
  Description of Artificial Sequence: Synthetic oligonucleotide
gcagagcuugcuccagga

SEQ ID NO: 61900 - RNA, 18 nt, Artificial Sequence
  Description of Artificial Sequence: Synthetic oligonucleotide
ccagggcagagcuugcuc

SEQ ID NO: 61901 - RNA, 18 nt, Artificial Sequence
  Description of Artificial Sequence: Synthetic oligonucleotide
cacagccagggcagagcu

SEQ ID NO: 61902 - RNA, 18 nt, Artificial Sequence
  Description of Artificial Sequence: Synthetic oligonucleotide
auacccacagccagggca

SEQ ID NO: 61903 - RNA, 18 nt, Artificial Sequence
  Description of Artificial Sequence: Synthetic oligonucleotide
uccugauacccacagcca

SEQ ID NO: 61904 - RNA, 18 nt, Artificial Sequence
  Description of Artificial Sequence: Synthetic oligonucleotide
cacaguccugauacccac

SEQ ID NO: 61905 - RNA, 18 nt, Artificial Sequence
  Description of Artificial Sequence: Synthetic oligonucleotide
uuggucacaguccugaua

SEQ ID NO: 61906 - RNA, 18 nt, Artificial Sequence
  Description of Artificial Sequence: Synthetic oligonucleotide
augcuuuggucacagucc

SEQ ID NO: 61907 - RNA, 18 nt, Artificial Sequence
  Description of Artificial Sequence: Synthetic oligonucleotide
uagaaaugcuuuggucac

SEQ ID NO: 61908 - RNA, 18 nt, Artificial Sequence
  Description of Artificial Sequence: Synthetic oligonucleotide
gggacuagaaaugcuuug

SEQ ID NO: 61909 - RNA, 18 nt, Artificial Sequence
  Description of Artificial Sequence: Synthetic oligonucleotide
gagaagggacuagaaaug

SEQ ID NO: 61910 - RNA, 18 nt, Artificial Sequence
  Description of Artificial Sequence: Synthetic oligonucleotide
aaagagagaagggacuag

SEQ ID NO: 61911 - RNA, 18 nt, Artificial Sequence
  Description of Artificial Sequence: Synthetic oligonucleotide
cuuagaaagagagaaggg

SEQ ID NO: 61912 - RNA, 18 nt, Artificial Sequence
  Description of Artificial Sequence: Synthetic oligonucleotide
ggguccuuagaaagagag

SEQ ID NO: 61913 - RNA, 18 nt, Artificial Sequence
  Description of Artificial Sequence: Synthetic oligonucleotide
aauuuggguccuuagaaa

SEQ ID NO: 61914 - RNA, 18 nt, Artificial Sequence
  Description of Artificial Sequence: Synthetic oligonucleotide
agggaaauuuggguccuu

SEQ ID NO: 61915 - RNA, 18 nt, Artificial Sequence
  Description of Artificial Sequence: Synthetic oligonucleotide
cccccagggaaauuuggg

SEQ ID NO: 61916 - RNA, 18 nt, Artificial Sequence
  Description of Artificial Sequence: Synthetic oligonucleotide
ggaugcccccagggaaau

SEQ ID NO: 61917 - RNA, 18 nt, Artificial Sequence
  Description of Artificial Sequence: Synthetic oligonucleotide
aagcaggaugcccccagg

SEQ ID NO: 61918 - RNA, 18 nt, Artificial Sequence
  Description of Artificial Sequence: Synthetic oligonucleotide
ucaggaagcaggaugccc

SEQ ID NO: 61919 - RNA, 18 nt, Artificial Sequence
  Description of Artificial Sequence: Synthetic oligonucleotide
agcuuucaggaagcagga

SEQ ID NO: 61920 - RNA, 18 nt, Artificial Sequence
  Description of Artificial Sequence: Synthetic oligonucleotide
ccaacagcuuucaggaag

SEQ ID NO: 61921 - RNA, 18 nt, Artificial Sequence
  Description of Artificial Sequence: Synthetic oligonucleotide
gaaauccaacagcuuuca

SEQ ID NO: 61922 - RNA, 18 nt, Artificial Sequence
  Description of Artificial Sequence: Synthetic oligonucleotide
ucacugaaauccaacagc

SEQ ID NO: 61923 - RNA, 18 nt, Artificial Sequence
  Description of Artificial Sequence: Synthetic oligonucleotide
aaaaaucacugaaaucca

SEQ ID NO: 61924 - RNA, 18 nt, Artificial Sequence
  Description of Artificial Sequence: Synthetic oligonucleotide
gggaaaaaucacugaaau

SEQ ID NO: 61925 - RNA, 18 nt, Artificial Sequence
  Description of Artificial Sequence: Synthetic oligonucleotide
gugcucuccugugcuggg

SEQ ID NO: 61926 - RNA, 18 nt, Artificial Sequence
  Description of Artificial Sequence: Synthetic oligonucleotide
ugugggugcucuccugug

SEQ ID NO: 61927 - RNA, 18 nt, Artificial Sequence
  Description of Artificial Sequence: Synthetic oligonucleotide
gcggcugugggugcucuc

SEQ ID NO: 61928 - RNA, 18 nt, Artificial Sequence
  Description of Artificial Sequence: Synthetic oligonucleotide
cuucugcggcugugggug

SEQ ID NO: 61929 - RNA, 18 nt, Artificial Sequence
  Description of Artificial Sequence: Synthetic oligonucleotide
uuccccuucugcggcugu

SEQ ID NO: 61930 - RNA, 18 nt, Artificial Sequence
  Description of Artificial Sequence: Synthetic oligonucleotide
acacauuccccuucugcg

SEQ ID NO: 61931 - RNA, 18 nt, Artificial Sequence
  Description of Artificial Sequence: Synthetic oligonucleotide
ggaggacacauuccccuu

SEQ ID NO: 61932 - RNA, 18 nt, Artificial Sequence
  Description of Artificial Sequence: Synthetic oligonucleotide
gagcaggaggacacauuc

SEQ ID NO: 61933 - RNA, 18 nt, Artificial Sequence
  Description of Artificial Sequence: Synthetic oligonucleotide
aagcagagcaggaggaca

SEQ ID NO: 61934 - RNA, 18 nt, Artificial Sequence
  Description of Artificial Sequence: Synthetic oligonucleotide
ugaggaagcagagcagga

SEQ ID NO: 61935 - RNA, 18 nt, Artificial Sequence
  Description of Artificial Sequence: Synthetic oligonucleotide
ggcccugaggaagcagag

SEQ ID NO: 61936 - RNA, 18 nt, Artificial Sequence
  Description of Artificial Sequence: Synthetic oligonucleotide
ugcugggcccugaggaag

SEQ ID NO: 61937 - RNA, 18 nt, Artificial Sequence
  Description of Artificial Sequence: Synthetic oligonucleotide
ccgccugcugggcccuga

SEQ ID NO: 61938 - RNA, 18 nt, Artificial Sequence
  Description of Artificial Sequence: Synthetic oligonucleotide
aacccccgccugcugggc

SEQ ID NO: 61939 - RNA, 18 nt, Artificial Sequence
  Description of Artificial Sequence: Synthetic oligonucleotide
gcucaaacccccgccugc

SEQ ID NO: 61940 - RNA, 18 nt, Artificial Sequence
  Description of Artificial Sequence: Synthetic oligonucleotide
ccagggcucaaacccccg

SEQ ID NO: 61941 - RNA, 18 nt, Artificial Sequence
  Description of Artificial Sequence: Synthetic oligonucleotide
ggguccagggcucaaacc

SEQ ID NO: 61942 - RNA, 18 nt, Artificial Sequence
  Description of Artificial Sequence: Synthetic oligonucleotide
agucucuaagagccuggg

SEQ ID NO: 61943 - RNA, 18 nt, Artificial Sequence
  Description of Artificial Sequence: Synthetic oligonucleotide
cccuuagucucuaagagc

SEQ ID NO: 61944 - RNA, 18 nt, Artificial Sequence
  Description of Artificial Sequence: Synthetic oligonucleotide
gcugccccuuagucucua

SEQ ID NO: 61945 - RNA, 18 nt, Artificial Sequence
  Description of Artificial Sequence: Synthetic oligonucleotide
caggagcugccccuuagu

SEQ ID NO: 61946 - RNA, 18 nt, Artificial Sequence
  Description of Artificial Sequence: Synthetic oligonucleotide
uuggucaggagcugcccc

SEQ ID NO: 61947 - RNA, 18 nt, Artificial Sequence
  Description of Artificial Sequence: Synthetic oligonucleotide
cgucuuuggucaggagcu

SEQ ID NO: 61948 - RNA, 18 nt, Artificial Sequence
  Description of Artificial Sequence: Synthetic oligonucleotide
uguaucgucuuuggucag

SEQ ID NO: 61949 - RNA, 18 nt, Artificial Sequence
  Description of Artificial Sequence: Synthetic oligonucleotide
caagcuguaucgucuuug

SEQ ID NO: 61950 - RNA, 18 nt, Artificial Sequence
  Description of Artificial Sequence: Synthetic oligonucleotide
agugccaagcuguaucgu

SEQ ID NO: 61951 - RNA, 18 nt, Artificial Sequence
  Description of Artificial Sequence: Synthetic oligonucleotide
uuuaaagugccaagcugu

SEQ ID NO: 61952 - RNA, 18 nt, Artificial Sequence
  Description of Artificial Sequence: Synthetic oligonucleotide
aaugcuuuaaagugccaa

SEQ ID NO: 61953 - RNA, 18 nt, Artificial Sequence
  Description of Artificial Sequence: Synthetic oligonucleotide
cuguuaaugcuuuaaagu

SEQ ID NO: 61954 - RNA, 18 nt, Artificial Sequence
  Description of Artificial Sequence: Synthetic oligonucleotide
accugcuguuaaugcuuu

SEQ ID NO: 61955 - RNA, 18 nt, Artificial Sequence
  Description of Artificial Sequence: Synthetic oligonucleotide
gucacaccugcuguuaau

SEQ ID NO: 61956 - RNA, 18 nt, Artificial Sequence
  Description of Artificial Sequence: Synthetic oligonucleotide
ucagggucacaccugcug

SEQ ID NO: 61957 - RNA, 18 nt, Artificial Sequence
  Description of Artificial Sequence: Synthetic oligonucleotide
agcccucagggucacacc

SEQ ID NO: 61958 - RNA, 18 nt, Artificial Sequence
  Description of Artificial Sequence: Synthetic oligonucleotide
ggaggagcccucaggguc

SEQ ID NO: 61959 - RNA, 18 nt, Artificial Sequence
  Description of Artificial Sequence: Synthetic oligonucleotide
accauggaggagcccuca

SEQ ID NO: 61960 - RNA, 18 nt, Artificial Sequence
  Description of Artificial Sequence: Synthetic oligonucleotide
gcagcaccauggaggagc

SEQ ID NO: 61961 - RNA, 18 nt, Artificial Sequence
  Description of Artificial Sequence: Synthetic oligonucleotide
ucaaugcagcaccaugga

SEQ ID NO: 61962 - RNA, 18 nt, Artificial Sequence
  Description of Artificial Sequence: Synthetic oligonucleotide
uggacucaaugcagcacc

SEQ ID NO: 61963 - RNA, 18 nt, Artificial Sequence
  Description of Artificial Sequence: Synthetic oligonucleotide
aaagcuggacucaaugca

SEQ ID NO: 61964 - RNA, 18 nt, Artificial Sequence
  Description of Artificial Sequence: Synthetic oligonucleotide
gaaggaaagcuggacuca

SEQ ID NO: 61965 - RNA, 18 nt, Artificial Sequence
  Description of Artificial Sequence: Synthetic oligonucleotide
gggcagaaggaaagcugg

SEQ ID NO: 61966 - RNA, 18 nt, Artificial Sequence
  Description of Artificial Sequence: Synthetic oligonucleotide
aggaagggcagaaggaaa

SEQ ID NO: 61967 - RNA, 18 nt, Artificial Sequence
  Description of Artificial Sequence: Synthetic oligonucleotide
ccuggaggaagggcagaa

SEQ ID NO: 61968 - RNA, 18 nt, Artificial Sequence
  Description of Artificial Sequence: Synthetic oligonucleotide
cuucuccuggaggaaggg

SEQ ID NO: 61969 - RNA, 18 nt, Artificial Sequence
  Description of Artificial Sequence: Synthetic oligonucleotide
ggccccuucuccuggagg

SEQ ID NO: 61970 - RNA, 18 nt, Artificial Sequence
  Description of Artificial Sequence: Synthetic oligonucleotide
ccuugggccccuucuccu

SEQ ID NO: 61971 - RNA, 18 nt, Artificial Sequence
  Description of Artificial Sequence: Synthetic oligonucleotide
gggaccuugggccccuuc

SEQ ID NO: 61972 - RNA, 18 nt, Artificial Sequence
  Description of Artificial Sequence: Synthetic oligonucleotide
guggagaccauccacggg

SEQ ID NO: 61973 - RNA, 18 nt, Artificial Sequence
  Description of Artificial Sequence: Synthetic oligonucleotide
cacagguggagaccaucc

SEQ ID NO: 61974 - RNA, 18 nt, Artificial Sequence
  Description of Artificial Sequence: Synthetic oligonucleotide
ccaagcacagguggagac

SEQ ID NO: 61975 - RNA, 18 nt, Artificial Sequence
  Description of Artificial Sequence: Synthetic oligonucleotide
ugguuccaagcacaggug

SEQ ID NO: 61976 - RNA, 18 nt, Artificial Sequence
  Description of Artificial Sequence: Synthetic oligonucleotide
uacacugguuccaagcac

SEQ ID NO: 61977 - RNA, 18 nt, Artificial Sequence
  Description of Artificial Sequence: Synthetic oligonucleotide
ccaguuacacugguucca

SEQ ID NO: 61978 - RNA, 18 nt, Artificial Sequence
  Description of Artificial Sequence: Synthetic oligonucleotide
agcagccaguuacacugg

SEQ ID NO: 61979 - RNA, 18 nt, Artificial Sequence
  Description of Artificial Sequence: Synthetic oligonucleotide
cagggagcagccaguuac

SEQ ID NO: 61980 - RNA, 18 nt, Artificial Sequence
  Description of Artificial Sequence: Synthetic oligonucleotide
gggagcagggagcagcca

SEQ ID NO: 61981 - RNA, 18 nt, Artificial Sequence
  Description of Artificial Sequence: Synthetic oligonucleotide
ucccugggagcagggagc

SEQ ID NO: 61982 - RNA, 18 nt, Artificial Sequence
  Description of Artificial Sequence: Synthetic oligonucleotide
gucagucccugggagcag

SEQ ID NO: 61983 - RNA, 18 nt, Artificial Sequence
  Description of Artificial Sequence: Synthetic oligonucleotide
cccgugucagucccuggg

SEQ ID NO: 61984 - RNA, 18 nt, Artificial Sequence
  Description of Artificial Sequence: Synthetic oligonucleotide
ugauccccgugucagucc

SEQ ID NO: 61985 - RNA, 18 nt, Artificial Sequence
  Description of Artificial Sequence: Synthetic oligonucleotide
agagaugauccccguguc

SEQ ID NO: 61986 - RNA, 18 nt, Artificial Sequence
  Description of Artificial Sequence: Synthetic oligonucleotide
gucacagagaugaucccc

SEQ ID NO: 61987 - RNA, 18 nt, Artificial Sequence
  Description of Artificial Sequence: Synthetic oligonucleotide
gggcggucacagagauga

SEQ ID NO: 61988 - RNA, 18 nt, Artificial Sequence
  Description of Artificial Sequence: Synthetic oligonucleotide
acggagggcggucacaga

SEQ ID NO: 61989 - RNA, 18 nt, Artificial Sequence
  Description of Artificial Sequence: Synthetic oligonucleotide
gcccgacggagggcgguc

SEQ ID NO: 61990 - RNA, 18 nt, Artificial Sequence
  Description of Artificial Sequence: Synthetic oligonucleotide
gggcccgacggagggcgg

SEQ ID NO: 61991 - RNA, 18 nt, Artificial Sequence
  Description of Artificial Sequence: Synthetic oligonucleotide
gggagaaggcaggcaggg

SEQ ID NO: 61992 - RNA, 18 nt, Artificial Sequence
  Description of Artificial Sequence: Synthetic oligonucleotide
gagcacagccuugcgugg

SEQ ID NO: 61993 - RNA, 18 nt, Artificial Sequence
  Description of Artificial Sequence: Synthetic oligonucleotide
aggaagagcacagccuug

SEQ ID NO: 61994 - RNA, 18 nt, Artificial Sequence
  Description of Artificial Sequence: Synthetic oligonucleotide
accagaggaagagcacag

SEQ ID NO: 61995 - RNA, 18 nt, Artificial Sequence
  Description of Artificial Sequence: Synthetic oligonucleotide
cagaaaccagaggaagag

SEQ ID NO: 61996 - RNA, 18 nt, Artificial Sequence
  Description of Artificial Sequence: Synthetic oligonucleotide
acacacagaaaccagagg

SEQ ID NO: 61997 - RNA, 18 nt, Artificial Sequence
  Description of Artificial Sequence: Synthetic oligonucleotide
aacggacacacagaaacc

SEQ ID NO: 61998 - RNA, 18 nt, Artificial Sequence
  Description of Artificial Sequence: Synthetic oligonucleotide
acucaaacggacacacag

SEQ ID NO: 61999 - RNA, 18 nt, Artificial Sequence
  Description of Artificial Sequence: Synthetic oligonucleotide
cagacacucaaacggaca

SEQ ID NO: 62000 - RNA, 18 nt, Artificial Sequence
  Description of Artificial Sequence: Synthetic oligonucleotide
gggcgcagacacucaaac

SEQ ID NO: 62001 - RNA, 18 nt, Artificial Sequence
  Description of Artificial Sequence: Synthetic oligonucleotide
ucaucccaggaaguaugg

SEQ ID NO: 62002 - RNA, 18 nt, Artificial Sequence
  Description of Artificial Sequence: Synthetic oligonucleotide
acacaucaucccaggaag

SEQ ID NO: 62003 - RNA, 18 nt, Artificial Sequence
  Description of Artificial Sequence: Synthetic oligonucleotide
guuucacacaucauccca

SEQ ID NO: 62004 - RNA, 18 nt, Artificial Sequence
  Description of Artificial Sequence: Synthetic oligonucleotide
gucagguuucacacauca

SEQ ID NO: 62005 - RNA, 18 nt, Artificial Sequence
  Description of Artificial Sequence: Synthetic oligonucleotide
uaggugucagguuucaca

SEQ ID NO: 62006 - RNA, 18 nt, Artificial Sequence
  Description of Artificial Sequence: Synthetic oligonucleotide
aaaucuaggugucagguu

SEQ ID NO: 62007 - RNA, 18 nt, Artificial Sequence
  Description of Artificial Sequence: Synthetic oligonucleotide
caaauaaaucuagguguc

SEQ ID NO: 62008 - RNA, 18 nt, Artificial Sequence
  Description of Artificial Sequence: Synthetic oligonucleotide
auuuccaaauaaaucuag

SEQ ID NO: 62009 - RNA, 18 nt, Artificial Sequence
  Description of Artificial Sequence: Synthetic oligonucleotide
agaauauuuccaaauaaa

SEQ ID NO: 62010 - RNA, 18 nt, Artificial Sequence
  Description of Artificial Sequence: Synthetic oligonucleotide
gucauagaauauuuccaa

SEQ ID NO: 62011 - RNA, 18 nt, Artificial Sequence
  Description of Artificial Sequence: Synthetic oligonucleotide
aaguggucauagaauauu

SEQ ID NO: 62012 - RNA, 18 nt, Artificial Sequence
  Description of Artificial Sequence: Synthetic oligonucleotide
cuguaaaguggucauaga

SEQ ID NO: 62013 - RNA, 18 nt, Artificial Sequence
  Description of Artificial Sequence: Synthetic oligonucleotide
cucaucuguaaagugguc

SEQ ID NO: 62014 - RNA, 18 nt, Artificial Sequence
  Description of Artificial Sequence: Synthetic oligonucleotide
guuuccucaucuguaaag

SEQ ID NO: 62015 - RNA, 18 nt, Artificial Sequence
  Description of Artificial Sequence: Synthetic oligonucleotide
ggccuguuuccucaucug

SEQ ID NO: 62016 - RNA, 18 nt, Artificial Sequence
  Description of Artificial Sequence: Synthetic oligonucleotide
cuugaggccuguuuccuc

SEQ ID NO: 62017 - RNA, 18 nt, Artificial Sequence
  Description of Artificial Sequence: Synthetic oligonucleotide
ccacgcuugaggccuguu

SEQ ID NO: 62018 - RNA, 18 nt, Artificial Sequence
  Description of Artificial Sequence: Synthetic oligonucleotide
ccccuccacgcuugaggc

SEQ ID NO: 62019 - RNA, 18 nt, Artificial Sequence
  Description of Artificial Sequence: Synthetic oligonucleotide
cucuaccccuccacgcuu

SEQ ID NO: 62020 - RNA, 18 nt, Artificial Sequence
  Description of Artificial Sequence: Synthetic oligonucleotide
cuucacucuaccccucca

SEQ ID NO: 62021 - RNA, 18 nt, Artificial Sequence
  Description of Artificial Sequence: Synthetic oligonucleotide
cuacucuucacucuaccc

SEQ ID NO: 62022 - RNA, 18 nt, Artificial Sequence
  Description of Artificial Sequence: Synthetic oligonucleotide
ggguucuacucuucacuc

SEQ ID NO: 62023 - RNA, 18 nt, Artificial Sequence
  Description of Artificial Sequence: Synthetic oligonucleotide
gaccuggguucuacucuu

SEQ ID NO: 62024 - RNA, 18 nt, Artificial Sequence
  Description of Artificial Sequence: Synthetic oligonucleotide
caucagaccuggguucua

SEQ ID NO: 62025 - RNA, 18 nt, Artificial Sequence
  Description of Artificial Sequence: Synthetic oligonucleotide
uuuggcaucagaccuggg

SEQ ID NO: 62026 - RNA, 18 nt, Artificial Sequence
  Description of Artificial Sequence: Synthetic oligonucleotide
gcagcuuuggcaucagac

SEQ ID NO: 62027 - RNA, 18 nt, Artificial Sequence
  Description of Artificial Sequence: Synthetic oligonucleotide
agaaagcagcuuuggcau

SEQ ID NO: 62028 - RNA, 18 nt, Artificial Sequence
  Description of Artificial Sequence: Synthetic oligonucleotide
agagaagaaagcagcuuu

SEQ ID NO: 62029 - RNA, 18 nt, Artificial Sequence
  Description of Artificial Sequence: Synthetic oligonucleotide
gaggcagagaagaaagca

SEQ ID NO: 62030 - RNA, 18 nt, Artificial Sequence
  Description of Artificial Sequence: Synthetic oligonucleotide
aggaggaggcagagaaga

SEQ ID NO: 62031 - RNA, 18 nt, Artificial Sequence
  Description of Artificial Sequence: Synthetic oligonucleotide
gcgugaggaggaggcaga

SEQ ID NO: 62032 - RNA, 18 nt, Artificial Sequence
  Description of Artificial Sequence: Synthetic oligonucleotide
gaguugcgugaggaggag

SEQ ID NO: 62033 - RNA, 18 nt, Artificial Sequence
  Description of Artificial Sequence: Synthetic oligonucleotide
ggugugaguugcgugagg

SEQ ID NO: 62034 - RNA, 18 nt, Artificial Sequence
  Description of Artificial Sequence: Synthetic oligonucleotide
aaggaggugugaguugcg

SEQ ID NO: 62035 - RNA, 18 nt, Artificial Sequence
  Description of Artificial Sequence: Synthetic oligonucleotide
aagaaaaggaggugugag

SEQ ID NO: 62036 - RNA, 18 nt, Artificial Sequence
  Description of Artificial Sequence: Synthetic oligonucleotide
gcuagaagaaaaggaggu

SEQ ID NO: 62037 - RNA, 18 nt, Artificial Sequence
  Description of Artificial Sequence: Synthetic oligonucleotide
acaaagcuagaagaaaag

SEQ ID NO: 62038 - RNA, 18 nt, Artificial Sequence
  Description of Artificial Sequence: Synthetic oligonucleotide
ggacaacaaagcuagaag

SEQ ID NO: 62039 - RNA, 18 nt, Artificial Sequence
  Description of Artificial Sequence: Synthetic oligonucleotide
ugggaggacaacaaagcu

SEQ ID NO: 62040 - RNA, 18 nt, Artificial Sequence
  Description of Artificial Sequence: Synthetic oligonucleotide
guuccugggaggacaaca

SEQ ID NO: 62041 - RNA, 18 nt, Artificial Sequence
  Description of Artificial Sequence: Synthetic oligonucleotide
uuuugguuccugggagga

SEQ ID NO: 62042 - RNA, 18 nt, Artificial Sequence
  Description of Artificial Sequence: Synthetic oligonucleotide
ggguuuuuugguuccugg

SEQ ID NO: 62043 - RNA, 18 nt, Artificial Sequence
  Description of Artificial Sequence: Synthetic oligonucleotide
uuuuggucagaaaauagc

SEQ ID NO: 62044 - RNA, 18 nt, Artificial Sequence
  Description of Artificial Sequence: Synthetic oligonucleotide
acacauuuuggucagaaa

SEQ ID NO: 62045 - RNA, 18 nt, Artificial Sequence
  Description of Artificial Sequence: Synthetic oligonucleotide
augaaacacauuuugguc

SEQ ID NO: 62046 - RNA, 18 nt, Artificial Sequence
  Description of Artificial Sequence: Synthetic oligonucleotide
uuguuaugaaacacauuu

SEQ ID NO: 62047 - RNA, 18 nt, Artificial Sequence
  Description of Artificial Sequence: Synthetic oligonucleotide
augguuuguuaugaaaca

SEQ ID NO: 62048 - RNA, 18 nt, Artificial Sequence
  Description of Artificial Sequence: Synthetic oligonucleotide
accagaugguuuguuaug

SEQ ID NO: 62049 - RNA, 18 nt, Artificial Sequence
  Description of Artificial Sequence: Synthetic oligonucleotide
aaggcaccagaugguuug

SEQ ID NO: 62050 - RNA, 18 nt, Artificial Sequence
  Description of Artificial Sequence: Synthetic oligonucleotide
guggaaaggcaccagaug

SEQ ID NO: 62051 - RNA, 18 nt, Artificial Sequence
  Description of Artificial Sequence: Synthetic oligonucleotide
ucuguguggaaaggcacc

SEQ ID NO: 62052 - RNA, 18 nt, Artificial Sequence
  Description of Artificial Sequence: Synthetic oligonucleotide
ccaguucuguguggaaag

SEQ ID NO: 62053 - RNA, 18 nt, Artificial Sequence
  Description of Artificial Sequence: Synthetic oligonucleotide
uccugccaguucugugug

SEQ ID NO: 62054 - RNA, 18 nt, Artificial Sequence
  Description of Artificial Sequence: Synthetic oligonucleotide
gaggcuccugccaguucu

SEQ ID NO: 62055 - RNA, 18 nt, Artificial Sequence
  Description of Artificial Sequence: Synthetic oligonucleotide
gacacgaggcuccugcca

SEQ ID NO: 62056 - RNA, 18 nt, Artificial Sequence
  Description of Artificial Sequence: Synthetic oligonucleotide
agcaggacacgaggcucc

SEQ ID NO: 62057 - RNA, 18 nt, Artificial Sequence
  Description of Artificial Sequence: Synthetic oligonucleotide
cagcuagcaggacacgag

SEQ ID NO: 62058 - RNA, 18 nt, Artificial Sequence
  Description of Artificial Sequence: Synthetic oligonucleotide
agagacagcuagcaggac

SEQ ID NO: 62059 - RNA, 18 nt, Artificial Sequence
  Description of Artificial Sequence: Synthetic oligonucleotide
acaagagagacagcuagc

SEQ ID NO: 62060 - RNA, 18 nt, Artificial Sequence
  Description of Artificial Sequence: Synthetic oligonucleotide
aaucaacaagagagacag

SEQ ID NO: 62061 - RNA, 18 nt, Artificial Sequence
  Description of Artificial Sequence: Synthetic oligonucleotide
acggaaaucaacaagaga

SEQ ID NO: 62062 - RNA, 18 nt, Artificial Sequence
  Description of Artificial Sequence: Synthetic oligonucleotide
uuuucacggaaaucaaca

SEQ ID NO: 62063 - RNA, 18 nt, Artificial Sequence
  Description of Artificial Sequence: Synthetic oligonucleotide
uugcauuuucacggaaau

SEQ ID NO: 62064 - RNA, 18 nt, Artificial Sequence
  Description of Artificial Sequence: Synthetic oligonucleotide
aacacuugcauuuucacg

SEQ ID NO: 62065 - RNA, 18 nt, Artificial Sequence
  Description of Artificial Sequence: Synthetic oligonucleotide
cuucaaacacuugcauuu

SEQ ID NO: 62066 - RNA, 18 nt, Artificial Sequence
  Description of Artificial Sequence: Synthetic oligonucleotide
gcagacuucaaacacuug

SEQ ID NO: 62067 - RNA, 18 nt, Artificial Sequence
  Description of Artificial Sequence: Synthetic oligonucleotide
aaugagcagacuucaaac

SEQ ID NO: 62068 - RNA, 18 nt, Artificial Sequence
  Description of Artificial Sequence: Synthetic oligonucleotide
cucggaaugagcagacuu

SEQ ID NO: 62069 - RNA, 18 nt, Artificial Sequence
  Description of Artificial Sequence: Synthetic oligonucleotide
ucacccucggaaugagca

SEQ ID NO: 62070 - RNA, 18 nt, Artificial Sequence
  Description of Artificial Sequence: Synthetic oligonucleotide
uuguuucacccucggaau

SEQ ID NO: 62071 - RNA, 18 nt, Artificial Sequence
  Description of Artificial Sequence: Synthetic oligonucleotide
ggauuuuguuucacccuc

SEQ ID NO: 62072 - RNA, 18 nt, Artificial Sequence
  Description of Artificial Sequence: Synthetic oligonucleotide
ggguuggauuuuguuuca

SEQ ID NO: 62073 - RNA, 18 nt, Artificial Sequence
  Description of Artificial Sequence: Synthetic oligonucleotide
ugacaggguuggauuuug

SEQ ID NO: 62074 - RNA, 18 nt, Artificial Sequence
  Description of Artificial Sequence: Synthetic oligonucleotide
gauucugacaggguugga

SEQ ID NO: 62075 - RNA, 18 nt, Artificial Sequence
  Description of Artificial Sequence: Synthetic oligonucleotide
agcaugauucugacaggg

SEQ ID NO: 62076 - RNA, 18 nt, Artificial Sequence
  Description of Artificial Sequence: Synthetic oligonucleotide
agaacagcaugauucuga

SEQ ID NO: 62077 - RNA, 18 nt, Artificial Sequence
  Description of Artificial Sequence: Synthetic oligonucleotide
caaagagaacagcaugau

SEQ ID NO: 62078 - RNA, 18 nt, Artificial Sequence
  Description of Artificial Sequence: Synthetic oligonucleotide
gucagcaaagagaacagc

SEQ ID NO: 62079 - RNA, 18 nt, Artificial Sequence
  Description of Artificial Sequence: Synthetic oligonucleotide
acagugucagcaaagaga

SEQ ID NO: 62080 - RNA, 18 nt, Artificial Sequence
  Description of Artificial Sequence: Synthetic oligonucleotide
gggucacagugucagcaa

SEQ ID NO: 62081 - RNA, 18 nt, Artificial Sequence
  Description of Artificial Sequence: Synthetic oligonucleotide
acccagggucacaguguc

SEQ ID NO: 62082 - RNA, 18 nt, Artificial Sequence
  Description of Artificial Sequence: Synthetic oligonucleotide
ucccgacccagggucaca

SEQ ID NO: 62083 - RNA, 18 nt, Artificial Sequence
  Description of Artificial Sequence: Synthetic oligonucleotide
gucugucccgacccaggg

SEQ ID NO: 62084 - RNA, 18 nt, Artificial Sequence
  Description of Artificial Sequence: Synthetic oligonucleotide
ugcuggucugucccgacc

SEQ ID NO: 62085 - RNA, 18 nt, Artificial Sequence
  Description of Artificial Sequence: Synthetic oligonucleotide
auugcugcuggucugucc

SEQ ID NO: 62086 - RNA, 18 nt, Artificial Sequence
  Description of Artificial Sequence: Synthetic oligonucleotide
gacagauugcugcugguc

SEQ ID NO: 62087 - RNA, 18 nt, Artificial Sequence
  Description of Artificial Sequence: Synthetic oligonucleotide
cuaaagacagauugcugc

SEQ ID NO: 62088 - RNA, 18 nt, Artificial Sequence
  Description of Artificial Sequence: Synthetic oligonucleotide
cgauucuaaagacagauu

SEQ ID NO: 62089 - RNA, 18 nt, Artificial Sequence
  Description of Artificial Sequence: Synthetic oligonucleotide
gaaagcgauucuaaagac

SEQ ID NO: 62090 - RNA, 18 nt, Artificial Sequence
  Description of Artificial Sequence: Synthetic oligonucleotide
ggaaggaaagcgauucua

SEQ ID NO: 62091 - RNA, 18 nt, Artificial Sequence
  Description of Artificial Sequence: Synthetic oligonucleotide
gggaggaaggaaagcgau

SEQ ID NO: 62092 - RNA, 18 nt, Artificial Sequence
  Description of Artificial Sequence: Synthetic oligonucleotide
ugccgggagccccacggg

SEQ ID NO: 62093 - RNA, 18 nt, Artificial Sequence
  Description of Artificial Sequence: Synthetic oligonucleotide
caggaugccgggagcccc

SEQ ID NO: 62094 - RNA, 18 nt, Artificial Sequence
  Description of Artificial Sequence: Synthetic oligonucleotide
gcuuucaggaugccggga

SEQ ID NO: 62095 - RNA, 18 nt, Artificial Sequence
  Description of Artificial Sequence: Synthetic oligonucleotide
ugcuggcuuucaggaugc

SEQ ID NO: 62096 - RNA, 18 nt, Artificial Sequence
  Description of Artificial Sequence: Synthetic oligonucleotide
ggcuuugcuggcuuucag

SEQ ID NO: 62097 - RNA, 18 nt, Artificial Sequence
  Description of Artificial Sequence: Synthetic oligonucleotide
cuggaggcuuugcuggcu

SEQ ID NO: 62098 - RNA, 18 nt, Artificial Sequence
  Description of Artificial Sequence: Synthetic oligonucleotide
agaugcuggaggcuuugc

SEQ ID NO: 62099 - RNA, 18 nt, Artificial Sequence
  Description of Artificial Sequence: Synthetic oligonucleotide
ggaaaagaugcuggaggc

SEQ ID NO: 62100 - RNA, 18 nt, Artificial Sequence
  Description of Artificial Sequence: Synthetic oligonucleotide
aggauggaaaagaugcug

SEQ ID NO: 62101 - RNA, 18 nt, Artificial Sequence
  Description of Artificial Sequence: Synthetic oligonucleotide
accucaggauggaaaaga

SEQ ID NO: 62102 - RNA, 18 nt, Artificial Sequence
  Description of Artificial Sequence: Synthetic oligonucleotide
gaggcaccucaggaugga

SEQ ID NO: 62103 - RNA, 18 nt, Artificial Sequence
  Description of Artificial Sequence: Synthetic oligonucleotide
acugggaggcaccucagg

SEQ ID NO: 62104 - RNA, 18 nt, Artificial Sequence
  Description of Artificial Sequence: Synthetic oligonucleotide
aggccacugggaggcacc

SEQ ID NO: 62105 - RNA, 18 nt, Artificial Sequence
  Description of Artificial Sequence: Synthetic oligonucleotide
aagccaggccacugggag

SEQ ID NO: 62106 - RNA, 18 nt, Artificial Sequence
  Description of Artificial Sequence: Synthetic oligonucleotide
ccgacaagccaggccacu

SEQ ID NO: 62107 - RNA, 18 nt, Artificial Sequence
  Description of Artificial Sequence: Synthetic oligonucleotide
uugcuccgacaagccagg

SEQ ID NO: 62108 - RNA, 18 nt, Artificial Sequence
  Description of Artificial Sequence: Synthetic oligonucleotide
gaaacuugcuccgacaag

SEQ ID NO: 62109 - RNA, 18 nt, Artificial Sequence
  Description of Artificial Sequence: Synthetic oligonucleotide
cugaugaaacuugcuccg

SEQ ID NO: 62110 - RNA, 18 nt, Artificial Sequence
  Description of Artificial Sequence: Synthetic oligonucleotide
uagggcugaugaaacuug

SEQ ID NO: 62111 - RNA, 18 nt, Artificial Sequence
  Description of Artificial Sequence: Synthetic oligonucleotide
uucccuagggcugaugaa

SEQ ID NO: 62112 - RNA, 18 nt, Artificial Sequence
  Description of Artificial Sequence: Synthetic oligonucleotide
guguuuucccuagggcug

SEQ ID NO: 62113 - RNA, 18 nt, Artificial Sequence
  Description of Artificial Sequence: Synthetic oligonucleotide
gggccguguuuucccuag

SEQ ID NO: 62114 - RNA, 18 nt, Artificial Sequence
  Description of Artificial Sequence: Synthetic oligonucleotide
caggagggccguguuuuc

SEQ ID NO: 62115 - RNA, 18 nt, Artificial Sequence
  Description of Artificial Sequence: Synthetic oligonucleotide
guucccaggagggccgug

SEQ ID NO: 62116 - RNA, 18 nt, Artificial Sequence
  Description of Artificial Sequence: Synthetic oligonucleotide
aggagguucccaggaggg

SEQ ID NO: 62117 - RNA, 18 nt, Artificial Sequence
  Description of Artificial Sequence: Synthetic oligonucleotide
agguaaggagguucccag

SEQ ID NO: 62118 - RNA, 18 nt, Artificial Sequence
  Description of Artificial Sequence: Synthetic oligonucleotide
acuccagguaaggagguu

SEQ ID NO: 62119 - RNA, 18 nt, Artificial Sequence
  Description of Artificial Sequence: Synthetic oligonucleotide
cgguuacuccagguaagg

SEQ ID NO: 62120 - RNA, 18 nt, Artificial Sequence
  Description of Artificial Sequence: Synthetic oligonucleotide
guguccgguuacuccagg

SEQ ID NO: 62121 - RNA, 18 nt, Artificial Sequence
  Description of Artificial Sequence: Synthetic oligonucleotide
cuaagguguccgguuacu

SEQ ID NO: 62122 - RNA, 18 nt, Artificial Sequence
  Description of Artificial Sequence: Synthetic oligonucleotide
uccgucuaagguguccgg

SEQ ID NO: 62123 - RNA, 18 nt, Artificial Sequence
  Description of Artificial Sequence: Synthetic oligonucleotide
gcaccuccgucuaaggug

SEQ ID NO: 62124 - RNA, 18 nt, Artificial Sequence
  Description of Artificial Sequence: Synthetic oligonucleotide
cucaggcaccuccgucua

SEQ ID NO: 62125 - RNA, 18 nt, Artificial Sequence
  Description of Artificial Sequence: Synthetic oligonucleotide
ccacccucaggcaccucc

SEQ ID NO: 62126 - RNA, 18 nt, Artificial Sequence
  Description of Artificial Sequence: Synthetic oligonucleotide
ccaccccacccucaggca

SEQ ID NO: 62127 - RNA, 18 nt, Artificial Sequence
  Description of Artificial Sequence: Synthetic oligonucleotide
aaaucccaccccacccuc

SEQ ID NO: 62128 - RNA, 18 nt, Artificial Sequence
  Description of Artificial Sequence: Synthetic oligonucleotide
ccugcaaaucccacccca

SEQ ID NO: 62129 - RNA, 18 nt, Artificial Sequence
  Description of Artificial Sequence: Synthetic oligonucleotide
augacccugcaaauccca

SEQ ID NO: 62130 - RNA, 18 nt, Artificial Sequence
  Description of Artificial Sequence: Synthetic oligonucleotide
ugauaaugacccugcaaa

SEQ ID NO: 62131 - RNA, 18 nt, Artificial Sequence
  Description of Artificial Sequence: Synthetic oligonucleotide
uguucugauaaugacccu

SEQ ID NO: 62132 - RNA, 18 nt, Artificial Sequence
  Description of Artificial Sequence: Synthetic oligonucleotide
ccucauguucugauaaug

SEQ ID NO: 62133 - RNA, 18 nt, Artificial Sequence
  Description of Artificial Sequence: Synthetic oligonucleotide
guuauccucauguucuga

SEQ ID NO: 62134 - RNA, 18 nt, Artificial Sequence
  Description of Artificial Sequence: Synthetic oligonucleotide
aggaaguuauccucaugu

SEQ ID NO: 62135 - RNA, 18 nt, Artificial Sequence
  Description of Artificial Sequence: Synthetic oligonucleotide
gggcaaggaaguuauccu

SEQ ID NO: 62136 - RNA, 18 nt, Artificial Sequence
  Description of Artificial Sequence: Synthetic oligonucleotide
aggagguggcuacagagc

SEQ ID NO: 62137 - RNA, 18 nt, Artificial Sequence
  Description of Artificial Sequence: Synthetic oligonucleotide
ugccaaggagguggcuac

SEQ ID NO: 62138 - RNA, 18 nt, Artificial Sequence
  Description of Artificial Sequence: Synthetic oligonucleotide
gccggugccaaggaggug

SEQ ID NO: 62139 - RNA, 18 nt, Artificial Sequence
  Description of Artificial Sequence: Synthetic oligonucleotide
uagaggccggugccaagg

SEQ ID NO: 62140 - RNA, 18 nt, Artificial Sequence
  Description of Artificial Sequence: Synthetic oligonucleotide
acaaauagaggccggugc

SEQ ID NO: 62141 - RNA, 18 nt, Artificial Sequence
  Description of Artificial Sequence: Synthetic oligonucleotide
uuaugacaaauagaggcc

SEQ ID NO: 62142 - RNA, 18 nt, Artificial Sequence
  Description of Artificial Sequence: Synthetic oligonucleotide
ccgccuuaugacaaauag

SEQ ID NO: 62143 - RNA, 18 nt, Artificial Sequence
  Description of Artificial Sequence: Synthetic oligonucleotide
ccacgccgccuuaugaca

SEQ ID NO: 62144 - RNA, 18 nt, Artificial Sequence
  Description of Artificial Sequence: Synthetic oligonucleotide
cucgcccacgccgccuua

SEQ ID NO: 62145 - RNA, 18 nt, Artificial Sequence
  Description of Artificial Sequence: Synthetic oligonucleotide
caggccucgcccacgccg

SEQ ID NO: 62146 - RNA, 18 nt, Artificial Sequence
  Description of Artificial Sequence: Synthetic oligonucleotide
ugugucaggccucgccca

SEQ ID NO: 62147 - RNA, 18 nt, Artificial Sequence
  Description of Artificial Sequence: Synthetic oligonucleotide
uggccugugucaggccuc

SEQ ID NO: 62148 - RNA, 18 nt, Artificial Sequence
  Description of Artificial Sequence: Synthetic oligonucleotide
aaggcuggccugugucag

SEQ ID NO: 62149 - RNA, 18 nt, Artificial Sequence
  Description of Artificial Sequence: Synthetic oligonucleotide
gugccaaggcuggccugu

SEQ ID NO: 62150 - RNA, 18 nt, Artificial Sequence
  Description of Artificial Sequence: Synthetic oligonucleotide
cccucgugccaaggcugg

SEQ ID NO: 62151 - RNA, 18 nt, Artificial Sequence
  Description of Artificial Sequence: Synthetic oligonucleotide
ggccccccucgugccaag

SEQ ID NO: 62152 - RNA, 18 nt, Artificial Sequence
  Description of Artificial Sequence: Synthetic oligonucleotide
ccccuggccccccucgug

SEQ ID NO: 62153 - RNA, 18 nt, Artificial Sequence
  Description of Artificial Sequence: Synthetic oligonucleotide
cagaaccccuggcccccc

SEQ ID NO: 62154 - RNA, 18 nt, Artificial Sequence
  Description of Artificial Sequence: Synthetic oligonucleotide
cuucucagaaccccuggc

SEQ ID NO: 62155 - RNA, 18 nt, Artificial Sequence
  Description of Artificial Sequence: Synthetic oligonucleotide
cagcgcuucucagaaccc

SEQ ID NO: 62156 - RNA, 18 nt, Artificial Sequence
  Description of Artificial Sequence: Synthetic oligonucleotide
cagggcagcgcuucucag

SEQ ID NO: 62157 - RNA, 18 nt, Artificial Sequence
  Description of Artificial Sequence: Synthetic oligonucleotide
ucucacagggcagcgcuu

SEQ ID NO: 62158 - RNA, 18 nt, Artificial Sequence
  Description of Artificial Sequence: Synthetic oligonucleotide
guggcucucacagggcag

SEQ ID NO: 62159 - RNA, 18 nt, Artificial Sequence
  Description of Artificial Sequence: Synthetic oligonucleotide
ccagcguggcucucacag

SEQ ID NO: 62160 - RNA, 18 nt, Artificial Sequence
  Description of Artificial Sequence: Synthetic oligonucleotide
gaaggccagcguggcucu

SEQ ID NO: 62161 - RNA, 18 nt, Artificial Sequence
  Description of Artificial Sequence: Synthetic oligonucleotide
gagacgaaggccagcgug

SEQ ID NO: 62162 - RNA, 18 nt, Artificial Sequence
  Description of Artificial Sequence: Synthetic oligonucleotide
agauggagacgaaggcca

SEQ ID NO: 62163 - RNA, 18 nt, Artificial Sequence
  Description of Artificial Sequence: Synthetic oligonucleotide
accagagauggagacgaa

SEQ ID NO: 62164 - RNA, 18 nt, Artificial Sequence
  Description of Artificial Sequence: Synthetic oligonucleotide
cgucaaccagagauggag

SEQ ID NO: 62165 - RNA, 18 nt, Artificial Sequence
  Description of Artificial Sequence: Synthetic oligonucleotide
cagcccgucaaccagaga

SEQ ID NO: 62166 - RNA, 18 nt, Artificial Sequence
  Description of Artificial Sequence: Synthetic oligonucleotide
acggacagcccgucaacc

SEQ ID NO: 62167 - RNA, 18 nt, Artificial Sequence
  Description of Artificial Sequence: Synthetic oligonucleotide
ggcacacggacagcccgu

SEQ ID NO: 62168 - RNA, 18 nt, Artificial Sequence
  Description of Artificial Sequence: Synthetic oligonucleotide
caggaggcacacggacag

SEQ ID NO: 62169 - RNA, 18 nt, Artificial Sequence
  Description of Artificial Sequence: Synthetic oligonucleotide
acacacaggaggcacacg

SEQ ID NO: 62170 - RNA, 18 nt, Artificial Sequence
  Description of Artificial Sequence: Synthetic oligonucleotide
ugcagacacacaggaggc

SEQ ID NO: 62171 - RNA, 18 nt, Artificial Sequence
  Description of Artificial Sequence: Synthetic oligonucleotide
uugucugcagacacacag

SEQ ID NO: 62172 - RNA, 18 nt, Artificial Sequence
  Description of Artificial Sequence: Synthetic oligonucleotide
aagacuugucugcagaca

SEQ ID NO: 62173 - RNA, 18 nt, Artificial Sequence
  Description of Artificial Sequence: Synthetic oligonucleotide
acagcaagacuugucugc

SEQ ID NO: 62174 - RNA, 18 nt, Artificial Sequence
  Description of Artificial Sequence: Synthetic oligonucleotide
aaagcacagcaagacuug

SEQ ID NO: 62175 - RNA, 18 nt, Artificial Sequence
  Description of Artificial Sequence: Synthetic oligonucleotide
caaauaaagcacagcaag

SEQ ID NO: 62176 - RNA, 18 nt, Artificial Sequence
  Description of Artificial Sequence: Synthetic oligonucleotide
uuucacaaauaaagcaca

SEQ ID NO: 62177 - RNA, 18 nt, Artificial Sequence
  Description of Artificial Sequence: Synthetic oligonucleotide
uaaaguuucacaaauaaa

SEQ ID NO: 62178 - RNA, 18 nt, Artificial Sequence
  Description of Artificial Sequence: Synthetic oligonucleotide
cucauuaaaguuucacaa

SEQ ID NO: 62179 - RNA, 18 nt, Artificial Sequence
  Description of Artificial Sequence: Synthetic oligonucleotide
uuuuccucauuaaaguuu

SEQ ID NO: 62180 - RNA, 18 nt, Artificial Sequence
  Description of Artificial Sequence: Synthetic oligonucleotide
uuguuuuuuccucauuaa

SEQ ID NO: 62181 - RNA, 18 nt, Artificial Sequence
  Description of Artificial Sequence: Synthetic oligonucleotide
auuauuuguuuuuuccuc

SEQ ID NO: 62182 - RNA, 18 nt, Artificial Sequence
  Description of Artificial Sequence: Synthetic oligonucleotide
cauuuauuauuuguuuuu

SEQ ID NO: 62183 - RNA, 18 nt, Artificial Sequence
  Description of Artificial Sequence: Synthetic oligonucleotide
gagaacauuuauuauuug

SEQ ID NO: 62184 - RNA, 18 nt, Artificial Sequence
  Description of Artificial Sequence: Synthetic oligonucleotide
aaaacgagaacauuuauu

SEQ ID NO: 62185 - RNA, 18 nt, Artificial Sequence
  Description of Artificial Sequence: Synthetic oligonucleotide
guuucaaaacgagaacau

SEQ ID NO: 62186 - RNA, 18 nt, Artificial Sequence
  Description of Artificial Sequence: Synthetic oligonucleotide
cccucccagcgccagcuc

SEQ ID NO: 62187 - RNA, 18 nt, Artificial Sequence
  Description of Artificial Sequence: Synthetic oligonucleotide
uccuccccucccagcgcc

SEQ ID NO: 62188 - RNA, 18 nt, Artificial Sequence
  Description of Artificial Sequence: Synthetic oligonucleotide
cgcgcuccuccccuccca

SEQ ID NO: 62189 - RNA, 18 nt, Artificial Sequence
  Description of Artificial Sequence: Synthetic oligonucleotide
ggcugcgcgcuccucccc

SEQ ID NO: 62190 - RNA, 18 nt, Artificial Sequence
  Description of Artificial Sequence: Synthetic oligonucleotide
gcgcgggcugcgcgcucc

SEQ ID NO: 62191 - RNA, 18 nt, Artificial Sequence
  Description of Artificial Sequence: Synthetic oligonucleotide
gcggcgcgcgggcugcgc

SEQ ID NO: 62192 - RNA, 18 nt, Artificial Sequence
  Description of Artificial Sequence: Synthetic oligonucleotide
gcccugcggcgcgcgggc

SEQ ID NO: 62193 - RNA, 18 nt, Artificial Sequence
  Description of Artificial Sequence: Synthetic oligonucleotide
gcccggcccugcggcgcg

SEQ ID NO: 62194 - RNA, 18 nt, Artificial Sequence
  Description of Artificial Sequence: Synthetic oligonucleotide
uuuccgcccggcccugcg

SEQ ID NO: 62195 - RNA, 18 nt, Artificial Sequence
  Description of Artificial Sequence: Synthetic oligonucleotide
aaaacuuuccgcccggcc

SEQ ID NO: 62196 - RNA, 18 nt, Artificial Sequence
  Description of Artificial Sequence: Synthetic oligonucleotide
caggaaaaacuuuccgcc

SEQ ID NO: 62197 - RNA, 18 nt, Artificial Sequence
  Description of Artificial Sequence: Synthetic oligonucleotide
uccgucaggaaaaacuuu

SEQ ID NO: 62198 - RNA, 18 nt, Artificial Sequence
  Description of Artificial Sequence: Synthetic oligonucleotide
aaaacuccgucaggaaaa

SEQ ID NO: 62199 - RNA, 18 nt, Artificial Sequence
  Description of Artificial Sequence: Synthetic oligonucleotide
cagccaaaacuccgucag

SEQ ID NO: 62200 - RNA, 18 nt, Artificial Sequence
  Description of Artificial Sequence: Synthetic oligonucleotide
ugccgcagccaaaacucc

SEQ ID NO: 62201 - RNA, 18 nt, Artificial Sequence
  Description of Artificial Sequence: Synthetic oligonucleotide
gccgcugccgcagccaaa

SEQ ID NO: 62202 - RNA, 18 nt, Artificial Sequence
  Description of Artificial Sequence: Synthetic oligonucleotide
ccgccgccgcugccgcag

SEQ ID NO: 62203 - RNA, 18 nt, Artificial Sequence
  Description of Artificial Sequence: Synthetic oligonucleotide
ggccgccgccgccgcugc

SEQ ID NO: 62204 - RNA, 18 nt, Artificial Sequence
  Description of Artificial Sequence: Synthetic oligonucleotide
gcuccggccgccgccgcc

SEQ ID NO: 62205 - RNA, 18 nt, Artificial Sequence
  Description of Artificial Sequence: Synthetic oligonucleotide
ggcccgcuccggccgccg

SEQ ID NO: 62206 - RNA, 18 nt, Artificial Sequence
  Description of Artificial Sequence: Synthetic oligonucleotide
uccauggcccgcuccggc

SEQ ID NO: 62207 - RNA, 18 nt, Artificial Sequence
  Description of Artificial Sequence: Synthetic oligonucleotide
gcgcguccauggcccgcu

SEQ ID NO: 62208 - RNA, 18 nt, Artificial Sequence
  Description of Artificial Sequence: Synthetic oligonucleotide
cuugagcgcguccauggc

SEQ ID NO: 62209 - RNA, 18 nt, Artificial Sequence
  Description of Artificial Sequence: Synthetic oligonucleotide
gccgacuugagcgcgucc

SEQ ID NO: 62210 - RNA, 18 nt, Artificial Sequence
  Description of Artificial Sequence: Synthetic oligonucleotide
gccccgccgacuugagcg

SEQ ID NO: 62211 - RNA, 18 nt, Artificial Sequence
  Description of Artificial Sequence: Synthetic oligonucleotide
cgcccgccccgccgacuu

SEQ ID NO: 62212 - RNA, 18 nt, Artificial Sequence
  Description of Artificial Sequence: Synthetic oligonucleotide
aucagcgcccgccccgcc

SEQ ID NO: 62213 - RNA, 18 nt, Artificial Sequence
  Description of Artificial Sequence: Synthetic oligonucleotide
uccggaucagcgcccgcc

SEQ ID NO: 62214 - RNA, 18 nt, Artificial Sequence
  Description of Artificial Sequence: Synthetic oligonucleotide
cugcuuggccaagcuggg

SEQ ID NO: 62215 - RNA, 18 nt, Artificial Sequence
  Description of Artificial Sequence: Synthetic oligonucleotide
cagcucugcuuggccaag

SEQ ID NO: 62216 - RNA, 18 nt, Artificial Sequence
  Description of Artificial Sequence: Synthetic oligonucleotide
ccccccagcucugcuugg

SEQ ID NO: 62217 - RNA, 18 nt, Artificial Sequence
  Description of Artificial Sequence: Synthetic oligonucleotide
accgcccccccagcucug

SEQ ID NO: 62218 - RNA, 18 nt, Artificial Sequence
  Description of Artificial Sequence: Synthetic oligonucleotide
cggccaccgcccccccag

SEQ ID NO: 62219 - RNA, 18 nt, Artificial Sequence
  Description of Artificial Sequence: Synthetic oligonucleotide
ggugccggccaccgcccc

SEQ ID NO: 62220 - RNA, 18 nt, Artificial Sequence
  Description of Artificial Sequence: Synthetic oligonucleotide
ccggcugacgcgcgcaca

SEQ ID NO: 62221 - RNA, 18 nt, Artificial Sequence
  Description of Artificial Sequence: Synthetic oligonucleotide
ccggcccggcugacgcgc

SEQ ID NO: 62222 - RNA, 18 nt, Artificial Sequence
  Description of Artificial Sequence: Synthetic oligonucleotide
ccggcccggcccggcuga

SEQ ID NO: 62223 - RNA, 18 nt, Artificial Sequence
  Description of Artificial Sequence: Synthetic oligonucleotide
cgaucccggcccggcccg

SEQ ID NO: 62224 - RNA, 18 nt, Artificial Sequence
  Description of Artificial Sequence: Synthetic oligonucleotide
cugcccgaucccggcccg

SEQ ID NO: 62225 - RNA, 18 nt, Artificial Sequence
  Description of Artificial Sequence: Synthetic oligonucleotide
cgccucugcccgaucccg

SEQ ID NO: 62226 - RNA, 18 nt, Artificial Sequence
  Description of Artificial Sequence: Synthetic oligonucleotide
ccgcgcgccucugcccga

SEQ ID NO: 62227 - RNA, 18 nt, Artificial Sequence
  Description of Artificial Sequence: Synthetic oligonucleotide
aggccccgcgcgccucug

SEQ ID NO: 62228 - RNA, 18 nt, Artificial Sequence
  Description of Artificial Sequence: Synthetic oligonucleotide
cgcggaggccccgcgcgc

SEQ ID NO: 62229 - RNA, 18 nt, Artificial Sequence
  Description of Artificial Sequence: Synthetic oligonucleotide
gcgcccgcggaggccccg

SEQ ID NO: 62230 - RNA, 18 nt, Artificial Sequence
  Description of Artificial Sequence: Synthetic oligonucleotide
uccgggcgcccgcggagg

SEQ ID NO: 62231 - RNA, 18 nt, Artificial Sequence
  Description of Artificial Sequence: Synthetic oligonucleotide
cgcacuccgggcgcccgc

SEQ ID NO: 62232 - RNA, 18 nt, Artificial Sequence
  Description of Artificial Sequence: Synthetic oligonucleotide
uuggccgcacuccgggcg

SEQ ID NO: 62233 - RNA, 18 nt, Artificial Sequence
  Description of Artificial Sequence: Synthetic oligonucleotide
ccaacuuggccgcacucc

SEQ ID NO: 62234 - RNA, 18 nt, Artificial Sequence
  Description of Artificial Sequence: Synthetic oligonucleotide
ucugcccaacuuggccgc

SEQ ID NO: 62235 - RNA, 18 nt, Artificial Sequence
  Description of Artificial Sequence: Synthetic oligonucleotide
ccgccucugcccaacuug

SEQ ID NO: 62236 - RNA, 18 nt, Artificial Sequence
  Description of Artificial Sequence: Synthetic oligonucleotide
aggccccgccucugccca

SEQ ID NO: 62237 - RNA, 18 nt, Artificial Sequence
  Description of Artificial Sequence: Synthetic oligonucleotide
cggugaggccccgccucu

SEQ ID NO: 62238 - RNA, 18 nt, Artificial Sequence
  Description of Artificial Sequence: Synthetic oligonucleotide
agcgccggugaggccccg

SEQ ID NO: 62239 - RNA, 18 nt, Artificial Sequence
  Description of Artificial Sequence: Synthetic oligonucleotide
accggagcgccggugagg

SEQ ID NO: 62240 - RNA, 18 nt, Artificial Sequence
  Description of Artificial Sequence: Synthetic oligonucleotide
ccgggaccggagcgccgg

SEQ ID NO: 62241 - RNA, 18 nt, Artificial Sequence
  Description of Artificial Sequence: Synthetic oligonucleotide
ccacgccgggaccggagc

SEQ ID NO: 62242 - RNA, 18 nt, Artificial Sequence
  Description of Artificial Sequence: Synthetic oligonucleotide
aagggccacgccgggacc

SEQ ID NO: 62243 - RNA, 18 nt, Artificial Sequence
  Description of Artificial Sequence: Synthetic oligonucleotide
cgggaaagggccacgccg

SEQ ID NO: 62244 - RNA, 18 nt, Artificial Sequence
  Description of Artificial Sequence: Synthetic oligonucleotide
agggccgggaaagggcca

SEQ ID NO: 62245 - RNA, 18 nt, Artificial Sequence
  Description of Artificial Sequence: Synthetic oligonucleotide
cccgcagggccgggaaag

SEQ ID NO: 62246 - RNA, 18 nt, Artificial Sequence
  Description of Artificial Sequence: Synthetic oligonucleotide
ccugccccgcagggccgg

SEQ ID NO: 62247 - RNA, 18 nt, Artificial Sequence
  Description of Artificial Sequence: Synthetic oligonucleotide
gacccccugccccgcagg

SEQ ID NO: 62248 - RNA, 18 nt, Artificial Sequence
  Description of Artificial Sequence: Synthetic oligonucleotide
cggccgacccccugcccc

SEQ ID NO: 62249 - RNA, 18 nt, Artificial Sequence
  Description of Artificial Sequence: Synthetic oligonucleotide
gaccccggccgacccccu

SEQ ID NO: 62250 - RNA, 18 nt, Artificial Sequence
  Description of Artificial Sequence: Synthetic oligonucleotide
aacuugaccccggccgac

SEQ ID NO: 62251 - RNA, 18 nt, Artificial Sequence
  Description of Artificial Sequence: Synthetic oligonucleotide
ugcacaacuugaccccgg

SEQ ID NO: 62252 - RNA, 18 nt, Artificial Sequence
  Description of Artificial Sequence: Synthetic oligonucleotide
guaggugcacaacuugac

SEQ ID NO: 62253 - RNA, 18 nt, Artificial Sequence
  Description of Artificial Sequence: Synthetic oligonucleotide
ggcgaguaggugcacaac

SEQ ID NO: 62254 - RNA, 18 nt, Artificial Sequence
  Description of Artificial Sequence: Synthetic oligonucleotide
cggccggcgaguaggugc

SEQ ID NO: 62255 - RNA, 18 nt, Artificial Sequence
  Description of Artificial Sequence: Synthetic oligonucleotide
ucgagcggccggcgagua

SEQ ID NO: 62256 - RNA, 18 nt, Artificial Sequence
  Description of Artificial Sequence: Synthetic oligonucleotide
cggcaucgagcggccggc

SEQ ID NO: 62257 - RNA, 18 nt, Artificial Sequence
  Description of Artificial Sequence: Synthetic oligonucleotide
cgcagcggcaucgagcgg

SEQ ID NO: 62258 - RNA, 18 nt, Artificial Sequence
  Description of Artificial Sequence: Synthetic oligonucleotide
cuccucgcagcggcaucg

SEQ ID NO: 62259 - RNA, 18 nt, Artificial Sequence
  Description of Artificial Sequence: Synthetic oligonucleotide
ugccccuccucgcagcgg

SEQ ID NO: 62260 - RNA, 18 nt, Artificial Sequence
  Description of Artificial Sequence: Synthetic oligonucleotide
agcgcugccccuccucgc

SEQ ID NO: 62261 - RNA, 18 nt, Artificial Sequence
  Description of Artificial Sequence: Synthetic oligonucleotide
uccucagcgcugccccuc

SEQ ID NO: 62262 - RNA, 18 nt, Artificial Sequence
  Description of Artificial Sequence: Synthetic oligonucleotide
cuccuuccucagcgcugc

SEQ ID NO: 62263 - RNA, 18 nt, Artificial Sequence
  Description of Artificial Sequence: Synthetic oligonucleotide
ucgggcuccuuccucagc

SEQ ID NO: 62264 - RNA, 18 nt, Artificial Sequence
  Description of Artificial Sequence: Synthetic oligonucleotide
cgagcucgggcuccuucc

SEQ ID NO: 62265 - RNA, 18 nt, Artificial Sequence
  Description of Artificial Sequence: Synthetic oligonucleotide
gaccccgagcucgggcuc

SEQ ID NO: 62266 - RNA, 18 nt, Artificial Sequence
  Description of Artificial Sequence: Synthetic oligonucleotide
cugaggaccccgagcucg

SEQ ID NO: 62267 - RNA, 18 nt, Artificial Sequence
  Description of Artificial Sequence: Synthetic oligonucleotide
ugcaccugaggaccccga

SEQ ID NO: 62268 - RNA, 18 nt, Artificial Sequence
  Description of Artificial Sequence: Synthetic oligonucleotide
ccggcugcaccugaggac

SEQ ID NO: 62269 - RNA, 18 nt, Artificial Sequence
  Description of Artificial Sequence: Synthetic oligonucleotide
ccaugccggcugcaccug

SEQ ID NO: 62270 - RNA, 18 nt, Artificial Sequence
  Description of Artificial Sequence: Synthetic oligonucleotide
ccaccccaugccggcugc

SEQ ID NO: 62271 - RNA, 18 nt, Artificial Sequence
  Description of Artificial Sequence: Synthetic oligonucleotide
gcaccccaccccaugccg

SEQ ID NO: 62272 - RNA, 18 nt, Artificial Sequence
  Description of Artificial Sequence: Synthetic oligonucleotide
aaccugcaccccacccca

SEQ ID NO: 62273 - RNA, 18 nt, Artificial Sequence
  Description of Artificial Sequence: Synthetic oligonucleotide
cucccaaccugcacccca

SEQ ID NO: 62274 - RNA, 18 nt, Artificial Sequence
  Description of Artificial Sequence: Synthetic oligonucleotide
cucuucucccaaccugca

SEQ ID NO: 62275 - RNA, 18 nt, Artificial Sequence
  Description of Artificial Sequence: Synthetic oligonucleotide
gggccucuucucccaacc

SEQ ID NO: 62276 - RNA, 18 nt, Artificial Sequence
  Description of Artificial Sequence: Synthetic oligonucleotide
ggugccgcggguggcggg

SEQ ID NO: 62277 - RNA, 18 nt, Artificial Sequence
  Description of Artificial Sequence: Synthetic oligonucleotide
cgggaggugccgcgggug

SEQ ID NO: 62278 - RNA, 18 nt, Artificial Sequence
  Description of Artificial Sequence: Synthetic oligonucleotide
cagggcgggaggugccgc

SEQ ID NO: 62279 - RNA, 18 nt, Artificial Sequence
  Description of Artificial Sequence: Synthetic oligonucleotide
gacagcagggcgggaggu

SEQ ID NO: 62280 - RNA, 18 nt, Artificial Sequence
  Description of Artificial Sequence: Synthetic oligonucleotide
gccaggacagcagggcgg

SEQ ID NO: 62281 - RNA, 18 nt, Artificial Sequence
  Description of Artificial Sequence: Synthetic oligonucleotide
agcuggccaggacagcag

SEQ ID NO: 62282 - RNA, 18 nt, Artificial Sequence
  Description of Artificial Sequence: Synthetic oligonucleotide
ccccuagcuggccaggac

SEQ ID NO: 62283 - RNA, 18 nt, Artificial Sequence
  Description of Artificial Sequence: Synthetic oligonucleotide
gccucccccuagcuggcc

SEQ ID NO: 62284 - RNA, 18 nt, Artificial Sequence
  Description of Artificial Sequence: Synthetic oligonucleotide
cgccugccucccccuagc

SEQ ID NO: 62285 - RNA, 18 nt, Artificial Sequence
  Description of Artificial Sequence: Synthetic oligonucleotide
acgagcgccugccucccc

SEQ ID NO: 62286 - RNA, 18 nt, Artificial Sequence
  Description of Artificial Sequence: Synthetic oligonucleotide
cgacgacgagcgccugcc

SEQ ID NO: 62287 - RNA, 18 nt, Artificial Sequence
  Description of Artificial Sequence: Synthetic oligonucleotide
ggcaccgacgacgagcgc

SEQ ID NO: 62288 - RNA, 18 nt, Artificial Sequence
  Description of Artificial Sequence: Synthetic oligonucleotide
cccuaggcaccgacgacg

SEQ ID NO: 62289 - RNA, 18 nt, Artificial Sequence
  Description of Artificial Sequence: Synthetic oligonucleotide
uccuccccuaggcaccga

SEQ ID NO: 62290 - RNA, 18 nt, Artificial Sequence
  Description of Artificial Sequence: Synthetic oligonucleotide
ucuccuccuccccuaggc

SEQ ID NO: 62291 - RNA, 18 nt, Artificial Sequence
  Description of Artificial Sequence: Synthetic oligonucleotide
cgcccucuccuccucccc

SEQ ID NO: 62292 - RNA, 18 nt, Artificial Sequence
  Description of Artificial Sequence: Synthetic oligonucleotide
cccugcgcccucuccucc

SEQ ID NO: 62293 - RNA, 18 nt, Artificial Sequence
  Description of Artificial Sequence: Synthetic oligonucleotide
caagccccugcgcccucu

SEQ ID NO: 62294 - RNA, 18 nt, Artificial Sequence
  Description of Artificial Sequence: Synthetic oligonucleotide
cuucccaagccccugcgc

SEQ ID NO: 62295 - RNA, 18 nt, Artificial Sequence
  Description of Artificial Sequence: Synthetic oligonucleotide
ggcgucuucccaagcccc

SEQ ID NO: 62296 - RNA, 18 nt, Artificial Sequence
  Description of Artificial Sequence: Synthetic oligonucleotide
gggcgucuucccaagccc

SEQ ID NO: 62297 - RNA, 18 nt, Artificial Sequence
  Description of Artificial Sequence: Synthetic oligonucleotide
ccgcagcugcuggcuggg

SEQ ID NO: 62298 - RNA, 18 nt, Artificial Sequence
  Description of Artificial Sequence: Synthetic oligonucleotide
gaccgccgcagcugcugg

SEQ ID NO: 62299 - RNA, 18 nt, Artificial Sequence
  Description of Artificial Sequence: Synthetic oligonucleotide
cuccugaccgccgcagcu

SEQ ID NO: 62300 - RNA, 18 nt, Artificial Sequence
  Description of Artificial Sequence: Synthetic oligonucleotide
gugggcuccugaccgccg

SEQ ID NO: 62301 - RNA, 18 nt, Artificial Sequence
  Description of Artificial Sequence: Synthetic oligonucleotide
ggccagugggcuccugac

SEQ ID NO: 62302 - RNA, 18 nt, Artificial Sequence
  Description of Artificial Sequence: Synthetic oligonucleotide
gaacgggccagugggcuc

SEQ ID NO: 62303 - RNA, 18 nt, Artificial Sequence
  Description of Artificial Sequence: Synthetic oligonucleotide
cgggagaacgggccagug

SEQ ID NO: 62304 - RNA, 18 nt, Artificial Sequence
  Description of Artificial Sequence: Synthetic oligonucleotide
gggcgggagaacgggcca

SEQ ID NO: 62305 - RNA, 18 nt, Artificial Sequence
  Description of Artificial Sequence: Synthetic oligonucleotide
ccggugggucgggcaggg

SEQ ID NO: 62306 - RNA, 18 nt, Artificial Sequence
  Description of Artificial Sequence: Synthetic oligonucleotide
uuggcccggugggucggg

SEQ ID NO: 62307 - RNA, 18 nt, Artificial Sequence
  Description of Artificial Sequence: Synthetic oligonucleotide
aaaaguuggcccgguggg

SEQ ID NO: 62308 - RNA, 18 nt, Artificial Sequence
  Description of Artificial Sequence: Synthetic oligonucleotide
gagucaaaaguuggcccg

SEQ ID NO: 62309 - RNA, 18 nt, Artificial Sequence
  Description of Artificial Sequence: Synthetic oligonucleotide
acccggagucaaaaguug

SEQ ID NO: 62310 - RNA, 18 nt, Artificial Sequence
  Description of Artificial Sequence: Synthetic oligonucleotide
acggaggccauggaggcu

SEQ ID NO: 62311 - RNA, 18 nt, Artificial Sequence
  Description of Artificial Sequence: Synthetic oligonucleotide
aagacacggaggccaugg

SEQ ID NO: 62312 - RNA, 18 nt, Artificial Sequence
  Description of Artificial Sequence: Synthetic oligonucleotide
agacaaagacacggaggc

SEQ ID NO: 62313 - RNA, 18 nt, Artificial Sequence
  Description of Artificial Sequence: Synthetic oligonucleotide
uugacagacaaagacacg

SEQ ID NO: 62314 - RNA, 18 nt, Artificial Sequence
  Description of Artificial Sequence: Synthetic oligonucleotide
acccauugacagacaaag

SEQ ID NO: 62315 - RNA, 18 nt, Artificial Sequence
  Description of Artificial Sequence: Synthetic oligonucleotide
aucaaacccauugacaga

SEQ ID NO: 62316 - RNA, 18 nt, Artificial Sequence
  Description of Artificial Sequence: Synthetic oligonucleotide
cuuuaaucaaacccauug

SEQ ID NO: 62317 - RNA, 18 nt, Artificial Sequence
  Description of Artificial Sequence: Synthetic oligonucleotide
caacgcuuuaaucaaacc

SEQ ID NO: 62318 - RNA, 18 nt, Artificial Sequence
  Description of Artificial Sequence: Synthetic oligonucleotide
gaggucaacgcuuuaauc

SEQ ID NO: 62319 - RNA, 18 nt, Artificial Sequence
  Description of Artificial Sequence: Synthetic oligonucleotide
ccuaugaggucaacgcuu

SEQ ID NO: 62320 - RNA, 18 nt, Artificial Sequence
  Description of Artificial Sequence: Synthetic oligonucleotide
aagaaccuaugaggucaa

SEQ ID NO: 62321 - RNA, 18 nt, Artificial Sequence
  Description of Artificial Sequence: Synthetic oligonucleotide
cuccuaagaaccuaugag

SEQ ID NO: 62322 - RNA, 18 nt, Artificial Sequence
  Description of Artificial Sequence: Synthetic oligonucleotide
uaauccuccuaagaaccu

SEQ ID NO: 62323 - RNA, 18 nt, Artificial Sequence
  Description of Artificial Sequence: Synthetic oligonucleotide
cucauuaauccuccuaag

SEQ ID NO: 62324 - RNA, 18 nt, Artificial Sequence
  Description of Artificial Sequence: Synthetic oligonucleotide
auguucucauuaauccuc

SEQ ID NO: 62325 - RNA, 18 nt, Artificial Sequence
  Description of Artificial Sequence: Synthetic oligonucleotide
auaaaauguucucauuaa

SEQ ID NO: 62326 - RNA, 18 nt, Artificial Sequence
  Description of Artificial Sequence: Synthetic oligonucleotide
uuuacauaaaauguucuc

SEQ ID NO: 62327 - RNA, 18 nt, Artificial Sequence
  Description of Artificial Sequence: Synthetic oligonucleotide
gcagcuuuacauaaaaug

SEQ ID NO: 62328 - RNA, 18 nt, Artificial Sequence
  Description of Artificial Sequence: Synthetic oligonucleotide
uguaagcagcuuuacaua

SEQ ID NO: 62329 - RNA, 18 nt, Artificial Sequence
  Description of Artificial Sequence: Synthetic oligonucleotide
cuccauguaagcagcuuu

SEQ ID NO: 62330 - RNA, 18 nt, Artificial Sequence
  Description of Artificial Sequence: Synthetic oligonucleotide
caaggcuccauguaagca

SEQ ID NO: 62331 - RNA, 18 nt, Artificial Sequence
  Description of Artificial Sequence: Synthetic oligonucleotide
cauaccaaggcuccaugu

SEQ ID NO: 62332 - RNA, 18 nt, Artificial Sequence
  Description of Artificial Sequence: Synthetic oligonucleotide
cggcacauaccaaggcuc

SEQ ID NO: 62333 - RNA, 18 nt, Artificial Sequence
  Description of Artificial Sequence: Synthetic oligonucleotide
cuuuccggcacauaccaa

SEQ ID NO: 62334 - RNA, 18 nt, Artificial Sequence
  Description of Artificial Sequence: Synthetic oligonucleotide
uaaagcuuuccggcacau

SEQ ID NO: 62335 - RNA, 18 nt, Artificial Sequence
  Description of Artificial Sequence: Synthetic oligonucleotide
agggcuaaagcuuuccgg

SEQ ID NO: 62336 - RNA, 18 nt, Artificial Sequence
  Description of Artificial Sequence: Synthetic oligonucleotide
aauaaagggcuaaagcuu

SEQ ID NO: 62337 - RNA, 18 nt, Artificial Sequence
  Description of Artificial Sequence: Synthetic oligonucleotide
cuuuuaauaaagggcuaa

SEQ ID NO: 62338 - RNA, 18 nt, Artificial Sequence
  Description of Artificial Sequence: Synthetic oligonucleotide
ugucacuuuuaauaaagg

SEQ ID NO: 62339 - RNA, 18 nt, Artificial Sequence
  Description of Artificial Sequence: Synthetic oligonucleotide
ucugcugucacuuuuaau

SEQ ID NO: 62340 - RNA, 18 nt, Artificial Sequence
  Description of Artificial Sequence: Synthetic oligonucleotide
cugggucugcugucacuu

SEQ ID NO: 62341 - RNA, 18 nt, Artificial Sequence
  Description of Artificial Sequence: Synthetic oligonucleotide
ccgugcugggucugcugu

SEQ ID NO: 62342 - RNA, 18 nt, Artificial Sequence
  Description of Artificial Sequence: Synthetic oligonucleotide
agccaccgugcugggucu

SEQ ID NO: 62343 - RNA, 18 nt, Artificial Sequence
  Description of Artificial Sequence: Synthetic oligonucleotide
gcaugagccaccgugcug

SEQ ID NO: 62344 - RNA, 18 nt, Artificial Sequence
  Description of Artificial Sequence: Synthetic oligonucleotide
uacaggcaugagccaccg

SEQ ID NO: 62345 - RNA, 18 nt, Artificial Sequence
  Description of Artificial Sequence: Synthetic oligonucleotide
gggauuacaggcaugagc

SEQ ID NO: 62346 - RNA, 18 nt, Artificial Sequence
  Description of Artificial Sequence: Synthetic oligonucleotide
gugcugggauuacaggca

SEQ ID NO: 62347 - RNA, 18 nt, Artificial Sequence
  Description of Artificial Sequence: Synthetic oligonucleotide
ccaaagugcugggauuac

SEQ ID NO: 62348 - RNA, 18 nt, Artificial Sequence
  Description of Artificial Sequence: Synthetic oligonucleotide
gccucccaaagugcuggg

SEQ ID NO: 62349 - RNA, 18 nt, Artificial Sequence
  Description of Artificial Sequence: Synthetic oligonucleotide
ccucagccucccaaagug

SEQ ID NO: 62350 - RNA, 18 nt, Artificial Sequence
  Description of Artificial Sequence: Synthetic oligonucleotide
gcccgccucagccuccca

SEQ ID NO: 62351 - RNA, 18 nt, Artificial Sequence
  Description of Artificial Sequence: Synthetic oligonucleotide
gaucugcccgccucagcc

SEQ ID NO: 62352 - RNA, 18 nt, Artificial Sequence
  Description of Artificial Sequence: Synthetic oligonucleotide
caagugaucugcccgccu

SEQ ID NO: 62353 - RNA, 18 nt, Artificial Sequence
  Description of Artificial Sequence: Synthetic oligonucleotide
gaccccaagugaucugcc

SEQ ID NO: 62354 - RNA, 18 nt, Artificial Sequence
  Description of Artificial Sequence: Synthetic oligonucleotide
cuccugaccccaagugau

SEQ ID NO: 62355 - RNA, 18 nt, Artificial Sequence
  Description of Artificial Sequence: Synthetic oligonucleotide
ucgaacuccugaccccaa

SEQ ID NO: 62356 - RNA, 18 nt, Artificial Sequence
  Description of Artificial Sequence: Synthetic oligonucleotide
uggucucgaacuccugac

SEQ ID NO: 62357 - RNA, 18 nt, Artificial Sequence
  Description of Artificial Sequence: Synthetic oligonucleotide
guagcuggucucgaacuc

SEQ ID NO: 62358 - RNA, 18 nt, Artificial Sequence
  Description of Artificial Sequence: Synthetic oligonucleotide
cccgaguagcuggucucg

SEQ ID NO: 62359 - RNA, 18 nt, Artificial Sequence
  Description of Artificial Sequence: Synthetic oligonucleotide
ugccucccgaguagcugg

SEQ ID NO: 62360 - RNA, 18 nt, Artificial Sequence
  Description of Artificial Sequence: Synthetic oligonucleotide
gccucugccucccgagua

SEQ ID NO: 62361 - RNA, 18 nt, Artificial Sequence
  Description of Artificial Sequence: Synthetic oligonucleotide
cuccugccucugccuccc

SEQ ID NO: 62362 - RNA, 18 nt, Artificial Sequence
  Description of Artificial Sequence: Synthetic oligonucleotide
cgauucuccugccucugc

SEQ ID NO: 62363 - RNA, 18 nt, Artificial Sequence
  Description of Artificial Sequence: Synthetic oligonucleotide
ucaagcgauucuccugcc

SEQ ID NO: 62364 - RNA, 18 nt, Artificial Sequence
  Description of Artificial Sequence: Synthetic oligonucleotide
cagguucaagcgauucuc

SEQ ID NO: 62365 - RNA, 18 nt, Artificial Sequence
  Description of Artificial Sequence: Synthetic oligonucleotide
caccccagguucaagcga

SEQ ID NO: 62366 - RNA, 18 nt, Artificial Sequence
  Description of Artificial Sequence: Synthetic oligonucleotide
cucugcaccccagguuca

SEQ ID NO: 62367 - RNA, 18 nt, Artificial Sequence
  Description of Artificial Sequence: Synthetic oligonucleotide
gcaaccucugcaccccag

SEQ ID NO: 62368 - RNA, 18 nt, Artificial Sequence
  Description of Artificial Sequence: Synthetic oligonucleotide
uuacugcaaccucugcac

SEQ ID NO: 62369 - RNA, 18 nt, Artificial Sequence
  Description of Artificial Sequence: Synthetic oligonucleotide
ucagcuuacugcaaccuc

SEQ ID NO: 62370 - RNA, 18 nt, Artificial Sequence
  Description of Artificial Sequence: Synthetic oligonucleotide
cgagcucagcuuacugca

SEQ ID NO: 62371 - RNA, 18 nt, Artificial Sequence
  Description of Artificial Sequence: Synthetic oligonucleotide
uggugcgagcucagcuua

SEQ ID NO: 62372 - RNA, 18 nt, Artificial Sequence
  Description of Artificial Sequence: Synthetic oligonucleotide
ugcaguggugcgagcuca

SEQ ID NO: 62373 - RNA, 18 nt, Artificial Sequence
  Description of Artificial Sequence: Synthetic oligonucleotide
uggagugcaguggugcga

SEQ ID NO: 62374 - RNA, 18 nt, Artificial Sequence
  Description of Artificial Sequence: Synthetic oligonucleotide
caggcuggagugcagugg

SEQ ID NO: 62375 - RNA, 18 nt, Artificial Sequence
  Description of Artificial Sequence: Synthetic oligonucleotide
ucacucaggcuggagugc

SEQ ID NO: 62376 - RNA, 18 nt, Artificial Sequence
  Description of Artificial Sequence: Synthetic oligonucleotide
cucugucacucaggcugg

SEQ ID NO: 62377 - RNA, 18 nt, Artificial Sequence
  Description of Artificial Sequence: Synthetic oligonucleotide
uuucacucugucacucag

SEQ ID NO: 62378 - RNA, 18 nt, Artificial Sequence
  Description of Artificial Sequence: Synthetic oligonucleotide
cugaguuucacucuguca

SEQ ID NO: 62379 - RNA, 18 nt, Artificial Sequence
  Description of Artificial Sequence: Synthetic oligonucleotide
ugagacugaguuucacuc

SEQ ID NO: 62380 - RNA, 18 nt, Artificial Sequence
  Description of Artificial Sequence: Synthetic oligonucleotide
uuuuuugagacugaguuu

SEQ ID NO: 62381 - RNA, 18 nt, Artificial Sequence
  Description of Artificial Sequence: Synthetic oligonucleotide
uuuuuuuuuuugagacug

SEQ ID NO: 62382 - RNA, 18 nt, Artificial Sequence
  Description of Artificial Sequence: Synthetic oligonucleotide
uuuuuuuuuuuuuuuuga

SEQ ID NO: 62383 - RNA, 18 nt, Artificial Sequence
  Description of Artificial Sequence: Synthetic oligonucleotide
ucuuuuuuuuuuuuuuuu

SEQ ID NO: 62384 - RNA, 18 nt, Artificial Sequence
  Description of Artificial Sequence: Synthetic oligonucleotide
gccacucuuuuuuuuuuu

SEQ ID NO: 62385 - RNA, 18 nt, Artificial Sequence
  Description of Artificial Sequence: Synthetic oligonucleotide
cuacugccacucuuuuuu

SEQ ID NO: 62386 - RNA, 18 nt, Artificial Sequence
  Description of Artificial Sequence: Synthetic oligonucleotide
caccacuacugccacucu

SEQ ID NO: 62387 - RNA, 18 nt, Artificial Sequence
  Description of Artificial Sequence: Synthetic oligonucleotide
ucccccaccacuacugcc

SEQ ID NO: 62388 - RNA, 18 nt, Artificial Sequence
  Description of Artificial Sequence: Synthetic oligonucleotide
gggucucccccaccacua

SEQ ID NO: 62389 - RNA, 18 nt, Artificial Sequence
  Description of Artificial Sequence: Synthetic oligonucleotide
aggaaaccccagcaaggg

SEQ ID NO: 62390 - RNA, 18 nt, Artificial Sequence
  Description of Artificial Sequence: Synthetic oligonucleotide
uaggaaaccccagcaagg

SEQ ID NO: 62391 - RNA, 18 nt, Artificial Sequence
  Description of Artificial Sequence: Synthetic oligonucleotide
uuuccuaggaaaccccag

SEQ ID NO: 62392 - RNA, 18 nt, Artificial Sequence
  Description of Artificial Sequence: Synthetic oligonucleotide
ccuucuuuccuaggaaac

SEQ ID NO: 62393 - RNA, 18 nt, Artificial Sequence
  Description of Artificial Sequence: Synthetic oligonucleotide
accagccuucuuuccuag

SEQ ID NO: 62394 - RNA, 18 nt, Artificial Sequence
  Description of Artificial Sequence: Synthetic oligonucleotide
cucucaccagccuucuuu

SEQ ID NO: 62395 - RNA, 18 nt, Artificial Sequence
  Description of Artificial Sequence: Synthetic oligonucleotide
aacagcucucaccagccu

SEQ ID NO: 62396 - RNA, 18 nt, Artificial Sequence
  Description of Artificial Sequence: Synthetic oligonucleotide
ccagcaacagcucucacc

SEQ ID NO: 62397 - RNA, 18 nt, Artificial Sequence
  Description of Artificial Sequence: Synthetic oligonucleotide
caccaccagcaacagcuc

SEQ ID NO: 62398 - RNA, 18 nt, Artificial Sequence
  Description of Artificial Sequence: Synthetic oligonucleotide
gggcccaccaccagcaac

SEQ ID NO: 62399 - RNA, 18 nt, Artificial Sequence
  Description of Artificial Sequence: Synthetic oligonucleotide
gcucagggcccaccacca

SEQ ID NO: 62400 - RNA, 18 nt, Artificial Sequence
  Description of Artificial Sequence: Synthetic oligonucleotide
cugcggcucagggcccac

SEQ ID NO: 62401 - RNA, 18 nt, Artificial Sequence
  Description of Artificial Sequence: Synthetic oligonucleotide
agacccugcggcucaggg

SEQ ID NO: 62402 - RNA, 18 nt, Artificial Sequence
  Description of Artificial Sequence: Synthetic oligonucleotide
cccucagacccugcggcu

SEQ ID NO: 62403 - RNA, 18 nt, Artificial Sequence
  Description of Artificial Sequence: Synthetic oligonucleotide
guaggcccucagacccug

SEQ ID NO: 62404 - RNA, 18 nt, Artificial Sequence
  Description of Artificial Sequence: Synthetic oligonucleotide
guccaguucucaggcagc

SEQ ID NO: 62405 - RNA, 18 nt, Artificial Sequence
  Description of Artificial Sequence: Synthetic oligonucleotide
ugucuguccaguucucag

SEQ ID NO: 62406 - RNA, 18 nt, Artificial Sequence
  Description of Artificial Sequence: Synthetic oligonucleotide
ccgcgugucuguccaguu

SEQ ID NO: 62407 - RNA, 18 nt, Artificial Sequence
  Description of Artificial Sequence: Synthetic oligonucleotide
gucucccgcgugucuguc

SEQ ID NO: 62408 - RNA, 18 nt, Artificial Sequence
  Description of Artificial Sequence: Synthetic oligonucleotide
gcagcgucucccgcgugu

SEQ ID NO: 62409 - RNA, 18 nt, Artificial Sequence
  Description of Artificial Sequence: Synthetic oligonucleotide
cuccagcagcgucucccg

SEQ ID NO: 62410 - RNA, 18 nt, Artificial Sequence
  Description of Artificial Sequence: Synthetic oligonucleotide
auccccuccagcagcguc

SEQ ID NO: 62411 - RNA, 18 nt, Artificial Sequence
  Description of Artificial Sequence: Synthetic oligonucleotide
acagcauccccuccagca

SEQ ID NO: 62412 - RNA, 18 nt, Artificial Sequence
  Description of Artificial Sequence: Synthetic oligonucleotide
gcugaacagcauccccuc

SEQ ID NO: 62413 - RNA, 18 nt, Artificial Sequence
  Description of Artificial Sequence: Synthetic oligonucleotide
uugaggcugaacagcauc

SEQ ID NO: 62414 - RNA, 18 nt, Artificial Sequence
  Description of Artificial Sequence: Synthetic oligonucleotide
gguacuugaggcugaaca

SEQ ID NO: 62415 - RNA, 18 nt, Artificial Sequence
  Description of Artificial Sequence: Synthetic oligonucleotide
gcccagguacuugaggcu

SEQ ID NO: 62416 - RNA, 18 nt, Artificial Sequence
  Description of Artificial Sequence: Synthetic oligonucleotide
gucaugcccagguacuug

SEQ ID NO: 62417 - RNA, 18 nt, Artificial Sequence
  Description of Artificial Sequence: Synthetic oligonucleotide
cuagcgucaugcccaggu

SEQ ID NO: 62418 - RNA, 18 nt, Artificial Sequence
  Description of Artificial Sequence: Synthetic oligonucleotide
cuccacuagcgucaugcc

SEQ ID NO: 62419 - RNA, 18 nt, Artificial Sequence
  Description of Artificial Sequence: Synthetic oligonucleotide
ggcugcuccacuagcguc

SEQ ID NO: 62420 - RNA, 18 nt, Artificial Sequence
  Description of Artificial Sequence: Synthetic oligonucleotide
ccuugggcugcuccacua

SEQ ID NO: 62421 - RNA, 18 nt, Artificial Sequence
  Description of Artificial Sequence: Synthetic oligonucleotide
cucacccuugggcugcuc

SEQ ID NO: 62422 - RNA, 18 nt, Artificial Sequence
  Description of Artificial Sequence: Synthetic oligonucleotide
agcuccucacccuugggc

SEQ ID NO: 62423 - RNA, 18 nt, Artificial Sequence
  Description of Artificial Sequence: Synthetic oligonucleotide
ccgacagcuccucacccu

SEQ ID NO: 62424 - RNA, 18 nt, Artificial Sequence
  Description of Artificial Sequence: Synthetic oligonucleotide
ggcggccgacagcuccuc

SEQ ID NO: 62425 - RNA, 18 nt, Artificial Sequence
  Description of Artificial Sequence: Synthetic oligonucleotide
auggcggcggccgacagc

SEQ ID NO: 62426 - RNA, 18 nt, Artificial Sequence
  Description of Artificial Sequence: Synthetic oligonucleotide
ucuugauggcggcggccg

SEQ ID NO: 62427 - RNA, 18 nt, Artificial Sequence
  Description of Artificial Sequence: Synthetic oligonucleotide
gauccucuugauggcggc

SEQ ID NO: 62428 - RNA, 18 nt, Artificial Sequence
  Description of Artificial Sequence: Synthetic oligonucleotide
gccacgauccucuugaug

SEQ ID NO: 62429 - RNA, 18 nt, Artificial Sequence
  Description of Artificial Sequence: Synthetic oligonucleotide
gcagcccggguuucccua

SEQ ID NO: 62430 - RNA, 18 nt, Artificial Sequence
  Description of Artificial Sequence: Synthetic oligonucleotide
ccugggcagcccggguuu

SEQ ID NO: 62431 - RNA, 18 nt, Artificial Sequence
  Description of Artificial Sequence: Synthetic oligonucleotide
aaaguccugggcagcccg

SEQ ID NO: 62432 - RNA, 18 nt, Artificial Sequence
  Description of Artificial Sequence: Synthetic oligonucleotide
cugaaaaaguccugggca

SEQ ID NO: 62433 - RNA, 18 nt, Artificial Sequence
  Description of Artificial Sequence: Synthetic oligonucleotide
acgugcugaaaaaguccu

SEQ ID NO: 62434 - RNA, 18 nt, Artificial Sequence
  Description of Artificial Sequence: Synthetic oligonucleotide
gcgacacgugcugaaaaa

SEQ ID NO: 62435 - RNA, 18 nt, Artificial Sequence
  Description of Artificial Sequence: Synthetic oligonucleotide
ggagagcgacacgugcug

SEQ ID NO: 62436 - RNA, 18 nt, Artificial Sequence
  Description of Artificial Sequence: Synthetic oligonucleotide
ccucaggagagcgacacg

SEQ ID NO: 62437 - RNA, 18 nt, Artificial Sequence
  Description of Artificial Sequence: Synthetic oligonucleotide
gcaggccucaggagagcg

SEQ ID NO: 62438 - RNA, 18 nt, Artificial Sequence
  Description of Artificial Sequence: Synthetic oligonucleotide
ucacagcaggccucagga

SEQ ID NO: 62439 - RNA, 18 nt, Artificial Sequence
  Description of Artificial Sequence: Synthetic oligonucleotide
ucaguucacagcaggccu

SEQ ID NO: 62440 - RNA, 18 nt, Artificial Sequence
  Description of Artificial Sequence: Synthetic oligonucleotide
cagagucaguucacagca

SEQ ID NO: 62441 - RNA, 18 nt, Artificial Sequence
  Description of Artificial Sequence: Synthetic oligonucleotide
ucccucuuuuguggaccc

SEQ ID NO: 62442 - RNA, 18 nt, Artificial Sequence
  Description of Artificial Sequence: Synthetic oligonucleotide
aucuuucccucuuuugug

SEQ ID NO: 62443 - RNA, 18 nt, Artificial Sequence
  Description of Artificial Sequence: Synthetic oligonucleotide
cauaaaucuuucccucuu

SEQ ID NO: 62444 - RNA, 18 nt, Artificial Sequence
  Description of Artificial Sequence: Synthetic oligonucleotide
gaaggcauaaaucuuucc

SEQ ID NO: 62445 - RNA, 18 nt, Artificial Sequence
  Description of Artificial Sequence: Synthetic oligonucleotide
agacugaaggcauaaauc

SEQ ID NO: 62446 - RNA, 18 nt, Artificial Sequence
  Description of Artificial Sequence: Synthetic oligonucleotide
guggcagacugaaggcau

SEQ ID NO: 62447 - RNA, 18 nt, Artificial Sequence
  Description of Artificial Sequence: Synthetic oligonucleotide
gcuagguggcagacugaa

SEQ ID NO: 62448 - RNA, 18 nt, Artificial Sequence
  Description of Artificial Sequence: Synthetic oligonucleotide
agguugcuagguggcaga

SEQ ID NO: 62449 - RNA, 18 nt, Artificial Sequence
  Description of Artificial Sequence: Synthetic oligonucleotide
gagacagguugcuaggug

SEQ ID NO: 62450 - RNA, 18 nt, Artificial Sequence
  Description of Artificial Sequence: Synthetic oligonucleotide
aacaggagacagguugcu

SEQ ID NO: 62451 - RNA, 18 nt, Artificial Sequence
  Description of Artificial Sequence: Synthetic oligonucleotide
cuuucccucuuuugugga

SEQ ID NO: 62452 - RNA, 18 nt, Artificial Sequence
  Description of Artificial Sequence: Synthetic oligonucleotide
uaaaucuuucccucuuuu

SEQ ID NO: 62453 - RNA, 18 nt, Artificial Sequence
  Description of Artificial Sequence: Synthetic oligonucleotide
aggcauaaaucuuucccu

SEQ ID NO: 62454 - RNA, 18 nt, Artificial Sequence
  Description of Artificial Sequence: Synthetic oligonucleotide
acugaaggcauaaaucuu

SEQ ID NO: 62455 - RNA, 18 nt, Artificial Sequence
  Description of Artificial Sequence: Synthetic oligonucleotide
ggcagacugaaggcauaa

SEQ ID NO: 62456 - RNA, 18 nt, Artificial Sequence
  Description of Artificial Sequence: Synthetic oligonucleotide
uagguggcagacugaagg

SEQ ID NO: 62457 - RNA, 18 nt, Artificial Sequence
  Description of Artificial Sequence: Synthetic oligonucleotide
guugcuagguggcagacu

SEQ ID NO: 62458 - RNA, 18 nt, Artificial Sequence
  Description of Artificial Sequence: Synthetic oligonucleotide
gacagguugcuagguggc

SEQ ID NO: 62459 - RNA, 18 nt, Artificial Sequence
  Description of Artificial Sequence: Synthetic oligonucleotide
gagggaagcgacgcagug

SEQ ID NO: 62460 - RNA, 18 nt, Artificial Sequence
  Description of Artificial Sequence: Synthetic oligonucleotide
auccagagggaagcgacg

SEQ ID NO: 62461 - RNA, 18 nt, Artificial Sequence
  Description of Artificial Sequence: Synthetic oligonucleotide
gcagcauccagagggaag

SEQ ID NO: 62462 - RNA, 18 nt, Artificial Sequence
  Description of Artificial Sequence: Synthetic oligonucleotide
ugauggcagcauccagag

SEQ ID NO: 62463 - RNA, 18 nt, Artificial Sequence
  Description of Artificial Sequence: Synthetic oligonucleotide
gaaaaugauggcagcauc

SEQ ID NO: 62464 - RNA, 18 nt, Artificial Sequence
  Description of Artificial Sequence: Synthetic oligonucleotide
ucggagaaaaugauggca

SEQ ID NO: 62465 - RNA, 18 nt, Artificial Sequence
  Description of Artificial Sequence: Synthetic oligonucleotide
ggaugucggagaaaauga

SEQ ID NO: 62466 - RNA, 18 nt, Artificial Sequence
  Description of Artificial Sequence: Synthetic oligonucleotide
aacaaggaugucggagaa

SEQ ID NO: 62467 - RNA, 18 nt, Artificial Sequence
  Description of Artificial Sequence: Synthetic oligonucleotide
gguacaacaaggaugucg

SEQ ID NO: 62468 - RNA, 18 nt, Artificial Sequence
  Description of Artificial Sequence: Synthetic oligonucleotide
agagggaagcgacgcagu

SEQ ID NO: 62469 - RNA, 18 nt, Artificial Sequence
  Description of Artificial Sequence: Synthetic oligonucleotide
cauccagagggaagcgac

SEQ ID NO: 62470 - RNA, 18 nt, Artificial Sequence
  Description of Artificial Sequence: Synthetic oligonucleotide
ggcagcauccagagggaa

SEQ ID NO: 62471 - RNA, 18 nt, Artificial Sequence
  Description of Artificial Sequence: Synthetic oligonucleotide
augauggcagcauccaga

SEQ ID NO: 62472 - RNA, 18 nt, Artificial Sequence
  Description of Artificial Sequence: Synthetic oligonucleotide
agaaaaugauggcagcau

SEQ ID NO: 62473 - RNA, 18 nt, Artificial Sequence
  Description of Artificial Sequence: Synthetic oligonucleotide
gucggagaaaaugauggc

SEQ ID NO: 62474 - RNA, 18 nt, Artificial Sequence
  Description of Artificial Sequence: Synthetic oligonucleotide
aggaugucggagaaaaug

SEQ ID NO: 62475 - RNA, 18 nt, Artificial Sequence
  Description of Artificial Sequence: Synthetic oligonucleotide
caacaaggaugucggaga

SEQ ID NO: 62476 - RNA, 18 nt, Artificial Sequence
  Description of Artificial Sequence: Synthetic oligonucleotide
ggguacaacaaggauguc

SEQ ID NO: 62477 - RNA, 18 nt, Artificial Sequence
  Description of Artificial Sequence: Synthetic oligonucleotide
uaggaucagguuugagug

SEQ ID NO: 62478 - RNA, 18 nt, Artificial Sequence
  Description of Artificial Sequence: Synthetic oligonucleotide
uauucuaggaucagguuu

SEQ ID NO: 62479 - RNA, 18 nt, Artificial Sequence
  Description of Artificial Sequence: Synthetic oligonucleotide
gauuauauucuaggauca

SEQ ID NO: 62480 - RNA, 18 nt, Artificial Sequence
  Description of Artificial Sequence: Synthetic oligonucleotide
ccuuggauuauauucuag

SEQ ID NO: 62481 - RNA, 18 nt, Artificial Sequence
  Description of Artificial Sequence: Synthetic oligonucleotide
ggcguccuuggauuauau

SEQ ID NO: 62482 - RNA, 18 nt, Artificial Sequence
  Description of Artificial Sequence: Synthetic oligonucleotide
uucaaggcguccuuggau

SEQ ID NO: 62483 - RNA, 18 nt, Artificial Sequence
  Description of Artificial Sequence: Synthetic oligonucleotide
ggauuuucaaggcguccu

SEQ ID NO: 62484 - RNA, 18 nt, Artificial Sequence
  Description of Artificial Sequence: Synthetic oligonucleotide
uagaaggauuuucaaggc

SEQ ID NO: 62485 - RNA, 18 nt, Artificial Sequence
  Description of Artificial Sequence: Synthetic oligonucleotide
acugauagaaggauuuuc

SEQ ID NO: 62486 - RNA, 18 nt, Artificial Sequence
  Description of Artificial Sequence: Synthetic oligonucleotide
acuggacugauagaagga

SEQ ID NO: 62487 - RNA, 18 nt, Artificial Sequence
  Description of Artificial Sequence: Synthetic oligonucleotide
ccuugacuggacugauag

SEQ ID NO: 62488 - RNA, 18 nt, Artificial Sequence
  Description of Artificial Sequence: Synthetic oligonucleotide
guaaaccuugacuggacu

SEQ ID NO: 62489 - RNA, 18 nt, Artificial Sequence
  Description of Artificial Sequence: Synthetic oligonucleotide
uuauuguaaaccuugacu

SEQ ID NO: 62490 - RNA, 18 nt, Artificial Sequence
  Description of Artificial Sequence: Synthetic oligonucleotide
agugcuuauuguaaaccu

SEQ ID NO: 62491 - RNA, 18 nt, Artificial Sequence
  Description of Artificial Sequence: Synthetic oligonucleotide
ggauaagugcuuauugua

SEQ ID NO: 62492 - RNA, 18 nt, Artificial Sequence
  Description of Artificial Sequence: Synthetic oligonucleotide
aguuaggauaagugcuua

SEQ ID NO: 62493 - RNA, 18 nt, Artificial Sequence
  Description of Artificial Sequence: Synthetic oligonucleotide
gauccaguuaggauaagu

SEQ ID NO: 62494 - RNA, 18 nt, Artificial Sequence
  Description of Artificial Sequence: Synthetic oligonucleotide
cccucgauccaguuagga

SEQ ID NO: 62495 - RNA, 18 nt, Artificial Sequence
  Description of Artificial Sequence: Synthetic oligonucleotide
uuuuucccucgauccagu

SEQ ID NO: 62496 - RNA, 18 nt, Artificial Sequence
  Description of Artificial Sequence: Synthetic oligonucleotide
cuuaguuuuucccucgau

SEQ ID NO: 62497 - RNA, 18 nt, Artificial Sequence
  Description of Artificial Sequence: Synthetic oligonucleotide
ucaaccuuaguuuuuccc

SEQ ID NO: 62498 - RNA, 18 nt, Artificial Sequence
  Description of Artificial Sequence: Synthetic oligonucleotide
uucuuucaaccuuaguuu

SEQ ID NO: 62499 - RNA, 18 nt, Artificial Sequence
  Description of Artificial Sequence: Synthetic oligonucleotide
uccauuucuuucaaccuu

SEQ ID NO: 62500 - RNA, 18 nt, Artificial Sequence
  Description of Artificial Sequence: Synthetic oligonucleotide
caaacuccauuucuuuca

SEQ ID NO: 62501 - RNA, 18 nt, Artificial Sequence
  Description of Artificial Sequence: Synthetic oligonucleotide
ucugccaaacuccauuuc

SEQ ID NO: 62502 - RNA, 18 nt, Artificial Sequence
  Description of Artificial Sequence: Synthetic oligonucleotide
aaaacucugccaaacucc

SEQ ID NO: 62503 - RNA, 18 nt, Artificial Sequence
  Description of Artificial Sequence: Synthetic oligonucleotide
ucccucgauccaguuagg

SEQ ID NO: 62504 - RNA, 18 nt, Artificial Sequence
  Description of Artificial Sequence: Synthetic oligonucleotide
guuuuucccucgauccag

SEQ ID NO: 62505 - RNA, 18 nt, Artificial Sequence
  Description of Artificial Sequence: Synthetic oligonucleotide
ccuuaguuuuucccucga

SEQ ID NO: 62506 - RNA, 18 nt, Artificial Sequence
  Description of Artificial Sequence: Synthetic oligonucleotide
uucaaccuuaguuuuucc

SEQ ID NO: 62507 - RNA, 18 nt, Artificial Sequence
  Description of Artificial Sequence: Synthetic oligonucleotide
uuucuuucaaccuuaguu

SEQ ID NO: 62508 - RNA, 18 nt, Artificial Sequence
  Description of Artificial Sequence: Synthetic oligonucleotide
cuccauuucuuucaaccu

SEQ ID NO: 62509 - RNA, 18 nt, Artificial Sequence
  Description of Artificial Sequence: Synthetic oligonucleotide
ccaaacuccauuucuuuc

SEQ ID NO: 62510 - RNA, 18 nt, Artificial Sequence
  Description of Artificial Sequence: Synthetic oligonucleotide
cucugccaaacuccauuu

SEQ ID NO: 62511 - RNA, 18 nt, Artificial Sequence
  Description of Artificial Sequence: Synthetic oligonucleotide
uaaaacucugccaaacuc

SEQ ID NO: 62512 - RNA, 18 nt, Artificial Sequence
  Description of Artificial Sequence: Synthetic oligonucleotide
gagaauaaaacucugcca

SEQ ID NO: 62513 - RNA, 18 nt, Artificial Sequence
  Description of Artificial Sequence: Synthetic oligonucleotide
aaaaggagaauaaaacuc

SEQ ID NO: 62514 - RNA, 18 nt, Artificial Sequence
  Description of Artificial Sequence: Synthetic oligonucleotide
gaaggaaaaggagaauaa

SEQ ID NO: 62515 - RNA, 18 nt, Artificial Sequence
  Description of Artificial Sequence: Synthetic oligonucleotide
aggaggaaggaaaaggag

SEQ ID NO: 62516 - RNA, 18 nt, Artificial Sequence
  Description of Artificial Sequence: Synthetic oligonucleotide
auuccaggaggaaggaaa

SEQ ID NO: 62517 - RNA, 18 nt, Artificial Sequence
  Description of Artificial Sequence: Synthetic oligonucleotide
agcucauuccaggaggaa

SEQ ID NO: 62518 - RNA, 18 nt, Artificial Sequence
  Description of Artificial Sequence: Synthetic oligonucleotide
uguucagcucauuccagg

SEQ ID NO: 62519 - RNA, 18 nt, Artificial Sequence
  Description of Artificial Sequence: Synthetic oligonucleotide
gguucuguucagcucauu

SEQ ID NO: 62520 - RNA, 18 nt, Artificial Sequence
  Description of Artificial Sequence: Synthetic oligonucleotide
ggaaagguucuguucagc

SEQ ID NO: 62521 - RNA, 18 nt, Artificial Sequence
  Description of Artificial Sequence: Synthetic oligonucleotide
caggaggaaagguucugu

SEQ ID NO: 62522 - RNA, 18 nt, Artificial Sequence
  Description of Artificial Sequence: Synthetic oligonucleotide
gaauccaggaggaaaggu

SEQ ID NO: 62523 - RNA, 18 nt, Artificial Sequence
  Description of Artificial Sequence: Synthetic oligonucleotide
aaauggaauccaggagga

SEQ ID NO: 62524 - RNA, 18 nt, Artificial Sequence
  Description of Artificial Sequence: Synthetic oligonucleotide
ucccaaaauggaauccag

SEQ ID NO: 62525 - RNA, 18 nt, Artificial Sequence
  Description of Artificial Sequence: Synthetic oligonucleotide
uggguucccaaaauggaa

SEQ ID NO: 62526 - RNA, 18 nt, Artificial Sequence
  Description of Artificial Sequence: Synthetic oligonucleotide
acaucuggguucccaaaa

SEQ ID NO: 62527 - RNA, 18 nt, Artificial Sequence
  Description of Artificial Sequence: Synthetic oligonucleotide
ucaccuccaugcccagug

SEQ ID NO: 62528 - RNA, 18 nt, Artificial Sequence
  Description of Artificial Sequence: Synthetic oligonucleotide
cauggucaccuccaugcc

SEQ ID NO: 62529 - RNA, 18 nt, Artificial Sequence
  Description of Artificial Sequence: Synthetic oligonucleotide
gguaccauggucaccucc

SEQ ID NO: 62530 - RNA, 18 nt, Artificial Sequence
  Description of Artificial Sequence: Synthetic oligonucleotide
ugccagguaccaugguca

SEQ ID NO: 62531 - RNA, 18 nt, Artificial Sequence
  Description of Artificial Sequence: Synthetic oligonucleotide
uccuuugccagguaccau

SEQ ID NO: 62532 - RNA, 18 nt, Artificial Sequence
  Description of Artificial Sequence: Synthetic oligonucleotide
cuggguccuuugccaggu

SEQ ID NO: 62533 - RNA, 18 nt, Artificial Sequence
  Description of Artificial Sequence: Synthetic oligonucleotide
ggaagcuggguccuuugc

SEQ ID NO: 62534 - RNA, 18 nt, Artificial Sequence
  Description of Artificial Sequence: Synthetic oligonucleotide
cucugggaagcugggucc

SEQ ID NO: 62535 - RNA, 18 nt, Artificial Sequence
  Description of Artificial Sequence: Synthetic oligonucleotide
aauggcucugggaagcug

SEQ ID NO: 62536 - RNA, 18 nt, Artificial Sequence
  Description of Artificial Sequence: Synthetic oligonucleotide
cucuuaauggcucuggga

SEQ ID NO: 62537 - RNA, 18 nt, Artificial Sequence
  Description of Artificial Sequence: Synthetic oligonucleotide
cucuucucuuaauggcuc

SEQ ID NO: 62538 - RNA, 18 nt, Artificial Sequence
  Description of Artificial Sequence: Synthetic oligonucleotide
uccugcucuucucuuaau

SEQ ID NO: 62539 - RNA, 18 nt, Artificial Sequence
  Description of Artificial Sequence: Synthetic oligonucleotide
cuagguccugcucuucuc

SEQ ID NO: 62540 - RNA, 18 nt, Artificial Sequence
  Description of Artificial Sequence: Synthetic oligonucleotide
gcguucuagguccugcuc

SEQ ID NO: 62541 - RNA, 18 nt, Artificial Sequence
  Description of Artificial Sequence: Synthetic oligonucleotide
cguaggcguucuaggucc

SEQ ID NO: 62542 - RNA, 18 nt, Artificial Sequence
  Description of Artificial Sequence: Synthetic oligonucleotide
gaucccguaggcguucua

SEQ ID NO: 62543 - RNA, 18 nt, Artificial Sequence
  Description of Artificial Sequence: Synthetic oligonucleotide
uucuggaucccguaggcg

SEQ ID NO: 62544 - RNA, 18 nt, Artificial Sequence
  Description of Artificial Sequence: Synthetic oligonucleotide
accacuucuggaucccgu

SEQ ID NO: 62545 - RNA, 18 nt, Artificial Sequence
  Description of Artificial Sequence: Synthetic oligonucleotide
aggcuaccacuucuggau

SEQ ID NO: 62546 - RNA, 18 nt, Artificial Sequence
  Description of Artificial Sequence: Synthetic oligonucleotide
cucagaggcuaccacuuc

SEQ ID NO: 62547 - RNA, 18 nt, Artificial Sequence
  Description of Artificial Sequence: Synthetic oligonucleotide
ccuagcucagaggcuacc

SEQ ID NO: 62548 - RNA, 18 nt, Artificial Sequence
  Description of Artificial Sequence: Synthetic oligonucleotide
cauagccuagcucagagg

SEQ ID NO: 62549 - RNA, 18 nt, Artificial Sequence
  Description of Artificial Sequence: Synthetic oligonucleotide
gaacacauagccuagcuc

SEQ ID NO: 62550 - RNA, 18 nt, Artificial Sequence
  Description of Artificial Sequence: Synthetic oligonucleotide
gcuuggaacacauagccu

SEQ ID NO: 62551 - RNA, 18 nt, Artificial Sequence
  Description of Artificial Sequence: Synthetic oligonucleotide
ugauggcuuggaacacau

SEQ ID NO: 62552 - RNA, 18 nt, Artificial Sequence
  Description of Artificial Sequence: Synthetic oligonucleotide
aagggugauggcuuggaa

SEQ ID NO: 62553 - RNA, 18 nt, Artificial Sequence
  Description of Artificial Sequence: Synthetic oligonucleotide
cggguaagggugauggcu

SEQ ID NO: 62554 - RNA, 18 nt, Artificial Sequence
  Description of Artificial Sequence: Synthetic oligonucleotide
guugucggguaaggguga

SEQ ID NO: 62555 - RNA, 18 nt, Artificial Sequence
  Description of Artificial Sequence: Synthetic oligonucleotide
cagucguugucggguaag

SEQ ID NO: 62556 - RNA, 18 nt, Artificial Sequence
  Description of Artificial Sequence: Synthetic oligonucleotide
ccagccagucguugucgg

SEQ ID NO: 62557 - RNA, 18 nt, Artificial Sequence
  Description of Artificial Sequence: Synthetic oligonucleotide
cacguccagccagucguu

SEQ ID NO: 62558 - RNA, 18 nt, Artificial Sequence
  Description of Artificial Sequence: Synthetic oligonucleotide
cggcacacguccagccag

SEQ ID NO: 62559 - RNA, 18 nt, Artificial Sequence
  Description of Artificial Sequence: Synthetic oligonucleotide
aucagcggcacacgucca

SEQ ID NO: 62560 - RNA, 18 nt, Artificial Sequence
  Description of Artificial Sequence: Synthetic oligonucleotide
agccaaucagcggcacac

SEQ ID NO: 62561 - RNA, 18 nt, Artificial Sequence
  Description of Artificial Sequence: Synthetic oligonucleotide
agcaaagccaaucagcgg

SEQ ID NO: 62562 - RNA, 18 nt, Artificial Sequence
  Description of Artificial Sequence: Synthetic oligonucleotide
gcaccagcaaagccaauc

SEQ ID NO: 62563 - RNA, 18 nt, Artificial Sequence
  Description of Artificial Sequence: Synthetic oligonucleotide
gucaccuccaugcccagu

SEQ ID NO: 62564 - RNA, 18 nt, Artificial Sequence
  Description of Artificial Sequence: Synthetic oligonucleotide
ccauggucaccuccaugc

SEQ ID NO: 62565 - RNA, 18 nt, Artificial Sequence
  Description of Artificial Sequence: Synthetic oligonucleotide
agguaccauggucaccuc

SEQ ID NO: 62566 - RNA, 18 nt, Artificial Sequence
  Description of Artificial Sequence: Synthetic oligonucleotide
uugccagguaccaugguc

SEQ ID NO: 62567 - RNA, 18 nt, Artificial Sequence
  Description of Artificial Sequence: Synthetic oligonucleotide
guccuuugccagguacca

SEQ ID NO: 62568 - RNA, 18 nt, Artificial Sequence
  Description of Artificial Sequence: Synthetic oligonucleotide
gcuggguccuuugccagg

SEQ ID NO: 62569 - RNA, 18 nt, Artificial Sequence
  Description of Artificial Sequence: Synthetic oligonucleotide
gggaagcuggguccuuug

SEQ ID NO: 62570 - RNA, 18 nt, Artificial Sequence
  Description of Artificial Sequence: Synthetic oligonucleotide
gcucugggaagcuggguc

SEQ ID NO: 62571 - RNA, 18 nt, Artificial Sequence
  Description of Artificial Sequence: Synthetic oligonucleotide
uaauggcucugggaagcu

SEQ ID NO: 62572 - RNA, 18 nt, Artificial Sequence
  Description of Artificial Sequence: Synthetic oligonucleotide
ucucuuaauggcucuggg

SEQ ID NO: 62573 - RNA, 18 nt, Artificial Sequence
  Description of Artificial Sequence: Synthetic oligonucleotide
gcucuucucuuaauggcu

SEQ ID NO: 62574 - RNA, 18 nt, Artificial Sequence
  Description of Artificial Sequence: Synthetic oligonucleotide
guccugcucuucucuuaa

SEQ ID NO: 62575 - RNA, 18 nt, Artificial Sequence
  Description of Artificial Sequence: Synthetic oligonucleotide
ucuagguccugcucuucu

SEQ ID NO: 62576 - RNA, 18 nt, Artificial Sequence
  Description of Artificial Sequence: Synthetic oligonucleotide
ggcguucuagguccugcu

SEQ ID NO: 62577 - RNA, 18 nt, Artificial Sequence
  Description of Artificial Sequence: Synthetic oligonucleotide
ccguaggcguucuagguc

SEQ ID NO: 62578 - RNA, 18 nt, Artificial Sequence
  Description of Artificial Sequence: Synthetic oligonucleotide
ggaucccguaggcguucu

SEQ ID NO: 62579 - RNA, 18 nt, Artificial Sequence
  Description of Artificial Sequence: Synthetic oligonucleotide
cuucuggaucccguaggc

SEQ ID NO: 62580 - RNA, 18 nt, Artificial Sequence
  Description of Artificial Sequence: Synthetic oligonucleotide
uaccacuucuggaucccg

SEQ ID NO: 62581 - RNA, 18 nt, Artificial Sequence
  Description of Artificial Sequence: Synthetic oligonucleotide
gaggcuaccacuucugga

SEQ ID NO: 62582 - RNA, 18 nt, Artificial Sequence
  Description of Artificial Sequence: Synthetic oligonucleotide
gcucagaggcuaccacuu

SEQ ID NO: 62583 - RNA, 18 nt, Artificial Sequence
  Description of Artificial Sequence: Synthetic oligonucleotide
gccuagcucagaggcuac

SEQ ID NO: 62584 - RNA, 18 nt, Artificial Sequence
  Description of Artificial Sequence: Synthetic oligonucleotide
acauagccuagcucagag

SEQ ID NO: 62585 - RNA, 18 nt, Artificial Sequence
  Description of Artificial Sequence: Synthetic oligonucleotide
ggaacacauagccuagcu

SEQ ID NO: 62586 - RNA, 18 nt, Artificial Sequence
  Description of Artificial Sequence: Synthetic oligonucleotide
ggcuuggaacacauagcc

SEQ ID NO: 62587 - RNA, 18 nt, Artificial Sequence
  Description of Artificial Sequence: Synthetic oligonucleotide
gugauggcuuggaacaca

SEQ ID NO: 62588 - RNA, 18 nt, Artificial Sequence
  Description of Artificial Sequence: Synthetic oligonucleotide
uaagggugauggcuugga

SEQ ID NO: 62589 - RNA, 18 nt, Artificial Sequence
  Description of Artificial Sequence: Synthetic oligonucleotide
ucggguaagggugauggc

SEQ ID NO: 62590 - RNA, 18 nt, Artificial Sequence
  Description of Artificial Sequence: Synthetic oligonucleotide
cguugucggguaagggug

SEQ ID NO: 62591 - RNA, 18 nt, Artificial Sequence
  Description of Artificial Sequence: Synthetic oligonucleotide
ccagucguugucggguaa

SEQ ID NO: 62592 - RNA, 18 nt, Artificial Sequence
  Description of Artificial Sequence: Synthetic oligonucleotide
uccagccagucguugucg

SEQ ID NO: 62593 - RNA, 18 nt, Artificial Sequence
  Description of Artificial Sequence: Synthetic oligonucleotide
acacguccagccagucgu

SEQ ID NO: 62594 - RNA, 18 nt, Artificial Sequence
  Description of Artificial Sequence: Synthetic oligonucleotide
gcggcacacguccagcca

SEQ ID NO: 62595 - RNA, 18 nt, Artificial Sequence
  Description of Artificial Sequence: Synthetic oligonucleotide
aaucagcggcacacgucc

SEQ ID NO: 62596 - RNA, 18 nt, Artificial Sequence
  Description of Artificial Sequence: Synthetic oligonucleotide
aagccaaucagcggcaca

SEQ ID NO: 62597 - RNA, 18 nt, Artificial Sequence
  Description of Artificial Sequence: Synthetic oligonucleotide
cagcaaagccaaucagcg

SEQ ID NO: 62598 - RNA, 18 nt, Artificial Sequence
  Description of Artificial Sequence: Synthetic oligonucleotide
ggcaccagcaaagccaau

SEQ ID NO: 62599 - RNA, 18 nt, Artificial Sequence
  Description of Artificial Sequence: Synthetic oligonucleotide
gucccugcccugucccac

SEQ ID NO: 62600 - RNA, 18 nt, Artificial Sequence
  Description of Artificial Sequence: Synthetic oligonucleotide
cccgagucccugcccugu

SEQ ID NO: 62601 - RNA, 18 nt, Artificial Sequence
  Description of Artificial Sequence: Synthetic oligonucleotide
cgcgccccgagucccugc

SEQ ID NO: 62602 - RNA, 18 nt, Artificial Sequence
  Description of Artificial Sequence: Synthetic oligonucleotide
cuccccgcgccccgaguc

SEQ ID NO: 62603 - RNA, 18 nt, Artificial Sequence
  Description of Artificial Sequence: Synthetic oligonucleotide
gugaucuccccgcgcccc

SEQ ID NO: 62604 - RNA, 18 nt, Artificial Sequence
  Description of Artificial Sequence: Synthetic oligonucleotide
ccagagugaucuccccgc

SEQ ID NO: 62605 - RNA, 18 nt, Artificial Sequence
  Description of Artificial Sequence: Synthetic oligonucleotide
accuuccagagugaucuc

SEQ ID NO: 62606 - RNA, 18 nt, Artificial Sequence
  Description of Artificial Sequence: Synthetic oligonucleotide
cccagaccuuccagagug

SEQ ID NO: 62607 - RNA, 18 nt, Artificial Sequence
  Description of Artificial Sequence: Synthetic oligonucleotide
ucuaccccagaccuucca

SEQ ID NO: 62608 - RNA, 18 nt, Artificial Sequence
  Description of Artificial Sequence: Synthetic oligonucleotide
uuuugucuaccccagacc

SEQ ID NO: 62609 - RNA, 18 nt, Artificial Sequence
  Description of Artificial Sequence: Synthetic oligonucleotide
cuuccuuuugucuacccc

SEQ ID NO: 62610 - RNA, 18 nt, Artificial Sequence
  Description of Artificial Sequence: Synthetic oligonucleotide
ugacccuuccuuuugucu

SEQ ID NO: 62611 - RNA, 18 nt, Artificial Sequence
  Description of Artificial Sequence: Synthetic oligonucleotide
cagacugacccuuccuuu

SEQ ID NO: 62612 - RNA, 18 nt, Artificial Sequence
  Description of Artificial Sequence: Synthetic oligonucleotide
gaagccagacugacccuu

SEQ ID NO: 62613 - RNA, 18 nt, Artificial Sequence
  Description of Artificial Sequence: Synthetic oligonucleotide
cagagugaucuccccgcg

SEQ ID NO: 62614 - RNA, 18 nt, Artificial Sequence
  Description of Artificial Sequence: Synthetic oligonucleotide
ccuuccagagugaucucc

SEQ ID NO: 62615 - RNA, 18 nt, Artificial Sequence
  Description of Artificial Sequence: Synthetic oligonucleotide
ccagaccuuccagaguga

SEQ ID NO: 62616 - RNA, 18 nt, Artificial Sequence
  Description of Artificial Sequence: Synthetic oligonucleotide
cuaccccagaccuuccag

SEQ ID NO: 62617 - RNA, 18 nt, Artificial Sequence
  Description of Artificial Sequence: Synthetic oligonucleotide
uuugucuaccccagaccu

SEQ ID NO: 62618 - RNA, 18 nt, Artificial Sequence
  Description of Artificial Sequence: Synthetic oligonucleotide
uuccuuuugucuacccca

SEQ ID NO: 62619 - RNA, 18 nt, Artificial Sequence
  Description of Artificial Sequence: Synthetic oligonucleotide
gacccuuccuuuugucua

SEQ ID NO: 62620 - RNA, 18 nt, Artificial Sequence
  Description of Artificial Sequence: Synthetic oligonucleotide
agacugacccuuccuuuu

SEQ ID NO: 62621 - RNA, 18 nt, Artificial Sequence
  Description of Artificial Sequence: Synthetic oligonucleotide
aagccagacugacccuuc

SEQ ID NO: 62622 - RNA, 18 nt, Artificial Sequence
  Description of Artificial Sequence: Synthetic oligonucleotide
cacagaagccagacugac

SEQ ID NO: 62623 - RNA, 18 nt, Artificial Sequence
  Description of Artificial Sequence: Synthetic oligonucleotide
ggugucacagaagccaga

SEQ ID NO: 62624 - RNA, 18 nt, Artificial Sequence
  Description of Artificial Sequence: Synthetic oligonucleotide
aagauggugucacagaag

SEQ ID NO: 62625 - RNA, 18 nt, Artificial Sequence
  Description of Artificial Sequence: Synthetic oligonucleotide
uguaugucaucagggucc

SEQ ID NO: 62626 - RNA, 18 nt, Artificial Sequence
  Description of Artificial Sequence: Synthetic oligonucleotide
aaccauguaugucaucag

SEQ ID NO: 62627 - RNA, 18 nt, Artificial Sequence
  Description of Artificial Sequence: Synthetic oligonucleotide
cccucaaccauguauguc

SEQ ID NO: 62628 - RNA, 18 nt, Artificial Sequence
  Description of Artificial Sequence: Synthetic oligonucleotide
caccacccucaaccaugu

SEQ ID NO: 62629 - RNA, 18 nt, Artificial Sequence
  Description of Artificial Sequence: Synthetic oligonucleotide
ugagccaccacccucaac

SEQ ID NO: 62630 - RNA, 18 nt, Artificial Sequence
  Description of Artificial Sequence: Synthetic oligonucleotide
gugcuugagccaccaccc

SEQ ID NO: 62631 - RNA, 18 nt, Artificial Sequence
  Description of Artificial Sequence: Synthetic oligonucleotide
ccauggugcuugagccac

SEQ ID NO: 62632 - RNA, 18 nt, Artificial Sequence
  Description of Artificial Sequence: Synthetic oligonucleotide
cugagccauggugcuuga

SEQ ID NO: 62633 - RNA, 18 nt, Artificial Sequence
  Description of Artificial Sequence: Synthetic oligonucleotide
uuggccugagccauggug

SEQ ID NO: 62634 - RNA, 18 nt, Artificial Sequence
  Description of Artificial Sequence: Synthetic oligonucleotide
agcgcuuggccugagcca

SEQ ID NO: 62635 - RNA, 18 nt, Artificial Sequence
  Description of Artificial Sequence: Synthetic oligonucleotide
gagccagcgcuuggccug

SEQ ID NO: 62636 - RNA, 18 nt, Artificial Sequence
  Description of Artificial Sequence: Synthetic oligonucleotide
ugauagagccagcgcuug

SEQ ID NO: 62637 - RNA, 18 nt, Artificial Sequence
  Description of Artificial Sequence: Synthetic oligonucleotide
gucucugauagagccagc

SEQ ID NO: 62638 - RNA, 18 nt, Artificial Sequence
  Description of Artificial Sequence: Synthetic oligonucleotide
cugaggucucugauagag

SEQ ID NO: 62639 - RNA, 18 nt, Artificial Sequence
  Description of Artificial Sequence: Synthetic oligonucleotide
cuagccugaggucucuga

SEQ ID NO: 62640 - RNA, 18 nt, Artificial Sequence
  Description of Artificial Sequence: Synthetic oligonucleotide
ggugacuagccugagguc

SEQ ID NO: 62641 - RNA, 18 nt, Artificial Sequence
  Description of Artificial Sequence: Synthetic oligonucleotide
cagcuggugacuagccug

SEQ ID NO: 62642 - RNA, 18 nt, Artificial Sequence
  Description of Artificial Sequence: Synthetic oligonucleotide
cgaagcagcuggugacua

SEQ ID NO: 62643 - RNA, 18 nt, Artificial Sequence
  Description of Artificial Sequence: Synthetic oligonucleotide
ggaugcgaagcagcuggu

SEQ ID NO: 62644 - RNA, 18 nt, Artificial Sequence
  Description of Artificial Sequence: Synthetic oligonucleotide
agugaggaugcgaagcag

SEQ ID NO: 62645 - RNA, 18 nt, Artificial Sequence
  Description of Artificial Sequence: Synthetic oligonucleotide
gcaucagugaggaugcga

SEQ ID NO: 62646 - RNA, 18 nt, Artificial Sequence
  Description of Artificial Sequence: Synthetic oligonucleotide
ccagagcaucagugagga

SEQ ID NO: 62647 - RNA, 18 nt, Artificial Sequence
  Description of Artificial Sequence: Synthetic oligonucleotide
ugggaccagagcaucagu

SEQ ID NO: 62648 - RNA, 18 nt, Artificial Sequence
  Description of Artificial Sequence: Synthetic oligonucleotide
agauaugggaccagagca

SEQ ID NO: 62649 - RNA, 18 nt, Artificial Sequence
  Description of Artificial Sequence: Synthetic oligonucleotide
cuaccagauaugggacca

SEQ ID NO: 62650 - RNA, 18 nt, Artificial Sequence
  Description of Artificial Sequence: Synthetic oligonucleotide
uuguccuaccagauaugg

SEQ ID NO: 62651 - RNA, 18 nt, Artificial Sequence
  Description of Artificial Sequence: Synthetic oligonucleotide
accacuuguccuaccaga

SEQ ID NO: 62652 - RNA, 18 nt, Artificial Sequence
  Description of Artificial Sequence: Synthetic oligonucleotide
cagccaccacuuguccua

SEQ ID NO: 62653 - RNA, 18 nt, Artificial Sequence
  Description of Artificial Sequence: Synthetic oligonucleotide
ggcaccagccaccacuug

SEQ ID NO: 62654 - RNA, 18 nt, Artificial Sequence
  Description of Artificial Sequence: Synthetic oligonucleotide
uguaugucaucagggucc

SEQ ID NO: 62655 - RNA, 18 nt, Artificial Sequence
  Description of Artificial Sequence: Synthetic oligonucleotide
aaccauguaugucaucag

SEQ ID NO: 62656 - RNA, 18 nt, Artificial Sequence
  Description of Artificial Sequence: Synthetic oligonucleotide
cccucaaccauguauguc

SEQ ID NO: 62657 - RNA, 18 nt, Artificial Sequence
  Description of Artificial Sequence: Synthetic oligonucleotide
caccacccucaaccaugu

SEQ ID NO: 62658 - RNA, 18 nt, Artificial Sequence
  Description of Artificial Sequence: Synthetic oligonucleotide
ugagccaccacccucaac

SEQ ID NO: 62659 - RNA, 18 nt, Artificial Sequence
  Description of Artificial Sequence: Synthetic oligonucleotide
gugcuugagccaccaccc

SEQ ID NO: 62660 - RNA, 18 nt, Artificial Sequence
  Description of Artificial Sequence: Synthetic oligonucleotide
ccauggugcuugagccac

SEQ ID NO: 62661 - RNA, 18 nt, Artificial Sequence
  Description of Artificial Sequence: Synthetic oligonucleotide
cugagccauggugcuuga

SEQ ID NO: 62662 - RNA, 18 nt, Artificial Sequence
  Description of Artificial Sequence: Synthetic oligonucleotide
uuggccugagccauggug

SEQ ID NO: 62663 - RNA, 18 nt, Artificial Sequence
  Description of Artificial Sequence: Synthetic oligonucleotide
agcgcuuggccugagcca

SEQ ID NO: 62664 - RNA, 18 nt, Artificial Sequence
  Description of Artificial Sequence: Synthetic oligonucleotide
gagccagcgcuuggccug

SEQ ID NO: 62665 - RNA, 18 nt, Artificial Sequence
  Description of Artificial Sequence: Synthetic oligonucleotide
ugauagagccagcgcuug

SEQ ID NO: 62666 - RNA, 18 nt, Artificial Sequence
  Description of Artificial Sequence: Synthetic oligonucleotide
gucucugauagagccagc

SEQ ID NO: 62667 - RNA, 18 nt, Artificial Sequence
  Description of Artificial Sequence: Synthetic oligonucleotide
cugaggucucugauagag

SEQ ID NO: 62668 - RNA, 18 nt, Artificial Sequence
  Description of Artificial Sequence: Synthetic oligonucleotide
cuagccugaggucucuga

SEQ ID NO: 62669 - RNA, 18 nt, Artificial Sequence
  Description of Artificial Sequence: Synthetic oligonucleotide
ggugacuagccugagguc

SEQ ID NO: 62670 - RNA, 18 nt, Artificial Sequence
  Description of Artificial Sequence: Synthetic oligonucleotide
cagcuggugacuagccug

SEQ ID NO: 62671 - RNA, 18 nt, Artificial Sequence
  Description of Artificial Sequence: Synthetic oligonucleotide
cgaagcagcuggugacua

SEQ ID NO: 62672 - RNA, 18 nt, Artificial Sequence
  Description of Artificial Sequence: Synthetic oligonucleotide
ggaugcgaagcagcuggu

SEQ ID NO: 62673 - RNA, 18 nt, Artificial Sequence
  Description of Artificial Sequence: Synthetic oligonucleotide
agugaggaugcgaagcag

SEQ ID NO: 62674 - RNA, 18 nt, Artificial Sequence
  Description of Artificial Sequence: Synthetic oligonucleotide
gcaucagugaggaugcga

SEQ ID NO: 62675 - RNA, 18 nt, Artificial Sequence
  Description of Artificial Sequence: Synthetic oligonucleotide
ccagagcaucagugagga

SEQ ID NO: 62676 - RNA, 18 nt, Artificial Sequence
  Description of Artificial Sequence: Synthetic oligonucleotide
ugggaccagagcaucagu

SEQ ID NO: 62677 - RNA, 18 nt, Artificial Sequence
  Description of Artificial Sequence: Synthetic oligonucleotide
agauaugggaccagagca

SEQ ID NO: 62678 - RNA, 18 nt, Artificial Sequence
  Description of Artificial Sequence: Synthetic oligonucleotide
cuaccagauaugggacca

SEQ ID NO: 62679 - RNA, 18 nt, Artificial Sequence
  Description of Artificial Sequence: Synthetic oligonucleotide
uuguccuaccagauaugg

SEQ ID NO: 62680 - RNA, 18 nt, Artificial Sequence
  Description of Artificial Sequence: Synthetic oligonucleotide
accacuuguccuaccaga

SEQ ID NO: 62681 - RNA, 18 nt, Artificial Sequence
  Description of Artificial Sequence: Synthetic oligonucleotide
cagccaccacuuguccua

SEQ ID NO: 62682 - RNA, 18 nt, Artificial Sequence
  Description of Artificial Sequence: Synthetic oligonucleotide
ggcaccagccaccacuug

SEQ ID NO: 62683 - RNA, 18 nt, Artificial Sequence
  Description of Artificial Sequence: Synthetic oligonucleotide
uuucucucucucucagga

SEQ ID NO: 62684 - RNA, 18 nt, Artificial Sequence
  Description of Artificial Sequence: Synthetic oligonucleotide
gccuauuucucucucucu

SEQ ID NO: 62685 - RNA, 18 nt, Artificial Sequence
  Description of Artificial Sequence: Synthetic oligonucleotide
ucccagccuauuucucuc

SEQ ID NO: 62686 - RNA, 18 nt, Artificial Sequence
  Description of Artificial Sequence: Synthetic oligonucleotide
ccaaaucccagccuauuu

SEQ ID NO: 62687 - RNA, 18 nt, Artificial Sequence
  Description of Artificial Sequence: Synthetic oligonucleotide
acagaccaaaucccagcc

SEQ ID NO: 62688 - RNA, 18 nt, Artificial Sequence
  Description of Artificial Sequence: Synthetic oligonucleotide
uccuuacagaccaaaucc

SEQ ID NO: 62689 - RNA, 18 nt, Artificial Sequence
  Description of Artificial Sequence: Synthetic oligonucleotide
ucugguccuuacagacca

SEQ ID NO: 62690 - RNA, 18 nt, Artificial Sequence
  Description of Artificial Sequence: Synthetic oligonucleotide
uugcuucugguccuuaca

SEQ ID NO: 62691 - RNA, 18 nt, Artificial Sequence
  Description of Artificial Sequence: Synthetic oligonucleotide
cacucuugcuucuggucc

SEQ ID NO: 62692 - RNA, 18 nt, Artificial Sequence
  Description of Artificial Sequence: Synthetic oligonucleotide
uaggacacucuugcuucu

SEQ ID NO: 62693 - RNA, 18 nt, Artificial Sequence
  Description of Artificial Sequence: Synthetic oligonucleotide
agguuuaggacacucuug

SEQ ID NO: 62694 - RNA, 18 nt, Artificial Sequence
  Description of Artificial Sequence: Synthetic oligonucleotide
cucucagguuuaggacac

SEQ ID NO: 62695 - RNA, 18 nt, Artificial Sequence
  Description of Artificial Sequence: Synthetic oligonucleotide
cugcccucucagguuuag

SEQ ID NO: 62696 - RNA, 18 nt, Artificial Sequence
  Description of Artificial Sequence: Synthetic oligonucleotide
gaccccugcccucucagg

SEQ ID NO: 62697 - RNA, 18 nt, Artificial Sequence
  Description of Artificial Sequence: Synthetic oligonucleotide
auuaagaccccugcccuc

SEQ ID NO: 62698 - RNA, 18 nt, Artificial Sequence
  Description of Artificial Sequence: Synthetic oligonucleotide
cuggcauuaagaccccug

SEQ ID NO: 62699 - RNA, 18 nt, Artificial Sequence
  Description of Artificial Sequence: Synthetic oligonucleotide
caucccuggcauuaagac

SEQ ID NO: 62700 - RNA, 18 nt, Artificial Sequence
  Description of Artificial Sequence: Synthetic oligonucleotide
ucuuucaucccuggcauu

SEQ ID NO: 62701 - RNA, 18 nt, Artificial Sequence
  Description of Artificial Sequence: Synthetic oligonucleotide
aagguucuuucaucccug

SEQ ID NO: 62702 - RNA, 18 nt, Artificial Sequence
  Description of Artificial Sequence: Synthetic oligonucleotide
aggccaagguucuuucau

SEQ ID NO: 62703 - RNA, 18 nt, Artificial Sequence
  Description of Artificial Sequence: Synthetic oligonucleotide
acuggaggccaagguucu

SEQ ID NO: 62704 - RNA, 18 nt, Artificial Sequence
  Description of Artificial Sequence: Synthetic oligonucleotide
agaucacuggaggccaag

SEQ ID NO: 62705 - RNA, 18 nt, Artificial Sequence
  Description of Artificial Sequence: Synthetic oligonucleotide
ccgcuagaucacuggagg

SEQ ID NO: 62706 - RNA, 18 nt, Artificial Sequence
  Description of Artificial Sequence: Synthetic oligonucleotide
cugcuccgcuagaucacu

SEQ ID NO: 62707 - RNA, 18 nt, Artificial Sequence
  Description of Artificial Sequence: Synthetic oligonucleotide
cuuggcugcuccgcuaga

SEQ ID NO: 62708 - RNA, 18 nt, Artificial Sequence
  Description of Artificial Sequence: Synthetic oligonucleotide
augggcuuggcugcuccg

SEQ ID NO: 62709 - RNA, 18 nt, Artificial Sequence
  Description of Artificial Sequence: Synthetic oligonucleotide
ucaggaugggcuuggcug

SEQ ID NO: 62710 - RNA, 18 nt, Artificial Sequence
  Description of Artificial Sequence: Synthetic oligonucleotide
cagugucaggaugggcuu

SEQ ID NO: 62711 - RNA, 18 nt, Artificial Sequence
  Description of Artificial Sequence: Synthetic oligonucleotide
acugucagugucaggaug

SEQ ID NO: 62712 - RNA, 18 nt, Artificial Sequence
  Description of Artificial Sequence: Synthetic oligonucleotide
gccccacugucaguguca

SEQ ID NO: 62713 - RNA, 18 nt, Artificial Sequence
  Description of Artificial Sequence: Synthetic oligonucleotide
auuaagccccacugucag

SEQ ID NO: 62714 - RNA, 18 nt, Artificial Sequence
  Description of Artificial Sequence: Synthetic oligonucleotide
agagcauuaagccccacu

SEQ ID NO: 62715 - RNA, 18 nt, Artificial Sequence
  Description of Artificial Sequence: Synthetic oligonucleotide
uacuuagagcauuaagcc

SEQ ID NO: 62716 - RNA, 18 nt, Artificial Sequence
  Description of Artificial Sequence: Synthetic oligonucleotide
cugaauacuuagagcauu

SEQ ID NO: 62717 - RNA, 18 nt, Artificial Sequence
  Description of Artificial Sequence: Synthetic oligonucleotide
ggugucugaauacuuaga

SEQ ID NO: 62718 - RNA, 18 nt, Artificial Sequence
  Description of Artificial Sequence: Synthetic oligonucleotide
acuuuggugucugaauac

SEQ ID NO: 62719 - RNA, 18 nt, Artificial Sequence
  Description of Artificial Sequence: Synthetic oligonucleotide
cacuaacuuuggugucug

SEQ ID NO: 62720 - RNA, 18 nt, Artificial Sequence
  Description of Artificial Sequence: Synthetic oligonucleotide
cccagcacuaacuuuggu

SEQ ID NO: 62721 - RNA, 18 nt, Artificial Sequence
  Description of Artificial Sequence: Synthetic oligonucleotide
cagaucccagcacuaacu

SEQ ID NO: 62722 - RNA, 18 nt, Artificial Sequence
  Description of Artificial Sequence: Synthetic oligonucleotide
auuaagccccacugucag

SEQ ID NO: 62723 - RNA, 18 nt, Artificial Sequence
  Description of Artificial Sequence: Synthetic oligonucleotide
agagcauuaagccccacu

SEQ ID NO: 62724 - RNA, 18 nt, Artificial Sequence
  Description of Artificial Sequence: Synthetic oligonucleotide
uacuuagagcauuaagcc

SEQ ID NO: 62725 - RNA, 18 nt, Artificial Sequence
  Description of Artificial Sequence: Synthetic oligonucleotide
cugaauacuuagagcauu

SEQ ID NO: 62726 - RNA, 18 nt, Artificial Sequence
  Description of Artificial Sequence: Synthetic oligonucleotide
ggugucugaauacuuaga

SEQ ID NO: 62727 - RNA, 18 nt, Artificial Sequence
  Description of Artificial Sequence: Synthetic oligonucleotide
acuuuggugucugaauac

SEQ ID NO: 62728 - RNA, 18 nt, Artificial Sequence
  Description of Artificial Sequence: Synthetic oligonucleotide
cacuaacuuuggugucug

SEQ ID NO: 62729 - RNA, 18 nt, Artificial Sequence
  Description of Artificial Sequence: Synthetic oligonucleotide
cccagcacuaacuuuggu

SEQ ID NO: 62730 - RNA, 18 nt, Artificial Sequence
  Description of Artificial Sequence: Synthetic oligonucleotide
cagaucccagcacuaacu

SEQ ID NO: 62731 - RNA, 18 nt, Artificial Sequence
  Description of Artificial Sequence: Synthetic oligonucleotide
uuccucagaucccagcac

SEQ ID NO: 62732 - RNA, 18 nt, Artificial Sequence
  Description of Artificial Sequence: Synthetic oligonucleotide
uuacuuuccucagauccc

SEQ ID NO: 62733 - RNA, 18 nt, Artificial Sequence
  Description of Artificial Sequence: Synthetic oligonucleotide
aaaauuuacuuuccucag

SEQ ID NO: 62734 - RNA, 18 nt, Artificial Sequence
  Description of Artificial Sequence: Synthetic oligonucleotide
aaaaaaaaauuuacuuuc

SEQ ID NO: 62735 - RNA, 18 nt, Artificial Sequence
  Description of Artificial Sequence: Synthetic oligonucleotide
uaaaaaaaaaaaaauuua

SEQ ID NO: 62736 - RNA, 18 nt, Artificial Sequence
  Description of Artificial Sequence: Synthetic oligonucleotide
guaauuaaaaaaaaaaaa

SEQ ID NO: 62737 - RNA, 18 nt, Artificial Sequence
  Description of Artificial Sequence: Synthetic oligonucleotide
acccaguaauuaaaaaaa

SEQ ID NO: 62738 - RNA, 18 nt, Artificial Sequence
  Description of Artificial Sequence: Synthetic oligonucleotide
uaaaaacccaguaauuaa

SEQ ID NO: 62739 - RNA, 18 nt, Artificial Sequence
  Description of Artificial Sequence: Synthetic oligonucleotide
gacccuaaaaacccagua

SEQ ID NO: 62740 - RNA, 18 nt, Artificial Sequence
  Description of Artificial Sequence: Synthetic oligonucleotide
ugccugacccuaaaaacc

SEQ ID NO: 62741 - RNA, 18 nt, Artificial Sequence
  Description of Artificial Sequence: Synthetic oligonucleotide
gauacugccugacccuaa

SEQ ID NO: 62742 - RNA, 18 nt, Artificial Sequence
  Description of Artificial Sequence: Synthetic oligonucleotide
ucccugauacugccugac

SEQ ID NO: 62743 - RNA, 18 nt, Artificial Sequence
  Description of Artificial Sequence: Synthetic oligonucleotide
uucaaucccugauacugc

SEQ ID NO: 62744 - RNA, 18 nt, Artificial Sequence
  Description of Artificial Sequence: Synthetic oligonucleotide
augacuucaaucccugau

SEQ ID NO: 62745 - RNA, 18 nt, Artificial Sequence
  Description of Artificial Sequence: Synthetic oligonucleotide
cccaaaugacuucaaucc

SEQ ID NO: 62746 - RNA, 18 nt, Artificial Sequence
  Description of Artificial Sequence: Synthetic oligonucleotide
uuuuccccaaaugacuuc

SEQ ID NO: 62747 - RNA, 18 nt, Artificial Sequence
  Description of Artificial Sequence: Synthetic oligonucleotide
cucaauuuuccccaaaug

SEQ ID NO: 62748 - RNA, 18 nt, Artificial Sequence
  Description of Artificial Sequence: Synthetic oligonucleotide
uccaccucaauuuucccc

SEQ ID NO: 62749 - RNA, 18 nt, Artificial Sequence
  Description of Artificial Sequence: Synthetic oligonucleotide
caaaauccaccucaauuu

SEQ ID NO: 62750 - RNA, 18 nt, Artificial Sequence
  Description of Artificial Sequence: Synthetic oligonucleotide
acauacaaaauccaccuc

SEQ ID NO: 62751 - RNA, 18 nt, Artificial Sequence
  Description of Artificial Sequence: Synthetic oligonucleotide
cccccacauacaaaaucc

SEQ ID NO: 62752 - RNA, 18 nt, Artificial Sequence
  Description of Artificial Sequence: Synthetic oligonucleotide
aguuucccccacauacaa

SEQ ID NO: 62753 - RNA, 18 nt, Artificial Sequence
  Description of Artificial Sequence: Synthetic oligonucleotide
gaggaaguuucccccaca

SEQ ID NO: 62754 - RNA, 18 nt, Artificial Sequence
  Description of Artificial Sequence: Synthetic oligonucleotide
acaaagaggaaguuuccc

SEQ ID NO: 62755 - RNA, 18 nt, Artificial Sequence
  Description of Artificial Sequence: Synthetic oligonucleotide
aacacacaaagaggaagu

SEQ ID NO: 62756 - RNA, 18 nt, Artificial Sequence
  Description of Artificial Sequence: Synthetic oligonucleotide
uauguaacacacaaagag

SEQ ID NO: 62757 - RNA, 18 nt, Artificial Sequence
  Description of Artificial Sequence: Synthetic oligonucleotide
aaaaauauguaacacaca

SEQ ID NO: 62758 - RNA, 18 nt, Artificial Sequence
  Description of Artificial Sequence: Synthetic oligonucleotide
ugaagaaaaauauguaac

SEQ ID NO: 62759 - RNA, 18 nt, Artificial Sequence
  Description of Artificial Sequence: Synthetic oligonucleotide
acucaaacagcugcaaug

SEQ ID NO: 62760 - RNA, 18 nt, Artificial Sequence
  Description of Artificial Sequence: Synthetic oligonucleotide
augggacucaaacagcug

SEQ ID NO: 62761 - RNA, 18 nt, Artificial Sequence
  Description of Artificial Sequence: Synthetic oligonucleotide
ccugcaugggacucaaac

SEQ ID NO: 62762 - RNA, 18 nt, Artificial Sequence
  Description of Artificial Sequence: Synthetic oligonucleotide
gaugcccugcaugggacu

SEQ ID NO: 62763 - RNA, 18 nt, Artificial Sequence
  Description of Artificial Sequence: Synthetic oligonucleotide
gccaagaugcccugcaug

SEQ ID NO: 62764 - RNA, 18 nt, Artificial Sequence
  Description of Artificial Sequence: Synthetic oligonucleotide
ugugggccaagaugcccu

SEQ ID NO: 62765 - RNA, 18 nt, Artificial Sequence
  Description of Artificial Sequence: Synthetic oligonucleotide
agagcugugggccaagau

SEQ ID NO: 62766 - RNA, 18 nt, Artificial Sequence
  Description of Artificial Sequence: Synthetic oligonucleotide
guugaagagcugugggcc

SEQ ID NO: 62767 - RNA, 18 nt, Artificial Sequence
  Description of Artificial Sequence: Synthetic oligonucleotide
aacuuguugaagagcugu

SEQ ID NO: 62768 - RNA, 18 nt, Artificial Sequence
  Description of Artificial Sequence: Synthetic oligonucleotide
gugcaaacuuguugaaga

SEQ ID NO: 62769 - RNA, 18 nt, Artificial Sequence
  Description of Artificial Sequence: Synthetic oligonucleotide
aggcagugcaaacuuguu

SEQ ID NO: 62770 - RNA, 18 nt, Artificial Sequence
  Description of Artificial Sequence: Synthetic oligonucleotide
auguaaggcagugcaaac

SEQ ID NO: 62771 - RNA, 18 nt, Artificial Sequence
  Description of Artificial Sequence: Synthetic oligonucleotide
cacggauguaaggcagug

SEQ ID NO: 62772 - RNA, 18 nt, Artificial Sequence
  Description of Artificial Sequence: Synthetic oligonucleotide
cacaucacggauguaagg

SEQ ID NO: 62773 - RNA, 18 nt, Artificial Sequence
  Description of Artificial Sequence: Synthetic oligonucleotide
uuggccacaucacggaug

SEQ ID NO: 62774 - RNA, 18 nt, Artificial Sequence
  Description of Artificial Sequence: Synthetic oligonucleotide
cuugcuuggccacaucac

SEQ ID NO: 62775 - RNA, 18 nt, Artificial Sequence
  Description of Artificial Sequence: Synthetic oligonucleotide
cuucacuugcuuggccac

SEQ ID NO: 62776 - RNA, 18 nt, Artificial Sequence
  Description of Artificial Sequence: Synthetic oligonucleotide
cuggccuucacuugcuug

SEQ ID NO: 62777 - RNA, 18 nt, Artificial Sequence
  Description of Artificial Sequence: Synthetic oligonucleotide
gcaaccuggccuucacuu

SEQ ID NO: 62778 - RNA, 18 nt, Artificial Sequence
  Description of Artificial Sequence: Synthetic oligonucleotide
cucccgcaaccuggccuu

SEQ ID NO: 62779 - RNA, 18 nt, Artificial Sequence
  Description of Artificial Sequence: Synthetic oligonucleotide
ccugccucccgcaaccug

SEQ ID NO: 62780 - RNA, 18 nt, Artificial Sequence
  Description of Artificial Sequence: Synthetic oligonucleotide
ccaggccugccucccgca

SEQ ID NO: 62781 - RNA, 18 nt, Artificial Sequence
  Description of Artificial Sequence: Synthetic oligonucleotide
uggugccaggccugccuc

SEQ ID NO: 62782 - RNA, 18 nt, Artificial Sequence
  Description of Artificial Sequence: Synthetic oligonucleotide
ggcacuggugccaggccu

SEQ ID NO: 62783 - RNA, 18 nt, Artificial Sequence
  Description of Artificial Sequence: Synthetic oligonucleotide
gacucaaacagcugcaau

SEQ ID NO: 62784 - RNA, 18 nt, Artificial Sequence
  Description of Artificial Sequence: Synthetic oligonucleotide
caugggacucaaacagcu

SEQ ID NO: 62785 - RNA, 18 nt, Artificial Sequence
  Description of Artificial Sequence: Synthetic oligonucleotide
cccugcaugggacucaaa

SEQ ID NO: 62786 - RNA, 18 nt, Artificial Sequence
  Description of Artificial Sequence: Synthetic oligonucleotide
agaugcccugcaugggac

SEQ ID NO: 62787 - RNA, 18 nt, Artificial Sequence
  Description of Artificial Sequence: Synthetic oligonucleotide
ggccaagaugcccugcau

SEQ ID NO: 62788 - RNA, 18 nt, Artificial Sequence
  Description of Artificial Sequence: Synthetic oligonucleotide
cugugggccaagaugccc

SEQ ID NO: 62789 - RNA, 18 nt, Artificial Sequence
  Description of Artificial Sequence: Synthetic oligonucleotide
aagagcugugggccaaga

SEQ ID NO: 62790 - RNA, 18 nt, Artificial Sequence
  Description of Artificial Sequence: Synthetic oligonucleotide
uguugaagagcugugggc

SEQ ID NO: 62791 - RNA, 18 nt, Artificial Sequence
  Description of Artificial Sequence: Synthetic oligonucleotide
aaacuuguugaagagcug

SEQ ID NO: 62792 - RNA, 18 nt, Artificial Sequence
  Description of Artificial Sequence: Synthetic oligonucleotide
agugcaaacuuguugaag

SEQ ID NO: 62793 - RNA, 18 nt, Artificial Sequence
  Description of Artificial Sequence: Synthetic oligonucleotide
aaggcagugcaaacuugu

SEQ ID NO: 62794 - RNA, 18 nt, Artificial Sequence
  Description of Artificial Sequence: Synthetic oligonucleotide
gauguaaggcagugcaaa

SEQ ID NO: 62795 - RNA, 18 nt, Artificial Sequence
  Description of Artificial Sequence: Synthetic oligonucleotide
ucacggauguaaggcagu

SEQ ID NO: 62796 - RNA, 18 nt, Artificial Sequence
  Description of Artificial Sequence: Synthetic oligonucleotide
ccacaucacggauguaag

SEQ ID NO: 62797 - RNA, 18 nt, Artificial Sequence
  Description of Artificial Sequence: Synthetic oligonucleotide
cuuggccacaucacggau

SEQ ID NO: 62798 - RNA, 18 nt, Artificial Sequence
  Description of Artificial Sequence: Synthetic oligonucleotide
acuugcuuggccacauca

SEQ ID NO: 62799 - RNA, 18 nt, Artificial Sequence
  Description of Artificial Sequence: Synthetic oligonucleotide
ccuucacuugcuuggcca

SEQ ID NO: 62800 - RNA, 18 nt, Artificial Sequence
  Description of Artificial Sequence: Synthetic oligonucleotide
ccuggccuucacuugcuu

SEQ ID NO: 62801 - RNA, 18 nt, Artificial Sequence
  Description of Artificial Sequence: Synthetic oligonucleotide
cgcaaccuggccuucacu

SEQ ID NO: 62802 - RNA, 18 nt, Artificial Sequence
  Description of Artificial Sequence: Synthetic oligonucleotide
ccucccgcaaccuggccu

SEQ ID NO: 62803 - RNA, 18 nt, Artificial Sequence
  Description of Artificial Sequence: Synthetic oligonucleotide
gccugccucccgcaaccu

SEQ ID NO: 62804 - RNA, 18 nt, Artificial Sequence
  Description of Artificial Sequence: Synthetic oligonucleotide
gccaggccugccucccgc

SEQ ID NO: 62805 - RNA, 18 nt, Artificial Sequence
  Description of Artificial Sequence: Synthetic oligonucleotide
cuggugccaggccugccu

SEQ ID NO: 62806 - RNA, 18 nt, Artificial Sequence
  Description of Artificial Sequence: Synthetic oligonucleotide
gggcacuggugccaggcc

SEQ ID NO: 62807 - RNA, 18 nt, Artificial Sequence
  Description of Artificial Sequence: Synthetic oligonucleotide
acucaacccaucccaauc

SEQ ID NO: 62808 - RNA, 18 nt, Artificial Sequence
  Description of Artificial Sequence: Synthetic oligonucleotide
ccuucacucaacccaucc

SEQ ID NO: 62809 - RNA, 18 nt, Artificial Sequence
  Description of Artificial Sequence: Synthetic oligonucleotide
gaccaccuucacucaacc

SEQ ID NO: 62810 - RNA, 18 nt, Artificial Sequence
  Description of Artificial Sequence: Synthetic oligonucleotide
cacaggaccaccuucacu

SEQ ID NO: 62811 - RNA, 18 nt, Artificial Sequence
  Description of Artificial Sequence: Synthetic oligonucleotide
agcuccacaggaccaccu

SEQ ID NO: 62812 - RNA, 18 nt, Artificial Sequence
  Description of Artificial Sequence: Synthetic oligonucleotide
cugaaagcuccacaggac

SEQ ID NO: 62813 - RNA, 18 nt, Artificial Sequence
  Description of Artificial Sequence: Synthetic oligonucleotide
uuagccugaaagcuccac

SEQ ID NO: 62814 - RNA, 18 nt, Artificial Sequence
  Description of Artificial Sequence: Synthetic oligonucleotide
aggacuuagccugaaagc

SEQ ID NO: 62815 - RNA, 18 nt, Artificial Sequence
  Description of Artificial Sequence: Synthetic oligonucleotide
caugcaggacuuagccug

SEQ ID NO: 62816 - RNA, 18 nt, Artificial Sequence
  Description of Artificial Sequence: Synthetic oligonucleotide
caguccaugcaggacuua

SEQ ID NO: 62817 - RNA, 18 nt, Artificial Sequence
  Description of Artificial Sequence: Synthetic oligonucleotide
cacuccaguccaugcagg

SEQ ID NO: 62818 - RNA, 18 nt, Artificial Sequence
  Description of Artificial Sequence: Synthetic oligonucleotide
guggucacuccaguccau

SEQ ID NO: 62819 - RNA, 18 nt, Artificial Sequence
  Description of Artificial Sequence: Synthetic oligonucleotide
cuccaguggucacuccag

SEQ ID NO: 62820 - RNA, 18 nt, Artificial Sequence
  Description of Artificial Sequence: Synthetic oligonucleotide
cugcccuccaguggucac

SEQ ID NO: 62821 - RNA, 18 nt, Artificial Sequence
  Description of Artificial Sequence: Synthetic oligonucleotide
uucugcugcccuccagug

SEQ ID NO: 62822 - RNA, 18 nt, Artificial Sequence
  Description of Artificial Sequence: Synthetic oligonucleotide
uguacuucugcugcccuc

SEQ ID NO: 62823 - RNA, 18 nt, Artificial Sequence
  Description of Artificial Sequence: Synthetic oligonucleotide
uugacuguacuucugcug

SEQ ID NO: 62824 - RNA, 18 nt, Artificial Sequence
  Description of Artificial Sequence: Synthetic oligonucleotide
cuuucuugacuguacuuc

SEQ ID NO: 62825 - RNA, 18 nt, Artificial Sequence
  Description of Artificial Sequence: Synthetic oligonucleotide
ccaguccaugcaggacuu

SEQ ID NO: 62826 - RNA, 18 nt, Artificial Sequence
  Description of Artificial Sequence: Synthetic oligonucleotide
ucacuccaguccaugcag

SEQ ID NO: 62827 - RNA, 18 nt, Artificial Sequence
  Description of Artificial Sequence: Synthetic oligonucleotide
aguggucacuccagucca

SEQ ID NO: 62828 - RNA, 18 nt, Artificial Sequence
  Description of Artificial Sequence: Synthetic oligonucleotide
ccuccaguggucacucca

SEQ ID NO: 62829 - RNA, 18 nt, Artificial Sequence
  Description of Artificial Sequence: Synthetic oligonucleotide
gcugcccuccagugguca

SEQ ID NO: 62830 - RNA, 18 nt, Artificial Sequence
  Description of Artificial Sequence: Synthetic oligonucleotide
cuucugcugcccuccagu

SEQ ID NO: 62831 - RNA, 18 nt, Artificial Sequence
  Description of Artificial Sequence: Synthetic oligonucleotide
cuguacuucugcugcccu

SEQ ID NO: 62832 - RNA, 18 nt, Artificial Sequence
  Description of Artificial Sequence: Synthetic oligonucleotide
cuugacuguacuucugcu

SEQ ID NO: 62833 - RNA, 18 nt, Artificial Sequence
  Description of Artificial Sequence: Synthetic oligonucleotide
ucuuucuugacuguacuu

SEQ ID NO: 62834 - RNA, 18 nt, Artificial Sequence
  Description of Artificial Sequence: Synthetic oligonucleotide
acuaaucuuucuugacug

SEQ ID NO: 62835 - RNA, 18 nt, Artificial Sequence
  Description of Artificial Sequence: Synthetic oligonucleotide
caaccacuaaucuuucuu

SEQ ID NO: 62836 - RNA, 18 nt, Artificial Sequence
  Description of Artificial Sequence: Synthetic oligonucleotide
ugcuacaaccacuaaucu

SEQ ID NO: 62837 - RNA, 18 nt, Artificial Sequence
  Description of Artificial Sequence: Synthetic oligonucleotide
ggccuugcuacaaccacu

SEQ ID NO: 62838 - RNA, 18 nt, Artificial Sequence
  Description of Artificial Sequence: Synthetic oligonucleotide
cagagggccuugcuacaa

SEQ ID NO: 62839 - RNA, 18 nt, Artificial Sequence
  Description of Artificial Sequence: Synthetic oligonucleotide
ggcuacagagggccuugc

SEQ ID NO: 62840 - RNA, 18 nt, Artificial Sequence
  Description of Artificial Sequence: Synthetic oligonucleotide
ucucaggcuacagagggc

SEQ ID NO: 62841 - RNA, 18 nt, Artificial Sequence
  Description of Artificial Sequence: Synthetic oligonucleotide
cauccuuagcaaagauga

SEQ ID NO: 62842 - RNA, 18 nt, Artificial Sequence
  Description of Artificial Sequence: Synthetic oligonucleotide
augcccauccuuagcaaa

SEQ ID NO: 62843 - RNA, 18 nt, Artificial Sequence
  Description of Artificial Sequence: Synthetic oligonucleotide
gcaaaaugcccauccuua

SEQ ID NO: 62844 - RNA, 18 nt, Artificial Sequence
  Description of Artificial Sequence: Synthetic oligonucleotide
ccagggcaaaaugcccau

SEQ ID NO: 62845 - RNA, 18 nt, Artificial Sequence
  Description of Artificial Sequence: Synthetic oligonucleotide
cuccuccagggcaaaaug

SEQ ID NO: 62846 - RNA, 18 nt, Artificial Sequence
  Description of Artificial Sequence: Synthetic oligonucleotide
gccagcuccuccagggca

SEQ ID NO: 62847 - RNA, 18 nt, Artificial Sequence
  Description of Artificial Sequence: Synthetic oligonucleotide
cuugggccagcuccucca

SEQ ID NO: 62848 - RNA, 18 nt, Artificial Sequence
  Description of Artificial Sequence: Synthetic oligonucleotide
gccagcuugggccagcuc

SEQ ID NO: 62849 - RNA, 18 nt, Artificial Sequence
  Description of Artificial Sequence: Synthetic oligonucleotide
ucauagccagcuugggcc

SEQ ID NO: 62850 - RNA, 18 nt, Artificial Sequence
  Description of Artificial Sequence: Synthetic oligonucleotide
ccaccucauagccagcuu

SEQ ID NO: 62851 - RNA, 18 nt, Artificial Sequence
  Description of Artificial Sequence: Synthetic oligonucleotide
cccaaccaccucauagcc

SEQ ID NO: 62852 - RNA, 18 nt, Artificial Sequence
  Description of Artificial Sequence: Synthetic oligonucleotide
ucaagcccaaccaccuca

SEQ ID NO: 62853 - RNA, 18 nt, Artificial Sequence
  Description of Artificial Sequence: Synthetic oligonucleotide
uccagucaagcccaacca

SEQ ID NO: 62854 - RNA, 18 nt, Artificial Sequence
  Description of Artificial Sequence: Synthetic oligonucleotide
cacuguccagucaagccc

SEQ ID NO: 62855 - RNA, 18 nt, Artificial Sequence
  Description of Artificial Sequence: Synthetic oligonucleotide
gggccacuguccagucaa

SEQ ID NO: 62856 - RNA, 18 nt, Artificial Sequence
  Description of Artificial Sequence: Synthetic oligonucleotide
gcagcccggguuucccua

SEQ ID NO: 62857 - RNA, 18 nt, Artificial Sequence
  Description of Artificial Sequence: Synthetic oligonucleotide
ccugggcagcccggguuu

SEQ ID NO: 62858 - RNA, 18 nt, Artificial Sequence
  Description of Artificial Sequence: Synthetic oligonucleotide
aaaguccugggcagcccg

SEQ ID NO: 62859 - RNA, 18 nt, Artificial Sequence
  Description of Artificial Sequence: Synthetic oligonucleotide
cugaaaaaguccugggca

SEQ ID NO: 62860 - RNA, 18 nt, Artificial Sequence
  Description of Artificial Sequence: Synthetic oligonucleotide
acgugcugaaaaaguccu

SEQ ID NO: 62861 - RNA, 18 nt, Artificial Sequence
  Description of Artificial Sequence: Synthetic oligonucleotide
gcgacacgugcugaaaaa

SEQ ID NO: 62862 - RNA, 18 nt, Artificial Sequence
  Description of Artificial Sequence: Synthetic oligonucleotide
ggagagcgacacgugcug

SEQ ID NO: 62863 - RNA, 18 nt, Artificial Sequence
  Description of Artificial Sequence: Synthetic oligonucleotide
ccucaggagagcgacacg

SEQ ID NO: 62864 - RNA, 18 nt, Artificial Sequence
  Description of Artificial Sequence: Synthetic oligonucleotide
gcaggccucaggagagcg

SEQ ID NO: 62865 - RNA, 18 nt, Artificial Sequence
  Description of Artificial Sequence: Synthetic oligonucleotide
ucacagcaggccucagga

SEQ ID NO: 62866 - RNA, 18 nt, Artificial Sequence
  Description of Artificial Sequence: Synthetic oligonucleotide
ucaguucacagcaggccu

SEQ ID NO: 62867 - RNA, 18 nt, Artificial Sequence
  Description of Artificial Sequence: Synthetic oligonucleotide
cagagucaguucacagca

SEQ ID NO: 62868 - RNA, 18 nt, Artificial Sequence
  Description of Artificial Sequence: Synthetic oligonucleotide
ucccucuuuuguggaccc

SEQ ID NO: 62869 - RNA, 18 nt, Artificial Sequence
  Description of Artificial Sequence: Synthetic oligonucleotide
aucuuucccucuuuugug

SEQ ID NO: 62870 - RNA, 18 nt, Artificial Sequence
  Description of Artificial Sequence: Synthetic oligonucleotide
cauaaaucuuucccucuu

SEQ ID NO: 62871 - RNA, 18 nt, Artificial Sequence
  Description of Artificial Sequence: Synthetic oligonucleotide
gaaggcauaaaucuuucc

SEQ ID NO: 62872 - RNA, 18 nt, Artificial Sequence
  Description of Artificial Sequence: Synthetic oligonucleotide
agacugaaggcauaaauc

SEQ ID NO: 62873 - RNA, 18 nt, Artificial Sequence
  Description of Artificial Sequence: Synthetic oligonucleotide
guggcagacugaaggcau

SEQ ID NO: 62874 - RNA, 18 nt, Artificial Sequence
  Description of Artificial Sequence: Synthetic oligonucleotide
gcuagguggcagacugaa

SEQ ID NO: 62875 - RNA, 18 nt, Artificial Sequence
  Description of Artificial Sequence: Synthetic oligonucleotide
agguugcuagguggcaga

SEQ ID NO: 62876 - RNA, 18 nt, Artificial Sequence
  Description of Artificial Sequence: Synthetic oligonucleotide
gagacagguugcuaggug

SEQ ID NO: 62877 - RNA, 18 nt, Artificial Sequence
  Description of Artificial Sequence: Synthetic oligonucleotide
aacaggagacagguugcu

SEQ ID NO: 62878 - RNA, 18 nt, Artificial Sequence
  Description of Artificial Sequence: Synthetic oligonucleotide
cuuucccucuuuugugga

SEQ ID NO: 62879 - RNA, 18 nt, Artificial Sequence
  Description of Artificial Sequence: Synthetic oligonucleotide
uaaaucuuucccucuuuu

SEQ ID NO: 62880 - RNA, 18 nt, Artificial Sequence
  Description of Artificial Sequence: Synthetic oligonucleotide
aggcauaaaucuuucccu

SEQ ID NO: 62881 - RNA, 18 nt, Artificial Sequence
  Description of Artificial Sequence: Synthetic oligonucleotide
acugaaggcauaaaucuu

SEQ ID NO: 62882 - RNA, 18 nt, Artificial Sequence
  Description of Artificial Sequence: Synthetic oligonucleotide
ggcagacugaaggcauaa

SEQ ID NO: 62883 - RNA, 18 nt, Artificial Sequence
  Description of Artificial Sequence: Synthetic oligonucleotide
uagguggcagacugaagg

SEQ ID NO: 62884 - RNA, 18 nt, Artificial Sequence
  Description of Artificial Sequence: Synthetic oligonucleotide
guugcuagguggcagacu

SEQ ID NO: 62885 - RNA, 18 nt, Artificial Sequence
  Description of Artificial Sequence: Synthetic oligonucleotide
gacagguugcuagguggc

SEQ ID NO: 62886 - RNA, 18 nt, Artificial Sequence
  Description of Artificial Sequence: Synthetic oligonucleotide
gagggaagcgacgcagug

SEQ ID NO: 62887 - RNA, 18 nt, Artificial Sequence
  Description of Artificial Sequence: Synthetic oligonucleotide
auccagagggaagcgacg

SEQ ID NO: 62888 - RNA, 18 nt, Artificial Sequence
  Description of Artificial Sequence: Synthetic oligonucleotide
gcagcauccagagggaag

SEQ ID NO: 62889 - RNA, 18 nt, Artificial Sequence
  Description of Artificial Sequence: Synthetic oligonucleotide
ugauggcagcauccagag

SEQ ID NO: 62890 - RNA, 18 nt, Artificial Sequence
  Description of Artificial Sequence: Synthetic oligonucleotide
gaaaaugauggcagcauc

SEQ ID NO: 62891 - RNA, 18 nt, Artificial Sequence
  Description of Artificial Sequence: Synthetic oligonucleotide
ucggagaaaaugauggca

SEQ ID NO: 62892 - RNA, 18 nt, Artificial Sequence
  Description of Artificial Sequence: Synthetic oligonucleotide
ggaugucggagaaaauga

SEQ ID NO: 62893 - RNA, 18 nt, Artificial Sequence
  Description of Artificial Sequence: Synthetic oligonucleotide
aacaaggaugucggagaa

SEQ ID NO: 62894 - RNA, 18 nt, Artificial Sequence
  Description of Artificial Sequence: Synthetic oligonucleotide
gguacaacaaggaugucg

SEQ ID NO: 62895 - RNA, 18 nt, Artificial Sequence
  Description of Artificial Sequence: Synthetic oligonucleotide
agagggaagcgacgcagu

SEQ ID NO: 62896 - RNA, 18 nt, Artificial Sequence
  Description of Artificial Sequence: Synthetic oligonucleotide
cauccagagggaagcgac

SEQ ID NO: 62897 - RNA, 18 nt, Artificial Sequence
  Description of Artificial Sequence: Synthetic oligonucleotide
ggcagcauccagagggaa

SEQ ID NO: 62898 - RNA, 18 nt, Artificial Sequence
  Description of Artificial Sequence: Synthetic oligonucleotide
augauggcagcauccaga

SEQ ID NO: 62899 - RNA, 18 nt, Artificial Sequence
  Description of Artificial Sequence: Synthetic oligonucleotide
agaaaaugauggcagcau

SEQ ID NO: 62900 - RNA, 18 nt, Artificial Sequence
  Description of Artificial Sequence: Synthetic oligonucleotide
gucggagaaaaugauggc

SEQ ID NO: 62901 - RNA, 18 nt, Artificial Sequence
  Description of Artificial Sequence: Synthetic oligonucleotide
aggaugucggagaaaaug

SEQ ID NO: 62902 - RNA, 18 nt, Artificial Sequence
  Description of Artificial Sequence: Synthetic oligonucleotide
caacaaggaugucggaga

SEQ ID NO: 62903 - RNA, 18 nt, Artificial Sequence
  Description of Artificial Sequence: Synthetic oligonucleotide
ggguacaacaaggauguc

SEQ ID NO: 62904 - RNA, 18 nt, Artificial Sequence
  Description of Artificial Sequence: Synthetic oligonucleotide
uaggaucagguuugagug

SEQ ID NO: 62905 - RNA, 18 nt, Artificial Sequence
  Description of Artificial Sequence: Synthetic oligonucleotide
uauucuaggaucagguuu

SEQ ID NO: 62906 - RNA, 18 nt, Artificial Sequence
  Description of Artificial Sequence: Synthetic oligonucleotide
gauuauauucuaggauca

SEQ ID NO: 62907 - RNA, 18 nt, Artificial Sequence
  Description of Artificial Sequence: Synthetic oligonucleotide
ccuuggauuauauucuag

SEQ ID NO: 62908 - RNA, 18 nt, Artificial Sequence
  Description of Artificial Sequence: Synthetic oligonucleotide
ggcguccuuggauuauau

SEQ ID NO: 62909 - RNA, 18 nt, Artificial Sequence
  Description of Artificial Sequence: Synthetic oligonucleotide
uucaaggcguccuuggau

SEQ ID NO: 62910 - RNA, 18 nt, Artificial Sequence
  Description of Artificial Sequence: Synthetic oligonucleotide
ggauuuucaaggcguccu

SEQ ID NO: 62911 - RNA, 18 nt, Artificial Sequence
  Description of Artificial Sequence: Synthetic oligonucleotide
uagaaggauuuucaaggc

SEQ ID NO: 62912 - RNA, 18 nt, Artificial Sequence
  Description of Artificial Sequence: Synthetic oligonucleotide
acugauagaaggauuuuc

SEQ ID NO: 62913 - RNA, 18 nt, Artificial Sequence
  Description of Artificial Sequence: Synthetic oligonucleotide
acuggacugauagaagga

SEQ ID NO: 62914 - RNA, 18 nt, Artificial Sequence
  Description of Artificial Sequence: Synthetic oligonucleotide
ccuugacuggacugauag

SEQ ID NO: 62915 - RNA, 18 nt, Artificial Sequence
  Description of Artificial Sequence: Synthetic oligonucleotide
guaaaccuugacuggacu

SEQ ID NO: 62916 - RNA, 18 nt, Artificial Sequence
  Description of Artificial Sequence: Synthetic oligonucleotide
uuauuguaaaccuugacu

SEQ ID NO: 62917 - RNA, 18 nt, Artificial Sequence
  Description of Artificial Sequence: Synthetic oligonucleotide
agugcuuauuguaaaccu

SEQ ID NO: 62918 - RNA, 18 nt, Artificial Sequence
  Description of Artificial Sequence: Synthetic oligonucleotide
ggauaagugcuuauugua

SEQ ID NO: 62919 - RNA, 18 nt, Artificial Sequence
  Description of Artificial Sequence: Synthetic oligonucleotide
aguuaggauaagugcuua

SEQ ID NO: 62920 - RNA, 18 nt, Artificial Sequence
  Description of Artificial Sequence: Synthetic oligonucleotide
gauccaguuaggauaagu

SEQ ID NO: 62921 - RNA, 18 nt, Artificial Sequence
  Description of Artificial Sequence: Synthetic oligonucleotide
cccucgauccaguuagga

SEQ ID NO: 62922 - RNA, 18 nt, Artificial Sequence
  Description of Artificial Sequence: Synthetic oligonucleotide
uuuuucccucgauccagu

SEQ ID NO: 62923 - RNA, 18 nt, Artificial Sequence
  Description of Artificial Sequence: Synthetic oligonucleotide
cuuaguuuuucccucgau

SEQ ID NO: 62924 - RNA, 18 nt, Artificial Sequence
  Description of Artificial Sequence: Synthetic oligonucleotide
ucaaccuuaguuuuuccc

SEQ ID NO: 62925 - RNA, 18 nt, Artificial Sequence
  Description of Artificial Sequence: Synthetic oligonucleotide
uucuuucaaccuuaguuu

SEQ ID NO: 62926 - RNA, 18 nt, Artificial Sequence
  Description of Artificial Sequence: Synthetic oligonucleotide
uccauuucuuucaaccuu

SEQ ID NO: 62927 - RNA, 18 nt, Artificial Sequence
  Description of Artificial Sequence: Synthetic oligonucleotide
caaacuccauuucuuuca

SEQ ID NO: 62928 - RNA, 18 nt, Artificial Sequence
  Description of Artificial Sequence: Synthetic oligonucleotide
ucugccaaacuccauuuc

SEQ ID NO: 62929 - RNA, 18 nt, Artificial Sequence
  Description of Artificial Sequence: Synthetic oligonucleotide
aaaacucugccaaacucc

SEQ ID NO: 62930 - RNA, 18 nt, Artificial Sequence
  Description of Artificial Sequence: Synthetic oligonucleotide
ucccucgauccaguuagg

SEQ ID NO: 62931 - RNA, 18 nt, Artificial Sequence
  Description of Artificial Sequence: Synthetic oligonucleotide
guuuuucccucgauccag

SEQ ID NO: 62932 - RNA, 18 nt, Artificial Sequence
  Description of Artificial Sequence: Synthetic oligonucleotide
ccuuaguuuuucccucga

SEQ ID NO: 62933 - RNA, 18 nt, Artificial Sequence
  Description of Artificial Sequence: Synthetic oligonucleotide
uucaaccuuaguuuuucc

SEQ ID NO: 62934 - RNA, 18 nt, Artificial Sequence
  Description of Artificial Sequence: Synthetic oligonucleotide
uuucuuucaaccuuaguu

SEQ ID NO: 62935 - RNA, 18 nt, Artificial Sequence
  Description of Artificial Sequence: Synthetic oligonucleotide
cuccauuucuuucaaccu

SEQ ID NO: 62936 - RNA, 18 nt, Artificial Sequence
  Description of Artificial Sequence: Synthetic oligonucleotide
ccaaacuccauuucuuuc

SEQ ID NO: 62937 - RNA, 18 nt, Artificial Sequence
  Description of Artificial Sequence: Synthetic oligonucleotide
cucugccaaacuccauuu

SEQ ID NO: 62938 - RNA, 18 nt, Artificial Sequence
  Description of Artificial Sequence: Synthetic oligonucleotide
uaaaacucugccaaacuc

SEQ ID NO: 62939 - RNA, 18 nt, Artificial Sequence
  Description of Artificial Sequence: Synthetic oligonucleotide
gagaauaaaacucugcca

SEQ ID NO: 62940 - RNA, 18 nt, Artificial Sequence
  Description of Artificial Sequence: Synthetic oligonucleotide
aaaaggagaauaaaacuc

SEQ ID NO: 62941 - RNA, 18 nt, Artificial Sequence
  Description of Artificial Sequence: Synthetic oligonucleotide
gaaggaaaaggagaauaa

SEQ ID NO: 62942 - RNA, 18 nt, Artificial Sequence
  Description of Artificial Sequence: Synthetic oligonucleotide
aggaggaaggaaaaggag

SEQ ID NO: 62943 - RNA, 18 nt, Artificial Sequence
  Description of Artificial Sequence: Synthetic oligonucleotide
auuccaggaggaaggaaa

SEQ ID NO: 62944 - RNA, 18 nt, Artificial Sequence
  Description of Artificial Sequence: Synthetic oligonucleotide
agcucauuccaggaggaa

SEQ ID NO: 62945 - RNA, 18 nt, Artificial Sequence
  Description of Artificial Sequence: Synthetic oligonucleotide
uguucagcucauuccagg

SEQ ID NO: 62946 - RNA, 18 nt, Artificial Sequence
  Description of Artificial Sequence: Synthetic oligonucleotide
gguucuguucagcucauu

SEQ ID NO: 62947 - RNA, 18 nt, Artificial Sequence
  Description of Artificial Sequence: Synthetic oligonucleotide
ggaaagguucuguucagc

SEQ ID NO: 62948 - RNA, 18 nt, Artificial Sequence
  Description of Artificial Sequence: Synthetic oligonucleotide
caggaggaaagguucugu

SEQ ID NO: 62949 - RNA, 18 nt, Artificial Sequence
  Description of Artificial Sequence: Synthetic oligonucleotide
gaauccaggaggaaaggu

SEQ ID NO: 62950 - RNA, 18 nt, Artificial Sequence
  Description of Artificial Sequence: Synthetic oligonucleotide
aaauggaauccaggagga

SEQ ID NO: 62951 - RNA, 18 nt, Artificial Sequence
  Description of Artificial Sequence: Synthetic oligonucleotide
ucccaaaauggaauccag

SEQ ID NO: 62952 - RNA, 18 nt, Artificial Sequence
  Description of Artificial Sequence: Synthetic oligonucleotide
uggguucccaaaauggaa

SEQ ID NO: 62953 - RNA, 18 nt, Artificial Sequence
  Description of Artificial Sequence: Synthetic oligonucleotide
acaucuggguucccaaaa

SEQ ID NO: 62954 - RNA, 18 nt, Artificial Sequence
  Description of Artificial Sequence: Synthetic oligonucleotide
ucaccuccaugcccagug

SEQ ID NO: 62955 - RNA, 18 nt, Artificial Sequence
  Description of Artificial Sequence: Synthetic oligonucleotide
cauggucaccuccaugcc

SEQ ID NO: 62956 - RNA, 18 nt, Artificial Sequence
  Description of Artificial Sequence: Synthetic oligonucleotide
gguaccauggucaccucc

SEQ ID NO: 62957 - RNA, 18 nt, Artificial Sequence
  Description of Artificial Sequence: Synthetic oligonucleotide
ugccagguaccaugguca

SEQ ID NO: 62958 - RNA, 18 nt, Artificial Sequence
  Description of Artificial Sequence: Synthetic oligonucleotide
uccuuugccagguaccau

SEQ ID NO: 62959 - RNA, 18 nt, Artificial Sequence
  Description of Artificial Sequence: Synthetic oligonucleotide
cuggguccuuugccaggu

SEQ ID NO: 62960 - RNA, 18 nt, Artificial Sequence
  Description of Artificial Sequence: Synthetic oligonucleotide
ggaagcuggguccuuugc

SEQ ID NO: 62961 - RNA, 18 nt, Artificial Sequence
  Description of Artificial Sequence: Synthetic oligonucleotide
cucugggaagcugggucc

SEQ ID NO: 62962 - RNA, 18 nt, Artificial Sequence
  Description of Artificial Sequence: Synthetic oligonucleotide
aauggcucugggaagcug

SEQ ID NO: 62963 - RNA, 18 nt, Artificial Sequence
  Description of Artificial Sequence: Synthetic oligonucleotide
cucuuaauggcucuggga

SEQ ID NO: 62964 - RNA, 18 nt, Artificial Sequence
  Description of Artificial Sequence: Synthetic oligonucleotide
cucuucucuuaauggcuc

SEQ ID NO: 62965 - RNA, 18 nt, Artificial Sequence
  Description of Artificial Sequence: Synthetic oligonucleotide
uccugcucuucucuuaau

SEQ ID NO: 62966 - RNA, 18 nt, Artificial Sequence
  Description of Artificial Sequence: Synthetic oligonucleotide
cuagguccugcucuucuc

SEQ ID NO: 62967 - RNA, 18 nt, Artificial Sequence
  Description of Artificial Sequence: Synthetic oligonucleotide
gcguucuagguccugcuc

SEQ ID NO: 62968 - RNA, 18 nt, Artificial Sequence
  Description of Artificial Sequence: Synthetic oligonucleotide
cguaggcguucuaggucc

SEQ ID NO: 62969 - RNA, 18 nt, Artificial Sequence
  Description of Artificial Sequence: Synthetic oligonucleotide
gaucccguaggcguucua

SEQ ID NO: 62970 - RNA, 18 nt, Artificial Sequence
  Description of Artificial Sequence: Synthetic oligonucleotide
uucuggaucccguaggcg

SEQ ID NO: 62971 - RNA, 18 nt, Artificial Sequence
  Description of Artificial Sequence: Synthetic oligonucleotide
accacuucuggaucccgu

SEQ ID NO: 62972 - RNA, 18 nt, Artificial Sequence
  Description of Artificial Sequence: Synthetic oligonucleotide
aggcuaccacuucuggau

SEQ ID NO: 62973 - RNA, 18 nt, Artificial Sequence
  Description of Artificial Sequence: Synthetic oligonucleotide
cucagaggcuaccacuuc

SEQ ID NO: 62974 - RNA, 18 nt, Artificial Sequence
  Description of Artificial Sequence: Synthetic oligonucleotide
ccuagcucagaggcuacc

SEQ ID NO: 62975 - RNA, 18 nt, Artificial Sequence
  Description of Artificial Sequence: Synthetic oligonucleotide
cauagccuagcucagagg

SEQ ID NO: 62976 - RNA, 18 nt, Artificial Sequence
  Description of Artificial Sequence: Synthetic oligonucleotide
gaacacauagccuagcuc

SEQ ID NO: 62977 - RNA, 18 nt, Artificial Sequence
  Description of Artificial Sequence: Synthetic oligonucleotide
gcuuggaacacauagccu

SEQ ID NO: 62978 - RNA, 18 nt, Artificial Sequence
  Description of Artificial Sequence: Synthetic oligonucleotide
ugauggcuuggaacacau

SEQ ID NO: 62979 - RNA, 18 nt, Artificial Sequence
  Description of Artificial Sequence: Synthetic oligonucleotide
aagggugauggcuuggaa

SEQ ID NO: 62980 - RNA, 18 nt, Artificial Sequence
  Description of Artificial Sequence: Synthetic oligonucleotide
cggguaagggugauggcu

SEQ ID NO: 62981 - RNA, 18 nt, Artificial Sequence
  Description of Artificial Sequence: Synthetic oligonucleotide
guugucggguaaggguga

SEQ ID NO: 62982 - RNA, 18 nt, Artificial Sequence
  Description of Artificial Sequence: Synthetic oligonucleotide
cagucguugucggguaag

SEQ ID NO: 62983 - RNA, 18 nt, Artificial Sequence
  Description of Artificial Sequence: Synthetic oligonucleotide
ccagccagucguugucgg

SEQ ID NO: 62984 - RNA, 18 nt, Artificial Sequence
  Description of Artificial Sequence: Synthetic oligonucleotide
cacguccagccagucguu

SEQ ID NO: 62985 - RNA, 18 nt, Artificial Sequence
  Description of Artificial Sequence: Synthetic oligonucleotide
cggcacacguccagccag

SEQ ID NO: 62986 - RNA, 18 nt, Artificial Sequence
  Description of Artificial Sequence: Synthetic oligonucleotide
aucagcggcacacgucca

SEQ ID NO: 62987 - RNA, 18 nt, Artificial Sequence
  Description of Artificial Sequence: Synthetic oligonucleotide
agccaaucagcggcacac

SEQ ID NO: 62988 - RNA, 18 nt, Artificial Sequence
  Description of Artificial Sequence: Synthetic oligonucleotide
agcaaagccaaucagcgg

SEQ ID NO: 62989 - RNA, 18 nt, Artificial Sequence
  Description of Artificial Sequence: Synthetic oligonucleotide
gcaccagcaaagccaauc

SEQ ID NO: 62990 - RNA, 18 nt, Artificial Sequence
  Description of Artificial Sequence: Synthetic oligonucleotide
gucaccuccaugcccagu

SEQ ID NO: 62991 - RNA, 18 nt, Artificial Sequence
  Description of Artificial Sequence: Synthetic oligonucleotide
ccauggucaccuccaugc

SEQ ID NO: 62992 - RNA, 18 nt, Artificial Sequence
  Description of Artificial Sequence: Synthetic oligonucleotide
agguaccauggucaccuc

SEQ ID NO: 62993 - RNA, 18 nt, Artificial Sequence
  Description of Artificial Sequence: Synthetic oligonucleotide
uugccagguaccaugguc

SEQ ID NO: 62994 - RNA, 18 nt, Artificial Sequence
  Description of Artificial Sequence: Synthetic oligonucleotide
guccuuugccagguacca

SEQ ID NO: 62995 - RNA, 18 nt, Artificial Sequence
  Description of Artificial Sequence: Synthetic oligonucleotide
gcuggguccuuugccagg

SEQ ID NO: 62996 - RNA, 18 nt, Artificial Sequence
  Description of Artificial Sequence: Synthetic oligonucleotide
gggaagcuggguccuuug

SEQ ID NO: 62997 - RNA, 18 nt, Artificial Sequence
  Description of Artificial Sequence: Synthetic oligonucleotide
gcucugggaagcuggguc

SEQ ID NO: 62998 - RNA, 18 nt, Artificial Sequence
  Description of Artificial Sequence: Synthetic oligonucleotide
uaauggcucugggaagcu

SEQ ID NO: 62999 - RNA, 18 nt, Artificial Sequence
  Description of Artificial Sequence: Synthetic oligonucleotide
ucucuuaauggcucuggg

SEQ ID NO: 63000 - RNA, 18 nt, Artificial Sequence
  Description of Artificial Sequence: Synthetic oligonucleotide
gcucuucucuuaauggcu

SEQ ID NO: 63001 - RNA, 18 nt, Artificial Sequence
  Description of Artificial Sequence: Synthetic oligonucleotide
guccugcucuucucuuaa

SEQ ID NO: 63002 - RNA, 18 nt, Artificial Sequence
  Description of Artificial Sequence: Synthetic oligonucleotide
ucuagguccugcucuucu

SEQ ID NO: 63003 - RNA, 18 nt, Artificial Sequence
  Description of Artificial Sequence: Synthetic oligonucleotide
ggcguucuagguccugcu

SEQ ID NO: 63004 - RNA, 18 nt, Artificial Sequence
  Description of Artificial Sequence: Synthetic oligonucleotide
ccguaggcguucuagguc

SEQ ID NO: 63005 - RNA, 18 nt, Artificial Sequence
  Description of Artificial Sequence: Synthetic oligonucleotide
ggaucccguaggcguucu

SEQ ID NO: 63006 - RNA, 18 nt, Artificial Sequence
  Description of Artificial Sequence: Synthetic oligonucleotide
cuucuggaucccguaggc

SEQ ID NO: 63007 - RNA, 18 nt, Artificial Sequence
  Description of Artificial Sequence: Synthetic oligonucleotide
uaccacuucuggaucccg

SEQ ID NO: 63008 - RNA, 18 nt, Artificial Sequence
  Description of Artificial Sequence: Synthetic oligonucleotide
gaggcuaccacuucugga

SEQ ID NO: 63009 - RNA, 18 nt, Artificial Sequence
  Description of Artificial Sequence: Synthetic oligonucleotide
gcucagaggcuaccacuu

SEQ ID NO: 63010 - RNA, 18 nt, Artificial Sequence
  Description of Artificial Sequence: Synthetic oligonucleotide
gccuagcucagaggcuac

SEQ ID NO: 63011 - RNA, 18 nt, Artificial Sequence
  Description of Artificial Sequence: Synthetic oligonucleotide
acauagccuagcucagag

SEQ ID NO: 63012 - RNA, 18 nt, Artificial Sequence
  Description of Artificial Sequence: Synthetic oligonucleotide
ggaacacauagccuagcu

SEQ ID NO: 63013 - RNA, 18 nt, Artificial Sequence
  Description of Artificial Sequence: Synthetic oligonucleotide
ggcuuggaacacauagcc

SEQ ID NO: 63014 - RNA, 18 nt, Artificial Sequence
  Description of Artificial Sequence: Synthetic oligonucleotide
gugauggcuuggaacaca

SEQ ID NO: 63015 - RNA, 18 nt, Artificial Sequence
  Description of Artificial Sequence: Synthetic oligonucleotide
uaagggugauggcuugga

SEQ ID NO: 63016 - RNA, 18 nt, Artificial Sequence
  Description of Artificial Sequence: Synthetic oligonucleotide
ucggguaagggugauggc

SEQ ID NO: 63017 - RNA, 18 nt, Artificial Sequence
  Description of Artificial Sequence: Synthetic oligonucleotide
cguugucggguaagggug

SEQ ID NO: 63018 - RNA, 18 nt, Artificial Sequence
  Description of Artificial Sequence: Synthetic oligonucleotide
ccagucguugucggguaa

SEQ ID NO: 63019 - RNA, 18 nt, Artificial Sequence
  Description of Artificial Sequence: Synthetic oligonucleotide
uccagccagucguugucg

SEQ ID NO: 63020 - RNA, 18 nt, Artificial Sequence
  Description of Artificial Sequence: Synthetic oligonucleotide
acacguccagccagucgu

SEQ ID NO: 63021 - RNA, 18 nt, Artificial Sequence
  Description of Artificial Sequence: Synthetic oligonucleotide
gcggcacacguccagcca

SEQ ID NO: 63022 - RNA, 18 nt, Artificial Sequence
  Description of Artificial Sequence: Synthetic oligonucleotide
aaucagcggcacacgucc

SEQ ID NO: 63023 - RNA, 18 nt, Artificial Sequence
  Description of Artificial Sequence: Synthetic oligonucleotide
aagccaaucagcggcaca

SEQ ID NO: 63024 - RNA, 18 nt, Artificial Sequence
  Description of Artificial Sequence: Synthetic oligonucleotide
cagcaaagccaaucagcg

SEQ ID NO: 63025 - RNA, 18 nt, Artificial Sequence
  Description of Artificial Sequence: Synthetic oligonucleotide
ggcaccagcaaagccaau

SEQ ID NO: 63026 - RNA, 18 nt, Artificial Sequence
  Description of Artificial Sequence: Synthetic oligonucleotide
gucccugcccugucccac

SEQ ID NO: 63027 - RNA, 18 nt, Artificial Sequence
  Description of Artificial Sequence: Synthetic oligonucleotide
cccgagucccugcccugu

SEQ ID NO: 63028 - RNA, 18 nt, Artificial Sequence
  Description of Artificial Sequence: Synthetic oligonucleotide
cgcgccccgagucccugc

SEQ ID NO: 63029 - RNA, 18 nt, Artificial Sequence
  Description of Artificial Sequence: Synthetic oligonucleotide
cuccccgcgccccgaguc

SEQ ID NO: 63030 - RNA, 18 nt, Artificial Sequence
  Description of Artificial Sequence: Synthetic oligonucleotide
gugaucuccccgcgcccc

SEQ ID NO: 63031 - RNA, 18 nt, Artificial Sequence
  Description of Artificial Sequence: Synthetic oligonucleotide
ccagagugaucuccccgc

SEQ ID NO: 63032 - RNA, 18 nt, Artificial Sequence
  Description of Artificial Sequence: Synthetic oligonucleotide
accuuccagagugaucuc

SEQ ID NO: 63033 - RNA, 18 nt, Artificial Sequence
  Description of Artificial Sequence: Synthetic oligonucleotide
cccagaccuuccagagug

SEQ ID NO: 63034 - RNA, 18 nt, Artificial Sequence
  Description of Artificial Sequence: Synthetic oligonucleotide
ucuaccccagaccuucca

SEQ ID NO: 63035 - RNA, 18 nt, Artificial Sequence
  Description of Artificial Sequence: Synthetic oligonucleotide
uuuugucuaccccagacc

SEQ ID NO: 63036 - RNA, 18 nt, Artificial Sequence
  Description of Artificial Sequence: Synthetic oligonucleotide
cuuccuuuugucuacccc

SEQ ID NO: 63037 - RNA, 18 nt, Artificial Sequence
  Description of Artificial Sequence: Synthetic oligonucleotide
ugacccuuccuuuugucu

SEQ ID NO: 63038 - RNA, 18 nt, Artificial Sequence
  Description of Artificial Sequence: Synthetic oligonucleotide
cagacugacccuuccuuu

SEQ ID NO: 63039 - RNA, 18 nt, Artificial Sequence
  Description of Artificial Sequence: Synthetic oligonucleotide
gaagccagacugacccuu

SEQ ID NO: 63040 - RNA, 18 nt, Artificial Sequence
  Description of Artificial Sequence: Synthetic oligonucleotide
cagagugaucuccccgcg

SEQ ID NO: 63041 - RNA, 18 nt, Artificial Sequence
  Description of Artificial Sequence: Synthetic oligonucleotide
ccuuccagagugaucucc

SEQ ID NO: 63042 - RNA, 18 nt, Artificial Sequence
  Description of Artificial Sequence: Synthetic oligonucleotide
ccagaccuuccagaguga

SEQ ID NO: 63043 - RNA, 18 nt, Artificial Sequence
  Description of Artificial Sequence: Synthetic oligonucleotide
cuaccccagaccuuccag

SEQ ID NO: 63044 - RNA, 18 nt, Artificial Sequence
  Description of Artificial Sequence: Synthetic oligonucleotide
uuugucuaccccagaccu

SEQ ID NO: 63045 - RNA, 18 nt, Artificial Sequence
  Description of Artificial Sequence: Synthetic oligonucleotide
uuccuuuugucuacccca

SEQ ID NO: 63046 - RNA, 18 nt, Artificial Sequence
  Description of Artificial Sequence: Synthetic oligonucleotide
gacccuuccuuuugucua

SEQ ID NO: 63047 - RNA, 18 nt, Artificial Sequence
  Description of Artificial Sequence: Synthetic oligonucleotide
agacugacccuuccuuuu

SEQ ID NO: 63048 - RNA, 18 nt, Artificial Sequence
  Description of Artificial Sequence: Synthetic oligonucleotide
aagccagacugacccuuc

SEQ ID NO: 63049 - RNA, 18 nt, Artificial Sequence
  Description of Artificial Sequence: Synthetic oligonucleotide
cacagaagccagacugac

SEQ ID NO: 63050 - RNA, 18 nt, Artificial Sequence
  Description of Artificial Sequence: Synthetic oligonucleotide
ggugucacagaagccaga

SEQ ID NO: 63051 - RNA, 18 nt, Artificial Sequence
  Description of Artificial Sequence: Synthetic oligonucleotide
aagauggugucacagaag

SEQ ID NO: 63052 - RNA, 18 nt, Artificial Sequence
  Description of Artificial Sequence: Synthetic oligonucleotide
uguaugucaucagggucc

SEQ ID NO: 63053 - RNA, 18 nt, Artificial Sequence
  Description of Artificial Sequence: Synthetic oligonucleotide
aaccauguaugucaucag

SEQ ID NO: 63054 - RNA, 18 nt, Artificial Sequence
  Description of Artificial Sequence: Synthetic oligonucleotide
cccucaaccauguauguc

SEQ ID NO: 63055 - RNA, 18 nt, Artificial Sequence
  Description of Artificial Sequence: Synthetic oligonucleotide
caccacccucaaccaugu

SEQ ID NO: 63056 - RNA, 18 nt, Artificial Sequence
  Description of Artificial Sequence: Synthetic oligonucleotide
ugagccaccacccucaac

SEQ ID NO: 63057 - RNA, 18 nt, Artificial Sequence
  Description of Artificial Sequence: Synthetic oligonucleotide
gugcuugagccaccaccc

SEQ ID NO: 63058 - RNA, 18 nt, Artificial Sequence
  Description of Artificial Sequence: Synthetic oligonucleotide
ccauggugcuugagccac

SEQ ID NO: 63059 - RNA, 18 nt, Artificial Sequence
  Description of Artificial Sequence: Synthetic oligonucleotide
cugagccauggugcuuga

SEQ ID NO: 63060 - RNA, 18 nt, Artificial Sequence
  Description of Artificial Sequence: Synthetic oligonucleotide
uuggccugagccauggug

SEQ ID NO: 63061 - RNA, 18 nt, Artificial Sequence
  Description of Artificial Sequence: Synthetic oligonucleotide
agcgcuuggccugagcca

SEQ ID NO: 63062 - RNA, 18 nt, Artificial Sequence
  Description of Artificial Sequence: Synthetic oligonucleotide
gagccagcgcuuggccug

SEQ ID NO: 63063 - RNA, 18 nt, Artificial Sequence
  Description of Artificial Sequence: Synthetic oligonucleotide
ugauagagccagcgcuug

SEQ ID NO: 63064 - RNA, 18 nt, Artificial Sequence
  Description of Artificial Sequence: Synthetic oligonucleotide
gucucugauagagccagc

SEQ ID NO: 63065 - RNA, 18 nt, Artificial Sequence
  Description of Artificial Sequence: Synthetic oligonucleotide
cugaggucucugauagag

SEQ ID NO: 63066 - RNA, 18 nt, Artificial Sequence
  Description of Artificial Sequence: Synthetic oligonucleotide
cuagccugaggucucuga

SEQ ID NO: 63067 - RNA, 18 nt, Artificial Sequence
  Description of Artificial Sequence: Synthetic oligonucleotide
ggugacuagccugagguc

SEQ ID NO: 63068 - RNA, 18 nt, Artificial Sequence
  Description of Artificial Sequence: Synthetic oligonucleotide
cagcuggugacuagccug

SEQ ID NO: 63069 - RNA, 18 nt, Artificial Sequence
  Description of Artificial Sequence: Synthetic oligonucleotide
cgaagcagcuggugacua

SEQ ID NO: 63070 - RNA, 18 nt, Artificial Sequence
  Description of Artificial Sequence: Synthetic oligonucleotide
ggaugcgaagcagcuggu

SEQ ID NO: 63071 - RNA, 18 nt, Artificial Sequence
  Description of Artificial Sequence: Synthetic oligonucleotide
agugaggaugcgaagcag

SEQ ID NO: 63072 - RNA, 18 nt, Artificial Sequence
  Description of Artificial Sequence: Synthetic oligonucleotide
gcaucagugaggaugcga

SEQ ID NO: 63073 - RNA, 18 nt, Artificial Sequence
  Description of Artificial Sequence: Synthetic oligonucleotide
ccagagcaucagugagga

SEQ ID NO: 63074 - RNA, 18 nt, Artificial Sequence
  Description of Artificial Sequence: Synthetic oligonucleotide
ugggaccagagcaucagu

SEQ ID NO: 63075 - RNA, 18 nt, Artificial Sequence
  Description of Artificial Sequence: Synthetic oligonucleotide
agauaugggaccagagca

SEQ ID NO: 63076 - RNA, 18 nt, Artificial Sequence
  Description of Artificial Sequence: Synthetic oligonucleotide
cuaccagauaugggacca

SEQ ID NO: 63077 - RNA, 18 nt, Artificial Sequence
  Description of Artificial Sequence: Synthetic oligonucleotide
uuguccuaccagauaugg

SEQ ID NO: 63078 - RNA, 18 nt, Artificial Sequence
  Description of Artificial Sequence: Synthetic oligonucleotide
accacuuguccuaccaga

SEQ ID NO: 63079 - RNA, 18 nt, Artificial Sequence
  Description of Artificial Sequence: Synthetic oligonucleotide
cagccaccacuuguccua

SEQ ID NO: 63080 - RNA, 18 nt, Artificial Sequence
  Description of Artificial Sequence: Synthetic oligonucleotide
ggcaccagccaccacuug

SEQ ID NO: 63081 - RNA, 18 nt, Artificial Sequence
  Description of Artificial Sequence: Synthetic oligonucleotide
uguaugucaucagggucc

SEQ ID NO: 63082 - RNA, 18 nt, Artificial Sequence
  Description of Artificial Sequence: Synthetic oligonucleotide
aaccauguaugucaucag

SEQ ID NO: 63083 - RNA, 18 nt, Artificial Sequence
  Description of Artificial Sequence: Synthetic oligonucleotide
cccucaaccauguauguc

SEQ ID NO: 63084 - RNA, 18 nt, Artificial Sequence
  Description of Artificial Sequence: Synthetic oligonucleotide
caccacccucaaccaugu

SEQ ID NO: 63085 - RNA, 18 nt, Artificial Sequence
  Description of Artificial Sequence: Synthetic oligonucleotide
ugagccaccacccucaac

SEQ ID NO: 63086 - RNA, 18 nt, Artificial Sequence
  Description of Artificial Sequence: Synthetic oligonucleotide
gugcuugagccaccaccc

SEQ ID NO: 63087 - RNA, 18 nt, Artificial Sequence
  Description of Artificial Sequence: Synthetic oligonucleotide
ccauggugcuugagccac

SEQ ID NO: 63088 - RNA, 18 nt, Artificial Sequence
  Description of Artificial Sequence: Synthetic oligonucleotide
cugagccauggugcuuga

SEQ ID NO: 63089 - RNA, 18 nt, Artificial Sequence
  Description of Artificial Sequence: Synthetic oligonucleotide
uuggccugagccauggug

SEQ ID NO: 63090 - RNA, 18 nt, Artificial Sequence
  Description of Artificial Sequence: Synthetic oligonucleotide
agcgcuuggccugagcca

SEQ ID NO: 63091 - RNA, 18 nt, Artificial Sequence
  Description of Artificial Sequence: Synthetic oligonucleotide
gagccagcgcuuggccug

SEQ ID NO: 63092 - RNA, 18 nt, Artificial Sequence
  Description of Artificial Sequence: Synthetic oligonucleotide
ugauagagccagcgcuug

SEQ ID NO: 63093 - RNA, 18 nt, Artificial Sequence
  Description of Artificial Sequence: Synthetic oligonucleotide
gucucugauagagccagc

SEQ ID NO: 63094 - RNA, 18 nt, Artificial Sequence
  Description of Artificial Sequence: Synthetic oligonucleotide
cugaggucucugauagag

SEQ ID NO: 63095 - RNA, 18 nt, Artificial Sequence
  Description of Artificial Sequence: Synthetic oligonucleotide
cuagccugaggucucuga

SEQ ID NO: 63096 - RNA, 18 nt, Artificial Sequence
  Description of Artificial Sequence: Synthetic oligonucleotide
ggugacuagccugagguc

SEQ ID NO: 63097 - RNA, 18 nt, Artificial Sequence
  Description of Artificial Sequence: Synthetic oligonucleotide
cagcuggugacuagccug

SEQ ID NO: 63098 - RNA, 18 nt, Artificial Sequence
  Description of Artificial Sequence: Synthetic oligonucleotide
cgaagcagcuggugacua

SEQ ID NO: 63099 - RNA, 18 nt, Artificial Sequence
  Description of Artificial Sequence: Synthetic oligonucleotide
ggaugcgaagcagcuggu

SEQ ID NO: 63100 - RNA, 18 nt, Artificial Sequence
  Description of Artificial Sequence: Synthetic oligonucleotide
agugaggaugcgaagcag

SEQ ID NO: 63101 - RNA, 18 nt, Artificial Sequence
  Description of Artificial Sequence: Synthetic oligonucleotide
gcaucagugaggaugcga

SEQ ID NO: 63102 - RNA, 18 nt, Artificial Sequence
  Description of Artificial Sequence: Synthetic oligonucleotide
ccagagcaucagugagga

SEQ ID NO: 63103 - RNA, 18 nt, Artificial Sequence
  Description of Artificial Sequence: Synthetic oligonucleotide
ugggaccagagcaucagu

SEQ ID NO: 63104 - RNA, 18 nt, Artificial Sequence
  Description of Artificial Sequence: Synthetic oligonucleotide
agauaugggaccagagca

SEQ ID NO: 63105 - RNA, 18 nt, Artificial Sequence
  Description of Artificial Sequence: Synthetic oligonucleotide
cuaccagauaugggacca

SEQ ID NO: 63106 - RNA, 18 nt, Artificial Sequence
  Description of Artificial Sequence: Synthetic oligonucleotide
uuguccuaccagauaugg

SEQ ID NO: 63107 - RNA, 18 nt, Artificial Sequence
  Description of Artificial Sequence: Synthetic oligonucleotide
accacuuguccuaccaga

SEQ ID NO: 63108 - RNA, 18 nt, Artificial Sequence
  Description of Artificial Sequence: Synthetic oligonucleotide
cagccaccacuuguccua

SEQ ID NO: 63109 - RNA, 18 nt, Artificial Sequence
  Description of Artificial Sequence: Synthetic oligonucleotide
ggcaccagccaccacuug

SEQ ID NO: 63110 - RNA, 18 nt, Artificial Sequence
  Description of Artificial Sequence: Synthetic oligonucleotide
uuucucucucucucagga

SEQ ID NO: 63111 - RNA, 18 nt, Artificial Sequence
  Description of Artificial Sequence: Synthetic oligonucleotide
gccuauuucucucucucu

SEQ ID NO: 63112 - RNA, 18 nt, Artificial Sequence
  Description of Artificial Sequence: Synthetic oligonucleotide
ucccagccuauuucucuc

SEQ ID NO: 63113 - RNA, 18 nt, Artificial Sequence
  Description of Artificial Sequence: Synthetic oligonucleotide
ccaaaucccagccuauuu

SEQ ID NO: 63114 - RNA, 18 nt, Artificial Sequence
  Description of Artificial Sequence: Synthetic oligonucleotide
acagaccaaaucccagcc

SEQ ID NO: 63115 - RNA, 18 nt, Artificial Sequence
  Description of Artificial Sequence: Synthetic oligonucleotide
uccuuacagaccaaaucc

SEQ ID NO: 63116 - RNA, 18 nt, Artificial Sequence
  Description of Artificial Sequence: Synthetic oligonucleotide
ucugguccuuacagacca

SEQ ID NO: 63117 - RNA, 18 nt, Artificial Sequence
  Description of Artificial Sequence: Synthetic oligonucleotide
uugcuucugguccuuaca

SEQ ID NO: 63118 - RNA, 18 nt, Artificial Sequence
  Description of Artificial Sequence: Synthetic oligonucleotide
cacucuugcuucuggucc

SEQ ID NO: 63119 - RNA, 18 nt, Artificial Sequence
  Description of Artificial Sequence: Synthetic oligonucleotide
uaggacacucuugcuucu

SEQ ID NO: 63120 - RNA, 18 nt, Artificial Sequence
  Description of Artificial Sequence: Synthetic oligonucleotide
agguuuaggacacucuug

SEQ ID NO: 63121 - RNA, 18 nt, Artificial Sequence
  Description of Artificial Sequence: Synthetic oligonucleotide
cucucagguuuaggacac

SEQ ID NO: 63122 - RNA, 18 nt, Artificial Sequence
  Description of Artificial Sequence: Synthetic oligonucleotide
cugcccucucagguuuag

SEQ ID NO: 63123 - RNA, 18 nt, Artificial Sequence
  Description of Artificial Sequence: Synthetic oligonucleotide
gaccccugcccucucagg

SEQ ID NO: 63124 - RNA, 18 nt, Artificial Sequence
  Description of Artificial Sequence: Synthetic oligonucleotide
auuaagaccccugcccuc

SEQ ID NO: 63125 - RNA, 18 nt, Artificial Sequence
  Description of Artificial Sequence: Synthetic oligonucleotide
cuggcauuaagaccccug

SEQ ID NO: 63126 - RNA, 18 nt, Artificial Sequence
  Description of Artificial Sequence: Synthetic oligonucleotide
caucccuggcauuaagac

SEQ ID NO: 63127 - RNA, 18 nt, Artificial Sequence
  Description of Artificial Sequence: Synthetic oligonucleotide
ucuuucaucccuggcauu

SEQ ID NO: 63128 - RNA, 18 nt, Artificial Sequence
  Description of Artificial Sequence: Synthetic oligonucleotide
aagguucuuucaucccug

SEQ ID NO: 63129 - RNA, 18 nt, Artificial Sequence
  Description of Artificial Sequence: Synthetic oligonucleotide
aggccaagguucuuucau

SEQ ID NO: 63130 - RNA, 18 nt, Artificial Sequence
  Description of Artificial Sequence: Synthetic oligonucleotide
acuggaggccaagguucu

SEQ ID NO: 63131 - RNA, 18 nt, Artificial Sequence
  Description of Artificial Sequence: Synthetic oligonucleotide
agaucacuggaggccaag

SEQ ID NO: 63132 - RNA, 18 nt, Artificial Sequence
  Description of Artificial Sequence: Synthetic oligonucleotide
ccgcuagaucacuggagg

SEQ ID NO: 63133 - RNA, 18 nt, Artificial Sequence
  Description of Artificial Sequence: Synthetic oligonucleotide
cugcuccgcuagaucacu

SEQ ID NO: 63134 - RNA, 18 nt, Artificial Sequence
  Description of Artificial Sequence: Synthetic oligonucleotide
cuuggcugcuccgcuaga

SEQ ID NO: 63135 - RNA, 18 nt, Artificial Sequence
  Description of Artificial Sequence: Synthetic oligonucleotide
augggcuuggcugcuccg

SEQ ID NO: 63136 - RNA, 18 nt, Artificial Sequence
  Description of Artificial Sequence: Synthetic oligonucleotide
ucaggaugggcuuggcug

SEQ ID NO: 63137 - RNA, 18 nt, Artificial Sequence
  Description of Artificial Sequence: Synthetic oligonucleotide
cagugucaggaugggcuu

SEQ ID NO: 63138 - RNA, 18 nt, Artificial Sequence
  Description of Artificial Sequence: Synthetic oligonucleotide
acugucagugucaggaug

SEQ ID NO: 63139 - RNA, 18 nt, Artificial Sequence
  Description of Artificial Sequence: Synthetic oligonucleotide
gccccacugucaguguca

SEQ ID NO: 63140 - RNA, 18 nt, Artificial Sequence
  Description of Artificial Sequence: Synthetic oligonucleotide
auuaagccccacugucag

SEQ ID NO: 63141 - RNA, 18 nt, Artificial Sequence
  Description of Artificial Sequence: Synthetic oligonucleotide
agagcauuaagccccacu

SEQ ID NO: 63142 - RNA, 18 nt, Artificial Sequence
  Description of Artificial Sequence: Synthetic oligonucleotide
uacuuagagcauuaagcc

SEQ ID NO: 63143 - RNA, 18 nt, Artificial Sequence
  Description of Artificial Sequence: Synthetic oligonucleotide
cugaauacuuagagcauu

SEQ ID NO: 63144 - RNA, 18 nt, Artificial Sequence
  Description of Artificial Sequence: Synthetic oligonucleotide
ggugucugaauacuuaga

SEQ ID NO: 63145 - RNA, 18 nt, Artificial Sequence
  Description of Artificial Sequence: Synthetic oligonucleotide
acuuuggugucugaauac

SEQ ID NO: 63146 - RNA, 18 nt, Artificial Sequence
  Description of Artificial Sequence: Synthetic oligonucleotide
cacuaacuuuggugucug

SEQ ID NO: 63147 - RNA, 18 nt, Artificial Sequence
  Description of Artificial Sequence: Synthetic oligonucleotide
cccagcacuaacuuuggu

SEQ ID NO: 63148 - RNA, 18 nt, Artificial Sequence
  Description of Artificial Sequence: Synthetic oligonucleotide
cagaucccagcacuaacu

SEQ ID NO: 63149 - RNA, 18 nt, Artificial Sequence
  Description of Artificial Sequence: Synthetic oligonucleotide
auuaagccccacugucag

SEQ ID NO: 63150 - RNA, 18 nt, Artificial Sequence
  Description of Artificial Sequence: Synthetic oligonucleotide
agagcauuaagccccacu

SEQ ID NO: 63151 - RNA, 18 nt, Artificial Sequence
  Description of Artificial Sequence: Synthetic oligonucleotide
uacuuagagcauuaagcc

SEQ ID NO: 63152 - RNA, 18 nt, Artificial Sequence
  Description of Artificial Sequence: Synthetic oligonucleotide
cugaauacuuagagcauu

SEQ ID NO: 63153 - RNA, 18 nt, Artificial Sequence
  Description of Artificial Sequence: Synthetic oligonucleotide
ggugucugaauacuuaga

SEQ ID NO: 63154 - RNA, 18 nt, Artificial Sequence
  Description of Artificial Sequence: Synthetic oligonucleotide
acuuuggugucugaauac

SEQ ID NO: 63155 - RNA, 18 nt, Artificial Sequence
  Description of Artificial Sequence: Synthetic oligonucleotide
cacuaacuuuggugucug

SEQ ID NO: 63156 - RNA, 18 nt, Artificial Sequence
  Description of Artificial Sequence: Synthetic oligonucleotide
cccagcacuaacuuuggu

SEQ ID NO: 63157 - RNA, 18 nt, Artificial Sequence
  Description of Artificial Sequence: Synthetic oligonucleotide
cagaucccagcacuaacu

SEQ ID NO: 63158 - RNA, 18 nt, Artificial Sequence
  Description of Artificial Sequence: Synthetic oligonucleotide
uuccucagaucccagcac

SEQ ID NO: 63159 - RNA, 18 nt, Artificial Sequence
  Description of Artificial Sequence: Synthetic oligonucleotide
uuacuuuccucagauccc

SEQ ID NO: 63160 - RNA, 18 nt, Artificial Sequence
  Description of Artificial Sequence: Synthetic oligonucleotide
aaaauuuacuuuccucag

SEQ ID NO: 63161 - RNA, 18 nt, Artificial Sequence
  Description of Artificial Sequence: Synthetic oligonucleotide
aaaaaaaaauuuacuuuc

SEQ ID NO: 63162 - RNA, 18 nt, Artificial Sequence
  Description of Artificial Sequence: Synthetic oligonucleotide
uaaaaaaaaaaaaauuua

SEQ ID NO: 63163 - RNA, 18 nt, Artificial Sequence
  Description of Artificial Sequence: Synthetic oligonucleotide
guaauuaaaaaaaaaaaa

SEQ ID NO: 63164 - RNA, 18 nt, Artificial Sequence
  Description of Artificial Sequence: Synthetic oligonucleotide
acccaguaauuaaaaaaa

SEQ ID NO: 63165 - RNA, 18 nt, Artificial Sequence
  Description of Artificial Sequence: Synthetic oligonucleotide
uaaaaacccaguaauuaa

SEQ ID NO: 63166 - RNA, 18 nt, Artificial Sequence
  Description of Artificial Sequence: Synthetic oligonucleotide
gacccuaaaaacccagua

SEQ ID NO: 63167 - RNA, 18 nt, Artificial Sequence
  Description of Artificial Sequence: Synthetic oligonucleotide
ugccugacccuaaaaacc

SEQ ID NO: 63168 - RNA, 18 nt, Artificial Sequence
  Description of Artificial Sequence: Synthetic oligonucleotide
gauacugccugacccuaa

SEQ ID NO: 63169 - RNA, 18 nt, Artificial Sequence
  Description of Artificial Sequence: Synthetic oligonucleotide
ucccugauacugccugac

SEQ ID NO: 63170 - RNA, 18 nt, Artificial Sequence
  Description of Artificial Sequence: Synthetic oligonucleotide
uucaaucccugauacugc

SEQ ID NO: 63171 - RNA, 18 nt, Artificial Sequence
  Description of Artificial Sequence: Synthetic oligonucleotide
augacuucaaucccugau

SEQ ID NO: 63172 - RNA, 18 nt, Artificial Sequence
  Description of Artificial Sequence: Synthetic oligonucleotide
cccaaaugacuucaaucc

SEQ ID NO: 63173 - RNA, 18 nt, Artificial Sequence
  Description of Artificial Sequence: Synthetic oligonucleotide
uuuuccccaaaugacuuc

SEQ ID NO: 63174 - RNA, 18 nt, Artificial Sequence
  Description of Artificial Sequence: Synthetic oligonucleotide
cucaauuuuccccaaaug

SEQ ID NO: 63175 - RNA, 18 nt, Artificial Sequence
  Description of Artificial Sequence: Synthetic oligonucleotide
uccaccucaauuuucccc

SEQ ID NO: 63176 - RNA, 18 nt, Artificial Sequence
  Description of Artificial Sequence: Synthetic oligonucleotide
caaaauccaccucaauuu

SEQ ID NO: 63177 - RNA, 18 nt, Artificial Sequence
  Description of Artificial Sequence: Synthetic oligonucleotide
acauacaaaauccaccuc

SEQ ID NO: 63178 - RNA, 18 nt, Artificial Sequence
  Description of Artificial Sequence: Synthetic oligonucleotide
cccccacauacaaaaucc

SEQ ID NO: 63179 - RNA, 18 nt, Artificial Sequence
  Description of Artificial Sequence: Synthetic oligonucleotide
aguuucccccacauacaa

SEQ ID NO: 63180 - RNA, 18 nt, Artificial Sequence
  Description of Artificial Sequence: Synthetic oligonucleotide
gaggaaguuucccccaca

SEQ ID NO: 63181 - RNA, 18 nt, Artificial Sequence
  Description of Artificial Sequence: Synthetic oligonucleotide
acaaagaggaaguuuccc

SEQ ID NO: 63182 - RNA, 18 nt, Artificial Sequence
  Description of Artificial Sequence: Synthetic oligonucleotide
aacacacaaagaggaagu

SEQ ID NO: 63183 - RNA, 18 nt, Artificial Sequence
  Description of Artificial Sequence: Synthetic oligonucleotide
uauguaacacacaaagag

SEQ ID NO: 63184 - RNA, 18 nt, Artificial Sequence
  Description of Artificial Sequence: Synthetic oligonucleotide
aaaaauauguaacacaca

SEQ ID NO: 63185 - RNA, 18 nt, Artificial Sequence
  Description of Artificial Sequence: Synthetic oligonucleotide
ugaagaaaaauauguaac

SEQ ID NO: 63186 - RNA, 18 nt, Artificial Sequence
  Description of Artificial Sequence: Synthetic oligonucleotide
acucaaacagcugcaaug

SEQ ID NO: 63187 - RNA, 18 nt, Artificial Sequence
  Description of Artificial Sequence: Synthetic oligonucleotide
augggacucaaacagcug

SEQ ID NO: 63188 - RNA, 18 nt, Artificial Sequence
  Description of Artificial Sequence: Synthetic oligonucleotide
ccugcaugggacucaaac

SEQ ID NO: 63189 - RNA, 18 nt, Artificial Sequence
  Description of Artificial Sequence: Synthetic oligonucleotide
gaugcccugcaugggacu

SEQ ID NO: 63190 - RNA, 18 nt, Artificial Sequence
  Description of Artificial Sequence: Synthetic oligonucleotide
gccaagaugcccugcaug

SEQ ID NO: 63191 - RNA, 18 nt, Artificial Sequence
  Description of Artificial Sequence: Synthetic oligonucleotide
ugugggccaagaugcccu

SEQ ID NO: 63192 - RNA, 18 nt, Artificial Sequence
  Description of Artificial Sequence: Synthetic oligonucleotide
agagcugugggccaagau

SEQ ID NO: 63193 - RNA, 18 nt, Artificial Sequence
  Description of Artificial Sequence: Synthetic oligonucleotide
guugaagagcugugggcc

SEQ ID NO: 63194 - RNA, 18 nt, Artificial Sequence
  Description of Artificial Sequence: Synthetic oligonucleotide
aacuuguugaagagcugu

SEQ ID NO: 63195 - RNA, 18 nt, Artificial Sequence
  Description of Artificial Sequence: Synthetic oligonucleotide
gugcaaacuuguugaaga

SEQ ID NO: 63196 - RNA, 18 nt, Artificial Sequence
  Description of Artificial Sequence: Synthetic oligonucleotide
aggcagugcaaacuuguu

SEQ ID NO: 63197 - RNA, 18 nt, Artificial Sequence
  Description of Artificial Sequence: Synthetic oligonucleotide
auguaaggcagugcaaac

SEQ ID NO: 63198 - RNA, 18 nt, Artificial Sequence
  Description of Artificial Sequence: Synthetic oligonucleotide
cacggauguaaggcagug

SEQ ID NO: 63199 - RNA, 18 nt, Artificial Sequence
  Description of Artificial Sequence: Synthetic oligonucleotide
cacaucacggauguaagg

SEQ ID NO: 63200 - RNA, 18 nt, Artificial Sequence
  Description of Artificial Sequence: Synthetic oligonucleotide
uuggccacaucacggaug

SEQ ID NO: 63201 - RNA, 18 nt, Artificial Sequence
  Description of Artificial Sequence: Synthetic oligonucleotide
cuugcuuggccacaucac

SEQ ID NO: 63202 - RNA, 18 nt, Artificial Sequence
  Description of Artificial Sequence: Synthetic oligonucleotide
cuucacuugcuuggccac

SEQ ID NO: 63203 - RNA, 18 nt, Artificial Sequence
  Description of Artificial Sequence: Synthetic oligonucleotide
cuggccuucacuugcuug

SEQ ID NO: 63204 - RNA, 18 nt, Artificial Sequence
  Description of Artificial Sequence: Synthetic oligonucleotide
gcaaccuggccuucacuu

SEQ ID NO: 63205 - RNA, 18 nt, Artificial Sequence
  Description of Artificial Sequence: Synthetic oligonucleotide
cucccgcaaccuggccuu

SEQ ID NO: 63206 - RNA, 18 nt, Artificial Sequence
  Description of Artificial Sequence: Synthetic oligonucleotide
ccugccucccgcaaccug

SEQ ID NO: 63207 - RNA, 18 nt, Artificial Sequence
  Description of Artificial Sequence: Synthetic oligonucleotide
ccaggccugccucccgca

SEQ ID NO: 63208 - RNA, 18 nt, Artificial Sequence
  Description of Artificial Sequence: Synthetic oligonucleotide
uggugccaggccugccuc

SEQ ID NO: 63209 - RNA, 18 nt, Artificial Sequence
  Description of Artificial Sequence: Synthetic oligonucleotide
ggcacuggugccaggccu

SEQ ID NO: 63210 - RNA, 18 nt, Artificial Sequence
  Description of Artificial Sequence: Synthetic oligonucleotide
gacucaaacagcugcaau

SEQ ID NO: 63211 - RNA, 18 nt, Artificial Sequence
  Description of Artificial Sequence: Synthetic oligonucleotide
caugggacucaaacagcu

SEQ ID NO: 63212 - RNA, 18 nt, Artificial Sequence
  Description of Artificial Sequence: Synthetic oligonucleotide
cccugcaugggacucaaa

SEQ ID NO: 63213 - RNA, 18 nt, Artificial Sequence
  Description of Artificial Sequence: Synthetic oligonucleotide
agaugcccugcaugggac

SEQ ID NO: 63214 - RNA, 18 nt, Artificial Sequence
  Description of Artificial Sequence: Synthetic oligonucleotide
ggccaagaugcccugcau

SEQ ID NO: 63215 - RNA, 18 nt, Artificial Sequence
  Description of Artificial Sequence: Synthetic oligonucleotide
cugugggccaagaugccc

SEQ ID NO: 63216 - RNA, 18 nt, Artificial Sequence
  Description of Artificial Sequence: Synthetic oligonucleotide
aagagcugugggccaaga

SEQ ID NO: 63217 - RNA, 18 nt, Artificial Sequence
  Description of Artificial Sequence: Synthetic oligonucleotide
uguugaagagcugugggc

SEQ ID NO: 63218 - RNA, 18 nt, Artificial Sequence
  Description of Artificial Sequence: Synthetic oligonucleotide
aaacuuguugaagagcug

SEQ ID NO: 63219 - RNA, 18 nt, Artificial Sequence
  Description of Artificial Sequence: Synthetic oligonucleotide
agugcaaacuuguugaag

SEQ ID NO: 63220 - RNA, 18 nt, Artificial Sequence
  Description of Artificial Sequence: Synthetic oligonucleotide
aaggcagugcaaacuugu

SEQ ID NO: 63221 - RNA, 18 nt, Artificial Sequence
  Description of Artificial Sequence: Synthetic oligonucleotide
gauguaaggcagugcaaa

SEQ ID NO: 63222 - RNA, 18 nt, Artificial Sequence
  Description of Artificial Sequence: Synthetic oligonucleotide
ucacggauguaaggcagu

SEQ ID NO: 63223 - RNA, 18 nt, Artificial Sequence
  Description of Artificial Sequence: Synthetic oligonucleotide
ccacaucacggauguaag

SEQ ID NO: 63224 - RNA, 18 nt, Artificial Sequence
  Description of Artificial Sequence: Synthetic oligonucleotide
cuuggccacaucacggau

SEQ ID NO: 63225 - RNA, 18 nt, Artificial Sequence
  Description of Artificial Sequence: Synthetic oligonucleotide
acuugcuuggccacauca

SEQ ID NO: 63226 - RNA, 18 nt, Artificial Sequence
  Description of Artificial Sequence: Synthetic oligonucleotide
ccuucacuugcuuggcca

SEQ ID NO: 63227 - RNA, 18 nt, Artificial Sequence
  Description of Artificial Sequence: Synthetic oligonucleotide
ccuggccuucacuugcuu

SEQ ID NO: 63228 - RNA, 18 nt, Artificial Sequence
  Description of Artificial Sequence: Synthetic oligonucleotide
cgcaaccuggccuucacu

SEQ ID NO: 63229 - RNA, 18 nt, Artificial Sequence
  Description of Artificial Sequence: Synthetic oligonucleotide
ccucccgcaaccuggccu

SEQ ID NO: 63230 - RNA, 18 nt, Artificial Sequence
  Description of Artificial Sequence: Synthetic oligonucleotide
gccugccucccgcaaccu

SEQ ID NO: 63231 - RNA, 18 nt, Artificial Sequence
  Description of Artificial Sequence: Synthetic oligonucleotide
gccaggccugccucccgc

SEQ ID NO: 63232 - RNA, 18 nt, Artificial Sequence
  Description of Artificial Sequence: Synthetic oligonucleotide
cuggugccaggccugccu

SEQ ID NO: 63233 - RNA, 18 nt, Artificial Sequence
  Description of Artificial Sequence: Synthetic oligonucleotide
gggcacuggugccaggcc

SEQ ID NO: 63234 - RNA, 18 nt, Artificial Sequence
  Description of Artificial Sequence: Synthetic oligonucleotide
acucaacccaucccaauc

SEQ ID NO: 63235 - RNA, 18 nt, Artificial Sequence
  Description of Artificial Sequence: Synthetic oligonucleotide
ccuucacucaacccaucc

SEQ ID NO: 63236 - RNA, 18 nt, Artificial Sequence
  Description of Artificial Sequence: Synthetic oligonucleotide
gaccaccuucacucaacc

SEQ ID NO: 63237 - RNA, 18 nt, Artificial Sequence
  Description of Artificial Sequence: Synthetic oligonucleotide
cacaggaccaccuucacu

SEQ ID NO: 63238 - RNA, 18 nt, Artificial Sequence
  Description of Artificial Sequence: Synthetic oligonucleotide
agcuccacaggaccaccu

SEQ ID NO: 63239 - RNA, 18 nt, Artificial Sequence
  Description of Artificial Sequence: Synthetic oligonucleotide
cugaaagcuccacaggac

SEQ ID NO: 63240 - RNA, 18 nt, Artificial Sequence
  Description of Artificial Sequence: Synthetic oligonucleotide
uuagccugaaagcuccac

SEQ ID NO: 63241 - RNA, 18 nt, Artificial Sequence
  Description of Artificial Sequence: Synthetic oligonucleotide
aggacuuagccugaaagc

SEQ ID NO: 63242 - RNA, 18 nt, Artificial Sequence
  Description of Artificial Sequence: Synthetic oligonucleotide
caugcaggacuuagccug

SEQ ID NO: 63243 - RNA, 18 nt, Artificial Sequence
  Description of Artificial Sequence: Synthetic oligonucleotide
caguccaugcaggacuua

SEQ ID NO: 63244 - RNA, 18 nt, Artificial Sequence
  Description of Artificial Sequence: Synthetic oligonucleotide
cacuccaguccaugcagg

SEQ ID NO: 63245 - RNA, 18 nt, Artificial Sequence
  Description of Artificial Sequence: Synthetic oligonucleotide
guggucacuccaguccau

SEQ ID NO: 63246 - RNA, 18 nt, Artificial Sequence
  Description of Artificial Sequence: Synthetic oligonucleotide
cuccaguggucacuccag

SEQ ID NO: 63247 - RNA, 18 nt, Artificial Sequence
  Description of Artificial Sequence: Synthetic oligonucleotide
cugcccuccaguggucac

SEQ ID NO: 63248 - RNA, 18 nt, Artificial Sequence
  Description of Artificial Sequence: Synthetic oligonucleotide
uucugcugcccuccagug

SEQ ID NO: 63249 - RNA, 18 nt, Artificial Sequence
  Description of Artificial Sequence: Synthetic oligonucleotide
uguacuucugcugcccuc

SEQ ID NO: 63250 - RNA, 18 nt, Artificial Sequence
  Description of Artificial Sequence: Synthetic oligonucleotide
uugacuguacuucugcug

SEQ ID NO: 63251 - RNA, 18 nt, Artificial Sequence
  Description of Artificial Sequence: Synthetic oligonucleotide
cuuucuugacuguacuuc

SEQ ID NO: 63252 - RNA, 18 nt, Artificial Sequence
  Description of Artificial Sequence: Synthetic oligonucleotide
ccaguccaugcaggacuu

SEQ ID NO: 63253 - RNA, 18 nt, Artificial Sequence
  Description of Artificial Sequence: Synthetic oligonucleotide
ucacuccaguccaugcag

SEQ ID NO: 63254 - RNA, 18 nt, Artificial Sequence
  Description of Artificial Sequence: Synthetic oligonucleotide
aguggucacuccagucca

SEQ ID NO: 63255 - RNA, 18 nt, Artificial Sequence
  Description of Artificial Sequence: Synthetic oligonucleotide
ccuccaguggucacucca

SEQ ID NO: 63256 - RNA, 18 nt, Artificial Sequence
  Description of Artificial Sequence: Synthetic oligonucleotide
gcugcccuccagugguca

SEQ ID NO: 63257 - RNA, 18 nt, Artificial Sequence
  Description of Artificial Sequence: Synthetic oligonucleotide
cuucugcugcccuccagu

SEQ ID NO: 63258 - RNA, 18 nt, Artificial Sequence
  Description of Artificial Sequence: Synthetic oligonucleotide
cuguacuucugcugcccu

SEQ ID NO: 63259 - RNA, 18 nt, Artificial Sequence
  Description of Artificial Sequence: Synthetic oligonucleotide
cuugacuguacuucugcu

SEQ ID NO: 63260 - RNA, 18 nt, Artificial Sequence
  Description of Artificial Sequence: Synthetic oligonucleotide
ucuuucuugacuguacuu

SEQ ID NO: 63261 - RNA, 18 nt, Artificial Sequence
  Description of Artificial Sequence: Synthetic oligonucleotide
acuaaucuuucuugacug

SEQ ID NO: 63262 - RNA, 18 nt, Artificial Sequence
  Description of Artificial Sequence: Synthetic oligonucleotide
caaccacuaaucuuucuu

SEQ ID NO: 63263 - RNA, 18 nt, Artificial Sequence
  Description of Artificial Sequence: Synthetic oligonucleotide
ugcuacaaccacuaaucu

SEQ ID NO: 63264 - RNA, 18 nt, Artificial Sequence
  Description of Artificial Sequence: Synthetic oligonucleotide
ggccuugcuacaaccacu

SEQ ID NO: 63265 - RNA, 18 nt, Artificial Sequence
  Description of Artificial Sequence: Synthetic oligonucleotide
cagagggccuugcuacaa

SEQ ID NO: 63266 - RNA, 18 nt, Artificial Sequence
  Description of Artificial Sequence: Synthetic oligonucleotide
ggcuacagagggccuugc

SEQ ID NO: 63267 - RNA, 18 nt, Artificial Sequence
  Description of Artificial Sequence: Synthetic oligonucleotide
ucucaggcuacagagggc

SEQ ID NO: 63268 - RNA, 18 nt, Artificial Sequence
  Description of Artificial Sequence: Synthetic oligonucleotide
cauccuuagcaaagauga

SEQ ID NO: 63269 - RNA, 18 nt, Artificial Sequence
  Description of Artificial Sequence: Synthetic oligonucleotide
augcccauccuuagcaaa

SEQ ID NO: 63270 - RNA, 18 nt, Artificial Sequence
  Description of Artificial Sequence: Synthetic oligonucleotide
gcaaaaugcccauccuua

SEQ ID NO: 63271 - RNA, 18 nt, Artificial Sequence
  Description of Artificial Sequence: Synthetic oligonucleotide
ccagggcaaaaugcccau

SEQ ID NO: 63272 - RNA, 18 nt, Artificial Sequence
  Description of Artificial Sequence: Synthetic oligonucleotide
cuccuccagggcaaaaug

SEQ ID NO: 63273 - RNA, 18 nt, Artificial Sequence
  Description of Artificial Sequence: Synthetic oligonucleotide
gccagcuccuccagggca

SEQ ID NO: 63274 - RNA, 18 nt, Artificial Sequence
  Description of Artificial Sequence: Synthetic oligonucleotide
cuugggccagcuccucca

SEQ ID NO: 63275 - RNA, 18 nt, Artificial Sequence
  Description of Artificial Sequence: Synthetic oligonucleotide
gccagcuugggccagcuc

SEQ ID NO: 63276 - RNA, 18 nt, Artificial Sequence
  Description of Artificial Sequence: Synthetic oligonucleotide
ucauagccagcuugggcc

SEQ ID NO: 63277 - RNA, 18 nt, Artificial Sequence
  Description of Artificial Sequence: Synthetic oligonucleotide
ccaccucauagccagcuu

SEQ ID NO: 63278 - RNA, 18 nt, Artificial Sequence
  Description of Artificial Sequence: Synthetic oligonucleotide
cccaaccaccucauagcc

SEQ ID NO: 63279 - RNA, 18 nt, Artificial Sequence
  Description of Artificial Sequence: Synthetic oligonucleotide
ucaagcccaaccaccuca

SEQ ID NO: 63280 - RNA, 18 nt, Artificial Sequence
  Description of Artificial Sequence: Synthetic oligonucleotide
uccagucaagcccaacca

SEQ ID NO: 63281 - RNA, 18 nt, Artificial Sequence
  Description of Artificial Sequence: Synthetic oligonucleotide
cacuguccagucaagccc

SEQ ID NO: 63282 - RNA, 18 nt, Artificial Sequence
  Description of Artificial Sequence: Synthetic oligonucleotide
gggccacuguccagucaa

SEQ ID NO: 63283 - RNA, 18 nt, Artificial Sequence
  Description of Artificial Sequence: Synthetic oligonucleotide
gucauagaaccaggguuu

SEQ ID NO: 63284 - RNA, 18 nt, Artificial Sequence
  Description of Artificial Sequence: Synthetic oligonucleotide
uucaugucauagaaccag

SEQ ID NO: 63285 - RNA, 18 nt, Artificial Sequence
  Description of Artificial Sequence: Synthetic oligonucleotide
cuuucuucaugucauaga

SEQ ID NO: 63286 - RNA, 18 nt, Artificial Sequence
  Description of Artificial Sequence: Synthetic oligonucleotide
ccaaacuuucuucauguc

SEQ ID NO: 63287 - RNA, 18 nt, Artificial Sequence
  Description of Artificial Sequence: Synthetic oligonucleotide
cccucccaaacuuucuuc

SEQ ID NO: 63288 - RNA, 18 nt, Artificial Sequence
  Description of Artificial Sequence: Synthetic oligonucleotide
gauaucccucccaaacuu

SEQ ID NO: 63289 - RNA, 18 nt, Artificial Sequence
  Description of Artificial Sequence: Synthetic oligonucleotide
uaugggauaucccuccca

SEQ ID NO: 63290 - RNA, 18 nt, Artificial Sequence
  Description of Artificial Sequence: Synthetic oligonucleotide
acaugaggaagcagaacu

SEQ ID NO: 63291 - RNA, 18 nt, Artificial Sequence
  Description of Artificial Sequence: Synthetic oligonucleotide
cccccacaugaggaagca

SEQ ID NO: 63292 - RNA, 18 nt, Artificial Sequence
  Description of Artificial Sequence: Synthetic oligonucleotide
guccacccccacaugagg

SEQ ID NO: 63293 - RNA, 18 nt, Artificial Sequence
  Description of Artificial Sequence: Synthetic oligonucleotide
ucuuaguccacccccaca

SEQ ID NO: 63294 - RNA, 18 nt, Artificial Sequence
  Description of Artificial Sequence: Synthetic oligonucleotide
gugugucuuaguccaccc

SEQ ID NO: 63295 - RNA, 18 nt, Artificial Sequence
  Description of Artificial Sequence: Synthetic oligonucleotide
cuagggugugucuuaguc

SEQ ID NO: 63296 - RNA, 18 nt, Artificial Sequence
  Description of Artificial Sequence: Synthetic oligonucleotide
cuucacuagggugugucu

SEQ ID NO: 63297 - RNA, 18 nt, Artificial Sequence
  Description of Artificial Sequence: Synthetic oligonucleotide
cgucucuucacuagggug

SEQ ID NO: 63298 - RNA, 18 nt, Artificial Sequence
  Description of Artificial Sequence: Synthetic oligonucleotide
caaaccgucucuucacua

SEQ ID NO: 63299 - RNA, 18 nt, Artificial Sequence
  Description of Artificial Sequence: Synthetic oligonucleotide
uuccacaaaccgucucuu

SEQ ID NO: 63300 - RNA, 18 nt, Artificial Sequence
  Description of Artificial Sequence: Synthetic oligonucleotide
auggauuccacaaaccgu

SEQ ID NO: 63301 - RNA, 18 nt, Artificial Sequence
  Description of Artificial Sequence: Synthetic oligonucleotide
cugccauggauuccacaa

SEQ ID NO: 63302 - RNA, 18 nt, Artificial Sequence
  Description of Artificial Sequence: Synthetic oligonucleotide
ucccucugccauggauuc

SEQ ID NO: 63303 - RNA, 18 nt, Artificial Sequence
  Description of Artificial Sequence: Synthetic oligonucleotide
ucuaaucccucugccaug

SEQ ID NO: 63304 - RNA, 18 nt, Artificial Sequence
  Description of Artificial Sequence: Synthetic oligonucleotide
aucacucuaaucccucug

SEQ ID NO: 63305 - RNA, 18 nt, Artificial Sequence
  Description of Artificial Sequence: Synthetic oligonucleotide
auuccaucacucuaaucc

SEQ ID NO: 63306 - RNA, 18 nt, Artificial Sequence
  Description of Artificial Sequence: Synthetic oligonucleotide
ucuucauuccaucacucu

SEQ ID NO: 63307 - RNA, 18 nt, Artificial Sequence
  Description of Artificial Sequence: Synthetic oligonucleotide
gagguucuucauuccauc

SEQ ID NO: 63308 - RNA, 18 nt, Artificial Sequence
  Description of Artificial Sequence: Synthetic oligonucleotide
ccccugagguucuucauu

SEQ ID NO: 63309 - RNA, 18 nt, Artificial Sequence
  Description of Artificial Sequence: Synthetic oligonucleotide
ccuagccccugagguucu

SEQ ID NO: 63310 - RNA, 18 nt, Artificial Sequence
  Description of Artificial Sequence: Synthetic oligonucleotide
ucugccauggauuccaca

SEQ ID NO: 63311 - RNA, 18 nt, Artificial Sequence
  Description of Artificial Sequence: Synthetic oligonucleotide
aucccucugccauggauu

SEQ ID NO: 63312 - RNA, 18 nt, Artificial Sequence
  Description of Artificial Sequence: Synthetic oligonucleotide
cucuaaucccucugccau

SEQ ID NO: 63313 - RNA, 18 nt, Artificial Sequence
  Description of Artificial Sequence: Synthetic oligonucleotide
caucacucuaaucccucu

SEQ ID NO: 63314 - RNA, 18 nt, Artificial Sequence
  Description of Artificial Sequence: Synthetic oligonucleotide
cauuccaucacucuaauc

SEQ ID NO: 63315 - RNA, 18 nt, Artificial Sequence
  Description of Artificial Sequence: Synthetic oligonucleotide
uucuucauuccaucacuc

SEQ ID NO: 63316 - RNA, 18 nt, Artificial Sequence
  Description of Artificial Sequence: Synthetic oligonucleotide
ugagguucuucauuccau

SEQ ID NO: 63317 - RNA, 18 nt, Artificial Sequence
  Description of Artificial Sequence: Synthetic oligonucleotide
gccccugagguucuucau

SEQ ID NO: 63318 - RNA, 18 nt, Artificial Sequence
  Description of Artificial Sequence: Synthetic oligonucleotide
cccuagccccugagguuc

SEQ ID NO: 63319 - RNA, 18 nt, Artificial Sequence
  Description of Artificial Sequence: Synthetic oligonucleotide
aaacccccuagccccuga

SEQ ID NO: 63320 - RNA, 18 nt, Artificial Sequence
  Description of Artificial Sequence: Synthetic oligonucleotide
uccacaaacccccuagcc

SEQ ID NO: 63321 - RNA, 18 nt, Artificial Sequence
  Description of Artificial Sequence: Synthetic oligonucleotide
cccacuccacaaaccccc

SEQ ID NO: 63322 - RNA, 18 nt, Artificial Sequence
  Description of Artificial Sequence: Synthetic oligonucleotide
guguccccacuccacaaa

SEQ ID NO: 63323 - RNA, 18 nt, Artificial Sequence
  Description of Artificial Sequence: Synthetic oligonucleotide
caaggguguccccacucc

SEQ ID NO: 63324 - RNA, 18 nt, Artificial Sequence
  Description of Artificial Sequence: Synthetic oligonucleotide
agccgcaagggugucccc

SEQ ID NO: 63325 - RNA, 18 nt, Artificial Sequence
  Description of Artificial Sequence: Synthetic oligonucleotide
caaccagccgcaagggug

SEQ ID NO: 63326 - RNA, 18 nt, Artificial Sequence
  Description of Artificial Sequence: Synthetic oligonucleotide
aagagcaaccagccgcaa

SEQ ID NO: 63327 - RNA, 18 nt, Artificial Sequence
  Description of Artificial Sequence: Synthetic oligonucleotide
gagguaagagcaaccagc

SEQ ID NO: 63328 - RNA, 18 nt, Artificial Sequence
  Description of Artificial Sequence: Synthetic oligonucleotide
acugggaagggauagugc

SEQ ID NO: 63329 - RNA, 18 nt, Artificial Sequence
  Description of Artificial Sequence: Synthetic oligonucleotide
ccaauacugggaagggau

SEQ ID NO: 63330 - RNA, 18 nt, Artificial Sequence
  Description of Artificial Sequence: Synthetic oligonucleotide
uaguaccaauacugggaa

SEQ ID NO: 63331 - RNA, 18 nt, Artificial Sequence
  Description of Artificial Sequence: Synthetic oligonucleotide
ucauguaguaccaauacu

SEQ ID NO: 63332 - RNA, 18 nt, Artificial Sequence
  Description of Artificial Sequence: Synthetic oligonucleotide
uucaaucauguaguacca

SEQ ID NO: 63333 - RNA, 18 nt, Artificial Sequence
  Description of Artificial Sequence: Synthetic oligonucleotide
gaaaguucaaucauguag

SEQ ID NO: 63334 - RNA, 18 nt, Artificial Sequence
  Description of Artificial Sequence: Synthetic oligonucleotide
agaaggaaaguucaauca

SEQ ID NO: 63335 - RNA, 18 nt, Artificial Sequence
  Description of Artificial Sequence: Synthetic oligonucleotide
ccaguagaaggaaaguuc

SEQ ID NO: 63336 - RNA, 18 nt, Artificial Sequence
  Description of Artificial Sequence: Synthetic oligonucleotide
agggaccaguagaaggaa

SEQ ID NO: 63337 - RNA, 18 nt, Artificial Sequence
  Description of Artificial Sequence: Synthetic oligonucleotide
agagcagggaccaguaga

SEQ ID NO: 63338 - RNA, 18 nt, Artificial Sequence
  Description of Artificial Sequence: Synthetic oligonucleotide
gcugaagagcagggacca

SEQ ID NO: 63339 - RNA, 18 nt, Artificial Sequence
  Description of Artificial Sequence: Synthetic oligonucleotide
gcaaugcugaagagcagg

SEQ ID NO: 63340 - RNA, 18 nt, Artificial Sequence
  Description of Artificial Sequence: Synthetic oligonucleotide
cagaggcaaugcugaaga

SEQ ID NO: 63341 - RNA, 18 nt, Artificial Sequence
  Description of Artificial Sequence: Synthetic oligonucleotide
gacaucagaggcaaugcu

SEQ ID NO: 63342 - RNA, 18 nt, Artificial Sequence
  Description of Artificial Sequence: Synthetic oligonucleotide
cgcuugacaucagaggca

SEQ ID NO: 63343 - RNA, 18 nt, Artificial Sequence
  Description of Artificial Sequence: Synthetic oligonucleotide
gucauagaaccaggguuu

SEQ ID NO: 63344 - RNA, 18 nt, Artificial Sequence
  Description of Artificial Sequence: Synthetic oligonucleotide
uucaugucauagaaccag

SEQ ID NO: 63345 - RNA, 18 nt, Artificial Sequence
  Description of Artificial Sequence: Synthetic oligonucleotide
cuuucuucaugucauaga

SEQ ID NO: 63346 - RNA, 18 nt, Artificial Sequence
  Description of Artificial Sequence: Synthetic oligonucleotide
ccaaacuuucuucauguc

SEQ ID NO: 63347 - RNA, 18 nt, Artificial Sequence
  Description of Artificial Sequence: Synthetic oligonucleotide
cccucccaaacuuucuuc

SEQ ID NO: 63348 - RNA, 18 nt, Artificial Sequence
  Description of Artificial Sequence: Synthetic oligonucleotide
gauaucccucccaaacuu

SEQ ID NO: 63349 - RNA, 18 nt, Artificial Sequence
  Description of Artificial Sequence: Synthetic oligonucleotide
uaugggauaucccuccca

SEQ ID NO: 63350 - RNA, 18 nt, Artificial Sequence
  Description of Artificial Sequence: Synthetic oligonucleotide
acaugaggaagcagaacu

SEQ ID NO: 63351 - RNA, 18 nt, Artificial Sequence
  Description of Artificial Sequence: Synthetic oligonucleotide
cccccacaugaggaagca

SEQ ID NO: 63352 - RNA, 18 nt, Artificial Sequence
  Description of Artificial Sequence: Synthetic oligonucleotide
guccacccccacaugagg

SEQ ID NO: 63353 - RNA, 18 nt, Artificial Sequence
  Description of Artificial Sequence: Synthetic oligonucleotide
ucuuaguccacccccaca

SEQ ID NO: 63354 - RNA, 18 nt, Artificial Sequence
  Description of Artificial Sequence: Synthetic oligonucleotide
gugugucuuaguccaccc

SEQ ID NO: 63355 - RNA, 18 nt, Artificial Sequence
  Description of Artificial Sequence: Synthetic oligonucleotide
cuagggugugucuuaguc

SEQ ID NO: 63356 - RNA, 18 nt, Artificial Sequence
  Description of Artificial Sequence: Synthetic oligonucleotide
cuucacuagggugugucu

SEQ ID NO: 63357 - RNA, 18 nt, Artificial Sequence
  Description of Artificial Sequence: Synthetic oligonucleotide
cgucucuucacuagggug

SEQ ID NO: 63358 - RNA, 18 nt, Artificial Sequence
  Description of Artificial Sequence: Synthetic oligonucleotide
caaaccgucucuucacua

SEQ ID NO: 63359 - RNA, 18 nt, Artificial Sequence
  Description of Artificial Sequence: Synthetic oligonucleotide
uuccacaaaccgucucuu

SEQ ID NO: 63360 - RNA, 18 nt, Artificial Sequence
  Description of Artificial Sequence: Synthetic oligonucleotide
auggauuccacaaaccgu

SEQ ID NO: 63361 - RNA, 18 nt, Artificial Sequence
  Description of Artificial Sequence: Synthetic oligonucleotide
cugccauggauuccacaa

SEQ ID NO: 63362 - RNA, 18 nt, Artificial Sequence
  Description of Artificial Sequence: Synthetic oligonucleotide
ucccucugccauggauuc

SEQ ID NO: 63363 - RNA, 18 nt, Artificial Sequence
  Description of Artificial Sequence: Synthetic oligonucleotide
ucuaaucccucugccaug

SEQ ID NO: 63364 - RNA, 18 nt, Artificial Sequence
  Description of Artificial Sequence: Synthetic oligonucleotide
aucacucuaaucccucug

SEQ ID NO: 63365 - RNA, 18 nt, Artificial Sequence
  Description of Artificial Sequence: Synthetic oligonucleotide
auuccaucacucuaaucc

SEQ ID NO: 63366 - RNA, 18 nt, Artificial Sequence
  Description of Artificial Sequence: Synthetic oligonucleotide
ucuucauuccaucacucu

SEQ ID NO: 63367 - RNA, 18 nt, Artificial Sequence
  Description of Artificial Sequence: Synthetic oligonucleotide
gagguucuucauuccauc

SEQ ID NO: 63368 - RNA, 18 nt, Artificial Sequence
  Description of Artificial Sequence: Synthetic oligonucleotide
ccccugagguucuucauu

SEQ ID NO: 63369 - RNA, 18 nt, Artificial Sequence
  Description of Artificial Sequence: Synthetic oligonucleotide
ccuagccccugagguucu

SEQ ID NO: 63370 - RNA, 18 nt, Artificial Sequence
  Description of Artificial Sequence: Synthetic oligonucleotide
ucugccauggauuccaca

SEQ ID NO: 63371 - RNA, 18 nt, Artificial Sequence
  Description of Artificial Sequence: Synthetic oligonucleotide
aucccucugccauggauu

SEQ ID NO: 63372 - RNA, 18 nt, Artificial Sequence
  Description of Artificial Sequence: Synthetic oligonucleotide
cucuaaucccucugccau

SEQ ID NO: 63373 - RNA, 18 nt, Artificial Sequence
  Description of Artificial Sequence: Synthetic oligonucleotide
caucacucuaaucccucu

SEQ ID NO: 63374 - RNA, 18 nt, Artificial Sequence
  Description of Artificial Sequence: Synthetic oligonucleotide
cauuccaucacucuaauc

SEQ ID NO: 63375 - RNA, 18 nt, Artificial Sequence
  Description of Artificial Sequence: Synthetic oligonucleotide
uucuucauuccaucacuc

SEQ ID NO: 63376 - RNA, 18 nt, Artificial Sequence
  Description of Artificial Sequence: Synthetic oligonucleotide
ugagguucuucauuccau

SEQ ID NO: 63377 - RNA, 18 nt, Artificial Sequence
  Description of Artificial Sequence: Synthetic oligonucleotide
gccccugagguucuucau

SEQ ID NO: 63378 - RNA, 18 nt, Artificial Sequence
  Description of Artificial Sequence: Synthetic oligonucleotide
cccuagccccugagguuc

SEQ ID NO: 63379 - RNA, 18 nt, Artificial Sequence
  Description of Artificial Sequence: Synthetic oligonucleotide
aaacccccuagccccuga

SEQ ID NO: 63380 - RNA, 18 nt, Artificial Sequence
  Description of Artificial Sequence: Synthetic oligonucleotide
uccacaaacccccuagcc

SEQ ID NO: 63381 - RNA, 18 nt, Artificial Sequence
  Description of Artificial Sequence: Synthetic oligonucleotide
cccacuccacaaaccccc

SEQ ID NO: 63382 - RNA, 18 nt, Artificial Sequence
  Description of Artificial Sequence: Synthetic oligonucleotide
guguccccacuccacaaa

SEQ ID NO: 63383 - RNA, 18 nt, Artificial Sequence
  Description of Artificial Sequence: Synthetic oligonucleotide
caaggguguccccacucc

SEQ ID NO: 63384 - RNA, 18 nt, Artificial Sequence
  Description of Artificial Sequence: Synthetic oligonucleotide
agccgcaagggugucccc

SEQ ID NO: 63385 - RNA, 18 nt, Artificial Sequence
  Description of Artificial Sequence: Synthetic oligonucleotide
caaccagccgcaagggug

SEQ ID NO: 63386 - RNA, 18 nt, Artificial Sequence
  Description of Artificial Sequence: Synthetic oligonucleotide
aagagcaaccagccgcaa

SEQ ID NO: 63387 - RNA, 18 nt, Artificial Sequence
  Description of Artificial Sequence: Synthetic oligonucleotide
gagguaagagcaaccagc

SEQ ID NO: 63388 - RNA, 18 nt, Artificial Sequence
  Description of Artificial Sequence: Synthetic oligonucleotide
acugggaagggauagugc

SEQ ID NO: 63389 - RNA, 18 nt, Artificial Sequence
  Description of Artificial Sequence: Synthetic oligonucleotide
ccaauacugggaagggau

SEQ ID NO: 63390 - RNA, 18 nt, Artificial Sequence
  Description of Artificial Sequence: Synthetic oligonucleotide
uaguaccaauacugggaa

SEQ ID NO: 63391 - RNA, 18 nt, Artificial Sequence
  Description of Artificial Sequence: Synthetic oligonucleotide
ucauguaguaccaauacu

SEQ ID NO: 63392 - RNA, 18 nt, Artificial Sequence
  Description of Artificial Sequence: Synthetic oligonucleotide
uucaaucauguaguacca

SEQ ID NO: 63393 - RNA, 18 nt, Artificial Sequence
  Description of Artificial Sequence: Synthetic oligonucleotide
gaaaguucaaucauguag

SEQ ID NO: 63394 - RNA, 18 nt, Artificial Sequence
  Description of Artificial Sequence: Synthetic oligonucleotide
agaaggaaaguucaauca

SEQ ID NO: 63395 - RNA, 18 nt, Artificial Sequence
  Description of Artificial Sequence: Synthetic oligonucleotide
ccaguagaaggaaaguuc

SEQ ID NO: 63396 - RNA, 18 nt, Artificial Sequence
  Description of Artificial Sequence: Synthetic oligonucleotide
agggaccaguagaaggaa

SEQ ID NO: 63397 - RNA, 18 nt, Artificial Sequence
  Description of Artificial Sequence: Synthetic oligonucleotide
agagcagggaccaguaga

SEQ ID NO: 63398 - RNA, 18 nt, Artificial Sequence
  Description of Artificial Sequence: Synthetic oligonucleotide
gcugaagagcagggacca

SEQ ID NO: 63399 - RNA, 18 nt, Artificial Sequence
  Description of Artificial Sequence: Synthetic oligonucleotide
gcaaugcugaagagcagg

SEQ ID NO: 63400 - RNA, 18 nt, Artificial Sequence
  Description of Artificial Sequence: Synthetic oligonucleotide
cagaggcaaugcugaaga

SEQ ID NO: 63401 - RNA, 18 nt, Artificial Sequence
  Description of Artificial Sequence: Synthetic oligonucleotide
gacaucagaggcaaugcu

SEQ ID NO: 63402 - RNA, 18 nt, Artificial Sequence
  Description of Artificial Sequence: Synthetic oligonucleotide
cgcuugacaucagaggca

SEQ ID NO: 63403 - RNA, 18 nt, Artificial Sequence
  Description of Artificial Sequence: Synthetic oligonucleotide
gcugucccuuagagauac

SEQ ID NO: 63404 - RNA, 18 nt, Artificial Sequence
  Description of Artificial Sequence: Synthetic oligonucleotide
agacugcugucccuuaga

SEQ ID NO: 63405 - RNA, 18 nt, Artificial Sequence
  Description of Artificial Sequence: Synthetic oligonucleotide
ccuccagacugcuguccc

SEQ ID NO: 63406 - RNA, 18 nt, Artificial Sequence
  Description of Artificial Sequence: Synthetic oligonucleotide
gucagccuccagacugcu

SEQ ID NO: 63407 - RNA, 18 nt, Artificial Sequence
  Description of Artificial Sequence: Synthetic oligonucleotide
acguggucagccuccaga

SEQ ID NO: 63408 - RNA, 18 nt, Artificial Sequence
  Description of Artificial Sequence: Synthetic oligonucleotide
uaauaacguggucagccu

SEQ ID NO: 63409 - RNA, 18 nt, Artificial Sequence
  Description of Artificial Sequence: Synthetic oligonucleotide
ggcacuaauaacgugguc

SEQ ID NO: 63410 - RNA, 18 nt, Artificial Sequence
  Description of Artificial Sequence: Synthetic oligonucleotide
ggaauggcacuaauaacg

SEQ ID NO: 63411 - RNA, 18 nt, Artificial Sequence
  Description of Artificial Sequence: Synthetic oligonucleotide
aagcuggaauggcacuaa

SEQ ID NO: 63412 - RNA, 18 nt, Artificial Sequence
  Description of Artificial Sequence: Synthetic oligonucleotide
gggaagguggcuauucca

SEQ ID NO: 63413 - RNA, 18 nt, Artificial Sequence
  Description of Artificial Sequence: Synthetic oligonucleotide
ugcuucucacugguaggg

SEQ ID NO: 63414 - RNA, 18 nt, Artificial Sequence
  Description of Artificial Sequence: Synthetic oligonucleotide
gcuuuugcuucucacugg

SEQ ID NO: 63415 - RNA, 18 nt, Artificial Sequence
  Description of Artificial Sequence: Synthetic oligonucleotide
guauagcuuuugcuucuc

SEQ ID NO: 63416 - RNA, 18 nt, Artificial Sequence
  Description of Artificial Sequence: Synthetic oligonucleotide
ggaagguauagcuuuugc

SEQ ID NO: 63417 - RNA, 18 nt, Artificial Sequence
  Description of Artificial Sequence: Synthetic oligonucleotide
acccaggaagguauagcu

SEQ ID NO: 63418 - RNA, 18 nt, Artificial Sequence
  Description of Artificial Sequence: Synthetic oligonucleotide
ugcugacccaggaaggua

SEQ ID NO: 63419 - RNA, 18 nt, Artificial Sequence
  Description of Artificial Sequence: Synthetic oligonucleotide
gguccugcugacccagga

SEQ ID NO: 63420 - RNA, 18 nt, Artificial Sequence
  Description of Artificial Sequence: Synthetic oligonucleotide
ggugugguccugcugacc

SEQ ID NO: 63421 - RNA, 18 nt, Artificial Sequence
  Description of Artificial Sequence: Synthetic oligonucleotide
ggcauggugugguccugc

SEQ ID NO: 63422 - RNA, 18 nt, Artificial Sequence
  Description of Artificial Sequence: Synthetic oligonucleotide
gggcauggugugguccug

SEQ ID NO: 63423 - RNA, 18 nt, Artificial Sequence
  Description of Artificial Sequence: Synthetic oligonucleotide
gagaugaccaguucaggg

SEQ ID NO: 63424 - RNA, 18 nt, Artificial Sequence
  Description of Artificial Sequence: Synthetic oligonucleotide
ccauagagaugaccaguu

SEQ ID NO: 63425 - RNA, 18 nt, Artificial Sequence
  Description of Artificial Sequence: Synthetic oligonucleotide
gacucccauagagaugac

SEQ ID NO: 63426 - RNA, 18 nt, Artificial Sequence
  Description of Artificial Sequence: Synthetic oligonucleotide
gauuagacucccauagag

SEQ ID NO: 63427 - RNA, 18 nt, Artificial Sequence
  Description of Artificial Sequence: Synthetic oligonucleotide
ugguccugcugacccagg

SEQ ID NO: 63428 - RNA, 18 nt, Artificial Sequence
  Description of Artificial Sequence: Synthetic oligonucleotide
uggugugguccugcugac

SEQ ID NO: 63429 - RNA, 18 nt, Artificial Sequence
  Description of Artificial Sequence: Synthetic oligonucleotide
gggcauggugugguccug

SEQ ID NO: 63430 - RNA, 18 nt, Artificial Sequence
  Description of Artificial Sequence: Synthetic oligonucleotide
gagaugaccaguucaggg

SEQ ID NO: 63431 - RNA, 18 nt, Artificial Sequence
  Description of Artificial Sequence: Synthetic oligonucleotide
auagagaugaccaguuca

SEQ ID NO: 63432 - RNA, 18 nt, Artificial Sequence
  Description of Artificial Sequence: Synthetic oligonucleotide
cucccauagagaugacca

SEQ ID NO: 63433 - RNA, 18 nt, Artificial Sequence
  Description of Artificial Sequence: Synthetic oligonucleotide
uuagacucccauagagau

SEQ ID NO: 63434 - RNA, 18 nt, Artificial Sequence
  Description of Artificial Sequence: Synthetic oligonucleotide
ugggauuagacucccaua

SEQ ID NO: 63435 - RNA, 18 nt, Artificial Sequence
  Description of Artificial Sequence: Synthetic oligonucleotide
cucuuugggauuagacuc

SEQ ID NO: 63436 - RNA, 18 nt, Artificial Sequence
  Description of Artificial Sequence: Synthetic oligonucleotide
caguccucuuugggauua

SEQ ID NO: 63437 - RNA, 18 nt, Artificial Sequence
  Description of Artificial Sequence: Synthetic oligonucleotide
guugucaguccucuuugg

SEQ ID NO: 63438 - RNA, 18 nt, Artificial Sequence
  Description of Artificial Sequence: Synthetic oligonucleotide
uuacaguugucaguccuc

SEQ ID NO: 63439 - RNA, 18 nt, Artificial Sequence
  Description of Artificial Sequence: Synthetic oligonucleotide
ucccauuacaguugucag

SEQ ID NO: 63440 - RNA, 18 nt, Artificial Sequence
  Description of Artificial Sequence: Synthetic oligonucleotide
ggcauucccauuacaguu

SEQ ID NO: 63441 - RNA, 18 nt, Artificial Sequence
  Description of Artificial Sequence: Synthetic oligonucleotide
cagaaggcauucccauua

SEQ ID NO: 63442 - RNA, 18 nt, Artificial Sequence
  Description of Artificial Sequence: Synthetic oligonucleotide
ugacucagaaggcauucc

SEQ ID NO: 63443 - RNA, 18 nt, Artificial Sequence
  Description of Artificial Sequence: Synthetic oligonucleotide
aggccugacucagaaggc

SEQ ID NO: 63444 - RNA, 18 nt, Artificial Sequence
  Description of Artificial Sequence: Synthetic oligonucleotide
gggagcagcucacugagc

SEQ ID NO: 63445 - RNA, 18 nt, Artificial Sequence
  Description of Artificial Sequence: Synthetic oligonucleotide
cagcagggagcagcucac

SEQ ID NO: 63446 - RNA, 18 nt, Artificial Sequence
  Description of Artificial Sequence: Synthetic oligonucleotide
agccucagcagggagcag

SEQ ID NO: 63447 - RNA, 18 nt, Artificial Sequence
  Description of Artificial Sequence: Synthetic oligonucleotide
gggcagccucagcaggga

SEQ ID NO: 63448 - RNA, 18 nt, Artificial Sequence
  Description of Artificial Sequence: Synthetic oligonucleotide
agggcacgagccagaggg

SEQ ID NO: 63449 - RNA, 18 nt, Artificial Sequence
  Description of Artificial Sequence: Synthetic oligonucleotide
cacucagggcacgagcca

SEQ ID NO: 63450 - RNA, 18 nt, Artificial Sequence
  Description of Artificial Sequence: Synthetic oligonucleotide
gauggcacucagggcacg

SEQ ID NO: 63451 - RNA, 18 nt, Artificial Sequence
  Description of Artificial Sequence: Synthetic oligonucleotide
gcagugauggcacucagg

SEQ ID NO: 63452 - RNA, 18 nt, Artificial Sequence
  Description of Artificial Sequence: Synthetic oligonucleotide
acacugcagugauggcac

SEQ ID NO: 63453 - RNA, 18 nt, Artificial Sequence
  Description of Artificial Sequence: Synthetic oligonucleotide
uacagacacugcagugau

SEQ ID NO: 63454 - RNA, 18 nt, Artificial Sequence
  Description of Artificial Sequence: Synthetic oligonucleotide
acagcuacagacacugca

SEQ ID NO: 63455 - RNA, 18 nt, Artificial Sequence
  Description of Artificial Sequence: Synthetic oligonucleotide
ucaccacagcuacagaca

SEQ ID NO: 63456 - RNA, 18 nt, Artificial Sequence
  Description of Artificial Sequence: Synthetic oligonucleotide
cagauucaccacagcuac

SEQ ID NO: 63457 - RNA, 18 nt, Artificial Sequence
  Description of Artificial Sequence: Synthetic oligonucleotide
uacugcagauucaccaca

SEQ ID NO: 63458 - RNA, 18 nt, Artificial Sequence
  Description of Artificial Sequence: Synthetic oligonucleotide
cuugguacugcagauuca

SEQ ID NO: 63459 - RNA, 18 nt, Artificial Sequence
  Description of Artificial Sequence: Synthetic oligonucleotide
ggcuccuugguacugcag

SEQ ID NO: 63460 - RNA, 18 nt, Artificial Sequence
  Description of Artificial Sequence: Synthetic oligonucleotide
agaugggcuccuugguac

SEQ ID NO: 63461 - RNA, 18 nt, Artificial Sequence
  Description of Artificial Sequence: Synthetic oligonucleotide
caggcagaugggcuccuu

SEQ ID NO: 63462 - RNA, 18 nt, Artificial Sequence
  Description of Artificial Sequence: Synthetic oligonucleotide
cuggacaggcagaugggc

SEQ ID NO: 63463 - RNA, 18 nt, Artificial Sequence
  Description of Artificial Sequence: Synthetic oligonucleotide
gggugaagggcggaguag

SEQ ID NO: 63464 - RNA, 18 nt, Artificial Sequence
  Description of Artificial Sequence: Synthetic oligonucleotide
cagagguuuggagaaggg

SEQ ID NO: 63465 - RNA, 18 nt, Artificial Sequence
  Description of Artificial Sequence: Synthetic oligonucleotide
aaacagagguuuggagaa

SEQ ID NO: 63466 - RNA, 18 nt, Artificial Sequence
  Description of Artificial Sequence: Synthetic oligonucleotide
gcccaaaacagagguuug

SEQ ID NO: 63467 - RNA, 18 nt, Artificial Sequence
  Description of Artificial Sequence: Synthetic oligonucleotide
gcccagcccaaaacagag

SEQ ID NO: 63468 - RNA, 18 nt, Artificial Sequence
  Description of Artificial Sequence: Synthetic oligonucleotide
ccucagcccagcccaaaa

SEQ ID NO: 63469 - RNA, 18 nt, Artificial Sequence
  Description of Artificial Sequence: Synthetic oligonucleotide
agcucccucagcccagcc

SEQ ID NO: 63470 - RNA, 18 nt, Artificial Sequence
  Description of Artificial Sequence: Synthetic oligonucleotide
uggucagcucccucagcc

SEQ ID NO: 63471 - RNA, 18 nt, Artificial Sequence
  Description of Artificial Sequence: Synthetic oligonucleotide
gggcuuggucagcucccu

SEQ ID NO: 63472 - RNA, 18 nt, Artificial Sequence
  Description of Artificial Sequence: Synthetic oligonucleotide
caggcucuuugccccggg

SEQ ID NO: 63473 - RNA, 18 nt, Artificial Sequence
  Description of Artificial Sequence: Synthetic oligonucleotide
ucaggcucuuugccccgg

SEQ ID NO: 63474 - RNA, 18 nt, Artificial Sequence
  Description of Artificial Sequence: Synthetic oligonucleotide
ucucaucaggcucuuugc

SEQ ID NO: 63475 - RNA, 18 nt, Artificial Sequence
  Description of Artificial Sequence: Synthetic oligonucleotide
cacagucucaucaggcuc

SEQ ID NO: 63476 - RNA, 18 nt, Artificial Sequence
  Description of Artificial Sequence: Synthetic oligonucleotide
cugugcacagucucauca

SEQ ID NO: 63477 - RNA, 18 nt, Artificial Sequence
  Description of Artificial Sequence: Synthetic oligonucleotide
caaaacugugcacagucu

SEQ ID NO: 63478 - RNA, 18 nt, Artificial Sequence
  Description of Artificial Sequence: Synthetic oligonucleotide
cugggcaaaacugugcac

SEQ ID NO: 63479 - RNA, 18 nt, Artificial Sequence
  Description of Artificial Sequence: Synthetic oligonucleotide
cggcgcugggcaaaacug

SEQ ID NO: 63480 - RNA, 18 nt, Artificial Sequence
  Description of Artificial Sequence: Synthetic oligonucleotide
caaggcggcgcugggcaa

SEQ ID NO: 63481 - RNA, 18 nt, Artificial Sequence
  Description of Artificial Sequence: Synthetic oligonucleotide
agguccaaggcggcgcug

SEQ ID NO: 63482 - RNA, 18 nt, Artificial Sequence
  Description of Artificial Sequence: Synthetic oligonucleotide
gggccucugggcaagugu

SEQ ID NO: 63483 - RNA, 18 nt, Artificial Sequence
  Description of Artificial Sequence: Synthetic oligonucleotide
ggagggaagagguuuggg

SEQ ID NO: 63484 - RNA, 18 nt, Artificial Sequence
  Description of Artificial Sequence: Synthetic oligonucleotide
guuuaggagggaagaggu

SEQ ID NO: 63485 - RNA, 18 nt, Artificial Sequence
  Description of Artificial Sequence: Synthetic oligonucleotide
agcugguuuaggagggaa

SEQ ID NO: 63486 - RNA, 18 nt, Artificial Sequence
  Description of Artificial Sequence: Synthetic oligonucleotide
ucugcagcugguuuagga

SEQ ID NO: 63487 - RNA, 18 nt, Artificial Sequence
  Description of Artificial Sequence: Synthetic oligonucleotide
ggagcucugcagcugguu

SEQ ID NO: 63488 - RNA, 18 nt, Artificial Sequence
  Description of Artificial Sequence: Synthetic oligonucleotide
aacagggagcucugcagc

SEQ ID NO: 63489 - RNA, 18 nt, Artificial Sequence
  Description of Artificial Sequence: Synthetic oligonucleotide
auuugaacagggagcucu

SEQ ID NO: 63490 - RNA, 18 nt, Artificial Sequence
  Description of Artificial Sequence: Synthetic oligonucleotide
gguagauuugaacaggga

SEQ ID NO: 63491 - RNA, 18 nt, Artificial Sequence
  Description of Artificial Sequence: Synthetic oligonucleotide
uaggugguagauuugaac

SEQ ID NO: 63492 - RNA, 18 nt, Artificial Sequence
  Description of Artificial Sequence: Synthetic oligonucleotide
gccccuaggugguagauu

SEQ ID NO: 63493 - RNA, 18 nt, Artificial Sequence
  Description of Artificial Sequence: Synthetic oligonucleotide
gaagagccccuagguggu

SEQ ID NO: 63494 - RNA, 18 nt, Artificial Sequence
  Description of Artificial Sequence: Synthetic oligonucleotide
auacagaagagccccuag

SEQ ID NO: 63495 - RNA, 18 nt, Artificial Sequence
  Description of Artificial Sequence: Synthetic oligonucleotide
aaaugauacagaagagcc

SEQ ID NO: 63496 - RNA, 18 nt, Artificial Sequence
  Description of Artificial Sequence: Synthetic oligonucleotide
uccccaaaugauacagaa

SEQ ID NO: 63497 - RNA, 18 nt, Artificial Sequence
  Description of Artificial Sequence: Synthetic oligonucleotide
gggcauccccaaaugaua

SEQ ID NO: 63498 - RNA, 18 nt, Artificial Sequence
  Description of Artificial Sequence: Synthetic oligonucleotide
gaagagggcauccccaaa

SEQ ID NO: 63499 - RNA, 18 nt, Artificial Sequence
  Description of Artificial Sequence: Synthetic oligonucleotide
gaagagaagagggcaucc

SEQ ID NO: 63500 - RNA, 18 nt, Artificial Sequence
  Description of Artificial Sequence: Synthetic oligonucleotide
gguaugaagagaagaggg

SEQ ID NO: 63501 - RNA, 18 nt, Artificial Sequence
  Description of Artificial Sequence: Synthetic oligonucleotide
ggguaugaagagaagagg

SEQ ID NO: 63502 - RNA, 18 nt, Artificial Sequence
  Description of Artificial Sequence: Synthetic oligonucleotide
uuuugggaauuaugaggg

SEQ ID NO: 63503 - RNA, 18 nt, Artificial Sequence
  Description of Artificial Sequence: Synthetic oligonucleotide
augaguuuugggaauuau

SEQ ID NO: 63504 - RNA, 18 nt, Artificial Sequence
  Description of Artificial Sequence: Synthetic oligonucleotide
caauaaugaguuuuggga

SEQ ID NO: 63505 - RNA, 18 nt, Artificial Sequence
  Description of Artificial Sequence: Synthetic oligonucleotide
acucccaauaaugaguuu

SEQ ID NO: 63506 - RNA, 18 nt, Artificial Sequence
  Description of Artificial Sequence: Synthetic oligonucleotide
ccuucacucccaauaaug

SEQ ID NO: 63507 - RNA, 18 nt, Artificial Sequence
  Description of Artificial Sequence: Synthetic oligonucleotide
gaaggccuucacucccaa

SEQ ID NO: 63508 - RNA, 18 nt, Artificial Sequence
  Description of Artificial Sequence: Synthetic oligonucleotide
gaaaugaaggccuucacu

SEQ ID NO: 63509 - RNA, 18 nt, Artificial Sequence
  Description of Artificial Sequence: Synthetic oligonucleotide
ggauggaaaugaaggccu

SEQ ID NO: 63510 - RNA, 18 nt, Artificial Sequence
  Description of Artificial Sequence: Synthetic oligonucleotide
uuuugggaauuaugaggg

SEQ ID NO: 63511 - RNA, 18 nt, Artificial Sequence
  Description of Artificial Sequence: Synthetic oligonucleotide
ugaguuuugggaauuaug

SEQ ID NO: 63512 - RNA, 18 nt, Artificial Sequence
  Description of Artificial Sequence: Synthetic oligonucleotide
aauaaugaguuuugggaa

SEQ ID NO: 63513 - RNA, 18 nt, Artificial Sequence
  Description of Artificial Sequence: Synthetic oligonucleotide
cucccaauaaugaguuuu

SEQ ID NO: 63514 - RNA, 18 nt, Artificial Sequence
  Description of Artificial Sequence: Synthetic oligonucleotide
cuucacucccaauaauga

SEQ ID NO: 63515 - RNA, 18 nt, Artificial Sequence
  Description of Artificial Sequence: Synthetic oligonucleotide
aaggccuucacucccaau

SEQ ID NO: 63516 - RNA, 18 nt, Artificial Sequence
  Description of Artificial Sequence: Synthetic oligonucleotide
aaaugaaggccuucacuc

SEQ ID NO: 63517 - RNA, 18 nt, Artificial Sequence
  Description of Artificial Sequence: Synthetic oligonucleotide
gauggaaaugaaggccuu

SEQ ID NO: 63518 - RNA, 18 nt, Artificial Sequence
  Description of Artificial Sequence: Synthetic oligonucleotide
ugacggauggaaaugaag

SEQ ID NO: 63519 - RNA, 18 nt, Artificial Sequence
  Description of Artificial Sequence: Synthetic oligonucleotide
cacugugacggauggaaa

SEQ ID NO: 63520 - RNA, 18 nt, Artificial Sequence
  Description of Artificial Sequence: Synthetic oligonucleotide
auucccacugugacggau

SEQ ID NO: 63521 - RNA, 18 nt, Artificial Sequence
  Description of Artificial Sequence: Synthetic oligonucleotide
gggacauucccacuguga

SEQ ID NO: 63522 - RNA, 18 nt, Artificial Sequence
  Description of Artificial Sequence: Synthetic oligonucleotide
gauaggguuuggguuggg

SEQ ID NO: 63523 - RNA, 18 nt, Artificial Sequence
  Description of Artificial Sequence: Synthetic oligonucleotide
ugggauaggguuuggguu

SEQ ID NO: 63524 - RNA, 18 nt, Artificial Sequence
  Description of Artificial Sequence: Synthetic oligonucleotide
gagggugggauaggguuu

SEQ ID NO: 63525 - RNA, 18 nt, Artificial Sequence
  Description of Artificial Sequence: Synthetic oligonucleotide
ggaaugagggugggauag

SEQ ID NO: 63526 - RNA, 18 nt, Artificial Sequence
  Description of Artificial Sequence: Synthetic oligonucleotide
gguagggaaugagggugg

SEQ ID NO: 63527 - RNA, 18 nt, Artificial Sequence
  Description of Artificial Sequence: Synthetic oligonucleotide
uauuugguagggaaugag

SEQ ID NO: 63528 - RNA, 18 nt, Artificial Sequence
  Description of Artificial Sequence: Synthetic oligonucleotide
gccccuauuugguaggga

SEQ ID NO: 63529 - RNA, 18 nt, Artificial Sequence
  Description of Artificial Sequence: Synthetic oligonucleotide
ccacagccccuauuuggu

SEQ ID NO: 63530 - RNA, 18 nt, Artificial Sequence
  Description of Artificial Sequence: Synthetic oligonucleotide
gauuuccacagccccuau

SEQ ID NO: 63531 - RNA, 18 nt, Artificial Sequence
  Description of Artificial Sequence: Synthetic oligonucleotide
ugacugauuuccacagcc

SEQ ID NO: 63532 - RNA, 18 nt, Artificial Sequence
  Description of Artificial Sequence: Synthetic oligonucleotide
uacacugacugauuucca

SEQ ID NO: 63533 - RNA, 18 nt, Artificial Sequence
  Description of Artificial Sequence: Synthetic oligonucleotide
uaaucuacacugacugau

SEQ ID NO: 63534 - RNA, 18 nt, Artificial Sequence
  Description of Artificial Sequence: Synthetic oligonucleotide
aaaaauaaucuacacuga

SEQ ID NO: 63535 - RNA, 18 nt, Artificial Sequence
  Description of Artificial Sequence: Synthetic oligonucleotide
agcgaaaaaauaaucuac

SEQ ID NO: 63536 - RNA, 18 nt, Artificial Sequence
  Description of Artificial Sequence: Synthetic oligonucleotide
uaaggagcgaaaaaauaa

SEQ ID NO: 63537 - RNA, 18 nt, Artificial Sequence
  Description of Artificial Sequence: Synthetic oligonucleotide
aggacuaaggagcgaaaa

SEQ ID NO: 63538 - RNA, 18 nt, Artificial Sequence
  Description of Artificial Sequence: Synthetic oligonucleotide
ccauggcuagagacgcca

SEQ ID NO: 63539 - RNA, 18 nt, Artificial Sequence
  Description of Artificial Sequence: Synthetic oligonucleotide
acuguccauggcuagaga

SEQ ID NO: 63540 - RNA, 18 nt, Artificial Sequence
  Description of Artificial Sequence: Synthetic oligonucleotide
cagagacuguccauggcu

SEQ ID NO: 63541 - RNA, 18 nt, Artificial Sequence
  Description of Artificial Sequence: Synthetic oligonucleotide
cacggcagagacugucca

SEQ ID NO: 63542 - RNA, 18 nt, Artificial Sequence
  Description of Artificial Sequence: Synthetic oligonucleotide
cacuccacggcagagacu

SEQ ID NO: 63543 - RNA, 18 nt, Artificial Sequence
  Description of Artificial Sequence: Synthetic oligonucleotide
gcaaacacuccacggcag

SEQ ID NO: 63544 - RNA, 18 nt, Artificial Sequence
  Description of Artificial Sequence: Synthetic oligonucleotide
ugccugcaaacacuccac

SEQ ID NO: 63545 - RNA, 18 nt, Artificial Sequence
  Description of Artificial Sequence: Synthetic oligonucleotide
gcuguugccugcaaacac

SEQ ID NO: 63546 - RNA, 18 nt, Artificial Sequence
  Description of Artificial Sequence: Synthetic oligonucleotide
ucacggcuguugccugca

SEQ ID NO: 63547 - RNA, 18 nt, Artificial Sequence
  Description of Artificial Sequence: Synthetic oligonucleotide
ugagcucacggcuguugc

SEQ ID NO: 63548 - RNA, 18 nt, Artificial Sequence
  Description of Artificial Sequence: Synthetic oligonucleotide
gaugcugagcucacggcu

SEQ ID NO: 63549 - RNA, 18 nt, Artificial Sequence
  Description of Artificial Sequence: Synthetic oligonucleotide
gaccugaugcugagcuca

SEQ ID NO: 63550 - RNA, 18 nt, Artificial Sequence
  Description of Artificial Sequence: Synthetic oligonucleotide
agcaggaccugaugcuga

SEQ ID NO: 63551 - RNA, 18 nt, Artificial Sequence
  Description of Artificial Sequence: Synthetic oligonucleotide
gggaaagcaggaccugau

SEQ ID NO: 63552 - RNA, 18 nt, Artificial Sequence
  Description of Artificial Sequence: Synthetic oligonucleotide
agacugggaaagcaggac

SEQ ID NO: 63553 - RNA, 18 nt, Artificial Sequence
  Description of Artificial Sequence: Synthetic oligonucleotide
ggaagagacugggaaagc

SEQ ID NO: 63554 - RNA, 18 nt, Artificial Sequence
  Description of Artificial Sequence: Synthetic oligonucleotide
agcuuggaagagacuggg

SEQ ID NO: 63555 - RNA, 18 nt, Artificial Sequence
  Description of Artificial Sequence: Synthetic oligonucleotide
ugcucagcuuggaagaga

SEQ ID NO: 63556 - RNA, 18 nt, Artificial Sequence
  Description of Artificial Sequence: Synthetic oligonucleotide
ggguuugcucagcuugga

SEQ ID NO: 63557 - RNA, 18 nt, Artificial Sequence
  Description of Artificial Sequence: Synthetic oligonucleotide
acgauggguuugcucagc

SEQ ID NO: 63558 - RNA, 18 nt, Artificial Sequence
  Description of Artificial Sequence: Synthetic oligonucleotide
auggaacgauggguuugc

SEQ ID NO: 63559 - RNA, 18 nt, Artificial Sequence
  Description of Artificial Sequence: Synthetic oligonucleotide
guaauauggaacgauggg

SEQ ID NO: 63560 - RNA, 18 nt, Artificial Sequence
  Description of Artificial Sequence: Synthetic oligonucleotide
gcccaguaauauggaacg

SEQ ID NO: 63561 - RNA, 18 nt, Artificial Sequence
  Description of Artificial Sequence: Synthetic oligonucleotide
agcaggcccaguaauaug

SEQ ID NO: 63562 - RNA, 18 nt, Artificial Sequence
  Description of Artificial Sequence: Synthetic oligonucleotide
ccagcagcaggcccagua

SEQ ID NO: 63563 - RNA, 18 nt, Artificial Sequence
  Description of Artificial Sequence: Synthetic oligonucleotide
ugcccccagcagcaggcc

SEQ ID NO: 63564 - RNA, 18 nt, Artificial Sequence
  Description of Artificial Sequence: Synthetic oligonucleotide
gaccuaguguauacuggg

SEQ ID NO: 63565 - RNA, 18 nt, Artificial Sequence
  Description of Artificial Sequence: Synthetic oligonucleotide
gugaccuaguguauacug

SEQ ID NO: 63566 - RNA, 18 nt, Artificial Sequence
  Description of Artificial Sequence: Synthetic oligonucleotide
ugccagugaccuagugua

SEQ ID NO: 63567 - RNA, 18 nt, Artificial Sequence
  Description of Artificial Sequence: Synthetic oligonucleotide
guuuuugccagugaccua

SEQ ID NO: 63568 - RNA, 18 nt, Artificial Sequence
  Description of Artificial Sequence: Synthetic oligonucleotide
gcccagcuguuuucccaa

SEQ ID NO: 63569 - RNA, 18 nt, Artificial Sequence
  Description of Artificial Sequence: Synthetic oligonucleotide
ccucagcccagcuguuuu

SEQ ID NO: 63570 - RNA, 18 nt, Artificial Sequence
  Description of Artificial Sequence: Synthetic oligonucleotide
gcccuccucagcccagcu

SEQ ID NO: 63571 - RNA, 18 nt, Artificial Sequence
  Description of Artificial Sequence: Synthetic oligonucleotide
ccuuggcccuccucagcc

SEQ ID NO: 63572 - RNA, 18 nt, Artificial Sequence
  Description of Artificial Sequence: Synthetic oligonucleotide
gauguccuuggcccuccu

SEQ ID NO: 63573 - RNA, 18 nt, Artificial Sequence
  Description of Artificial Sequence: Synthetic oligonucleotide
ggucugauguccuuggcc

SEQ ID NO: 63574 - RNA, 18 nt, Artificial Sequence
  Description of Artificial Sequence: Synthetic oligonucleotide
gggucugauguccuuggc

SEQ ID NO: 63575 - RNA, 18 nt, Artificial Sequence
  Description of Artificial Sequence: Synthetic oligonucleotide
aggaauguuuuagcuggg

SEQ ID NO: 63576 - RNA, 18 nt, Artificial Sequence
  Description of Artificial Sequence: Synthetic oligonucleotide
augaaaggaauguuuuag

SEQ ID NO: 63577 - RNA, 18 nt, Artificial Sequence
  Description of Artificial Sequence: Synthetic oligonucleotide
uccucagcccagcuguuu

SEQ ID NO: 63578 - RNA, 18 nt, Artificial Sequence
  Description of Artificial Sequence: Synthetic oligonucleotide
ggcccuccucagcccagc

SEQ ID NO: 63579 - RNA, 18 nt, Artificial Sequence
  Description of Artificial Sequence: Synthetic oligonucleotide
uccuuggcccuccucagc

SEQ ID NO: 63580 - RNA, 18 nt, Artificial Sequence
  Description of Artificial Sequence: Synthetic oligonucleotide
ugauguccuuggcccucc

SEQ ID NO: 63581 - RNA, 18 nt, Artificial Sequence
  Description of Artificial Sequence: Synthetic oligonucleotide
gggucugauguccuuggc

SEQ ID NO: 63582 - RNA, 18 nt, Artificial Sequence
  Description of Artificial Sequence: Synthetic oligonucleotide
aggaauguuuuagcuggg

SEQ ID NO: 63583 - RNA, 18 nt, Artificial Sequence
  Description of Artificial Sequence: Synthetic oligonucleotide
gaaaggaauguuuuagcu

SEQ ID NO: 63584 - RNA, 18 nt, Artificial Sequence
  Description of Artificial Sequence: Synthetic oligonucleotide
aggaauugccuagcugac

SEQ ID NO: 63585 - RNA, 18 nt, Artificial Sequence
  Description of Artificial Sequence: Synthetic oligonucleotide
cagucaggaauugccuag

SEQ ID NO: 63586 - RNA, 18 nt, Artificial Sequence
  Description of Artificial Sequence: Synthetic oligonucleotide
gugagcagucaggaauug

SEQ ID NO: 63587 - RNA, 18 nt, Artificial Sequence
  Description of Artificial Sequence: Synthetic oligonucleotide
aaccugugagcagucagg

SEQ ID NO: 63588 - RNA, 18 nt, Artificial Sequence
  Description of Artificial Sequence: Synthetic oligonucleotide
gggcaaccugugagcagu

SEQ ID NO: 63589 - RNA, 18 nt, Artificial Sequence
  Description of Artificial Sequence: Synthetic oligonucleotide
cuccagccagagucaggg

SEQ ID NO: 63590 - RNA, 18 nt, Artificial Sequence
  Description of Artificial Sequence: Synthetic oligonucleotide
ggaggcuccagccagagu

SEQ ID NO: 63591 - RNA, 18 nt, Artificial Sequence
  Description of Artificial Sequence: Synthetic oligonucleotide
ucauaggaggcuccagcc

SEQ ID NO: 63592 - RNA, 18 nt, Artificial Sequence
  Description of Artificial Sequence: Synthetic oligonucleotide
cucccucauaggaggcuc

SEQ ID NO: 63593 - RNA, 18 nt, Artificial Sequence
  Description of Artificial Sequence: Synthetic oligonucleotide
agcaacucccucauagga

SEQ ID NO: 63594 - RNA, 18 nt, Artificial Sequence
  Description of Artificial Sequence: Synthetic oligonucleotide
uuaacagcaacucccuca

SEQ ID NO: 63595 - RNA, 18 nt, Artificial Sequence
  Description of Artificial Sequence: Synthetic oligonucleotide
agucauuaacagcaacuc

SEQ ID NO: 63596 - RNA, 18 nt, Artificial Sequence
  Description of Artificial Sequence: Synthetic oligonucleotide
uauacagucauuaacagc

SEQ ID NO: 63597 - RNA, 18 nt, Artificial Sequence
  Description of Artificial Sequence: Synthetic oligonucleotide
cucucuauacagucauua

SEQ ID NO: 63598 - RNA, 18 nt, Artificial Sequence
  Description of Artificial Sequence: Synthetic oligonucleotide
gcccacucucuauacagu

SEQ ID NO: 63599 - RNA, 18 nt, Artificial Sequence
  Description of Artificial Sequence: Synthetic oligonucleotide
cuggcgcccacucucuau

SEQ ID NO: 63600 - RNA, 18 nt, Artificial Sequence
  Description of Artificial Sequence: Synthetic oligonucleotide
gcugccuggcgcccacuc

SEQ ID NO: 63601 - RNA, 18 nt, Artificial Sequence
  Description of Artificial Sequence: Synthetic oligonucleotide
ugacugcugccuggcgcc

SEQ ID NO: 63602 - RNA, 18 nt, Artificial Sequence
  Description of Artificial Sequence: Synthetic oligonucleotide
gacacugacugcugccug

SEQ ID NO: 63603 - RNA, 18 nt, Artificial Sequence
  Description of Artificial Sequence: Synthetic oligonucleotide
cccaggacacugacugcu

SEQ ID NO: 63604 - RNA, 18 nt, Artificial Sequence
  Description of Artificial Sequence: Synthetic oligonucleotide
cugugcccaggacacuga

SEQ ID NO: 63605 - RNA, 18 nt, Artificial Sequence
  Description of Artificial Sequence: Synthetic oligonucleotide
agguucugugcccaggac

SEQ ID NO: 63606 - RNA, 18 nt, Artificial Sequence
  Description of Artificial Sequence: Synthetic oligonucleotide
cuguuagguucugugccc

SEQ ID NO: 63607 - RNA, 18 nt, Artificial Sequence
  Description of Artificial Sequence: Synthetic oligonucleotide
aucagcuguuagguucug

SEQ ID NO: 63608 - RNA, 18 nt, Artificial Sequence
  Description of Artificial Sequence: Synthetic oligonucleotide
gggaucagcuguuagguu

SEQ ID NO: 63609 - RNA, 18 nt, Artificial Sequence
  Description of Artificial Sequence: Synthetic oligonucleotide
ucaugaaugagaguuggg

SEQ ID NO: 63610 - RNA, 18 nt, Artificial Sequence
  Description of Artificial Sequence: Synthetic oligonucleotide
uauuuucaugaaugagag

SEQ ID NO: 63611 - RNA, 18 nt, Artificial Sequence
  Description of Artificial Sequence: Synthetic oligonucleotide
auuuuuauuuucaugaau

SEQ ID NO: 63612 - RNA, 18 nt, Artificial Sequence
  Description of Artificial Sequence: Synthetic oligonucleotide
cagcaauuuuuauuuuca

SEQ ID NO: 63613 - RNA, 18 nt, Artificial Sequence
  Description of Artificial Sequence: Synthetic oligonucleotide
agcuccagcaauuuuuau

SEQ ID NO: 63614 - RNA, 18 nt, Artificial Sequence
  Description of Artificial Sequence: Synthetic oligonucleotide
caagccaagcucagaaac

SEQ ID NO: 63615 - RNA, 18 nt, Artificial Sequence
  Description of Artificial Sequence: Synthetic oligonucleotide
gaauccaagccaagcuca

SEQ ID NO: 63616 - RNA, 18 nt, Artificial Sequence
  Description of Artificial Sequence: Synthetic oligonucleotide
cuucugaauccaagccaa

SEQ ID NO: 63617 - RNA, 18 nt, Artificial Sequence
  Description of Artificial Sequence: Synthetic oligonucleotide
cagcacuucugaauccaa

SEQ ID NO: 63618 - RNA, 18 nt, Artificial Sequence
  Description of Artificial Sequence: Synthetic oligonucleotide
acaggcagcacuucugaa

SEQ ID NO: 63619 - RNA, 18 nt, Artificial Sequence
  Description of Artificial Sequence: Synthetic oligonucleotide
cccggacaggcagcacuu

SEQ ID NO: 63620 - RNA, 18 nt, Artificial Sequence
  Description of Artificial Sequence: Synthetic oligonucleotide
gucuccccggacaggcag

SEQ ID NO: 63621 - RNA, 18 nt, Artificial Sequence
  Description of Artificial Sequence: Synthetic oligonucleotide
ggguggucuccccggaca

SEQ ID NO: 63622 - RNA, 18 nt, Artificial Sequence
  Description of Artificial Sequence: Synthetic oligonucleotide
cagcuggguggucucccc

SEQ ID NO: 63623 - RNA, 18 nt, Artificial Sequence
  Description of Artificial Sequence: Synthetic oligonucleotide
cugggcagcugggugguc

SEQ ID NO: 63624 - RNA, 18 nt, Artificial Sequence
  Description of Artificial Sequence: Synthetic oligonucleotide
cuguucugggcagcuggg

SEQ ID NO: 63625 - RNA, 18 nt, Artificial Sequence
  Description of Artificial Sequence: Synthetic oligonucleotide
ggaaccuguucugggcag

SEQ ID NO: 63626 - RNA, 18 nt, Artificial Sequence
  Description of Artificial Sequence: Synthetic oligonucleotide
guagaggaaccuguucug

SEQ ID NO: 63627 - RNA, 18 nt, Artificial Sequence
  Description of Artificial Sequence: Synthetic oligonucleotide
cccacguagaggaaccug

SEQ ID NO: 63628 - RNA, 18 nt, Artificial Sequence
  Description of Artificial Sequence: Synthetic oligonucleotide
caccgcccacguagagga

SEQ ID NO: 63629 - RNA, 18 nt, Artificial Sequence
  Description of Artificial Sequence: Synthetic oligonucleotide
cagggcaccgcccacgua

SEQ ID NO: 63630 - RNA, 18 nt, Artificial Sequence
  Description of Artificial Sequence: Synthetic oligonucleotide
gcaugcagggcaccgccc

SEQ ID NO: 63631 - RNA, 18 nt, Artificial Sequence
  Description of Artificial Sequence: Synthetic oligonucleotide
guagggcaugcagggcac

SEQ ID NO: 63632 - RNA, 18 nt, Artificial Sequence
  Description of Artificial Sequence: Synthetic oligonucleotide
aguggguagggcaugcag

SEQ ID NO: 63633 - RNA, 18 nt, Artificial Sequence
  Description of Artificial Sequence: Synthetic oligonucleotide
aggccaguggguagggca

SEQ ID NO: 63634 - RNA, 18 nt, Artificial Sequence
  Description of Artificial Sequence: Synthetic oligonucleotide
aggagcggaggugcuggu

SEQ ID NO: 63635 - RNA, 18 nt, Artificial Sequence
  Description of Artificial Sequence: Synthetic oligonucleotide
guaaaaggagcggaggug

SEQ ID NO: 63636 - RNA, 18 nt, Artificial Sequence
  Description of Artificial Sequence: Synthetic oligonucleotide
gcacaguaaaaggagcgg

SEQ ID NO: 63637 - RNA, 18 nt, Artificial Sequence
  Description of Artificial Sequence: Synthetic oligonucleotide
ugagggcacaguaaaagg

SEQ ID NO: 63638 - RNA, 18 nt, Artificial Sequence
  Description of Artificial Sequence: Synthetic oligonucleotide
gaggaugagggcacagua

SEQ ID NO: 63639 - RNA, 18 nt, Artificial Sequence
  Description of Artificial Sequence: Synthetic oligonucleotide
cauaugaggaugagggca

SEQ ID NO: 63640 - RNA, 18 nt, Artificial Sequence
  Description of Artificial Sequence: Synthetic oligonucleotide
gaaggcauaugaggauga

SEQ ID NO: 63641 - RNA, 18 nt, Artificial Sequence
  Description of Artificial Sequence: Synthetic oligonucleotide
aaauggaaggcauaugag

SEQ ID NO: 63642 - RNA, 18 nt, Artificial Sequence
  Description of Artificial Sequence: Synthetic oligonucleotide
gaaagaaauggaaggcau

SEQ ID NO: 63643 - RNA, 18 nt, Artificial Sequence
  Description of Artificial Sequence: Synthetic oligonucleotide
aagaagaaagaaauggaa

SEQ ID NO: 63644 - RNA, 18 nt, Artificial Sequence
  Description of Artificial Sequence: Synthetic oligonucleotide
aagaaaagaagaaagaaa

SEQ ID NO: 63645 - RNA, 18 nt, Artificial Sequence
  Description of Artificial Sequence: Synthetic oligonucleotide
aaaaaaagaaaagaagaa

SEQ ID NO: 63646 - RNA, 18 nt, Artificial Sequence
  Description of Artificial Sequence: Synthetic oligonucleotide
aaaaaaaaaaaagaaaag

SEQ ID NO: 63647 - RNA, 18 nt, Artificial Sequence
  Description of Artificial Sequence: Synthetic oligonucleotide
aaaaaaaaaaaaaaaaag

SEQ ID NO: 63648 - RNA, 18 nt, Artificial Sequence
  Description of Artificial Sequence: Synthetic oligonucleotide
aaaaaaaaaaaaaaaaaa

SEQ ID NO: 63649 - RNA, 18 nt, Artificial Sequence
  Description of Artificial Sequence: Synthetic oligonucleotide
aaaaaaaaaaaaaaaaaa

SEQ ID NO: 63650 - RNA, 18 nt, Artificial Sequence
  Description of Artificial Sequence: Synthetic oligonucleotide
gucucaaaaaaaaaaaaa

SEQ ID NO: 63651 - RNA, 18 nt, Artificial Sequence
  Description of Artificial Sequence: Synthetic oligonucleotide
acuccgucucaaaaaaaa

SEQ ID NO: 63652 - RNA, 18 nt, Artificial Sequence
  Description of Artificial Sequence: Synthetic oligonucleotide
gcgauacuccgucucaaa

SEQ ID NO: 63653 - RNA, 18 nt, Artificial Sequence
  Description of Artificial Sequence: Synthetic oligonucleotide
cgagagcgauacuccguc

SEQ ID NO: 63654 - RNA, 18 nt, Artificial Sequence
  Description of Artificial Sequence: Synthetic oligonucleotide
cugggcgagagcgauacu

SEQ ID NO: 63655 - RNA, 18 nt, Artificial Sequence
  Description of Artificial Sequence: Synthetic oligonucleotide
ccauccugggcgagagcg

SEQ ID NO: 63656 - RNA, 18 nt, Artificial Sequence
  Description of Artificial Sequence: Synthetic oligonucleotide
gcacuccauccugggcga

SEQ ID NO: 63657 - RNA, 18 nt, Artificial Sequence
  Description of Artificial Sequence: Synthetic oligonucleotide
ccauugcacuccauccug

SEQ ID NO: 63658 - RNA, 18 nt, Artificial Sequence
  Description of Artificial Sequence: Synthetic oligonucleotide
ucgcgccauugcacucca

SEQ ID NO: 63659 - RNA, 18 nt, Artificial Sequence
  Description of Artificial Sequence: Synthetic oligonucleotide
caagaucgcgccauugca

SEQ ID NO: 63660 - RNA, 18 nt, Artificial Sequence
  Description of Artificial Sequence: Synthetic oligonucleotide
ugagccaagaucgcgcca

SEQ ID NO: 63661 - RNA, 18 nt, Artificial Sequence
  Description of Artificial Sequence: Synthetic oligonucleotide
ugcagugagccaagaucg

SEQ ID NO: 63662 - RNA, 18 nt, Artificial Sequence
  Description of Artificial Sequence: Synthetic oligonucleotide
gaaguugcagugagccaa

SEQ ID NO: 63663 - RNA, 18 nt, Artificial Sequence
  Description of Artificial Sequence: Synthetic oligonucleotide
aggcggaaguugcaguga

SEQ ID NO: 63664 - RNA, 18 nt, Artificial Sequence
  Description of Artificial Sequence: Synthetic oligonucleotide
ccgaaaggcggaaguugc

SEQ ID NO: 63665 - RNA, 18 nt, Artificial Sequence
  Description of Artificial Sequence: Synthetic oligonucleotide
ugaacccgaaaggcggaa

SEQ ID NO: 63666 - RNA, 18 nt, Artificial Sequence
  Description of Artificial Sequence: Synthetic oligonucleotide
ucgcuugaacccgaaagg

SEQ ID NO: 63667 - RNA, 18 nt, Artificial Sequence
  Description of Artificial Sequence: Synthetic oligonucleotide
gagaaucgcuugaacccg

SEQ ID NO: 63668 - RNA, 18 nt, Artificial Sequence
  Description of Artificial Sequence: Synthetic oligonucleotide
ggcaggagaaucgcuuga

SEQ ID NO: 63669 - RNA, 18 nt, Artificial Sequence
  Description of Artificial Sequence: Synthetic oligonucleotide
gcugaggcaggagaaucg

SEQ ID NO: 63670 - RNA, 18 nt, Artificial Sequence
  Description of Artificial Sequence: Synthetic oligonucleotide
gggaggcugaggcaggag

SEQ ID NO: 63671 - RNA, 18 nt, Artificial Sequence
  Description of Artificial Sequence: Synthetic oligonucleotide
uacucgggaggcugaggc

SEQ ID NO: 63672 - RNA, 18 nt, Artificial Sequence
  Description of Artificial Sequence: Synthetic oligonucleotide
ccagcuacucgggaggcu

SEQ ID NO: 63673 - RNA, 18 nt, Artificial Sequence
  Description of Artificial Sequence: Synthetic oligonucleotide
uagucccagcuacucggg

SEQ ID NO: 63674 - RNA, 18 nt, Artificial Sequence
  Description of Artificial Sequence: Synthetic oligonucleotide
accuguagucccagcuac

SEQ ID NO: 63675 - RNA, 18 nt, Artificial Sequence
  Description of Artificial Sequence: Synthetic oligonucleotide
uaggcaccuguaguccca

SEQ ID NO: 63676 - RNA, 18 nt, Artificial Sequence
  Description of Artificial Sequence: Synthetic oligonucleotide
ggugguaggcaccuguag

SEQ ID NO: 63677 - RNA, 18 nt, Artificial Sequence
  Description of Artificial Sequence: Synthetic oligonucleotide
gacguggugguaggcacc

SEQ ID NO: 63678 - RNA, 18 nt, Artificial Sequence
  Description of Artificial Sequence: Synthetic oligonucleotide
agccagacguggugguag

SEQ ID NO: 63679 - RNA, 18 nt, Artificial Sequence
  Description of Artificial Sequence: Synthetic oligonucleotide
aaacuagccagacguggu

SEQ ID NO: 63680 - RNA, 18 nt, Artificial Sequence
  Description of Artificial Sequence: Synthetic oligonucleotide
uacaaaaacuagccagac

SEQ ID NO: 63681 - RNA, 18 nt, Artificial Sequence
  Description of Artificial Sequence: Synthetic oligonucleotide
aaaaauacaaaaacuagc

SEQ ID NO: 63682 - RNA, 18 nt, Artificial Sequence
  Description of Artificial Sequence: Synthetic oligonucleotide
cuacuaaaaauacaaaaa

SEQ ID NO: 63683 - RNA, 18 nt, Artificial Sequence
  Description of Artificial Sequence: Synthetic oligonucleotide
caucucuacuaaaaauac

SEQ ID NO: 63684 - RNA, 18 nt, Artificial Sequence
  Description of Artificial Sequence: Synthetic oligonucleotide
aaccccaucucuacuaaa

SEQ ID NO: 63685 - RNA, 18 nt, Artificial Sequence
  Description of Artificial Sequence: Synthetic oligonucleotide
ggugaaaccccaucucua

SEQ ID NO: 63686 - RNA, 18 nt, Artificial Sequence
  Description of Artificial Sequence: Synthetic oligonucleotide
aauauggugaaaccccau

SEQ ID NO: 63687 - RNA, 18 nt, Artificial Sequence
  Description of Artificial Sequence: Synthetic oligonucleotide
cuagccagacgugguggu

SEQ ID NO: 63688 - RNA, 18 nt, Artificial Sequence
  Description of Artificial Sequence: Synthetic oligonucleotide
aaaaacuagccagacgug

SEQ ID NO: 63689 - RNA, 18 nt, Artificial Sequence
  Description of Artificial Sequence: Synthetic oligonucleotide
aauacaaaaacuagccag

SEQ ID NO: 63690 - RNA, 18 nt, Artificial Sequence
  Description of Artificial Sequence: Synthetic oligonucleotide
cuaaaaauacaaaaacua

SEQ ID NO: 63691 - RNA, 18 nt, Artificial Sequence
  Description of Artificial Sequence: Synthetic oligonucleotide
cucuacuaaaaauacaaa

SEQ ID NO: 63692 - RNA, 18 nt, Artificial Sequence
  Description of Artificial Sequence: Synthetic oligonucleotide
cccaucucuacuaaaaau

SEQ ID NO: 63693 - RNA, 18 nt, Artificial Sequence
  Description of Artificial Sequence: Synthetic oligonucleotide
gaaaccccaucucuacua

SEQ ID NO: 63694 - RNA, 18 nt, Artificial Sequence
  Description of Artificial Sequence: Synthetic oligonucleotide
auggugaaaccccaucuc

SEQ ID NO: 63695 - RNA, 18 nt, Artificial Sequence
  Description of Artificial Sequence: Synthetic oligonucleotide
ccaauauggugaaacccc

SEQ ID NO: 63696 - RNA, 18 nt, Artificial Sequence
  Description of Artificial Sequence: Synthetic oligonucleotide
ccuggccaauauggugaa

SEQ ID NO: 63697 - RNA, 18 nt, Artificial Sequence
  Description of Artificial Sequence: Synthetic oligonucleotide
accagccuggccaauaug

SEQ ID NO: 63698 - RNA, 18 nt, Artificial Sequence
  Description of Artificial Sequence: Synthetic oligonucleotide
ucaagaccagccuggcca

SEQ ID NO: 63699 - RNA, 18 nt, Artificial Sequence
  Description of Artificial Sequence: Synthetic oligonucleotide
ggaguucaagaccagccu

SEQ ID NO: 63700 - RNA, 18 nt, Artificial Sequence
  Description of Artificial Sequence: Synthetic oligonucleotide
ggucaggaguucaagacc

SEQ ID NO: 63701 - RNA, 18 nt, Artificial Sequence
  Description of Artificial Sequence: Synthetic oligonucleotide
cacaaggucaggaguuca

SEQ ID NO: 63702 - RNA, 18 nt, Artificial Sequence
  Description of Artificial Sequence: Synthetic oligonucleotide
cggaucacaaggucagga

SEQ ID NO: 63703 - RNA, 18 nt, Artificial Sequence
  Description of Artificial Sequence: Synthetic oligonucleotide
gcgggcggaucacaaggu

SEQ ID NO: 63704 - RNA, 18 nt, Artificial Sequence
  Description of Artificial Sequence: Synthetic oligonucleotide
ccgaggcgggcggaucac

SEQ ID NO: 63705 - RNA, 18 nt, Artificial Sequence
  Description of Artificial Sequence: Synthetic oligonucleotide
gcaggccgaggcgggcgg

SEQ ID NO: 63706 - RNA, 18 nt, Artificial Sequence
  Description of Artificial Sequence: Synthetic oligonucleotide
cuuuggcaggccgaggcg

SEQ ID NO: 63707 - RNA, 18 nt, Artificial Sequence
  Description of Artificial Sequence: Synthetic oligonucleotide
cagcacuuuggcaggccg

SEQ ID NO: 63708 - RNA, 18 nt, Artificial Sequence
  Description of Artificial Sequence: Synthetic oligonucleotide
aaucccagcacuuuggca

SEQ ID NO: 63709 - RNA, 18 nt, Artificial Sequence
  Description of Artificial Sequence: Synthetic oligonucleotide
ccuguaaucccagcacuu

SEQ ID NO: 63710 - RNA, 18 nt, Artificial Sequence
  Description of Artificial Sequence: Synthetic oligonucleotide
ucacgccuguaaucccag

SEQ ID NO: 63711 - RNA, 18 nt, Artificial Sequence
  Description of Artificial Sequence: Synthetic oligonucleotide
guggcucacgccuguaau

SEQ ID NO: 63712 - RNA, 18 nt, Artificial Sequence
  Description of Artificial Sequence: Synthetic oligonucleotide
gcgugguggcucacgccu

SEQ ID NO: 63713 - RNA, 18 nt, Artificial Sequence
  Description of Artificial Sequence: Synthetic oligonucleotide
gucgggcgugguggcuca

SEQ ID NO: 63714 - RNA, 18 nt, Artificial Sequence
  Description of Artificial Sequence: Synthetic oligonucleotide
ggcaggucgggcguggug

SEQ ID NO: 63715 - RNA, 18 nt, Artificial Sequence
  Description of Artificial Sequence: Synthetic oligonucleotide
uggaaggcaggucgggcg

SEQ ID NO: 63716 - RNA, 18 nt, Artificial Sequence
  Description of Artificial Sequence: Synthetic oligonucleotide
agaaauggaaggcagguc

SEQ ID NO: 63717 - RNA, 18 nt, Artificial Sequence
  Description of Artificial Sequence: Synthetic oligonucleotide
gaugaagaaauggaaggc

SEQ ID NO: 63718 - RNA, 18 nt, Artificial Sequence
  Description of Artificial Sequence: Synthetic oligonucleotide
agggagaugaagaaaugg

SEQ ID NO: 63719 - RNA, 18 nt, Artificial Sequence
  Description of Artificial Sequence: Synthetic oligonucleotide
cugacagggagaugaaga

SEQ ID NO: 63720 - RNA, 18 nt, Artificial Sequence
  Description of Artificial Sequence: Synthetic oligonucleotide
gaaggcugacagggagau

SEQ ID NO: 63721 - RNA, 18 nt, Artificial Sequence
  Description of Artificial Sequence: Synthetic oligonucleotide
gcugggaaggcugacagg

SEQ ID NO: 63722 - RNA, 18 nt, Artificial Sequence
  Description of Artificial Sequence: Synthetic oligonucleotide
cuuuugcugggaaggcug

SEQ ID NO: 63723 - RNA, 18 nt, Artificial Sequence
  Description of Artificial Sequence: Synthetic oligonucleotide
gcuuccuuuugcugggaa

SEQ ID NO: 63724 - RNA, 18 nt, Artificial Sequence
  Description of Artificial Sequence: Synthetic oligonucleotide
auuuggcuuccuuuugcu

SEQ ID NO: 63725 - RNA, 18 nt, Artificial Sequence
  Description of Artificial Sequence: Synthetic oligonucleotide
cacucauuuggcuuccuu

SEQ ID NO: 63726 - RNA, 18 nt, Artificial Sequence
  Description of Artificial Sequence: Synthetic oligonucleotide
auuuccacucauuuggcu

SEQ ID NO: 63727 - RNA, 18 nt, Artificial Sequence
  Description of Artificial Sequence: Synthetic oligonucleotide
gggucauuuccacucauu

SEQ ID NO: 63728 - RNA, 18 nt, Artificial Sequence
  Description of Artificial Sequence: Synthetic oligonucleotide
ccagcuccaggcgcuggg

SEQ ID NO: 63729 - RNA, 18 nt, Artificial Sequence
  Description of Artificial Sequence: Synthetic oligonucleotide
ccccagcuccaggcgcug

SEQ ID NO: 63730 - RNA, 18 nt, Artificial Sequence
  Description of Artificial Sequence: Synthetic oligonucleotide
uaccuccccagcuccagg

SEQ ID NO: 63731 - RNA, 18 nt, Artificial Sequence
  Description of Artificial Sequence: Synthetic oligonucleotide
ugacauaccuccccagcu

SEQ ID NO: 63732 - RNA, 18 nt, Artificial Sequence
  Description of Artificial Sequence: Synthetic oligonucleotide
gcuccugacauaccuccc

SEQ ID NO: 63733 - RNA, 18 nt, Artificial Sequence
  Description of Artificial Sequence: Synthetic oligonucleotide
gggaagcuccugacauac

SEQ ID NO: 63734 - RNA, 18 nt, Artificial Sequence
  Description of Artificial Sequence: Synthetic oligonucleotide
ugaagggcggaguagccc

SEQ ID NO: 63735 - RNA, 18 nt, Artificial Sequence
  Description of Artificial Sequence: Synthetic oligonucleotide
gggugaagggcggaguag

SEQ ID NO: 63736 - RNA, 18 nt, Artificial Sequence
  Description of Artificial Sequence: Synthetic oligonucleotide
cagagguuuggagaaggg

SEQ ID NO: 63737 - RNA, 18 nt, Artificial Sequence
  Description of Artificial Sequence: Synthetic oligonucleotide
caaaacagagguuuggag

SEQ ID NO: 63738 - RNA, 18 nt, Artificial Sequence
  Description of Artificial Sequence: Synthetic oligonucleotide
cagcccaaaacagagguu

SEQ ID NO: 63739 - RNA, 18 nt, Artificial Sequence
  Description of Artificial Sequence: Synthetic oligonucleotide
cagcccagcccaaaacag

SEQ ID NO: 63740 - RNA, 18 nt, Artificial Sequence
  Description of Artificial Sequence: Synthetic oligonucleotide
ucccucagcccagcccaa

SEQ ID NO: 63741 - RNA, 18 nt, Artificial Sequence
  Description of Artificial Sequence: Synthetic oligonucleotide
ucagcucccucagcccag

SEQ ID NO: 63742 - RNA, 18 nt, Artificial Sequence
  Description of Artificial Sequence: Synthetic oligonucleotide
cuuggucagcucccucag

SEQ ID NO: 63743 - RNA, 18 nt, Artificial Sequence
  Description of Artificial Sequence: Synthetic oligonucleotide
gggcuuggucagcucccu

SEQ ID NO: 63744 - RNA, 18 nt, Artificial Sequence
  Description of Artificial Sequence: Synthetic oligonucleotide
caggcucuuugccccggg

SEQ ID NO: 63745 - RNA, 18 nt, Artificial Sequence
  Description of Artificial Sequence: Synthetic oligonucleotide
cucaucaggcucuuugcc

SEQ ID NO: 63746 - RNA, 18 nt, Artificial Sequence
  Description of Artificial Sequence: Synthetic oligonucleotide
acagucucaucaggcucu

SEQ ID NO: 63747 - RNA, 18 nt, Artificial Sequence
  Description of Artificial Sequence: Synthetic oligonucleotide
ugugcacagucucaucag

SEQ ID NO: 63748 - RNA, 18 nt, Artificial Sequence
  Description of Artificial Sequence: Synthetic oligonucleotide
aaaacugugcacagucuc

SEQ ID NO: 63749 - RNA, 18 nt, Artificial Sequence
  Description of Artificial Sequence: Synthetic oligonucleotide
ugggcaaaacugugcaca

SEQ ID NO: 63750 - RNA, 18 nt, Artificial Sequence
  Description of Artificial Sequence: Synthetic oligonucleotide
ggcgcugggcaaaacugu

SEQ ID NO: 63751 - RNA, 18 nt, Artificial Sequence
  Description of Artificial Sequence: Synthetic oligonucleotide
aaggcggcgcugggcaaa

SEQ ID NO: 63752 - RNA, 18 nt, Artificial Sequence
  Description of Artificial Sequence: Synthetic oligonucleotide
gguccaaggcggcgcugg

SEQ ID NO: 63753 - RNA, 18 nt, Artificial Sequence
  Description of Artificial Sequence: Synthetic oligonucleotide
gcugucccuuagagauac

SEQ ID NO: 63754 - RNA, 18 nt, Artificial Sequence
  Description of Artificial Sequence: Synthetic oligonucleotide
agacugcugucccuuaga

SEQ ID NO: 63755 - RNA, 18 nt, Artificial Sequence
  Description of Artificial Sequence: Synthetic oligonucleotide
ccuccagacugcuguccc

SEQ ID NO: 63756 - RNA, 18 nt, Artificial Sequence
  Description of Artificial Sequence: Synthetic oligonucleotide
gucagccuccagacugcu

SEQ ID NO: 63757 - RNA, 18 nt, Artificial Sequence
  Description of Artificial Sequence: Synthetic oligonucleotide
acguggucagccuccaga

SEQ ID NO: 63758 - RNA, 18 nt, Artificial Sequence
  Description of Artificial Sequence: Synthetic oligonucleotide
uaauaacguggucagccu

SEQ ID NO: 63759 - RNA, 18 nt, Artificial Sequence
  Description of Artificial Sequence: Synthetic oligonucleotide
ggcacuaauaacgugguc

SEQ ID NO: 63760 - RNA, 18 nt, Artificial Sequence
  Description of Artificial Sequence: Synthetic oligonucleotide
ggaauggcacuaauaacg

SEQ ID NO: 63761 - RNA, 18 nt, Artificial Sequence
  Description of Artificial Sequence: Synthetic oligonucleotide
aagcuggaauggcacuaa

SEQ ID NO: 63762 - RNA, 18 nt, Artificial Sequence
  Description of Artificial Sequence: Synthetic oligonucleotide
gggaagguggcuauucca

SEQ ID NO: 63763 - RNA, 18 nt, Artificial Sequence
  Description of Artificial Sequence: Synthetic oligonucleotide
ugcuucucacugguaggg

SEQ ID NO: 63764 - RNA, 18 nt, Artificial Sequence
  Description of Artificial Sequence: Synthetic oligonucleotide
gcuuuugcuucucacugg

SEQ ID NO: 63765 - RNA, 18 nt, Artificial Sequence
  Description of Artificial Sequence: Synthetic oligonucleotide
guauagcuuuugcuucuc

SEQ ID NO: 63766 - RNA, 18 nt, Artificial Sequence
  Description of Artificial Sequence: Synthetic oligonucleotide
ggaagguauagcuuuugc

SEQ ID NO: 63767 - RNA, 18 nt, Artificial Sequence
  Description of Artificial Sequence: Synthetic oligonucleotide
acccaggaagguauagcu

SEQ ID NO: 63768 - RNA, 18 nt, Artificial Sequence
  Description of Artificial Sequence: Synthetic oligonucleotide
ugcugacccaggaaggua

SEQ ID NO: 63769 - RNA, 18 nt, Artificial Sequence
  Description of Artificial Sequence: Synthetic oligonucleotide
gguccugcugacccagga

SEQ ID NO: 63770 - RNA, 18 nt, Artificial Sequence
  Description of Artificial Sequence: Synthetic oligonucleotide
ggugugguccugcugacc

SEQ ID NO: 63771 - RNA, 18 nt, Artificial Sequence
  Description of Artificial Sequence: Synthetic oligonucleotide
ggcauggugugguccugc

SEQ ID NO: 63772 - RNA, 18 nt, Artificial Sequence
  Description of Artificial Sequence: Synthetic oligonucleotide
gggcauggugugguccug

SEQ ID NO: 63773 - RNA, 18 nt, Artificial Sequence
  Description of Artificial Sequence: Synthetic oligonucleotide
gagaugaccaguucaggg

SEQ ID NO: 63774 - RNA, 18 nt, Artificial Sequence
  Description of Artificial Sequence: Synthetic oligonucleotide
ccauagagaugaccaguu

SEQ ID NO: 63775 - RNA, 18 nt, Artificial Sequence
  Description of Artificial Sequence: Synthetic oligonucleotide
gacucccauagagaugac

SEQ ID NO: 63776 - RNA, 18 nt, Artificial Sequence
  Description of Artificial Sequence: Synthetic oligonucleotide
gauuagacucccauagag

SEQ ID NO: 63777 - RNA, 18 nt, Artificial Sequence
  Description of Artificial Sequence: Synthetic oligonucleotide
ugguccugcugacccagg

SEQ ID NO: 63778 - RNA, 18 nt, Artificial Sequence
  Description of Artificial Sequence: Synthetic oligonucleotide
uggugugguccugcugac

SEQ ID NO: 63779 - RNA, 18 nt, Artificial Sequence
  Description of Artificial Sequence: Synthetic oligonucleotide
gggcauggugugguccug

SEQ ID NO: 63780 - RNA, 18 nt, Artificial Sequence
  Description of Artificial Sequence: Synthetic oligonucleotide
gagaugaccaguucaggg

SEQ ID NO: 63781 - RNA, 18 nt, Artificial Sequence
  Description of Artificial Sequence: Synthetic oligonucleotide
auagagaugaccaguuca

SEQ ID NO: 63782 - RNA, 18 nt, Artificial Sequence
  Description of Artificial Sequence: Synthetic oligonucleotide
cucccauagagaugacca

SEQ ID NO: 63783 - RNA, 18 nt, Artificial Sequence
  Description of Artificial Sequence: Synthetic oligonucleotide
uuagacucccauagagau

SEQ ID NO: 63784 - RNA, 18 nt, Artificial Sequence
  Description of Artificial Sequence: Synthetic oligonucleotide
ugggauuagacucccaua

SEQ ID NO: 63785 - RNA, 18 nt, Artificial Sequence
  Description of Artificial Sequence: Synthetic oligonucleotide
cucuuugggauuagacuc

SEQ ID NO: 63786 - RNA, 18 nt, Artificial Sequence
  Description of Artificial Sequence: Synthetic oligonucleotide
caguccucuuugggauua

SEQ ID NO: 63787 - RNA, 18 nt, Artificial Sequence
  Description of Artificial Sequence: Synthetic oligonucleotide
guugucaguccucuuugg

SEQ ID NO: 63788 - RNA, 18 nt, Artificial Sequence
  Description of Artificial Sequence: Synthetic oligonucleotide
uuacaguugucaguccuc

SEQ ID NO: 63789 - RNA, 18 nt, Artificial Sequence
  Description of Artificial Sequence: Synthetic oligonucleotide
ucccauuacaguugucag

SEQ ID NO: 63790 - RNA, 18 nt, Artificial Sequence
  Description of Artificial Sequence: Synthetic oligonucleotide
ggcauucccauuacaguu

SEQ ID NO: 63791 - RNA, 18 nt, Artificial Sequence
  Description of Artificial Sequence: Synthetic oligonucleotide
cagaaggcauucccauua

SEQ ID NO: 63792 - RNA, 18 nt, Artificial Sequence
  Description of Artificial Sequence: Synthetic oligonucleotide
ugacucagaaggcauucc

SEQ ID NO: 63793 - RNA, 18 nt, Artificial Sequence
  Description of Artificial Sequence: Synthetic oligonucleotide
aggccugacucagaaggc

SEQ ID NO: 63794 - RNA, 18 nt, Artificial Sequence
  Description of Artificial Sequence: Synthetic oligonucleotide
gggagcagcucacugagc

SEQ ID NO: 63795 - RNA, 18 nt, Artificial Sequence
  Description of Artificial Sequence: Synthetic oligonucleotide
cagcagggagcagcucac

SEQ ID NO: 63796 - RNA, 18 nt, Artificial Sequence
  Description of Artificial Sequence: Synthetic oligonucleotide
agccucagcagggagcag

SEQ ID NO: 63797 - RNA, 18 nt, Artificial Sequence
  Description of Artificial Sequence: Synthetic oligonucleotide
gggcagccucagcaggga

SEQ ID NO: 63798 - RNA, 18 nt, Artificial Sequence
  Description of Artificial Sequence: Synthetic oligonucleotide
agggcacgagccagaggg

SEQ ID NO: 63799 - RNA, 18 nt, Artificial Sequence
  Description of Artificial Sequence: Synthetic oligonucleotide
cacucagggcacgagcca

SEQ ID NO: 63800 - RNA, 18 nt, Artificial Sequence
  Description of Artificial Sequence: Synthetic oligonucleotide
gauggcacucagggcacg

SEQ ID NO: 63801 - RNA, 18 nt, Artificial Sequence
  Description of Artificial Sequence: Synthetic oligonucleotide
gcagugauggcacucagg

SEQ ID NO: 63802 - RNA, 18 nt, Artificial Sequence
  Description of Artificial Sequence: Synthetic oligonucleotide
acacugcagugauggcac

SEQ ID NO: 63803 - RNA, 18 nt, Artificial Sequence
  Description of Artificial Sequence: Synthetic oligonucleotide
uacagacacugcagugau

SEQ ID NO: 63804 - RNA, 18 nt, Artificial Sequence
  Description of Artificial Sequence: Synthetic oligonucleotide
acagcuacagacacugca

SEQ ID NO: 63805 - RNA, 18 nt, Artificial Sequence
  Description of Artificial Sequence: Synthetic oligonucleotide
ucaccacagcuacagaca

SEQ ID NO: 63806 - RNA, 18 nt, Artificial Sequence
  Description of Artificial Sequence: Synthetic oligonucleotide
cagauucaccacagcuac

SEQ ID NO: 63807 - RNA, 18 nt, Artificial Sequence
  Description of Artificial Sequence: Synthetic oligonucleotide
uacugcagauucaccaca

SEQ ID NO: 63808 - RNA, 18 nt, Artificial Sequence
  Description of Artificial Sequence: Synthetic oligonucleotide
cuugguacugcagauuca

SEQ ID NO: 63809 - RNA, 18 nt, Artificial Sequence
  Description of Artificial Sequence: Synthetic oligonucleotide
ggcuccuugguacugcag

SEQ ID NO: 63810 - RNA, 18 nt, Artificial Sequence
  Description of Artificial Sequence: Synthetic oligonucleotide
agaugggcuccuugguac

SEQ ID NO: 63811 - RNA, 18 nt, Artificial Sequence
  Description of Artificial Sequence: Synthetic oligonucleotide
caggcagaugggcuccuu

SEQ ID NO: 63812 - RNA, 18 nt, Artificial Sequence
  Description of Artificial Sequence: Synthetic oligonucleotide
cuggacaggcagaugggc

SEQ ID NO: 63813 - RNA, 18 nt, Artificial Sequence
  Description of Artificial Sequence: Synthetic oligonucleotide
gggugaagggcggaguag

SEQ ID NO: 63814 - RNA, 18 nt, Artificial Sequence
  Description of Artificial Sequence: Synthetic oligonucleotide
cagagguuuggagaaggg

SEQ ID NO: 63815 - RNA, 18 nt, Artificial Sequence
  Description of Artificial Sequence: Synthetic oligonucleotide
aaacagagguuuggagaa

SEQ ID NO: 63816 - RNA, 18 nt, Artificial Sequence
  Description of Artificial Sequence: Synthetic oligonucleotide
gcccaaaacagagguuug

SEQ ID NO: 63817 - RNA, 18 nt, Artificial Sequence
  Description of Artificial Sequence: Synthetic oligonucleotide
gcccagcccaaaacagag

SEQ ID NO: 63818 - RNA, 18 nt, Artificial Sequence
  Description of Artificial Sequence: Synthetic oligonucleotide
ccucagcccagcccaaaa

SEQ ID NO: 63819 - RNA, 18 nt, Artificial Sequence
  Description of Artificial Sequence: Synthetic oligonucleotide
agcucccucagcccagcc

SEQ ID NO: 63820 - RNA, 18 nt, Artificial Sequence
  Description of Artificial Sequence: Synthetic oligonucleotide
uggucagcucccucagcc

SEQ ID NO: 63821 - RNA, 18 nt, Artificial Sequence
  Description of Artificial Sequence: Synthetic oligonucleotide
gggcuuggucagcucccu

SEQ ID NO: 63822 - RNA, 18 nt, Artificial Sequence
  Description of Artificial Sequence: Synthetic oligonucleotide
caggcucuuugccccggg

SEQ ID NO: 63823 - RNA, 18 nt, Artificial Sequence
  Description of Artificial Sequence: Synthetic oligonucleotide
ucaggcucuuugccccgg

SEQ ID NO: 63824 - RNA, 18 nt, Artificial Sequence
  Description of Artificial Sequence: Synthetic oligonucleotide
ucucaucaggcucuuugc

SEQ ID NO: 63825 - RNA, 18 nt, Artificial Sequence
  Description of Artificial Sequence: Synthetic oligonucleotide
cacagucucaucaggcuc

SEQ ID NO: 63826 - RNA, 18 nt, Artificial Sequence
  Description of Artificial Sequence: Synthetic oligonucleotide
cugugcacagucucauca

SEQ ID NO: 63827 - RNA, 18 nt, Artificial Sequence
  Description of Artificial Sequence: Synthetic oligonucleotide
caaaacugugcacagucu

SEQ ID NO: 63828 - RNA, 18 nt, Artificial Sequence
  Description of Artificial Sequence: Synthetic oligonucleotide
cugggcaaaacugugcac

SEQ ID NO: 63829 - RNA, 18 nt, Artificial Sequence
  Description of Artificial Sequence: Synthetic oligonucleotide
cggcgcugggcaaaacug

SEQ ID NO: 63830 - RNA, 18 nt, Artificial Sequence
  Description of Artificial Sequence: Synthetic oligonucleotide
caaggcggcgcugggcaa

SEQ ID NO: 63831 - RNA, 18 nt, Artificial Sequence
  Description of Artificial Sequence: Synthetic oligonucleotide
agguccaaggcggcgcug

SEQ ID NO: 63832 - RNA, 18 nt, Artificial Sequence
  Description of Artificial Sequence: Synthetic oligonucleotide
gggccucugggcaagugu

SEQ ID NO: 63833 - RNA, 18 nt, Artificial Sequence
  Description of Artificial Sequence: Synthetic oligonucleotide
ggagggaagagguuuggg

SEQ ID NO: 63834 - RNA, 18 nt, Artificial Sequence
  Description of Artificial Sequence: Synthetic oligonucleotide
guuuaggagggaagaggu

SEQ ID NO: 63835 - RNA, 18 nt, Artificial Sequence
  Description of Artificial Sequence: Synthetic oligonucleotide
agcugguuuaggagggaa

SEQ ID NO: 63836 - RNA, 18 nt, Artificial Sequence
  Description of Artificial Sequence: Synthetic oligonucleotide
ucugcagcugguuuagga

SEQ ID NO: 63837 - RNA, 18 nt, Artificial Sequence
  Description of Artificial Sequence: Synthetic oligonucleotide
ggagcucugcagcugguu

SEQ ID NO: 63838 - RNA, 18 nt, Artificial Sequence
  Description of Artificial Sequence: Synthetic oligonucleotide
aacagggagcucugcagc

SEQ ID NO: 63839 - RNA, 18 nt, Artificial Sequence
  Description of Artificial Sequence: Synthetic oligonucleotide
auuugaacagggagcucu

SEQ ID NO: 63840 - RNA, 18 nt, Artificial Sequence
  Description of Artificial Sequence: Synthetic oligonucleotide
gguagauuugaacaggga

SEQ ID NO: 63841 - RNA, 18 nt, Artificial Sequence
  Description of Artificial Sequence: Synthetic oligonucleotide
uaggugguagauuugaac

SEQ ID NO: 63842 - RNA, 18 nt, Artificial Sequence
  Description of Artificial Sequence: Synthetic oligonucleotide
gccccuaggugguagauu

SEQ ID NO: 63843 - RNA, 18 nt, Artificial Sequence
  Description of Artificial Sequence: Synthetic oligonucleotide
gaagagccccuagguggu

SEQ ID NO: 63844 - RNA, 18 nt, Artificial Sequence
  Description of Artificial Sequence: Synthetic oligonucleotide
auacagaagagccccuag

SEQ ID NO: 63845 - RNA, 18 nt, Artificial Sequence
  Description of Artificial Sequence: Synthetic oligonucleotide
aaaugauacagaagagcc

SEQ ID NO: 63846 - RNA, 18 nt, Artificial Sequence
  Description of Artificial Sequence: Synthetic oligonucleotide
uccccaaaugauacagaa

SEQ ID NO: 63847 - RNA, 18 nt, Artificial Sequence
  Description of Artificial Sequence: Synthetic oligonucleotide
gggcauccccaaaugaua

SEQ ID NO: 63848 - RNA, 18 nt, Artificial Sequence
  Description of Artificial Sequence: Synthetic oligonucleotide
gaagagggcauccccaaa

SEQ ID NO: 63849 - RNA, 18 nt, Artificial Sequence
  Description of Artificial Sequence: Synthetic oligonucleotide
gaagagaagagggcaucc

SEQ ID NO: 63850 - RNA, 18 nt, Artificial Sequence
  Description of Artificial Sequence: Synthetic oligonucleotide
gguaugaagagaagaggg

SEQ ID NO: 63851 - RNA, 18 nt, Artificial Sequence
  Description of Artificial Sequence: Synthetic oligonucleotide
ggguaugaagagaagagg

SEQ ID NO: 63852 - RNA, 18 nt, Artificial Sequence
  Description of Artificial Sequence: Synthetic oligonucleotide
uuuugggaauuaugaggg

SEQ ID NO: 63853 - RNA, 18 nt, Artificial Sequence
  Description of Artificial Sequence: Synthetic oligonucleotide
augaguuuugggaauuau

SEQ ID NO: 63854 - RNA, 18 nt, Artificial Sequence
  Description of Artificial Sequence: Synthetic oligonucleotide
caauaaugaguuuuggga

SEQ ID NO: 63855 - RNA, 18 nt, Artificial Sequence
  Description of Artificial Sequence: Synthetic oligonucleotide
acucccaauaaugaguuu

SEQ ID NO: 63856 - RNA, 18 nt, Artificial Sequence
  Description of Artificial Sequence: Synthetic oligonucleotide
ccuucacucccaauaaug

SEQ ID NO: 63857 - RNA, 18 nt, Artificial Sequence
  Description of Artificial Sequence: Synthetic oligonucleotide
gaaggccuucacucccaa

SEQ ID NO: 63858 - RNA, 18 nt, Artificial Sequence
  Description of Artificial Sequence: Synthetic oligonucleotide
gaaaugaaggccuucacu

SEQ ID NO: 63859 - RNA, 18 nt, Artificial Sequence
  Description of Artificial Sequence: Synthetic oligonucleotide
ggauggaaaugaaggccu

SEQ ID NO: 63860 - RNA, 18 nt, Artificial Sequence
  Description of Artificial Sequence: Synthetic oligonucleotide
uuuugggaauuaugaggg

SEQ ID NO: 63861 - RNA, 18 nt, Artificial Sequence
  Description of Artificial Sequence: Synthetic oligonucleotide
ugaguuuugggaauuaug

SEQ ID NO: 63862 - RNA, 18 nt, Artificial Sequence
  Description of Artificial Sequence: Synthetic oligonucleotide
aauaaugaguuuugggaa

SEQ ID NO: 63863 - RNA, 18 nt, Artificial Sequence
  Description of Artificial Sequence: Synthetic oligonucleotide
cucccaauaaugaguuuu

SEQ ID NO: 63864 - RNA, 18 nt, Artificial Sequence
  Description of Artificial Sequence: Synthetic oligonucleotide
cuucacucccaauaauga

SEQ ID NO: 63865 - RNA, 18 nt, Artificial Sequence
  Description of Artificial Sequence: Synthetic oligonucleotide
aaggccuucacucccaau

SEQ ID NO: 63866 - RNA, 18 nt, Artificial Sequence
  Description of Artificial Sequence: Synthetic oligonucleotide
aaaugaaggccuucacuc

SEQ ID NO: 63867 - RNA, 18 nt, Artificial Sequence
  Description of Artificial Sequence: Synthetic oligonucleotide
gauggaaaugaaggccuu

SEQ ID NO: 63868 - RNA, 18 nt, Artificial Sequence
  Description of Artificial Sequence: Synthetic oligonucleotide
ugacggauggaaaugaag

SEQ ID NO: 63869 - RNA, 18 nt, Artificial Sequence
  Description of Artificial Sequence: Synthetic oligonucleotide
cacugugacggauggaaa

SEQ ID NO: 63870 - RNA, 18 nt, Artificial Sequence
  Description of Artificial Sequence: Synthetic oligonucleotide
auucccacugugacggau

SEQ ID NO: 63871 - RNA, 18 nt, Artificial Sequence
  Description of Artificial Sequence: Synthetic oligonucleotide
gggacauucccacuguga

SEQ ID NO: 63872 - RNA, 18 nt, Artificial Sequence
  Description of Artificial Sequence: Synthetic oligonucleotide
gauaggguuuggguuggg

SEQ ID NO: 63873 - RNA, 18 nt, Artificial Sequence
  Description of Artificial Sequence: Synthetic oligonucleotide
ugggauaggguuuggguu

SEQ ID NO: 63874 - RNA, 18 nt, Artificial Sequence
  Description of Artificial Sequence: Synthetic oligonucleotide
gagggugggauaggguuu

SEQ ID NO: 63875 - RNA, 18 nt, Artificial Sequence
  Description of Artificial Sequence: Synthetic oligonucleotide
ggaaugagggugggauag

SEQ ID NO: 63876 - RNA, 18 nt, Artificial Sequence
  Description of Artificial Sequence: Synthetic oligonucleotide
gguagggaaugagggugg

SEQ ID NO: 63877 - RNA, 18 nt, Artificial Sequence
  Description of Artificial Sequence: Synthetic oligonucleotide
uauuugguagggaaugag

SEQ ID NO: 63878 - RNA, 18 nt, Artificial Sequence
  Description of Artificial Sequence: Synthetic oligonucleotide
gccccuauuugguaggga

SEQ ID NO: 63879 - RNA, 18 nt, Artificial Sequence
  Description of Artificial Sequence: Synthetic oligonucleotide
ccacagccccuauuuggu

SEQ ID NO: 63880 - RNA, 18 nt, Artificial Sequence
  Description of Artificial Sequence: Synthetic oligonucleotide
gauuuccacagccccuau

SEQ ID NO: 63881 - RNA, 18 nt, Artificial Sequence
  Description of Artificial Sequence: Synthetic oligonucleotide
ugacugauuuccacagcc

SEQ ID NO: 63882 - RNA, 18 nt, Artificial Sequence
  Description of Artificial Sequence: Synthetic oligonucleotide
uacacugacugauuucca

SEQ ID NO: 63883 - RNA, 18 nt, Artificial Sequence
  Description of Artificial Sequence: Synthetic oligonucleotide
uaaucuacacugacugau

SEQ ID NO: 63884 - RNA, 18 nt, Artificial Sequence
  Description of Artificial Sequence: Synthetic oligonucleotide
aaaaauaaucuacacuga

SEQ ID NO: 63885 - RNA, 18 nt, Artificial Sequence
  Description of Artificial Sequence: Synthetic oligonucleotide
agcgaaaaaauaaucuac

SEQ ID NO: 63886 - RNA, 18 nt, Artificial Sequence
  Description of Artificial Sequence: Synthetic oligonucleotide
uaaggagcgaaaaaauaa

SEQ ID NO: 63887 - RNA, 18 nt, Artificial Sequence
  Description of Artificial Sequence: Synthetic oligonucleotide
aggacuaaggagcgaaaa

SEQ ID NO: 63888 - RNA, 18 nt, Artificial Sequence
  Description of Artificial Sequence: Synthetic oligonucleotide
ccauggcuagagacgcca

SEQ ID NO: 63889 - RNA, 18 nt, Artificial Sequence
  Description of Artificial Sequence: Synthetic oligonucleotide
acuguccauggcuagaga

SEQ ID NO: 63890 - RNA, 18 nt, Artificial Sequence
  Description of Artificial Sequence: Synthetic oligonucleotide
cagagacuguccauggcu

SEQ ID NO: 63891 - RNA, 18 nt, Artificial Sequence
  Description of Artificial Sequence: Synthetic oligonucleotide
cacggcagagacugucca

SEQ ID NO: 63892 - RNA, 18 nt, Artificial Sequence
  Description of Artificial Sequence: Synthetic oligonucleotide
cacuccacggcagagacu

SEQ ID NO: 63893 - RNA, 18 nt, Artificial Sequence
  Description of Artificial Sequence: Synthetic oligonucleotide
gcaaacacuccacggcag

SEQ ID NO: 63894 - RNA, 18 nt, Artificial Sequence
  Description of Artificial Sequence: Synthetic oligonucleotide
ugccugcaaacacuccac

SEQ ID NO: 63895 - RNA, 18 nt, Artificial Sequence
  Description of Artificial Sequence: Synthetic oligonucleotide
gcuguugccugcaaacac

SEQ ID NO: 63896 - RNA, 18 nt, Artificial Sequence
  Description of Artificial Sequence: Synthetic oligonucleotide
ucacggcuguugccugca

SEQ ID NO: 63897 - RNA, 18 nt, Artificial Sequence
  Description of Artificial Sequence: Synthetic oligonucleotide
ugagcucacggcuguugc

SEQ ID NO: 63898 - RNA, 18 nt, Artificial Sequence
  Description of Artificial Sequence: Synthetic oligonucleotide
gaugcugagcucacggcu

SEQ ID NO: 63899 - RNA, 18 nt, Artificial Sequence
  Description of Artificial Sequence: Synthetic oligonucleotide
gaccugaugcugagcuca

SEQ ID NO: 63900 - RNA, 18 nt, Artificial Sequence
  Description of Artificial Sequence: Synthetic oligonucleotide
agcaggaccugaugcuga

SEQ ID NO: 63901 - RNA, 18 nt, Artificial Sequence
  Description of Artificial Sequence: Synthetic oligonucleotide
gggaaagcaggaccugau

SEQ ID NO: 63902 - RNA, 18 nt, Artificial Sequence
  Description of Artificial Sequence: Synthetic oligonucleotide
agacugggaaagcaggac

SEQ ID NO: 63903 - RNA, 18 nt, Artificial Sequence
  Description of Artificial Sequence: Synthetic oligonucleotide
ggaagagacugggaaagc

SEQ ID NO: 63904 - RNA, 18 nt, Artificial Sequence
  Description of Artificial Sequence: Synthetic oligonucleotide
agcuuggaagagacuggg

SEQ ID NO: 63905 - RNA, 18 nt, Artificial Sequence
  Description of Artificial Sequence: Synthetic oligonucleotide
ugcucagcuuggaagaga

SEQ ID NO: 63906 - RNA, 18 nt, Artificial Sequence
  Description of Artificial Sequence: Synthetic oligonucleotide
ggguuugcucagcuugga

SEQ ID NO: 63907 - RNA, 18 nt, Artificial Sequence
  Description of Artificial Sequence: Synthetic oligonucleotide
acgauggguuugcucagc

SEQ ID NO: 63908 - RNA, 18 nt, Artificial Sequence
  Description of Artificial Sequence: Synthetic oligonucleotide
auggaacgauggguuugc

SEQ ID NO: 63909 - RNA, 18 nt, Artificial Sequence
  Description of Artificial Sequence: Synthetic oligonucleotide
guaauauggaacgauggg

SEQ ID NO: 63910 - RNA, 18 nt, Artificial Sequence
  Description of Artificial Sequence: Synthetic oligonucleotide
gcccaguaauauggaacg

SEQ ID NO: 63911 - RNA, 18 nt, Artificial Sequence
  Description of Artificial Sequence: Synthetic oligonucleotide
agcaggcccaguaauaug

SEQ ID NO: 63912 - RNA, 18 nt, Artificial Sequence
  Description of Artificial Sequence: Synthetic oligonucleotide
ccagcagcaggcccagua

SEQ ID NO: 63913 - RNA, 18 nt, Artificial Sequence
  Description of Artificial Sequence: Synthetic oligonucleotide
ugcccccagcagcaggcc

SEQ ID NO: 63914 - RNA, 18 nt, Artificial Sequence
  Description of Artificial Sequence: Synthetic oligonucleotide
gaccuaguguauacuggg

SEQ ID NO: 63915 - RNA, 18 nt, Artificial Sequence
  Description of Artificial Sequence: Synthetic oligonucleotide
gugaccuaguguauacug

SEQ ID NO: 63916 - RNA, 18 nt, Artificial Sequence
  Description of Artificial Sequence: Synthetic oligonucleotide
ugccagugaccuagugua

SEQ ID NO: 63917 - RNA, 18 nt, Artificial Sequence
  Description of Artificial Sequence: Synthetic oligonucleotide
guuuuugccagugaccua

SEQ ID NO: 63918 - RNA, 18 nt, Artificial Sequence
  Description of Artificial Sequence: Synthetic oligonucleotide
gcccagcuguuuucccaa

SEQ ID NO: 63919 - RNA, 18 nt, Artificial Sequence
  Description of Artificial Sequence: Synthetic oligonucleotide
ccucagcccagcuguuuu

SEQ ID NO: 63920 - RNA, 18 nt, Artificial Sequence
  Description of Artificial Sequence: Synthetic oligonucleotide
gcccuccucagcccagcu

SEQ ID NO: 63921 - RNA, 18 nt, Artificial Sequence
  Description of Artificial Sequence: Synthetic oligonucleotide
ccuuggcccuccucagcc

SEQ ID NO: 63922 - RNA, 18 nt, Artificial Sequence
  Description of Artificial Sequence: Synthetic oligonucleotide
gauguccuuggcccuccu

SEQ ID NO: 63923 - RNA, 18 nt, Artificial Sequence
  Description of Artificial Sequence: Synthetic oligonucleotide
ggucugauguccuuggcc

SEQ ID NO: 63924 - RNA, 18 nt, Artificial Sequence
  Description of Artificial Sequence: Synthetic oligonucleotide
gggucugauguccuuggc

SEQ ID NO: 63925 - RNA, 18 nt, Artificial Sequence
  Description of Artificial Sequence: Synthetic oligonucleotide
aggaauguuuuagcuggg

SEQ ID NO: 63926 - RNA, 18 nt, Artificial Sequence
  Description of Artificial Sequence: Synthetic oligonucleotide
augaaaggaauguuuuag

SEQ ID NO: 63927 - RNA, 18 nt, Artificial Sequence
  Description of Artificial Sequence: Synthetic oligonucleotide
uccucagcccagcuguuu

SEQ ID NO: 63928 - RNA, 18 nt, Artificial Sequence
  Description of Artificial Sequence: Synthetic oligonucleotide
ggcccuccucagcccagc

SEQ ID NO: 63929 - RNA, 18 nt, Artificial Sequence
  Description of Artificial Sequence: Synthetic oligonucleotide
uccuuggcccuccucagc

SEQ ID NO: 63930 - RNA, 18 nt, Artificial Sequence
  Description of Artificial Sequence: Synthetic oligonucleotide
ugauguccuuggcccucc

SEQ ID NO: 63931 - RNA, 18 nt, Artificial Sequence
  Description of Artificial Sequence: Synthetic oligonucleotide
gggucugauguccuuggc

SEQ ID NO: 63932 - RNA, 18 nt, Artificial Sequence
  Description of Artificial Sequence: Synthetic oligonucleotide
aggaauguuuuagcuggg

SEQ ID NO: 63933 - RNA, 18 nt, Artificial Sequence
  Description of Artificial Sequence: Synthetic oligonucleotide
gaaaggaauguuuuagcu

SEQ ID NO: 63934 - RNA, 18 nt, Artificial Sequence
  Description of Artificial Sequence: Synthetic oligonucleotide
aggaauugccuagcugac

SEQ ID NO: 63935 - RNA, 18 nt, Artificial Sequence
  Description of Artificial Sequence: Synthetic oligonucleotide
cagucaggaauugccuag

SEQ ID NO: 63936 - RNA, 18 nt, Artificial Sequence
  Description of Artificial Sequence: Synthetic oligonucleotide
gugagcagucaggaauug

SEQ ID NO: 63937 - RNA, 18 nt, Artificial Sequence
  Description of Artificial Sequence: Synthetic oligonucleotide
aaccugugagcagucagg

SEQ ID NO: 63938 - RNA, 18 nt, Artificial Sequence
  Description of Artificial Sequence: Synthetic oligonucleotide
gggcaaccugugagcagu

SEQ ID NO: 63939 - RNA, 18 nt, Artificial Sequence
  Description of Artificial Sequence: Synthetic oligonucleotide
cuccagccagagucaggg

SEQ ID NO: 63940 - RNA, 18 nt, Artificial Sequence
  Description of Artificial Sequence: Synthetic oligonucleotide
ggaggcuccagccagagu

SEQ ID NO: 63941 - RNA, 18 nt, Artificial Sequence
  Description of Artificial Sequence: Synthetic oligonucleotide
ucauaggaggcuccagcc

SEQ ID NO: 63942 - RNA, 18 nt, Artificial Sequence
  Description of Artificial Sequence: Synthetic oligonucleotide
cucccucauaggaggcuc

SEQ ID NO: 63943 - RNA, 18 nt, Artificial Sequence
  Description of Artificial Sequence: Synthetic oligonucleotide
agcaacucccucauagga

SEQ ID NO: 63944 - RNA, 18 nt, Artificial Sequence
  Description of Artificial Sequence: Synthetic oligonucleotide
uuaacagcaacucccuca

SEQ ID NO: 63945 - RNA, 18 nt, Artificial Sequence
  Description of Artificial Sequence: Synthetic oligonucleotide
agucauuaacagcaacuc

SEQ ID NO: 63946 - RNA, 18 nt, Artificial Sequence
  Description of Artificial Sequence: Synthetic oligonucleotide
uauacagucauuaacagc

SEQ ID NO: 63947 - RNA, 18 nt, Artificial Sequence
  Description of Artificial Sequence: Synthetic oligonucleotide
cucucuauacagucauua

SEQ ID NO: 63948 - RNA, 18 nt, Artificial Sequence
  Description of Artificial Sequence: Synthetic oligonucleotide
gcccacucucuauacagu

SEQ ID NO: 63949 - RNA, 18 nt, Artificial Sequence
  Description of Artificial Sequence: Synthetic oligonucleotide
cuggcgcccacucucuau

SEQ ID NO: 63950 - RNA, 18 nt, Artificial Sequence
  Description of Artificial Sequence: Synthetic oligonucleotide
gcugccuggcgcccacuc

SEQ ID NO: 63951 - RNA, 18 nt, Artificial Sequence
  Description of Artificial Sequence: Synthetic oligonucleotide
ugacugcugccuggcgcc

SEQ ID NO: 63952 - RNA, 18 nt, Artificial Sequence
  Description of Artificial Sequence: Synthetic oligonucleotide
gacacugacugcugccug

SEQ ID NO: 63953 - RNA, 18 nt, Artificial Sequence
  Description of Artificial Sequence: Synthetic oligonucleotide
cccaggacacugacugcu

SEQ ID NO: 63954 - RNA, 18 nt, Artificial Sequence
  Description of Artificial Sequence: Synthetic oligonucleotide
cugugcccaggacacuga

SEQ ID NO: 63955 - RNA, 18 nt, Artificial Sequence
  Description of Artificial Sequence: Synthetic oligonucleotide
agguucugugcccaggac

SEQ ID NO: 63956 - RNA, 18 nt, Artificial Sequence
  Description of Artificial Sequence: Synthetic oligonucleotide
cuguuagguucugugccc

SEQ ID NO: 63957 - RNA, 18 nt, Artificial Sequence
  Description of Artificial Sequence: Synthetic oligonucleotide
aucagcuguuagguucug

SEQ ID NO: 63958 - RNA, 18 nt, Artificial Sequence
  Description of Artificial Sequence: Synthetic oligonucleotide
gggaucagcuguuagguu

SEQ ID NO: 63959 - RNA, 18 nt, Artificial Sequence
  Description of Artificial Sequence: Synthetic oligonucleotide
ucaugaaugagaguuggg

SEQ ID NO: 63960 - RNA, 18 nt, Artificial Sequence
  Description of Artificial Sequence: Synthetic oligonucleotide
uauuuucaugaaugagag

SEQ ID NO: 63961 - RNA, 18 nt, Artificial Sequence
  Description of Artificial Sequence: Synthetic oligonucleotide
auuuuuauuuucaugaau

SEQ ID NO: 63962 - RNA, 18 nt, Artificial Sequence
  Description of Artificial Sequence: Synthetic oligonucleotide
cagcaauuuuuauuuuca

SEQ ID NO: 63963 - RNA, 18 nt, Artificial Sequence
  Description of Artificial Sequence: Synthetic oligonucleotide
agcuccagcaauuuuuau

SEQ ID NO: 63964 - RNA, 18 nt, Artificial Sequence
  Description of Artificial Sequence: Synthetic oligonucleotide
caagccaagcucagaaac

SEQ ID NO: 63965 - RNA, 18 nt, Artificial Sequence
  Description of Artificial Sequence: Synthetic oligonucleotide
gaauccaagccaagcuca

SEQ ID NO: 63966 - RNA, 18 nt, Artificial Sequence
  Description of Artificial Sequence: Synthetic oligonucleotide
cuucugaauccaagccaa

SEQ ID NO: 63967 - RNA, 18 nt, Artificial Sequence
  Description of Artificial Sequence: Synthetic oligonucleotide
cagcacuucugaauccaa

SEQ ID NO: 63968 - RNA, 18 nt, Artificial Sequence
  Description of Artificial Sequence: Synthetic oligonucleotide
acaggcagcacuucugaa

SEQ ID NO: 63969 - RNA, 18 nt, Artificial Sequence
  Description of Artificial Sequence: Synthetic oligonucleotide
cccggacaggcagcacuu

SEQ ID NO: 63970 - RNA, 18 nt, Artificial Sequence
  Description of Artificial Sequence: Synthetic oligonucleotide
gucuccccggacaggcag

SEQ ID NO: 63971 - RNA, 18 nt, Artificial Sequence
  Description of Artificial Sequence: Synthetic oligonucleotide
ggguggucuccccggaca

SEQ ID NO: 63972 - RNA, 18 nt, Artificial Sequence
  Description of Artificial Sequence: Synthetic oligonucleotide
cagcuggguggucucccc

SEQ ID NO: 63973 - RNA, 18 nt, Artificial Sequence
  Description of Artificial Sequence: Synthetic oligonucleotide
cugggcagcugggugguc

SEQ ID NO: 63974 - RNA, 18 nt, Artificial Sequence
  Description of Artificial Sequence: Synthetic oligonucleotide
cuguucugggcagcuggg

SEQ ID NO: 63975 - RNA, 18 nt, Artificial Sequence
  Description of Artificial Sequence: Synthetic oligonucleotide
ggaaccuguucugggcag

SEQ ID NO: 63976 - RNA, 18 nt, Artificial Sequence
  Description of Artificial Sequence: Synthetic oligonucleotide
guagaggaaccuguucug

SEQ ID NO: 63977 - RNA, 18 nt, Artificial Sequence
  Description of Artificial Sequence: Synthetic oligonucleotide
cccacguagaggaaccug

SEQ ID NO: 63978 - RNA, 18 nt, Artificial Sequence
  Description of Artificial Sequence: Synthetic oligonucleotide
caccgcccacguagagga

SEQ ID NO: 63979 - RNA, 18 nt, Artificial Sequence
  Description of Artificial Sequence: Synthetic oligonucleotide
cagggcaccgcccacgua

SEQ ID NO: 63980 - RNA, 18 nt, Artificial Sequence
  Description of Artificial Sequence: Synthetic oligonucleotide
gcaugcagggcaccgccc

SEQ ID NO: 63981 - RNA, 18 nt, Artificial Sequence
  Description of Artificial Sequence: Synthetic oligonucleotide
guagggcaugcagggcac

SEQ ID NO: 63982 - RNA, 18 nt, Artificial Sequence
  Description of Artificial Sequence: Synthetic oligonucleotide
aguggguagggcaugcag

SEQ ID NO: 63983 - RNA, 18 nt, Artificial Sequence
  Description of Artificial Sequence: Synthetic oligonucleotide
aggccaguggguagggca

SEQ ID NO: 63984 - RNA, 18 nt, Artificial Sequence
  Description of Artificial Sequence: Synthetic oligonucleotide
aggagcggaggugcuggu

SEQ ID NO: 63985 - RNA, 18 nt, Artificial Sequence
  Description of Artificial Sequence: Synthetic oligonucleotide
guaaaaggagcggaggug

SEQ ID NO: 63986 - RNA, 18 nt, Artificial Sequence
  Description of Artificial Sequence: Synthetic oligonucleotide
gcacaguaaaaggagcgg

SEQ ID NO: 63987 - RNA, 18 nt, Artificial Sequence
  Description of Artificial Sequence: Synthetic oligonucleotide
ugagggcacaguaaaagg

SEQ ID NO: 63988 - RNA, 18 nt, Artificial Sequence
  Description of Artificial Sequence: Synthetic oligonucleotide
gaggaugagggcacagua

SEQ ID NO: 63989 - RNA, 18 nt, Artificial Sequence
  Description of Artificial Sequence: Synthetic oligonucleotide
cauaugaggaugagggca

SEQ ID NO: 63990 - RNA, 18 nt, Artificial Sequence
  Description of Artificial Sequence: Synthetic oligonucleotide
gaaggcauaugaggauga

SEQ ID NO: 63991 - RNA, 18 nt, Artificial Sequence
  Description of Artificial Sequence: Synthetic oligonucleotide
aaauggaaggcauaugag

SEQ ID NO: 63992 - RNA, 18 nt, Artificial Sequence
  Description of Artificial Sequence: Synthetic oligonucleotide
gaaagaaauggaaggcau

SEQ ID NO: 63993 - RNA, 18 nt, Artificial Sequence
  Description of Artificial Sequence: Synthetic oligonucleotide
aagaagaaagaaauggaa

SEQ ID NO: 63994 - RNA, 18 nt, Artificial Sequence
  Description of Artificial Sequence: Synthetic oligonucleotide
aagaaaagaagaaagaaa

SEQ ID NO: 63995 - RNA, 18 nt, Artificial Sequence
  Description of Artificial Sequence: Synthetic oligonucleotide
aaaaaaagaaaagaagaa

SEQ ID NO: 63996 - RNA, 18 nt, Artificial Sequence
  Description of Artificial Sequence: Synthetic oligonucleotide
aaaaaaaaaaaagaaaag

SEQ ID NO: 63997 - RNA, 18 nt, Artificial Sequence
  Description of Artificial Sequence: Synthetic oligonucleotide
aaaaaaaaaaaaaaaaag

SEQ ID NO: 63998 - RNA, 18 nt, Artificial Sequence
  Description of Artificial Sequence: Synthetic oligonucleotide
aaaaaaaaaaaaaaaaaa

SEQ ID NO: 63999 - RNA, 18 nt, Artificial Sequence
  Description of Artificial Sequence: Synthetic oligonucleotide
aaaaaaaaaaaaaaaaaa

SEQ ID NO: 64000 - RNA, 18 nt, Artificial Sequence
  Description of Artificial Sequence: Synthetic oligonucleotide
gucucaaaaaaaaaaaaa

SEQ ID NO: 64001 - RNA, 18 nt, Artificial Sequence
  Description of Artificial Sequence: Synthetic oligonucleotide
acuccgucucaaaaaaaa

SEQ ID NO: 64002 - RNA, 18 nt, Artificial Sequence
  Description of Artificial Sequence: Synthetic oligonucleotide
gcgauacuccgucucaaa

SEQ ID NO: 64003 - RNA, 18 nt, Artificial Sequence
  Description of Artificial Sequence: Synthetic oligonucleotide
cgagagcgauacuccguc

SEQ ID NO: 64004 - RNA, 18 nt, Artificial Sequence
  Description of Artificial Sequence: Synthetic oligonucleotide
cugggcgagagcgauacu

SEQ ID NO: 64005 - RNA, 18 nt, Artificial Sequence
  Description of Artificial Sequence: Synthetic oligonucleotide
ccauccugggcgagagcg

SEQ ID NO: 64006 - RNA, 18 nt, Artificial Sequence
  Description of Artificial Sequence: Synthetic oligonucleotide
gcacuccauccugggcga

SEQ ID NO: 64007 - RNA, 18 nt, Artificial Sequence
  Description of Artificial Sequence: Synthetic oligonucleotide
ccauugcacuccauccug

SEQ ID NO: 64008 - RNA, 18 nt, Artificial Sequence
  Description of Artificial Sequence: Synthetic oligonucleotide
ucgcgccauugcacucca

SEQ ID NO: 64009 - RNA, 18 nt, Artificial Sequence
  Description of Artificial Sequence: Synthetic oligonucleotide
caagaucgcgccauugca

SEQ ID NO: 64010 - RNA, 18 nt, Artificial Sequence
  Description of Artificial Sequence: Synthetic oligonucleotide
ugagccaagaucgcgcca

SEQ ID NO: 64011 - RNA, 18 nt, Artificial Sequence
  Description of Artificial Sequence: Synthetic oligonucleotide
ugcagugagccaagaucg

SEQ ID NO: 64012 - RNA, 18 nt, Artificial Sequence
  Description of Artificial Sequence: Synthetic oligonucleotide
gaaguugcagugagccaa

SEQ ID NO: 64013 - RNA, 18 nt, Artificial Sequence
  Description of Artificial Sequence: Synthetic oligonucleotide
aggcggaaguugcaguga

SEQ ID NO: 64014 - RNA, 18 nt, Artificial Sequence
  Description of Artificial Sequence: Synthetic oligonucleotide
ccgaaaggcggaaguugc

SEQ ID NO: 64015 - RNA, 18 nt, Artificial Sequence
  Description of Artificial Sequence: Synthetic oligonucleotide
ugaacccgaaaggcggaa

SEQ ID NO: 64016 - RNA, 18 nt, Artificial Sequence
  Description of Artificial Sequence: Synthetic oligonucleotide
ucgcuugaacccgaaagg

SEQ ID NO: 64017 - RNA, 18 nt, Artificial Sequence
  Description of Artificial Sequence: Synthetic oligonucleotide
gagaaucgcuugaacccg

SEQ ID NO: 64018 - RNA, 18 nt, Artificial Sequence
  Description of Artificial Sequence: Synthetic oligonucleotide
ggcaggagaaucgcuuga

SEQ ID NO: 64019 - RNA, 18 nt, Artificial Sequence
  Description of Artificial Sequence: Synthetic oligonucleotide
gcugaggcaggagaaucg

SEQ ID NO: 64020 - RNA, 18 nt, Artificial Sequence
  Description of Artificial Sequence: Synthetic oligonucleotide
gggaggcugaggcaggag

SEQ ID NO: 64021 - RNA, 18 nt, Artificial Sequence
  Description of Artificial Sequence: Synthetic oligonucleotide
uacucgggaggcugaggc

SEQ ID NO: 64022 - RNA, 18 nt, Artificial Sequence
  Description of Artificial Sequence: Synthetic oligonucleotide
ccagcuacucgggaggcu

SEQ ID NO: 64023 - RNA, 18 nt, Artificial Sequence
  Description of Artificial Sequence: Synthetic oligonucleotide
uagucccagcuacucggg

SEQ ID NO: 64024 - RNA, 18 nt, Artificial Sequence
  Description of Artificial Sequence: Synthetic oligonucleotide
accuguagucccagcuac

SEQ ID NO: 64025 - RNA, 18 nt, Artificial Sequence
  Description of Artificial Sequence: Synthetic oligonucleotide
uaggcaccuguaguccca

SEQ ID NO: 64026 - RNA, 18 nt, Artificial Sequence
  Description of Artificial Sequence: Synthetic oligonucleotide
ggugguaggcaccuguag

SEQ ID NO: 64027 - RNA, 18 nt, Artificial Sequence
  Description of Artificial Sequence: Synthetic oligonucleotide
gacguggugguaggcacc

SEQ ID NO: 64028 - RNA, 18 nt, Artificial Sequence
  Description of Artificial Sequence: Synthetic oligonucleotide
agccagacguggugguag

SEQ ID NO: 64029 - RNA, 18 nt, Artificial Sequence
  Description of Artificial Sequence: Synthetic oligonucleotide
aaacuagccagacguggu

SEQ ID NO: 64030 - RNA, 18 nt, Artificial Sequence
  Description of Artificial Sequence: Synthetic oligonucleotide
uacaaaaacuagccagac

SEQ ID NO: 64031 - RNA, 18 nt, Artificial Sequence
  Description of Artificial Sequence: Synthetic oligonucleotide
aaaaauacaaaaacuagc

SEQ ID NO: 64032 - RNA, 18 nt, Artificial Sequence
  Description of Artificial Sequence: Synthetic oligonucleotide
cuacuaaaaauacaaaaa

SEQ ID NO: 64033 - RNA, 18 nt, Artificial Sequence
  Description of Artificial Sequence: Synthetic oligonucleotide
caucucuacuaaaaauac

SEQ ID NO: 64034 - RNA, 18 nt, Artificial Sequence
  Description of Artificial Sequence: Synthetic oligonucleotide
aaccccaucucuacuaaa

SEQ ID NO: 64035 - RNA, 18 nt, Artificial Sequence
  Description of Artificial Sequence: Synthetic oligonucleotide
ggugaaaccccaucucua

SEQ ID NO: 64036 - RNA, 18 nt, Artificial Sequence
  Description of Artificial Sequence: Synthetic oligonucleotide
aauauggugaaaccccau

SEQ ID NO: 64037 - RNA, 18 nt, Artificial Sequence
  Description of Artificial Sequence: Synthetic oligonucleotide
cuagccagacgugguggu

SEQ ID NO: 64038 - RNA, 18 nt, Artificial Sequence
  Description of Artificial Sequence: Synthetic oligonucleotide
aaaaacuagccagacgug

SEQ ID NO: 64039 - RNA, 18 nt, Artificial Sequence
  Description of Artificial Sequence: Synthetic oligonucleotide
aauacaaaaacuagccag

SEQ ID NO: 64040 - RNA, 18 nt, Artificial Sequence
  Description of Artificial Sequence: Synthetic oligonucleotide
cuaaaaauacaaaaacua

SEQ ID NO: 64041 - RNA, 18 nt, Artificial Sequence
  Description of Artificial Sequence: Synthetic oligonucleotide
cucuacuaaaaauacaaa

SEQ ID NO: 64042 - RNA, 18 nt, Artificial Sequence
  Description of Artificial Sequence: Synthetic oligonucleotide
cccaucucuacuaaaaau

SEQ ID NO: 64043 - RNA, 18 nt, Artificial Sequence
  Description of Artificial Sequence: Synthetic oligonucleotide
gaaaccccaucucuacua

SEQ ID NO: 64044 - RNA, 18 nt, Artificial Sequence
  Description of Artificial Sequence: Synthetic oligonucleotide
auggugaaaccccaucuc

SEQ ID NO: 64045 - RNA, 18 nt, Artificial Sequence
  Description of Artificial Sequence: Synthetic oligonucleotide
ccaauauggugaaacccc

SEQ ID NO: 64046 - RNA, 18 nt, Artificial Sequence
  Description of Artificial Sequence: Synthetic oligonucleotide
ccuggccaauauggugaa

SEQ ID NO: 64047 - RNA, 18 nt, Artificial Sequence
  Description of Artificial Sequence: Synthetic oligonucleotide
accagccuggccaauaug

SEQ ID NO: 64048 - RNA, 18 nt, Artificial Sequence
  Description of Artificial Sequence: Synthetic oligonucleotide
ucaagaccagccuggcca

SEQ ID NO: 64049 - RNA, 18 nt, Artificial Sequence
  Description of Artificial Sequence: Synthetic oligonucleotide
ggaguucaagaccagccu

SEQ ID NO: 64050 - RNA, 18 nt, Artificial Sequence
  Description of Artificial Sequence: Synthetic oligonucleotide
ggucaggaguucaagacc

SEQ ID NO: 64051 - RNA, 18 nt, Artificial Sequence
  Description of Artificial Sequence: Synthetic oligonucleotide
cacaaggucaggaguuca

SEQ ID NO: 64052 - RNA, 18 nt, Artificial Sequence
  Description of Artificial Sequence: Synthetic oligonucleotide
cggaucacaaggucagga

SEQ ID NO: 64053 - RNA, 18 nt, Artificial Sequence
  Description of Artificial Sequence: Synthetic oligonucleotide
gcgggcggaucacaaggu

SEQ ID NO: 64054 - RNA, 18 nt, Artificial Sequence
  Description of Artificial Sequence: Synthetic oligonucleotide
ccgaggcgggcggaucac

SEQ ID NO: 64055 - RNA, 18 nt, Artificial Sequence
  Description of Artificial Sequence: Synthetic oligonucleotide
gcaggccgaggcgggcgg

SEQ ID NO: 64056 - RNA, 18 nt, Artificial Sequence
  Description of Artificial Sequence: Synthetic oligonucleotide
cuuuggcaggccgaggcg

SEQ ID NO: 64057 - RNA, 18 nt, Artificial Sequence
  Description of Artificial Sequence: Synthetic oligonucleotide
cagcacuuuggcaggccg

SEQ ID NO: 64058 - RNA, 18 nt, Artificial Sequence
  Description of Artificial Sequence: Synthetic oligonucleotide
aaucccagcacuuuggca

SEQ ID NO: 64059 - RNA, 18 nt, Artificial Sequence
  Description of Artificial Sequence: Synthetic oligonucleotide
ccuguaaucccagcacuu

SEQ ID NO: 64060 - RNA, 18 nt, Artificial Sequence
  Description of Artificial Sequence: Synthetic oligonucleotide
ucacgccuguaaucccag

SEQ ID NO: 64061 - RNA, 18 nt, Artificial Sequence
  Description of Artificial Sequence: Synthetic oligonucleotide
guggcucacgccuguaau

SEQ ID NO: 64062 - RNA, 18 nt, Artificial Sequence
  Description of Artificial Sequence: Synthetic oligonucleotide
gcgugguggcucacgccu

SEQ ID NO: 64063 - RNA, 18 nt, Artificial Sequence
  Description of Artificial Sequence: Synthetic oligonucleotide
gucgggcgugguggcuca

SEQ ID NO: 64064 - RNA, 18 nt, Artificial Sequence
  Description of Artificial Sequence: Synthetic oligonucleotide
ggcaggucgggcguggug

SEQ ID NO: 64065 - RNA, 18 nt, Artificial Sequence
  Description of Artificial Sequence: Synthetic oligonucleotide
uggaaggcaggucgggcg

SEQ ID NO: 64066 - RNA, 18 nt, Artificial Sequence
  Description of Artificial Sequence: Synthetic oligonucleotide
agaaauggaaggcagguc

SEQ ID NO: 64067 - RNA, 18 nt, Artificial Sequence
  Description of Artificial Sequence: Synthetic oligonucleotide
gaugaagaaauggaaggc

SEQ ID NO: 64068 - RNA, 18 nt, Artificial Sequence
  Description of Artificial Sequence: Synthetic oligonucleotide
agggagaugaagaaaugg

SEQ ID NO: 64069 - RNA, 18 nt, Artificial Sequence
  Description of Artificial Sequence: Synthetic oligonucleotide
cugacagggagaugaaga

SEQ ID NO: 64070 - RNA, 18 nt, Artificial Sequence
  Description of Artificial Sequence: Synthetic oligonucleotide
gaaggcugacagggagau

SEQ ID NO: 64071 - RNA, 18 nt, Artificial Sequence
  Description of Artificial Sequence: Synthetic oligonucleotide
gcugggaaggcugacagg

SEQ ID NO: 64072 - RNA, 18 nt, Artificial Sequence
  Description of Artificial Sequence: Synthetic oligonucleotide
cuuuugcugggaaggcug

SEQ ID NO: 64073 - RNA, 18 nt, Artificial Sequence
  Description of Artificial Sequence: Synthetic oligonucleotide
gcuuccuuuugcugggaa

SEQ ID NO: 64074 - RNA, 18 nt, Artificial Sequence
  Description of Artificial Sequence: Synthetic oligonucleotide
auuuggcuuccuuuugcu

SEQ ID NO: 64075 - RNA, 18 nt, Artificial Sequence
  Description of Artificial Sequence: Synthetic oligonucleotide
cacucauuuggcuuccuu

SEQ ID NO: 64076 - RNA, 18 nt, Artificial Sequence
  Description of Artificial Sequence: Synthetic oligonucleotide
auuuccacucauuuggcu

SEQ ID NO: 64077 - RNA, 18 nt, Artificial Sequence
  Description of Artificial Sequence: Synthetic oligonucleotide
gggucauuuccacucauu

SEQ ID NO: 64078 - RNA, 18 nt, Artificial Sequence
  Description of Artificial Sequence: Synthetic oligonucleotide
ccagcuccaggcgcuggg

SEQ ID NO: 64079 - RNA, 18 nt, Artificial Sequence
  Description of Artificial Sequence: Synthetic oligonucleotide
ccccagcuccaggcgcug

SEQ ID NO: 64080 - RNA, 18 nt, Artificial Sequence
  Description of Artificial Sequence: Synthetic oligonucleotide
uaccuccccagcuccagg

SEQ ID NO: 64081 - RNA, 18 nt, Artificial Sequence
  Description of Artificial Sequence: Synthetic oligonucleotide
ugacauaccuccccagcu

SEQ ID NO: 64082 - RNA, 18 nt, Artificial Sequence
  Description of Artificial Sequence: Synthetic oligonucleotide
gcuccugacauaccuccc

SEQ ID NO: 64083 - RNA, 18 nt, Artificial Sequence
  Description of Artificial Sequence: Synthetic oligonucleotide
gggaagcuccugacauac

SEQ ID NO: 64084 - RNA, 18 nt, Artificial Sequence
  Description of Artificial Sequence: Synthetic oligonucleotide
ugaagggcggaguagccc

SEQ ID NO: 64085 - RNA, 18 nt, Artificial Sequence
  Description of Artificial Sequence: Synthetic oligonucleotide
gggugaagggcggaguag

SEQ ID NO: 64086 - RNA, 18 nt, Artificial Sequence
  Description of Artificial Sequence: Synthetic oligonucleotide
cagagguuuggagaaggg

SEQ ID NO: 64087 - RNA, 18 nt, Artificial Sequence
  Description of Artificial Sequence: Synthetic oligonucleotide
caaaacagagguuuggag

SEQ ID NO: 64088 - RNA, 18 nt, Artificial Sequence
  Description of Artificial Sequence: Synthetic oligonucleotide
cagcccaaaacagagguu

SEQ ID NO: 64089 - RNA, 18 nt, Artificial Sequence
  Description of Artificial Sequence: Synthetic oligonucleotide
cagcccagcccaaaacag

SEQ ID NO: 64090 - RNA, 18 nt, Artificial Sequence
  Description of Artificial Sequence: Synthetic oligonucleotide
ucccucagcccagcccaa

SEQ ID NO: 64091 - RNA, 18 nt, Artificial Sequence
  Description of Artificial Sequence: Synthetic oligonucleotide
ucagcucccucagcccag

SEQ ID NO: 64092 - RNA, 18 nt, Artificial Sequence
  Description of Artificial Sequence: Synthetic oligonucleotide
cuuggucagcucccucag

SEQ ID NO: 64093 - RNA, 18 nt, Artificial Sequence
  Description of Artificial Sequence: Synthetic oligonucleotide
gggcuuggucagcucccu

SEQ ID NO: 64094 - RNA, 18 nt, Artificial Sequence
  Description of Artificial Sequence: Synthetic oligonucleotide
caggcucuuugccccggg

SEQ ID NO: 64095 - RNA, 18 nt, Artificial Sequence
  Description of Artificial Sequence: Synthetic oligonucleotide
cucaucaggcucuuugcc

SEQ ID NO: 64096 - RNA, 18 nt, Artificial Sequence
  Description of Artificial Sequence: Synthetic oligonucleotide
acagucucaucaggcucu

SEQ ID NO: 64097 - RNA, 18 nt, Artificial Sequence
  Description of Artificial Sequence: Synthetic oligonucleotide
ugugcacagucucaucag

SEQ ID NO: 64098 - RNA, 18 nt, Artificial Sequence
  Description of Artificial Sequence: Synthetic oligonucleotide
aaaacugugcacagucuc

SEQ ID NO: 64099 - RNA, 18 nt, Artificial Sequence
  Description of Artificial Sequence: Synthetic oligonucleotide
ugggcaaaacugugcaca

SEQ ID NO: 64100 - RNA, 18 nt, Artificial Sequence
  Description of Artificial Sequence: Synthetic oligonucleotide
ggcgcugggcaaaacugu

SEQ ID NO: 64101 - RNA, 18 nt, Artificial Sequence
  Description of Artificial Sequence: Synthetic oligonucleotide
aaggcggcgcugggcaaa

SEQ ID NO: 64102 - RNA, 18 nt, Artificial Sequence
  Description of Artificial Sequence: Synthetic oligonucleotide
gguccaaggcggcgcugg

SEQ ID NO: 64103 - RNA, 18 nt, Artificial Sequence
  Description of Artificial Sequence: Synthetic oligonucleotide
ucuucuggauagccagga

SEQ ID NO: 64104 - RNA, 18 nt, Artificial Sequence
  Description of Artificial Sequence: Synthetic oligonucleotide
cuuguucuucuggauagc

SEQ ID NO: 64105 - RNA, 18 nt, Artificial Sequence
  Description of Artificial Sequence: Synthetic oligonucleotide
auaggcuuguucuucugg

SEQ ID NO: 64106 - RNA, 18 nt, Artificial Sequence
  Description of Artificial Sequence: Synthetic oligonucleotide
ugcugauaggcuuguucu

SEQ ID NO: 64107 - RNA, 18 nt, Artificial Sequence
  Description of Artificial Sequence: Synthetic oligonucleotide
cuucuugcugauaggcuu

SEQ ID NO: 64108 - RNA, 18 nt, Artificial Sequence
  Description of Artificial Sequence: Synthetic oligonucleotide
auuuccuucuugcugaua

SEQ ID NO: 64109 - RNA, 18 nt, Artificial Sequence
  Description of Artificial Sequence: Synthetic oligonucleotide
gaaucauuuccuucuugc

SEQ ID NO: 64110 - RNA, 18 nt, Artificial Sequence
  Description of Artificial Sequence: Synthetic oligonucleotide
ccucugaaucauuuccuu

SEQ ID NO: 64111 - RNA, 18 nt, Artificial Sequence
  Description of Artificial Sequence: Synthetic oligonucleotide
uuggaccucugaaucauu

SEQ ID NO: 64112 - RNA, 18 nt, Artificial Sequence
  Description of Artificial Sequence: Synthetic oligonucleotide
uacucuuguuuucuuggu

SEQ ID NO: 64113 - RNA, 18 nt, Artificial Sequence
  Description of Artificial Sequence: Synthetic oligonucleotide
auacguacucuuguuuuc

SEQ ID NO: 64114 - RNA, 18 nt, Artificial Sequence
  Description of Artificial Sequence: Synthetic oligonucleotide
cuuguauacguacucuug

SEQ ID NO: 64115 - RNA, 18 nt, Artificial Sequence
  Description of Artificial Sequence: Synthetic oligonucleotide
uuacacuuguauacguac

SEQ ID NO: 64116 - RNA, 18 nt, Artificial Sequence
  Description of Artificial Sequence: Synthetic oligonucleotide
cugguuuacacuuguaua

SEQ ID NO: 64117 - RNA, 18 nt, Artificial Sequence
  Description of Artificial Sequence: Synthetic oligonucleotide
guggccugguuuacacuu

SEQ ID NO: 64118 - RNA, 18 nt, Artificial Sequence
  Description of Artificial Sequence: Synthetic oligonucleotide
acuugguggccugguuua

SEQ ID NO: 64119 - RNA, 18 nt, Artificial Sequence
  Description of Artificial Sequence: Synthetic oligonucleotide
cgaccacuugguggccug

SEQ ID NO: 64120 - RNA, 18 nt, Artificial Sequence
  Description of Artificial Sequence: Synthetic oligonucleotide
gcucccgaccacuuggug

SEQ ID NO: 64121 - RNA, 18 nt, Artificial Sequence
  Description of Artificial Sequence: Synthetic oligonucleotide
ccagagcucccgaccacu

SEQ ID NO: 64122 - RNA, 18 nt, Artificial Sequence
  Description of Artificial Sequence: Synthetic oligonucleotide
gcaagccagagcucccga

SEQ ID NO: 64123 - RNA, 18 nt, Artificial Sequence
  Description of Artificial Sequence: Synthetic oligonucleotide
ugggugcaagccagagcu

SEQ ID NO: 64124 - RNA, 18 nt, Artificial Sequence
  Description of Artificial Sequence: Synthetic oligonucleotide
uauucugggugcaagcca

SEQ ID NO: 64125 - RNA, 18 nt, Artificial Sequence
  Description of Artificial Sequence: Synthetic oligonucleotide
acauuuauucugggugca

SEQ ID NO: 64126 - RNA, 18 nt, Artificial Sequence
  Description of Artificial Sequence: Synthetic oligonucleotide
auaauacauuuauucugg

SEQ ID NO: 64127 - RNA, 18 nt, Artificial Sequence
  Description of Artificial Sequence: Synthetic oligonucleotide
ugaguauaauacauuuau

SEQ ID NO: 64128 - RNA, 18 nt, Artificial Sequence
  Description of Artificial Sequence: Synthetic oligonucleotide
aaacuugaguauaauaca

SEQ ID NO: 64129 - RNA, 18 nt, Artificial Sequence
  Description of Artificial Sequence: Synthetic oligonucleotide
uguuuaaacuugaguaua

SEQ ID NO: 64130 - RNA, 18 nt, Artificial Sequence
  Description of Artificial Sequence: Synthetic oligonucleotide
cauaauguuuaaacuuga

SEQ ID NO: 64131 - RNA, 18 nt, Artificial Sequence
  Description of Artificial Sequence: Synthetic oligonucleotide
uuucucauaauguuuaaa

SEQ ID NO: 64132 - RNA, 18 nt, Artificial Sequence
  Description of Artificial Sequence: Synthetic oligonucleotide
acaacuuucucauaaugu

SEQ ID NO: 64133 - RNA, 18 nt, Artificial Sequence
  Description of Artificial Sequence: Synthetic oligonucleotide
cucucacaacuuucucau

SEQ ID NO: 64134 - RNA, 18 nt, Artificial Sequence
  Description of Artificial Sequence: Synthetic oligonucleotide
aaugacucucacaacuuu

SEQ ID NO: 64135 - RNA, 18 nt, Artificial Sequence
  Description of Artificial Sequence: Synthetic oligonucleotide
ugagaaaugacucucaca

SEQ ID NO: 64136 - RNA, 18 nt, Artificial Sequence
  Description of Artificial Sequence: Synthetic oligonucleotide
auaagugagaaaugacuc

SEQ ID NO: 64137 - RNA, 18 nt, Artificial Sequence
  Description of Artificial Sequence: Synthetic oligonucleotide
gugccauaagugagaaau

SEQ ID NO: 64138 - RNA, 18 nt, Artificial Sequence
  Description of Artificial Sequence: Synthetic oligonucleotide
uuucagugccauaaguga

SEQ ID NO: 64139 - RNA, 18 nt, Artificial Sequence
  Description of Artificial Sequence: Synthetic oligonucleotide
uuuuuuuucagugccaua

SEQ ID NO: 64140 - RNA, 18 nt, Artificial Sequence
  Description of Artificial Sequence: Synthetic oligonucleotide
cuuuuuuuuuuuucagug

SEQ ID NO: 64141 - RNA, 18 nt, Artificial Sequence
  Description of Artificial Sequence: Synthetic oligonucleotide
augugcuuuuuuuuuuuu

SEQ ID NO: 64142 - RNA, 18 nt, Artificial Sequence
  Description of Artificial Sequence: Synthetic oligonucleotide
ccaugaugugcuuuuuuu

SEQ ID NO: 64143 - RNA, 18 nt, Artificial Sequence
  Description of Artificial Sequence: Synthetic oligonucleotide
ucauaccaugaugugcuu

SEQ ID NO: 64144 - RNA, 18 nt, Artificial Sequence
  Description of Artificial Sequence: Synthetic oligonucleotide
gucauucauaccaugaug

SEQ ID NO: 64145 - RNA, 18 nt, Artificial Sequence
  Description of Artificial Sequence: Synthetic oligonucleotide
uaugagucauucauacca

SEQ ID NO: 64146 - RNA, 18 nt, Artificial Sequence
  Description of Artificial Sequence: Synthetic oligonucleotide
uugcauaugagucauuca

SEQ ID NO: 64147 - RNA, 18 nt, Artificial Sequence
  Description of Artificial Sequence: Synthetic oligonucleotide
aucuuuugcauaugaguc

SEQ ID NO: 64148 - RNA, 18 nt, Artificial Sequence
  Description of Artificial Sequence: Synthetic oligonucleotide
uuuucaucuuuugcauau

SEQ ID NO: 64149 - RNA, 18 nt, Artificial Sequence
  Description of Artificial Sequence: Synthetic oligonucleotide
gaaguuuuucaucuuuug

SEQ ID NO: 64150 - RNA, 18 nt, Artificial Sequence
  Description of Artificial Sequence: Synthetic oligonucleotide
agugagaaguuuuucauc

SEQ ID NO: 64151 - RNA, 18 nt, Artificial Sequence
  Description of Artificial Sequence: Synthetic oligonucleotide
aaauuagugagaaguuuu

SEQ ID NO: 64152 - RNA, 18 nt, Artificial Sequence
  Description of Artificial Sequence: Synthetic oligonucleotide
caugcaaauuagugagaa

SEQ ID NO: 64153 - RNA, 18 nt, Artificial Sequence
  Description of Artificial Sequence: Synthetic oligonucleotide
uaagacaugcaaauuagu

SEQ ID NO: 64154 - RNA, 18 nt, Artificial Sequence
  Description of Artificial Sequence: Synthetic oligonucleotide
gagccuaagacaugcaaa

SEQ ID NO: 64155 - RNA, 18 nt, Artificial Sequence
  Description of Artificial Sequence: Synthetic oligonucleotide
aagaggagccuaagacau

SEQ ID NO: 64156 - RNA, 18 nt, Artificial Sequence
  Description of Artificial Sequence: Synthetic oligonucleotide
uaauaaagaggagccuaa

SEQ ID NO: 64157 - RNA, 18 nt, Artificial Sequence
  Description of Artificial Sequence: Synthetic oligonucleotide
guuucuaauaaagaggag

SEQ ID NO: 64158 - RNA, 18 nt, Artificial Sequence
  Description of Artificial Sequence: Synthetic oligonucleotide
uuuagguuucuaauaaag

SEQ ID NO: 64159 - RNA, 18 nt, Artificial Sequence
  Description of Artificial Sequence: Synthetic oligonucleotide
uuacauuuagguuucuaa

SEQ ID NO: 64160 - RNA, 18 nt, Artificial Sequence
  Description of Artificial Sequence: Synthetic oligonucleotide
uuuauuuacauuuagguu

SEQ ID NO: 64161 - RNA, 18 nt, Artificial Sequence
  Description of Artificial Sequence: Synthetic oligonucleotide
uauucuuuauuuacauuu

SEQ ID NO: 64162 - RNA, 18 nt, Artificial Sequence
  Description of Artificial Sequence: Synthetic oligonucleotide
uaaaauauucuuuauuua

SEQ ID NO: 64163 - RNA, 18 nt, Artificial Sequence
  Description of Artificial Sequence: Synthetic oligonucleotide
uggccuaaaauauucuuu

SEQ ID NO: 64164 - RNA, 18 nt, Artificial Sequence
  Description of Artificial Sequence: Synthetic oligonucleotide
guaccuggccuaaaauau

SEQ ID NO: 64165 - RNA, 18 nt, Artificial Sequence
  Description of Artificial Sequence: Synthetic oligonucleotide
ccaccguaccuggccuaa

SEQ ID NO: 64166 - RNA, 18 nt, Artificial Sequence
  Description of Artificial Sequence: Synthetic oligonucleotide
augagccaccguaccugg

SEQ ID NO: 64167 - RNA, 18 nt, Artificial Sequence
  Description of Artificial Sequence: Synthetic oligonucleotide
caggcaugagccaccgua

SEQ ID NO: 64168 - RNA, 18 nt, Artificial Sequence
  Description of Artificial Sequence: Synthetic oligonucleotide
gauuacaggcaugagcca

SEQ ID NO: 64169 - RNA, 18 nt, Artificial Sequence
  Description of Artificial Sequence: Synthetic oligonucleotide
gcugggauuacaggcaug

SEQ ID NO: 64170 - RNA, 18 nt, Artificial Sequence
  Description of Artificial Sequence: Synthetic oligonucleotide
uaagugcugggauuacag

SEQ ID NO: 64171 - RNA, 18 nt, Artificial Sequence
  Description of Artificial Sequence: Synthetic oligonucleotide
cucccuaagugcugggau

SEQ ID NO: 64172 - RNA, 18 nt, Artificial Sequence
  Description of Artificial Sequence: Synthetic oligonucleotide
ucggccucccuaagugcu

SEQ ID NO: 64173 - RNA, 18 nt, Artificial Sequence
  Description of Artificial Sequence: Synthetic oligonucleotide
acaccucggccucccuaa

SEQ ID NO: 64174 - RNA, 18 nt, Artificial Sequence
  Description of Artificial Sequence: Synthetic oligonucleotide
ucugcacaccucggccuc

SEQ ID NO: 64175 - RNA, 18 nt, Artificial Sequence
  Description of Artificial Sequence: Synthetic oligonucleotide
ugugaucugcacaccucg

SEQ ID NO: 64176 - RNA, 18 nt, Artificial Sequence
  Description of Artificial Sequence: Synthetic oligonucleotide
ccucaugugaucugcaca

SEQ ID NO: 64177 - RNA, 18 nt, Artificial Sequence
  Description of Artificial Sequence: Synthetic oligonucleotide
ccuaaccucaugugaucu

SEQ ID NO: 64178 - RNA, 18 nt, Artificial Sequence
  Description of Artificial Sequence: Synthetic oligonucleotide
gaacuccuaaccucaugu

SEQ ID NO: 64179 - RNA, 18 nt, Artificial Sequence
  Description of Artificial Sequence: Synthetic oligonucleotide
gucucgaacuccuaaccu

SEQ ID NO: 64180 - RNA, 18 nt, Artificial Sequence
  Description of Artificial Sequence: Synthetic oligonucleotide
ggcuggucucgaacuccu

SEQ ID NO: 64181 - RNA, 18 nt, Artificial Sequence
  Description of Artificial Sequence: Synthetic oligonucleotide
ggccaggcuggucucgaa

SEQ ID NO: 64182 - RNA, 18 nt, Artificial Sequence
  Description of Artificial Sequence: Synthetic oligonucleotide
auguuggccaggcugguc

SEQ ID NO: 64183 - RNA, 18 nt, Artificial Sequence
  Description of Artificial Sequence: Synthetic oligonucleotide
ucaccauguuggccaggc

SEQ ID NO: 64184 - RNA, 18 nt, Artificial Sequence
  Description of Artificial Sequence: Synthetic oligonucleotide
gaguuucaccauguuggc

SEQ ID NO: 64185 - RNA, 18 nt, Artificial Sequence
  Description of Artificial Sequence: Synthetic oligonucleotide
agauggaguuucaccaug

SEQ ID NO: 64186 - RNA, 18 nt, Artificial Sequence
  Description of Artificial Sequence: Synthetic oligonucleotide
aguagagauggaguuuca

SEQ ID NO: 64187 - RNA, 18 nt, Artificial Sequence
  Description of Artificial Sequence: Synthetic oligonucleotide
uuuugaguagagauggag

SEQ ID NO: 64188 - RNA, 18 nt, Artificial Sequence
  Description of Artificial Sequence: Synthetic oligonucleotide
uuguauuuugaguagaga

SEQ ID NO: 64189 - RNA, 18 nt, Artificial Sequence
  Description of Artificial Sequence: Synthetic oligonucleotide
aauuuuuguauuuugagu

SEQ ID NO: 64190 - RNA, 18 nt, Artificial Sequence
  Description of Artificial Sequence: Synthetic oligonucleotide
cagcuaauuuuuguauuu

SEQ ID NO: 64191 - RNA, 18 nt, Artificial Sequence
  Description of Artificial Sequence: Synthetic oligonucleotide
acacccagcuaauuuuug

SEQ ID NO: 64192 - RNA, 18 nt, Artificial Sequence
  Description of Artificial Sequence: Synthetic oligonucleotide
ccuccacacccagcuaau

SEQ ID NO: 64193 - RNA, 18 nt, Artificial Sequence
  Description of Artificial Sequence: Synthetic oligonucleotide
gugugccuccacacccag

SEQ ID NO: 64194 - RNA, 18 nt, Artificial Sequence
  Description of Artificial Sequence: Synthetic oligonucleotide
caggcgugugccuccaca

SEQ ID NO: 64195 - RNA, 18 nt, Artificial Sequence
  Description of Artificial Sequence: Synthetic oligonucleotide
gauuacaggcgugugccu

SEQ ID NO: 64196 - RNA, 18 nt, Artificial Sequence
  Description of Artificial Sequence: Synthetic oligonucleotide
gcugggauuacaggcgug

SEQ ID NO: 64197 - RNA, 18 nt, Artificial Sequence
  Description of Artificial Sequence: Synthetic oligonucleotide
gaguagcugggauuacag

SEQ ID NO: 64198 - RNA, 18 nt, Artificial Sequence
  Description of Artificial Sequence: Synthetic oligonucleotide
cuacugaguagcugggau

SEQ ID NO: 64199 - RNA, 18 nt, Artificial Sequence
  Description of Artificial Sequence: Synthetic oligonucleotide
ucagccuacugaguagcu

SEQ ID NO: 64200 - RNA, 18 nt, Artificial Sequence
  Description of Artificial Sequence: Synthetic oligonucleotide
ccggcucagccuacugag

SEQ ID NO: 64201 - RNA, 18 nt, Artificial Sequence
  Description of Artificial Sequence: Synthetic oligonucleotide
uccucccggcucagccua

SEQ ID NO: 64202 - RNA, 18 nt, Artificial Sequence
  Description of Artificial Sequence: Synthetic oligonucleotide
agagauccucccggcuca

SEQ ID NO: 64203 - RNA, 18 nt, Artificial Sequence
  Description of Artificial Sequence: Synthetic oligonucleotide
guucaagagauccucccg

SEQ ID NO: 64204 - RNA, 18 nt, Artificial Sequence
  Description of Artificial Sequence: Synthetic oligonucleotide
cccagguucaagagaucc

SEQ ID NO: 64205 - RNA, 18 nt, Artificial Sequence
  Description of Artificial Sequence: Synthetic oligonucleotide
ugccucccagguucaaga

SEQ ID NO: 64206 - RNA, 18 nt, Artificial Sequence
  Description of Artificial Sequence: Synthetic oligonucleotide
accucugccucccagguu

SEQ ID NO: 64207 - RNA, 18 nt, Artificial Sequence
  Description of Artificial Sequence: Synthetic oligonucleotide
cugcaaccucugccuccc

SEQ ID NO: 64208 - RNA, 18 nt, Artificial Sequence
  Description of Artificial Sequence: Synthetic oligonucleotide
gcucacugcaaccucugc

SEQ ID NO: 64209 - RNA, 18 nt, Artificial Sequence
  Description of Artificial Sequence: Synthetic oligonucleotide
ucuaagcucacugcaacc

SEQ ID NO: 64210 - RNA, 18 nt, Artificial Sequence
  Description of Artificial Sequence: Synthetic oligonucleotide
caccaucuaagcucacug

SEQ ID NO: 64211 - RNA, 18 nt, Artificial Sequence
  Description of Artificial Sequence: Synthetic oligonucleotide
cuuaagaauagauaggag

SEQ ID NO: 64212 - RNA, 18 nt, Artificial Sequence
  Description of Artificial Sequence: Synthetic oligonucleotide
ugggucuuaagaauagau

SEQ ID NO: 64213 - RNA, 18 nt, Artificial Sequence
  Description of Artificial Sequence: Synthetic oligonucleotide
uaaguugggucuuaagaa

SEQ ID NO: 64214 - RNA, 18 nt, Artificial Sequence
  Description of Artificial Sequence: Synthetic oligonucleotide
auagguaaguugggucuu

SEQ ID NO: 64215 - RNA, 18 nt, Artificial Sequence
  Description of Artificial Sequence: Synthetic oligonucleotide
aaauuauagguaaguugg

SEQ ID NO: 64216 - RNA, 18 nt, Artificial Sequence
  Description of Artificial Sequence: Synthetic oligonucleotide
agaggaaauuauagguaa

SEQ ID NO: 64217 - RNA, 18 nt, Artificial Sequence
  Description of Artificial Sequence: Synthetic oligonucleotide
uccagagaggaaauuaua

SEQ ID NO: 64218 - RNA, 18 nt, Artificial Sequence
  Description of Artificial Sequence: Synthetic oligonucleotide
aaggcuccagagaggaaa

SEQ ID NO: 64219 - RNA, 18 nt, Artificial Sequence
  Description of Artificial Sequence: Synthetic oligonucleotide
ucggaaaggcuccagaga

SEQ ID NO: 64220 - RNA, 18 nt, Artificial Sequence
  Description of Artificial Sequence: Synthetic oligonucleotide
gagguucggaaaggcucc

SEQ ID NO: 64221 - RNA, 18 nt, Artificial Sequence
  Description of Artificial Sequence: Synthetic oligonucleotide
ggaaggagguucggaaag

SEQ ID NO: 64222 - RNA, 18 nt, Artificial Sequence
  Description of Artificial Sequence: Synthetic oligonucleotide
cugguggaaggagguucg

SEQ ID NO: 64223 - RNA, 18 nt, Artificial Sequence
  Description of Artificial Sequence: Synthetic oligonucleotide
uuggucugguggaaggag

SEQ ID NO: 64224 - RNA, 18 nt, Artificial Sequence
  Description of Artificial Sequence: Synthetic oligonucleotide
gaaacuuggucuggugga

SEQ ID NO: 64225 - RNA, 18 nt, Artificial Sequence
  Description of Artificial Sequence: Synthetic oligonucleotide
gagaagaaacuuggucug

SEQ ID NO: 64226 - RNA, 18 nt, Artificial Sequence
  Description of Artificial Sequence: Synthetic oligonucleotide
uagaggagaagaaacuug

SEQ ID NO: 64227 - RNA, 18 nt, Artificial Sequence
  Description of Artificial Sequence: Synthetic oligonucleotide
uguucuagaggagaagaa

SEQ ID NO: 64228 - RNA, 18 nt, Artificial Sequence
  Description of Artificial Sequence: Synthetic oligonucleotide
uaaaauguucuagaggag

SEQ ID NO: 64229 - RNA, 18 nt, Artificial Sequence
  Description of Artificial Sequence: Synthetic oligonucleotide
accuauaaaauguucuag

SEQ ID NO: 64230 - RNA, 18 nt, Artificial Sequence
  Description of Artificial Sequence: Synthetic oligonucleotide
gucacaccuauaaaaugu

SEQ ID NO: 64231 - RNA, 18 nt, Artificial Sequence
  Description of Artificial Sequence: Synthetic oligonucleotide
aaauggucacaccuauaa

SEQ ID NO: 64232 - RNA, 18 nt, Artificial Sequence
  Description of Artificial Sequence: Synthetic oligonucleotide
uacuaaaauggucacacc

SEQ ID NO: 64233 - RNA, 18 nt, Artificial Sequence
  Description of Artificial Sequence: Synthetic oligonucleotide
aaaaguacuaaaaugguc

SEQ ID NO: 64234 - RNA, 18 nt, Artificial Sequence
  Description of Artificial Sequence: Synthetic oligonucleotide
uauggaaaaguacuaaaa

SEQ ID NO: 64235 - RNA, 18 nt, Artificial Sequence
  Description of Artificial Sequence: Synthetic oligonucleotide
gaaauuauggaaaaguac

SEQ ID NO: 64236 - RNA, 18 nt, Artificial Sequence
  Description of Artificial Sequence: Synthetic oligonucleotide
caagugaaauuauggaaa

SEQ ID NO: 64237 - RNA, 18 nt, Artificial Sequence
  Description of Artificial Sequence: Synthetic oligonucleotide
aaacacaagugaaauuau

SEQ ID NO: 64238 - RNA, 18 nt, Artificial Sequence
  Description of Artificial Sequence: Synthetic oligonucleotide
uuuggaaacacaagugaa

SEQ ID NO: 64239 - RNA, 18 nt, Artificial Sequence
  Description of Artificial Sequence: Synthetic oligonucleotide
uuguguuuggaaacacaa

SEQ ID NO: 64240 - RNA, 18 nt, Artificial Sequence
  Description of Artificial Sequence: Synthetic oligonucleotide
uacuauuguguuuggaaa

SEQ ID NO: 64241 - RNA, 18 nt, Artificial Sequence
  Description of Artificial Sequence: Synthetic oligonucleotide
agcguuacuauuguguuu

SEQ ID NO: 64242 - RNA, 18 nt, Artificial Sequence
  Description of Artificial Sequence: Synthetic oligonucleotide
ugaacagcguuacuauug

SEQ ID NO: 64243 - RNA, 18 nt, Artificial Sequence
  Description of Artificial Sequence: Synthetic oligonucleotide
gauaaugaacagcguuac

SEQ ID NO: 64244 - RNA, 18 nt, Artificial Sequence
  Description of Artificial Sequence: Synthetic oligonucleotide
uauaagauaaugaacagc

SEQ ID NO: 64245 - RNA, 18 nt, Artificial Sequence
  Description of Artificial Sequence: Synthetic oligonucleotide
uucaauauaagauaauga

SEQ ID NO: 64246 - RNA, 18 nt, Artificial Sequence
  Description of Artificial Sequence: Synthetic oligonucleotide
acuguuucaauauaagau

SEQ ID NO: 64247 - RNA, 18 nt, Artificial Sequence
  Description of Artificial Sequence: Synthetic oligonucleotide
aauggacuguuucaauau

SEQ ID NO: 64248 - RNA, 18 nt, Artificial Sequence
  Description of Artificial Sequence: Synthetic oligonucleotide
gcaaaaauggacuguuuc

SEQ ID NO: 64249 - RNA, 18 nt, Artificial Sequence
  Description of Artificial Sequence: Synthetic oligonucleotide
uacaugcaaaaauggacu

SEQ ID NO: 64250 - RNA, 18 nt, Artificial Sequence
  Description of Artificial Sequence: Synthetic oligonucleotide
ugcucuacaugcaaaaau

SEQ ID NO: 64251 - RNA, 18 nt, Artificial Sequence
  Description of Artificial Sequence: Synthetic oligonucleotide
cuuucugcucuacaugca

SEQ ID NO: 64252 - RNA, 18 nt, Artificial Sequence
  Description of Artificial Sequence: Synthetic oligonucleotide
uucuacuuucugcucuac

SEQ ID NO: 64253 - RNA, 18 nt, Artificial Sequence
  Description of Artificial Sequence: Synthetic oligonucleotide
ugaacuucuacuuucugc

SEQ ID NO: 64254 - RNA, 18 nt, Artificial Sequence
  Description of Artificial Sequence: Synthetic oligonucleotide
agagcugaacuucuacuu

SEQ ID NO: 64255 - RNA, 18 nt, Artificial Sequence
  Description of Artificial Sequence: Synthetic oligonucleotide
gaaggagagcugaacuuc

SEQ ID NO: 64256 - RNA, 18 nt, Artificial Sequence
  Description of Artificial Sequence: Synthetic oligonucleotide
uaaaugaaggagagcuga

SEQ ID NO: 64257 - RNA, 18 nt, Artificial Sequence
  Description of Artificial Sequence: Synthetic oligonucleotide
ugagauaaaugaaggaga

SEQ ID NO: 64258 - RNA, 18 nt, Artificial Sequence
  Description of Artificial Sequence: Synthetic oligonucleotide
aggagugagauaaaugaa

SEQ ID NO: 64259 - RNA, 18 nt, Artificial Sequence
  Description of Artificial Sequence: Synthetic oligonucleotide
gggaaaggagugagauaa

SEQ ID NO: 64260 - RNA, 18 nt, Artificial Sequence
  Description of Artificial Sequence: Synthetic oligonucleotide
aagaagugggauaaaggg

SEQ ID NO: 64261 - RNA, 18 nt, Artificial Sequence
  Description of Artificial Sequence: Synthetic oligonucleotide
uggaaagaagugggauaa

SEQ ID NO: 64262 - RNA, 18 nt, Artificial Sequence
  Description of Artificial Sequence: Synthetic oligonucleotide
acauguggaaagaagugg

SEQ ID NO: 64263 - RNA, 18 nt, Artificial Sequence
  Description of Artificial Sequence: Synthetic oligonucleotide
ugcuuacauguggaaaga

SEQ ID NO: 64264 - RNA, 18 nt, Artificial Sequence
  Description of Artificial Sequence: Synthetic oligonucleotide
aauagugcuuacaugugg

SEQ ID NO: 64265 - RNA, 18 nt, Artificial Sequence
  Description of Artificial Sequence: Synthetic oligonucleotide
auccuaauagugcuuaca

SEQ ID NO: 64266 - RNA, 18 nt, Artificial Sequence
  Description of Artificial Sequence: Synthetic oligonucleotide
auaaaauccuaauagugc

SEQ ID NO: 64267 - RNA, 18 nt, Artificial Sequence
  Description of Artificial Sequence: Synthetic oligonucleotide
acacaauaaaauccuaau

SEQ ID NO: 64268 - RNA, 18 nt, Artificial Sequence
  Description of Artificial Sequence: Synthetic oligonucleotide
uacaaacacaauaaaauc

SEQ ID NO: 64269 - RNA, 18 nt, Artificial Sequence
  Description of Artificial Sequence: Synthetic oligonucleotide
auaaauacaaacacaaua

SEQ ID NO: 64270 - RNA, 18 nt, Artificial Sequence
  Description of Artificial Sequence: Synthetic oligonucleotide
gggagauaaauacaaaca

SEQ ID NO: 64271 - RNA, 18 nt, Artificial Sequence
  Description of Artificial Sequence: Synthetic oligonucleotide
gcucacaaucuggaaggg

SEQ ID NO: 64272 - RNA, 18 nt, Artificial Sequence
  Description of Artificial Sequence: Synthetic oligonucleotide
agaaaacccuagcccggg

SEQ ID NO: 64273 - RNA, 18 nt, Artificial Sequence
  Description of Artificial Sequence: Synthetic oligonucleotide
agcacagaaaacccuagc

SEQ ID NO: 64274 - RNA, 18 nt, Artificial Sequence
  Description of Artificial Sequence: Synthetic oligonucleotide
acuccagcacagaaaacc

SEQ ID NO: 64275 - RNA, 18 nt, Artificial Sequence
  Description of Artificial Sequence: Synthetic oligonucleotide
uagauacuccagcacaga

SEQ ID NO: 64276 - RNA, 18 nt, Artificial Sequence
  Description of Artificial Sequence: Synthetic oligonucleotide
cccguuagauacuccagc

SEQ ID NO: 64277 - RNA, 18 nt, Artificial Sequence
  Description of Artificial Sequence: Synthetic oligonucleotide
ugggccccguuagauacu

SEQ ID NO: 64278 - RNA, 18 nt, Artificial Sequence
  Description of Artificial Sequence: Synthetic oligonucleotide
ggcccugggccccguuag

SEQ ID NO: 64279 - RNA, 18 nt, Artificial Sequence
  Description of Artificial Sequence: Synthetic oligonucleotide
agaaaggcccugggcccc

SEQ ID NO: 64280 - RNA, 18 nt, Artificial Sequence
  Description of Artificial Sequence: Synthetic oligonucleotide
cucucagaaaggcccugg

SEQ ID NO: 64281 - RNA, 18 nt, Artificial Sequence
  Description of Artificial Sequence: Synthetic oligonucleotide
caucccucucagaaaggc

SEQ ID NO: 64282 - RNA, 18 nt, Artificial Sequence
  Description of Artificial Sequence: Synthetic oligonucleotide
gagcucaucccucucaga

SEQ ID NO: 64283 - RNA, 18 nt, Artificial Sequence
  Description of Artificial Sequence: Synthetic oligonucleotide
uccaggagcucaucccuc

SEQ ID NO: 64284 - RNA, 18 nt, Artificial Sequence
  Description of Artificial Sequence: Synthetic oligonucleotide
cacucuccaggagcucau

SEQ ID NO: 64285 - RNA, 18 nt, Artificial Sequence
  Description of Artificial Sequence: Synthetic oligonucleotide
ccucccacucuccaggag

SEQ ID NO: 64286 - RNA, 18 nt, Artificial Sequence
  Description of Artificial Sequence: Synthetic oligonucleotide
cuauaccucccacucucc

SEQ ID NO: 64287 - RNA, 18 nt, Artificial Sequence
  Description of Artificial Sequence: Synthetic oligonucleotide
ccucccuauaccucccac

SEQ ID NO: 64288 - RNA, 18 nt, Artificial Sequence
  Description of Artificial Sequence: Synthetic oligonucleotide
ucaucccucccuauaccu

SEQ ID NO: 64289 - RNA, 18 nt, Artificial Sequence
  Description of Artificial Sequence: Synthetic oligonucleotide
ucucaucaucccucccua

SEQ ID NO: 64290 - RNA, 18 nt, Artificial Sequence
  Description of Artificial Sequence: Synthetic oligonucleotide
ucuccucucaucaucccu

SEQ ID NO: 64291 - RNA, 18 nt, Artificial Sequence
  Description of Artificial Sequence: Synthetic oligonucleotide
ugagaucuccucucauca

SEQ ID NO: 64292 - RNA, 18 nt, Artificial Sequence
  Description of Artificial Sequence: Synthetic oligonucleotide
agucaugagaucuccucu

SEQ ID NO: 64293 - RNA, 18 nt, Artificial Sequence
  Description of Artificial Sequence: Synthetic oligonucleotide
ugcagagucaugagaucu

SEQ ID NO: 64294 - RNA, 18 nt, Artificial Sequence
  Description of Artificial Sequence: Synthetic oligonucleotide
cagggugcagagucauga

SEQ ID NO: 64295 - RNA, 18 nt, Artificial Sequence
  Description of Artificial Sequence: Synthetic oligonucleotide
guuaccagggugcagagu

SEQ ID NO: 64296 - RNA, 18 nt, Artificial Sequence
  Description of Artificial Sequence: Synthetic oligonucleotide
gggagguuaccagggugc

SEQ ID NO: 64297 - RNA, 18 nt, Artificial Sequence
  Description of Artificial Sequence: Synthetic oligonucleotide
gaaaggacagaaaucggg

SEQ ID NO: 64298 - RNA, 18 nt, Artificial Sequence
  Description of Artificial Sequence: Synthetic oligonucleotide
agugaaaggacagaaauc

SEQ ID NO: 64299 - RNA, 18 nt, Artificial Sequence
  Description of Artificial Sequence: Synthetic oligonucleotide
uggaagcugcucauaaau

SEQ ID NO: 64300 - RNA, 18 nt, Artificial Sequence
  Description of Artificial Sequence: Synthetic oligonucleotide
acuucuggaagcugcuca

SEQ ID NO: 64301 - RNA, 18 nt, Artificial Sequence
  Description of Artificial Sequence: Synthetic oligonucleotide
ucuguacuucuggaagcu

SEQ ID NO: 64302 - RNA, 18 nt, Artificial Sequence
  Description of Artificial Sequence: Synthetic oligonucleotide
cuuuuucuguacuucugg

SEQ ID NO: 64303 - RNA, 18 nt, Artificial Sequence
  Description of Artificial Sequence: Synthetic oligonucleotide
ucucucuuuuucuguacu

SEQ ID NO: 64304 - RNA, 18 nt, Artificial Sequence
  Description of Artificial Sequence: Synthetic oligonucleotide
cuucuucucucuuuuucu

SEQ ID NO: 64305 - RNA, 18 nt, Artificial Sequence
  Description of Artificial Sequence: Synthetic oligonucleotide
cuucucuucuucucucuu

SEQ ID NO: 64306 - RNA, 18 nt, Artificial Sequence
  Description of Artificial Sequence: Synthetic oligonucleotide
uuucucuucucuucuucu

SEQ ID NO: 64307 - RNA, 18 nt, Artificial Sequence
  Description of Artificial Sequence: Synthetic oligonucleotide
cugauuuucucuucucuu

SEQ ID NO: 64308 - RNA, 18 nt, Artificial Sequence
  Description of Artificial Sequence: Synthetic oligonucleotide
auauucugauuuucucuu

SEQ ID NO: 64309 - RNA, 18 nt, Artificial Sequence
  Description of Artificial Sequence: Synthetic oligonucleotide
gacuuauauucugauuuu

SEQ ID NO: 64310 - RNA, 18 nt, Artificial Sequence
  Description of Artificial Sequence: Synthetic oligonucleotide
gguaugacuuauauucug

SEQ ID NO: 64311 - RNA, 18 nt, Artificial Sequence
  Description of Artificial Sequence: Synthetic oligonucleotide
cagccgguaugacuuaua

SEQ ID NO: 64312 - RNA, 18 nt, Artificial Sequence
  Description of Artificial Sequence: Synthetic oligonucleotide
gcucgcagccgguaugac

SEQ ID NO: 64313 - RNA, 18 nt, Artificial Sequence
  Description of Artificial Sequence: Synthetic oligonucleotide
gcugggcucgcagccggu

SEQ ID NO: 64314 - RNA, 18 nt, Artificial Sequence
  Description of Artificial Sequence: Synthetic oligonucleotide
auauagcugggcucgcag

SEQ ID NO: 64315 - RNA, 18 nt, Artificial Sequence
  Description of Artificial Sequence: Synthetic oligonucleotide
uuuuuauauagcugggcu

SEQ ID NO: 64316 - RNA, 18 nt, Artificial Sequence
  Description of Artificial Sequence: Synthetic oligonucleotide
acuaccaaguaucuuggu

SEQ ID NO: 64317 - RNA, 18 nt, Artificial Sequence
  Description of Artificial Sequence: Synthetic oligonucleotide
cggucacuaccaaguauc

SEQ ID NO: 64318 - RNA, 18 nt, Artificial Sequence
  Description of Artificial Sequence: Synthetic oligonucleotide
ucacccggucacuaccaa

SEQ ID NO: 64319 - RNA, 18 nt, Artificial Sequence
  Description of Artificial Sequence: Synthetic oligonucleotide
cagcuucacccggucacu

SEQ ID NO: 64320 - RNA, 18 nt, Artificial Sequence
  Description of Artificial Sequence: Synthetic oligonucleotide
uccaucagcuucacccgg

SEQ ID NO: 64321 - RNA, 18 nt, Artificial Sequence
  Description of Artificial Sequence: Synthetic oligonucleotide
gacucuccaucagcuuca

SEQ ID NO: 64322 - RNA, 18 nt, Artificial Sequence
  Description of Artificial Sequence: Synthetic oligonucleotide
cacuagacucuccaucag

SEQ ID NO: 64323 - RNA, 18 nt, Artificial Sequence
  Description of Artificial Sequence: Synthetic oligonucleotide
ccaaccacuagacucucc

SEQ ID NO: 64324 - RNA, 18 nt, Artificial Sequence
  Description of Artificial Sequence: Synthetic oligonucleotide
ugucuccaaccacuagac

SEQ ID NO: 64325 - RNA, 18 nt, Artificial Sequence
  Description of Artificial Sequence: Synthetic oligonucleotide
ugcaaugucuccaaccac

SEQ ID NO: 64326 - RNA, 18 nt, Artificial Sequence
  Description of Artificial Sequence: Synthetic oligonucleotide
agcucugcaaugucucca

SEQ ID NO: 64327 - RNA, 18 nt, Artificial Sequence
  Description of Artificial Sequence: Synthetic oligonucleotide
gucuuagcucugcaaugu

SEQ ID NO: 64328 - RNA, 18 nt, Artificial Sequence
  Description of Artificial Sequence: Synthetic oligonucleotide
guuuggucuuagcucugc

SEQ ID NO: 64329 - RNA, 18 nt, Artificial Sequence
  Description of Artificial Sequence: Synthetic oligonucleotide
agagcagaaauaaaaggg

SEQ ID NO: 64330 - RNA, 18 nt, Artificial Sequence
  Description of Artificial Sequence: Synthetic oligonucleotide
cucauagagcagaaauaa

SEQ ID NO: 64331 - RNA, 18 nt, Artificial Sequence
  Description of Artificial Sequence: Synthetic oligonucleotide
gaaaacucauagagcaga

SEQ ID NO: 64332 - RNA, 18 nt, Artificial Sequence
  Description of Artificial Sequence: Synthetic oligonucleotide
acuaagaaaacucauaga

SEQ ID NO: 64333 - RNA, 18 nt, Artificial Sequence
  Description of Artificial Sequence: Synthetic oligonucleotide
ucaugacuaagaaaacuc

SEQ ID NO: 64334 - RNA, 18 nt, Artificial Sequence
  Description of Artificial Sequence: Synthetic oligonucleotide
cuggcucaugacuaagaa

SEQ ID NO: 64335 - RNA, 18 nt, Artificial Sequence
  Description of Artificial Sequence: Synthetic oligonucleotide
auuugcuggcucaugacu

SEQ ID NO: 64336 - RNA, 18 nt, Artificial Sequence
  Description of Artificial Sequence: Synthetic oligonucleotide
agcccauuugcuggcuca

SEQ ID NO: 64337 - RNA, 18 nt, Artificial Sequence
  Description of Artificial Sequence: Synthetic oligonucleotide
gacucagcccauuugcug

SEQ ID NO: 64338 - RNA, 18 nt, Artificial Sequence
  Description of Artificial Sequence: Synthetic oligonucleotide
guagggacucagcccauu

SEQ ID NO: 64339 - RNA, 18 nt, Artificial Sequence
  Description of Artificial Sequence: Synthetic oligonucleotide
cugagguagggacucagc

SEQ ID NO: 64340 - RNA, 18 nt, Artificial Sequence
  Description of Artificial Sequence: Synthetic oligonucleotide
uaagccugagguagggac

SEQ ID NO: 64341 - RNA, 18 nt, Artificial Sequence
  Description of Artificial Sequence: Synthetic oligonucleotide
gccccuaagccugaggua

SEQ ID NO: 64342 - RNA, 18 nt, Artificial Sequence
  Description of Artificial Sequence: Synthetic oligonucleotide
ucugugccccuaagccug

SEQ ID NO: 64343 - RNA, 18 nt, Artificial Sequence
  Description of Artificial Sequence: Synthetic oligonucleotide
ucaucucugugccccuaa

SEQ ID NO: 64344 - RNA, 18 nt, Artificial Sequence
  Description of Artificial Sequence: Synthetic oligonucleotide
uugacucaucucugugcc

SEQ ID NO: 64345 - RNA, 18 nt, Artificial Sequence
  Description of Artificial Sequence: Synthetic oligonucleotide
uguguuugacucaucucu

SEQ ID NO: 64346 - RNA, 18 nt, Artificial Sequence
  Description of Artificial Sequence: Synthetic oligonucleotide
gaagcuguguuugacuca

SEQ ID NO: 64347 - RNA, 18 nt, Artificial Sequence
  Description of Artificial Sequence: Synthetic oligonucleotide
ccugagaagcuguguuug

SEQ ID NO: 64348 - RNA, 18 nt, Artificial Sequence
  Description of Artificial Sequence: Synthetic oligonucleotide
caagcccugagaagcugu

SEQ ID NO: 64349 - RNA, 18 nt, Artificial Sequence
  Description of Artificial Sequence: Synthetic oligonucleotide
gacugcaagcccugagaa

SEQ ID NO: 64350 - RNA, 18 nt, Artificial Sequence
  Description of Artificial Sequence: Synthetic oligonucleotide
uccaagacugcaagcccu

SEQ ID NO: 64351 - RNA, 18 nt, Artificial Sequence
  Description of Artificial Sequence: Synthetic oligonucleotide
uucuguccaagacugcaa

SEQ ID NO: 64352 - RNA, 18 nt, Artificial Sequence
  Description of Artificial Sequence: Synthetic oligonucleotide
agggauucuguccaagac

SEQ ID NO: 64353 - RNA, 18 nt, Artificial Sequence
  Description of Artificial Sequence: Synthetic oligonucleotide
gacucagggauucugucc

SEQ ID NO: 64354 - RNA, 18 nt, Artificial Sequence
  Description of Artificial Sequence: Synthetic oligonucleotide
gaaaugacucagggauuc

SEQ ID NO: 64355 - RNA, 18 nt, Artificial Sequence
  Description of Artificial Sequence: Synthetic oligonucleotide
cucuggaaaugacucagg

SEQ ID NO: 64356 - RNA, 18 nt, Artificial Sequence
  Description of Artificial Sequence: Synthetic oligonucleotide
ugugucucuggaaaugac

SEQ ID NO: 64357 - RNA, 18 nt, Artificial Sequence
  Description of Artificial Sequence: Synthetic oligonucleotide
augucugugucucuggaa

SEQ ID NO: 64358 - RNA, 18 nt, Artificial Sequence
  Description of Artificial Sequence: Synthetic oligonucleotide
uacaaaugucugugucuc

SEQ ID NO: 64359 - RNA, 18 nt, Artificial Sequence
  Description of Artificial Sequence: Synthetic oligonucleotide
cucccuacaaaugucugu

SEQ ID NO: 64360 - RNA, 18 nt, Artificial Sequence
  Description of Artificial Sequence: Synthetic oligonucleotide
uuccccucccuacaaaug

SEQ ID NO: 64361 - RNA, 18 nt, Artificial Sequence
  Description of Artificial Sequence: Synthetic oligonucleotide
ggauauuccccucccuac

SEQ ID NO: 64362 - RNA, 18 nt, Artificial Sequence
  Description of Artificial Sequence: Synthetic oligonucleotide
gacugggauauuccccuc

SEQ ID NO: 64363 - RNA, 18 nt, Artificial Sequence
  Description of Artificial Sequence: Synthetic oligonucleotide
aguaagacugggauauuc

SEQ ID NO: 64364 - RNA, 18 nt, Artificial Sequence
  Description of Artificial Sequence: Synthetic oligonucleotide
gauguaguaagacuggga

SEQ ID NO: 64365 - RNA, 18 nt, Artificial Sequence
  Description of Artificial Sequence: Synthetic oligonucleotide
agccugauguaguaagac

SEQ ID NO: 64366 - RNA, 18 nt, Artificial Sequence
  Description of Artificial Sequence: Synthetic oligonucleotide
cuccuagccugauguagu

SEQ ID NO: 64367 - RNA, 18 nt, Artificial Sequence
  Description of Artificial Sequence: Synthetic oligonucleotide
cuggccuccuagccugau

SEQ ID NO: 64368 - RNA, 18 nt, Artificial Sequence
  Description of Artificial Sequence: Synthetic oligonucleotide
gguuucuggccuccuagc

SEQ ID NO: 64369 - RNA, 18 nt, Artificial Sequence
  Description of Artificial Sequence: Synthetic oligonucleotide
accuugguuucuggccuc

SEQ ID NO: 64370 - RNA, 18 nt, Artificial Sequence
  Description of Artificial Sequence: Synthetic oligonucleotide
uauuaaccuugguuucug

SEQ ID NO: 64371 - RNA, 18 nt, Artificial Sequence
  Description of Artificial Sequence: Synthetic oligonucleotide
cagcauauuaaccuuggu

SEQ ID NO: 64372 - RNA, 18 nt, Artificial Sequence
  Description of Artificial Sequence: Synthetic oligonucleotide
gagagcagcauauuaacc

SEQ ID NO: 64373 - RNA, 18 nt, Artificial Sequence
  Description of Artificial Sequence: Synthetic oligonucleotide
ggccagagagcagcauau

SEQ ID NO: 64374 - RNA, 18 nt, Artificial Sequence
  Description of Artificial Sequence: Synthetic oligonucleotide
gggauggccagagagcag

SEQ ID NO: 64375 - RNA, 18 nt, Artificial Sequence
  Description of Artificial Sequence: Synthetic oligonucleotide
cagaagggauggccagag

SEQ ID NO: 64376 - RNA, 18 nt, Artificial Sequence
  Description of Artificial Sequence: Synthetic oligonucleotide
uuaagcagaagggauggc

SEQ ID NO: 64377 - RNA, 18 nt, Artificial Sequence
  Description of Artificial Sequence: Synthetic oligonucleotide
ggguuaagcagaagggau

SEQ ID NO: 64378 - RNA, 18 nt, Artificial Sequence
  Description of Artificial Sequence: Synthetic oligonucleotide
cauguugaauagagaggg

SEQ ID NO: 64379 - RNA, 18 nt, Artificial Sequence
  Description of Artificial Sequence: Synthetic oligonucleotide
gaccacauguugaauaga

SEQ ID NO: 64380 - RNA, 18 nt, Artificial Sequence
  Description of Artificial Sequence: Synthetic oligonucleotide
ccagggaccacauguuga

SEQ ID NO: 64381 - RNA, 18 nt, Artificial Sequence
  Description of Artificial Sequence: Synthetic oligonucleotide
ccuggccagggaccacau

SEQ ID NO: 64382 - RNA, 18 nt, Artificial Sequence
  Description of Artificial Sequence: Synthetic oligonucleotide
cgucgccuggccagggac

SEQ ID NO: 64383 - RNA, 18 nt, Artificial Sequence
  Description of Artificial Sequence: Synthetic oligonucleotide
agucacgucgccuggcca

SEQ ID NO: 64384 - RNA, 18 nt, Artificial Sequence
  Description of Artificial Sequence: Synthetic oligonucleotide
guuugagucacgucgccu

SEQ ID NO: 64385 - RNA, 18 nt, Artificial Sequence
  Description of Artificial Sequence: Synthetic oligonucleotide
cagguguuugagucacgu

SEQ ID NO: 64386 - RNA, 18 nt, Artificial Sequence
  Description of Artificial Sequence: Synthetic oligonucleotide
gauuacagguguuugagu

SEQ ID NO: 64387 - RNA, 18 nt, Artificial Sequence
  Description of Artificial Sequence: Synthetic oligonucleotide
gccaggauuacagguguu

SEQ ID NO: 64388 - RNA, 18 nt, Artificial Sequence
  Description of Artificial Sequence: Synthetic oligonucleotide
caagugccaggauuacag

SEQ ID NO: 64389 - RNA, 18 nt, Artificial Sequence
  Description of Artificial Sequence: Synthetic oligonucleotide
cuccccaagugccaggau

SEQ ID NO: 64390 - RNA, 18 nt, Artificial Sequence
  Description of Artificial Sequence: Synthetic oligonucleotide
uuggccuccccaagugcc

SEQ ID NO: 64391 - RNA, 18 nt, Artificial Sequence
  Description of Artificial Sequence: Synthetic oligonucleotide
ccgccuuggccuccccaa

SEQ ID NO: 64392 - RNA, 18 nt, Artificial Sequence
  Description of Artificial Sequence: Synthetic oligonucleotide
uccacccgccuuggccuc

SEQ ID NO: 64393 - RNA, 18 nt, Artificial Sequence
  Description of Artificial Sequence: Synthetic oligonucleotide
ggugauccacccgccuug

SEQ ID NO: 64394 - RNA, 18 nt, Artificial Sequence
  Description of Artificial Sequence: Synthetic oligonucleotide
ccucaggugauccacccg

SEQ ID NO: 64395 - RNA, 18 nt, Artificial Sequence
  Description of Artificial Sequence: Synthetic oligonucleotide
ccugaccucaggugaucc

SEQ ID NO: 64396 - RNA, 18 nt, Artificial Sequence
  Description of Artificial Sequence: Synthetic oligonucleotide
gaacuccugaccucaggu

SEQ ID NO: 64397 - RNA, 18 nt, Artificial Sequence
  Description of Artificial Sequence: Synthetic oligonucleotide
gucucgaacuccugaccu

SEQ ID NO: 64398 - RNA, 18 nt, Artificial Sequence
  Description of Artificial Sequence: Synthetic oligonucleotide
ggcuggucucgaacuccu

SEQ ID NO: 64399 - RNA, 18 nt, Artificial Sequence
  Description of Artificial Sequence: Synthetic oligonucleotide
ggccaggcuggucucgaa

SEQ ID NO: 64400 - RNA, 18 nt, Artificial Sequence
  Description of Artificial Sequence: Synthetic oligonucleotide
auguuggccaggcugguc

SEQ ID NO: 64401 - RNA, 18 nt, Artificial Sequence
  Description of Artificial Sequence: Synthetic oligonucleotide
uugccauguuggccaggc

SEQ ID NO: 64402 - RNA, 18 nt, Artificial Sequence
  Description of Artificial Sequence: Synthetic oligonucleotide
agguuuugccauguuggc

SEQ ID NO: 64403 - RNA, 18 nt, Artificial Sequence
  Description of Artificial Sequence: Synthetic oligonucleotide
aaacgagguuuugccaug

SEQ ID NO: 64404 - RNA, 18 nt, Artificial Sequence
  Description of Artificial Sequence: Synthetic oligonucleotide
aguagaaacgagguuuug

SEQ ID NO: 64405 - RNA, 18 nt, Artificial Sequence
  Description of Artificial Sequence: Synthetic oligonucleotide
uuuuuaguagaaacgagg

SEQ ID NO: 64406 - RNA, 18 nt, Artificial Sequence
  Description of Artificial Sequence: Synthetic oligonucleotide
uuguguuuuuaguagaaa

SEQ ID NO: 64407 - RNA, 18 nt, Artificial Sequence
  Description of Artificial Sequence: Synthetic oligonucleotide
aauuuuuguguuuuuagu

SEQ ID NO: 64408 - RNA, 18 nt, Artificial Sequence
  Description of Artificial Sequence: Synthetic oligonucleotide
cggcuaauuuuuguguuu

SEQ ID NO: 64409 - RNA, 18 nt, Artificial Sequence
  Description of Artificial Sequence: Synthetic oligonucleotide
acgcccggcuaauuuuug

SEQ ID NO: 64410 - RNA, 18 nt, Artificial Sequence
  Description of Artificial Sequence: Synthetic oligonucleotide
ccaccacgcccggcuaau

SEQ ID NO: 64411 - RNA, 18 nt, Artificial Sequence
  Description of Artificial Sequence: Synthetic oligonucleotide
acgcgccaccacgcccgg

SEQ ID NO: 64412 - RNA, 18 nt, Artificial Sequence
  Description of Artificial Sequence: Synthetic oligonucleotide
caagcacgcgccaccacg

SEQ ID NO: 64413 - RNA, 18 nt, Artificial Sequence
  Description of Artificial Sequence: Synthetic oligonucleotide
gacuacaagcacgcgcca

SEQ ID NO: 64414 - RNA, 18 nt, Artificial Sequence
  Description of Artificial Sequence: Synthetic oligonucleotide
gcugggacuacaagcacg

SEQ ID NO: 64415 - RNA, 18 nt, Artificial Sequence
  Description of Artificial Sequence: Synthetic oligonucleotide
gaguagcugggacuacaa

SEQ ID NO: 64416 - RNA, 18 nt, Artificial Sequence
  Description of Artificial Sequence: Synthetic oligonucleotide
cucccgaguagcugggac

SEQ ID NO: 64417 - RNA, 18 nt, Artificial Sequence
  Description of Artificial Sequence: Synthetic oligonucleotide
ucagccucccgaguagcu

SEQ ID NO: 64418 - RNA, 18 nt, Artificial Sequence
  Description of Artificial Sequence: Synthetic oligonucleotide
caaccucagccucccgag

SEQ ID NO: 64419 - RNA, 18 nt, Artificial Sequence
  Description of Artificial Sequence: Synthetic oligonucleotide
ugcugcaaccucagccuc

SEQ ID NO: 64420 - RNA, 18 nt, Artificial Sequence
  Description of Artificial Sequence: Synthetic oligonucleotide
cagcuugcugcaaccuca

SEQ ID NO: 64421 - RNA, 18 nt, Artificial Sequence
  Description of Artificial Sequence: Synthetic oligonucleotide
aaccucagcuugcugcaa

SEQ ID NO: 64422 - RNA, 18 nt, Artificial Sequence
  Description of Artificial Sequence: Synthetic oligonucleotide
ggugcaaccucagcuugc

SEQ ID NO: 64423 - RNA, 18 nt, Artificial Sequence
  Description of Artificial Sequence: Synthetic oligonucleotide
gcaguggugcaaccucag

SEQ ID NO: 64424 - RNA, 18 nt, Artificial Sequence
  Description of Artificial Sequence: Synthetic oligonucleotide
agagugcaguggugcaac

SEQ ID NO: 64425 - RNA, 18 nt, Artificial Sequence
  Description of Artificial Sequence: Synthetic oligonucleotide
aggccagagugcaguggu

SEQ ID NO: 64426 - RNA, 18 nt, Artificial Sequence
  Description of Artificial Sequence: Synthetic oligonucleotide
ugcccaggccagagugca

SEQ ID NO: 64427 - RNA, 18 nt, Artificial Sequence
  Description of Artificial Sequence: Synthetic oligonucleotide
uacaaucaagucaucuaa

SEQ ID NO: 64428 - RNA, 18 nt, Artificial Sequence
  Description of Artificial Sequence: Synthetic oligonucleotide
uugguuacaaucaaguca

SEQ ID NO: 64429 - RNA, 18 nt, Artificial Sequence
  Description of Artificial Sequence: Synthetic oligonucleotide
aaguauugguuacaauca

SEQ ID NO: 64430 - RNA, 18 nt, Artificial Sequence
  Description of Artificial Sequence: Synthetic oligonucleotide
cucagaaguauugguuac

SEQ ID NO: 64431 - RNA, 18 nt, Artificial Sequence
  Description of Artificial Sequence: Synthetic oligonucleotide
uggcccucagaaguauug

SEQ ID NO: 64432 - RNA, 18 nt, Artificial Sequence
  Description of Artificial Sequence: Synthetic oligonucleotide
acagguggcccucagaag

SEQ ID NO: 64433 - RNA, 18 nt, Artificial Sequence
  Description of Artificial Sequence: Synthetic oligonucleotide
cacauacagguggcccuc

SEQ ID NO: 64434 - RNA, 18 nt, Artificial Sequence
  Description of Artificial Sequence: Synthetic oligonucleotide
gacaccacauacaggugg

SEQ ID NO: 64435 - RNA, 18 nt, Artificial Sequence
  Description of Artificial Sequence: Synthetic oligonucleotide
cguuggacaccacauaca

SEQ ID NO: 64436 - RNA, 18 nt, Artificial Sequence
  Description of Artificial Sequence: Synthetic oligonucleotide
gccagcguuggacaccac

SEQ ID NO: 64437 - RNA, 18 nt, Artificial Sequence
  Description of Artificial Sequence: Synthetic oligonucleotide
cagcagccagcguuggac

SEQ ID NO: 64438 - RNA, 18 nt, Artificial Sequence
  Description of Artificial Sequence: Synthetic oligonucleotide
ucucccagcagccagcgu

SEQ ID NO: 64439 - RNA, 18 nt, Artificial Sequence
  Description of Artificial Sequence: Synthetic oligonucleotide
aucuuucucccagcagcc

SEQ ID NO: 64440 - RNA, 18 nt, Artificial Sequence
  Description of Artificial Sequence: Synthetic oligonucleotide
gccaaaucuuucucccag

SEQ ID NO: 64441 - RNA, 18 nt, Artificial Sequence
  Description of Artificial Sequence: Synthetic oligonucleotide
ugagggccaaaucuuucu

SEQ ID NO: 64442 - RNA, 18 nt, Artificial Sequence
  Description of Artificial Sequence: Synthetic oligonucleotide
cugcaugagggccaaauc

SEQ ID NO: 64443 - RNA, 18 nt, Artificial Sequence
  Description of Artificial Sequence: Synthetic oligonucleotide
uauaccugcaugagggcc

SEQ ID NO: 64444 - RNA, 18 nt, Artificial Sequence
  Description of Artificial Sequence: Synthetic oligonucleotide
ugucuagaacacagaggg

SEQ ID NO: 64445 - RNA, 18 nt, Artificial Sequence
  Description of Artificial Sequence: Synthetic oligonucleotide
caaggugucuagaacaca

SEQ ID NO: 64446 - RNA, 18 nt, Artificial Sequence
  Description of Artificial Sequence: Synthetic oligonucleotide
gaagacaaggugucuaga

SEQ ID NO: 64447 - RNA, 18 nt, Artificial Sequence
  Description of Artificial Sequence: Synthetic oligonucleotide
acaaggaagacaaggugu

SEQ ID NO: 64448 - RNA, 18 nt, Artificial Sequence
  Description of Artificial Sequence: Synthetic oligonucleotide
uaugaacaaggaagacaa

SEQ ID NO: 64449 - RNA, 18 nt, Artificial Sequence
  Description of Artificial Sequence: Synthetic oligonucleotide
ugcucuaugaacaaggaa

SEQ ID NO: 64450 - RNA, 18 nt, Artificial Sequence
  Description of Artificial Sequence: Synthetic oligonucleotide
gauacugcucuaugaaca

SEQ ID NO: 64451 - RNA, 18 nt, Artificial Sequence
  Description of Artificial Sequence: Synthetic oligonucleotide
acaaggauacugcucuau

SEQ ID NO: 64452 - RNA, 18 nt, Artificial Sequence
  Description of Artificial Sequence: Synthetic oligonucleotide
ggacaacaaggauacugc

SEQ ID NO: 64453 - RNA, 18 nt, Artificial Sequence
  Description of Artificial Sequence: Synthetic oligonucleotide
gucuuggacaacaaggau

SEQ ID NO: 64454 - RNA, 18 nt, Artificial Sequence
  Description of Artificial Sequence: Synthetic oligonucleotide
acccugucuuggacaaca

SEQ ID NO: 64455 - RNA, 18 nt, Artificial Sequence
  Description of Artificial Sequence: Synthetic oligonucleotide
ugccaacccugucuugga

SEQ ID NO: 64456 - RNA, 18 nt, Artificial Sequence
  Description of Artificial Sequence: Synthetic oligonucleotide
gucugugccaacccuguc

SEQ ID NO: 64457 - RNA, 18 nt, Artificial Sequence
  Description of Artificial Sequence: Synthetic oligonucleotide
cccuugucugugccaacc

SEQ ID NO: 64458 - RNA, 18 nt, Artificial Sequence
  Description of Artificial Sequence: Synthetic oligonucleotide
caggucccuugucugugc

SEQ ID NO: 64459 - RNA, 18 nt, Artificial Sequence
  Description of Artificial Sequence: Synthetic oligonucleotide
uuuuccaggucccuuguc

SEQ ID NO: 64460 - RNA, 18 nt, Artificial Sequence
  Description of Artificial Sequence: Synthetic oligonucleotide
agccauuuuccagguccc

SEQ ID NO: 64461 - RNA, 18 nt, Artificial Sequence
  Description of Artificial Sequence: Synthetic oligonucleotide
gaaagagccauuuuccag

SEQ ID NO: 64462 - RNA, 18 nt, Artificial Sequence
  Description of Artificial Sequence: Synthetic oligonucleotide
ucacugaaagagccauuu

SEQ ID NO: 64463 - RNA, 18 nt, Artificial Sequence
  Description of Artificial Sequence: Synthetic oligonucleotide
uucauucacugaaagagc

SEQ ID NO: 64464 - RNA, 18 nt, Artificial Sequence
  Description of Artificial Sequence: Synthetic oligonucleotide
agcuguucauucacugaa

SEQ ID NO: 64465 - RNA, 18 nt, Artificial Sequence
  Description of Artificial Sequence: Synthetic oligonucleotide
cucauagcuguucauuca

SEQ ID NO: 64466 - RNA, 18 nt, Artificial Sequence
  Description of Artificial Sequence: Synthetic oligonucleotide
ugagucucauagcuguuc

SEQ ID NO: 64467 - RNA, 18 nt, Artificial Sequence
  Description of Artificial Sequence: Synthetic oligonucleotide
gcucuugagucucauagc

SEQ ID NO: 64468 - RNA, 18 nt, Artificial Sequence
  Description of Artificial Sequence: Synthetic oligonucleotide
ggccugcucuugagucuc

SEQ ID NO: 64469 - RNA, 18 nt, Artificial Sequence
  Description of Artificial Sequence: Synthetic oligonucleotide
gagagggccugcucuuga

SEQ ID NO: 64470 - RNA, 18 nt, Artificial Sequence
  Description of Artificial Sequence: Synthetic oligonucleotide
cuccagagagggccugcu

SEQ ID NO: 64471 - RNA, 18 nt, Artificial Sequence
  Description of Artificial Sequence: Synthetic oligonucleotide
gcgugcuccagagagggc

SEQ ID NO: 64472 - RNA, 18 nt, Artificial Sequence
  Description of Artificial Sequence: Synthetic oligonucleotide
cccuggcgugcuccagag

SEQ ID NO: 64473 - RNA, 18 nt, Artificial Sequence
  Description of Artificial Sequence: Synthetic oligonucleotide
ccaaacccuggcgugcuc

SEQ ID NO: 64474 - RNA, 18 nt, Artificial Sequence
  Description of Artificial Sequence: Synthetic oligonucleotide
caccaccaaacccuggcg

SEQ ID NO: 64475 - RNA, 18 nt, Artificial Sequence
  Description of Artificial Sequence: Synthetic oligonucleotide
ucccccaccaccaaaccc

SEQ ID NO: 64476 - RNA, 18 nt, Artificial Sequence
  Description of Artificial Sequence: Synthetic oligonucleotide
gguaaucccccaccacca

SEQ ID NO: 64477 - RNA, 18 nt, Artificial Sequence
  Description of Artificial Sequence: Synthetic oligonucleotide
ugccugguaaucccccac

SEQ ID NO: 64478 - RNA, 18 nt, Artificial Sequence
  Description of Artificial Sequence: Synthetic oligonucleotide
ccccaugccugguaaucc

SEQ ID NO: 64479 - RNA, 18 nt, Artificial Sequence
  Description of Artificial Sequence: Synthetic oligonucleotide
ccccuccccaugccuggu

SEQ ID NO: 64480 - RNA, 18 nt, Artificial Sequence
  Description of Artificial Sequence: Synthetic oligonucleotide
aagacccccuccccaugc

SEQ ID NO: 64481 - RNA, 18 nt, Artificial Sequence
  Description of Artificial Sequence: Synthetic oligonucleotide
gggccaagacccccuccc

SEQ ID NO: 64482 - RNA, 18 nt, Artificial Sequence
  Description of Artificial Sequence: Synthetic oligonucleotide
ccaccucacaccagaggg

SEQ ID NO: 64483 - RNA, 18 nt, Artificial Sequence
  Description of Artificial Sequence: Synthetic oligonucleotide
cugccaccucacaccaga

SEQ ID NO: 64484 - RNA, 18 nt, Artificial Sequence
  Description of Artificial Sequence: Synthetic oligonucleotide
caguucugccaccucaca

SEQ ID NO: 64485 - RNA, 18 nt, Artificial Sequence
  Description of Artificial Sequence: Synthetic oligonucleotide
aagcccaguucugccacc

SEQ ID NO: 64486 - RNA, 18 nt, Artificial Sequence
  Description of Artificial Sequence: Synthetic oligonucleotide
gacccaagcccaguucug

SEQ ID NO: 64487 - RNA, 18 nt, Artificial Sequence
  Description of Artificial Sequence: Synthetic oligonucleotide
gagaugacccaagcccag

SEQ ID NO: 64488 - RNA, 18 nt, Artificial Sequence
  Description of Artificial Sequence: Synthetic oligonucleotide
ugauagagaugacccaag

SEQ ID NO: 64489 - RNA, 18 nt, Artificial Sequence
  Description of Artificial Sequence: Synthetic oligonucleotide
cuaagugauagagaugac

SEQ ID NO: 64490 - RNA, 18 nt, Artificial Sequence
  Description of Artificial Sequence: Synthetic oligonucleotide
agcuacuaagugauagag

SEQ ID NO: 64491 - RNA, 18 nt, Artificial Sequence
  Description of Artificial Sequence: Synthetic oligonucleotide
cacauagcuacuaaguga

SEQ ID NO: 64492 - RNA, 18 nt, Artificial Sequence
  Description of Artificial Sequence: Synthetic oligonucleotide
aaggucacauagcuacua

SEQ ID NO: 64493 - RNA, 18 nt, Artificial Sequence
  Description of Artificial Sequence: Synthetic oligonucleotide
cuuacaaggucacauagc

SEQ ID NO: 64494 - RNA, 18 nt, Artificial Sequence
  Description of Artificial Sequence: Synthetic oligonucleotide
cccaucuuacaaggucac

SEQ ID NO: 64495 - RNA, 18 nt, Artificial Sequence
  Description of Artificial Sequence: Synthetic oligonucleotide
ugguucccaucuuacaag

SEQ ID NO: 64496 - RNA, 18 nt, Artificial Sequence
  Description of Artificial Sequence: Synthetic oligonucleotide
uaggcugguucccaucuu

SEQ ID NO: 64497 - RNA, 18 nt, Artificial Sequence
  Description of Artificial Sequence: Synthetic oligonucleotide
gguaguaggcugguuccc

SEQ ID NO: 64498 - RNA, 18 nt, Artificial Sequence
  Description of Artificial Sequence: Synthetic oligonucleotide
aaaaagguaguaggcugg

SEQ ID NO: 64499 - RNA, 18 nt, Artificial Sequence
  Description of Artificial Sequence: Synthetic oligonucleotide
gaaaaaaaaagguaguag

SEQ ID NO: 64500 - RNA, 18 nt, Artificial Sequence
  Description of Artificial Sequence: Synthetic oligonucleotide
gggaggaaaaaaaaaggu

SEQ ID NO: 64501 - RNA, 18 nt, Artificial Sequence
  Description of Artificial Sequence: Synthetic oligonucleotide
gaggagggaggaaaaaaa

SEQ ID NO: 64502 - RNA, 18 nt, Artificial Sequence
  Description of Artificial Sequence: Synthetic oligonucleotide
aggaggaggagggaggaa

SEQ ID NO: 64503 - RNA, 18 nt, Artificial Sequence
  Description of Artificial Sequence: Synthetic oligonucleotide
agaggaggaggaggaggg

SEQ ID NO: 64504 - RNA, 18 nt, Artificial Sequence
  Description of Artificial Sequence: Synthetic oligonucleotide
aguggagaggaggaggag

SEQ ID NO: 64505 - RNA, 18 nt, Artificial Sequence
  Description of Artificial Sequence: Synthetic oligonucleotide
aggacaguggagaggagg

SEQ ID NO: 64506 - RNA, 18 nt, Artificial Sequence
  Description of Artificial Sequence: Synthetic oligonucleotide
guaguaggacaguggaga

SEQ ID NO: 64507 - RNA, 18 nt, Artificial Sequence
  Description of Artificial Sequence: Synthetic oligonucleotide
ggacaguaguaggacagu

SEQ ID NO: 64508 - RNA, 18 nt, Artificial Sequence
  Description of Artificial Sequence: Synthetic oligonucleotide
gagcuggacaguaguagg

SEQ ID NO: 64509 - RNA, 18 nt, Artificial Sequence
  Description of Artificial Sequence: Synthetic oligonucleotide
cugcagagcuggacagua

SEQ ID NO: 64510 - RNA, 18 nt, Artificial Sequence
  Description of Artificial Sequence: Synthetic oligonucleotide
ggacgcugcagagcugga

SEQ ID NO: 64511 - RNA, 18 nt, Artificial Sequence
  Description of Artificial Sequence: Synthetic oligonucleotide
gggcuggacgcugcagag

SEQ ID NO: 64512 - RNA, 18 nt, Artificial Sequence
  Description of Artificial Sequence: Synthetic oligonucleotide
accaugggcuggacgcug

SEQ ID NO: 64513 - RNA, 18 nt, Artificial Sequence
  Description of Artificial Sequence: Synthetic oligonucleotide
cagcuaccaugggcugga

SEQ ID NO: 64514 - RNA, 18 nt, Artificial Sequence
  Description of Artificial Sequence: Synthetic oligonucleotide
cugagcagcuaccauggg

SEQ ID NO: 64515 - RNA, 18 nt, Artificial Sequence
  Description of Artificial Sequence: Synthetic oligonucleotide
acuuacugagcagcuacc

SEQ ID NO: 64516 - RNA, 18 nt, Artificial Sequence
  Description of Artificial Sequence: Synthetic oligonucleotide
gggccacuuacugagcag

SEQ ID NO: 64517 - RNA, 18 nt, Artificial Sequence
  Description of Artificial Sequence: Synthetic oligonucleotide
aacacaagagcaucuggg

SEQ ID NO: 64518 - RNA, 18 nt, Artificial Sequence
  Description of Artificial Sequence: Synthetic oligonucleotide
gaagcucccugaccuugu

SEQ ID NO: 64519 - RNA, 18 nt, Artificial Sequence
  Description of Artificial Sequence: Synthetic oligonucleotide
guucugaagcucccugac

SEQ ID NO: 64520 - RNA, 18 nt, Artificial Sequence
  Description of Artificial Sequence: Synthetic oligonucleotide
cccugguucugaagcucc

SEQ ID NO: 64521 - RNA, 18 nt, Artificial Sequence
  Description of Artificial Sequence: Synthetic oligonucleotide
cucugcccugguucugaa

SEQ ID NO: 64522 - RNA, 18 nt, Artificial Sequence
  Description of Artificial Sequence: Synthetic oligonucleotide
cacaucucugcccugguu

SEQ ID NO: 64523 - RNA, 18 nt, Artificial Sequence
  Description of Artificial Sequence: Synthetic oligonucleotide
aggcccacaucucugccc

SEQ ID NO: 64524 - RNA, 18 nt, Artificial Sequence
  Description of Artificial Sequence: Synthetic oligonucleotide
ccuccaggcccacaucuc

SEQ ID NO: 64525 - RNA, 18 nt, Artificial Sequence
  Description of Artificial Sequence: Synthetic oligonucleotide
caacaccuccaggcccac

SEQ ID NO: 64526 - RNA, 18 nt, Artificial Sequence
  Description of Artificial Sequence: Synthetic oligonucleotide
uuauccaacaccuccagg

SEQ ID NO: 64527 - RNA, 18 nt, Artificial Sequence
  Description of Artificial Sequence: Synthetic oligonucleotide
gggcauuauccaacaccu

SEQ ID NO: 64528 - RNA, 18 nt, Artificial Sequence
  Description of Artificial Sequence: Synthetic oligonucleotide
uagcagggcauuauccaa

SEQ ID NO: 64529 - RNA, 18 nt, Artificial Sequence
  Description of Artificial Sequence: Synthetic oligonucleotide
agagcuagcagggcauua

SEQ ID NO: 64530 - RNA, 18 nt, Artificial Sequence
  Description of Artificial Sequence: Synthetic oligonucleotide
cuugcagagcuagcaggg

SEQ ID NO: 64531 - RNA, 18 nt, Artificial Sequence
  Description of Artificial Sequence: Synthetic oligonucleotide
uaccugggcugcaguggg

SEQ ID NO: 64532 - RNA, 18 nt, Artificial Sequence
  Description of Artificial Sequence: Synthetic oligonucleotide
uaguaccugggcugcagu

SEQ ID NO: 64533 - RNA, 18 nt, Artificial Sequence
  Description of Artificial Sequence: Synthetic oligonucleotide
gccuguaguaccugggcu

SEQ ID NO: 64534 - RNA, 18 nt, Artificial Sequence
  Description of Artificial Sequence: Synthetic oligonucleotide
cgccggccuguaguaccu

SEQ ID NO: 64535 - RNA, 18 nt, Artificial Sequence
  Description of Artificial Sequence: Synthetic oligonucleotide
ugccacgccggccuguag

SEQ ID NO: 64536 - RNA, 18 nt, Artificial Sequence
  Description of Artificial Sequence: Synthetic oligonucleotide
ucaucugccacgccggcc

SEQ ID NO: 64537 - RNA, 18 nt, Artificial Sequence
  Description of Artificial Sequence: Synthetic oligonucleotide
ucaggucaucugccacgc

SEQ ID NO: 64538 - RNA, 18 nt, Artificial Sequence
  Description of Artificial Sequence: Synthetic oligonucleotide
uuuccucaggucaucugc

SEQ ID NO: 64539 - RNA, 18 nt, Artificial Sequence
  Description of Artificial Sequence: Synthetic oligonucleotide
ggcaguuuccucagguca

SEQ ID NO: 64540 - RNA, 18 nt, Artificial Sequence
  Description of Artificial Sequence: Synthetic oligonucleotide
ugaagggcaguuuccuca

SEQ ID NO: 64541 - RNA, 18 nt, Artificial Sequence
  Description of Artificial Sequence: Synthetic oligonucleotide
ggucaugaagggcaguuu

SEQ ID NO: 64542 - RNA, 18 nt, Artificial Sequence
  Description of Artificial Sequence: Synthetic oligonucleotide
gcacuggucaugaagggc

SEQ ID NO: 64543 - RNA, 18 nt, Artificial Sequence
  Description of Artificial Sequence: Synthetic oligonucleotide
ucacagcacuggucauga

SEQ ID NO: 64544 - RNA, 18 nt, Artificial Sequence
  Description of Artificial Sequence: Synthetic oligonucleotide
cuccaucacagcacuggu

SEQ ID NO: 64545 - RNA, 18 nt, Artificial Sequence
  Description of Artificial Sequence: Synthetic oligonucleotide
aacaccuccaucacagca

SEQ ID NO: 64546 - RNA, 18 nt, Artificial Sequence
  Description of Artificial Sequence: Synthetic oligonucleotide
cgccaaacaccuccauca

SEQ ID NO: 64547 - RNA, 18 nt, Artificial Sequence
  Description of Artificial Sequence: Synthetic oligonucleotide
agacacgccaaacaccuc

SEQ ID NO: 64548 - RNA, 18 nt, Artificial Sequence
  Description of Artificial Sequence: Synthetic oligonucleotide
cagccagacacgccaaac

SEQ ID NO: 64549 - RNA, 18 nt, Artificial Sequence
  Description of Artificial Sequence: Synthetic oligonucleotide
cgcggcagccagacacgc

SEQ ID NO: 64550 - RNA, 18 nt, Artificial Sequence
  Description of Artificial Sequence: Synthetic oligonucleotide
ggucacgcggcagccaga

SEQ ID NO: 64551 - RNA, 18 nt, Artificial Sequence
  Description of Artificial Sequence: Synthetic oligonucleotide
cagcgggucacgcggcag

SEQ ID NO: 64552 - RNA, 18 nt, Artificial Sequence
  Description of Artificial Sequence: Synthetic oligonucleotide
agccacagcgggucacgc

SEQ ID NO: 64553 - RNA, 18 nt, Artificial Sequence
  Description of Artificial Sequence: Synthetic oligonucleotide
uguguagccacagcgggu

SEQ ID NO: 64554 - RNA, 18 nt, Artificial Sequence
  Description of Artificial Sequence: Synthetic oligonucleotide
ucuccuguguagccacag

SEQ ID NO: 64555 - RNA, 18 nt, Artificial Sequence
  Description of Artificial Sequence: Synthetic oligonucleotide
cauccucuccuguguagc

SEQ ID NO: 64556 - RNA, 18 nt, Artificial Sequence
  Description of Artificial Sequence: Synthetic oligonucleotide
cacaccauccucuccugu

SEQ ID NO: 64557 - RNA, 18 nt, Artificial Sequence
  Description of Artificial Sequence: Synthetic oligonucleotide
ccccacaccacuucuuga

SEQ ID NO: 64558 - RNA, 18 nt, Artificial Sequence
  Description of Artificial Sequence: Synthetic oligonucleotide
acugcccccacaccacuu

SEQ ID NO: 64559 - RNA, 18 nt, Artificial Sequence
  Description of Artificial Sequence: Synthetic oligonucleotide
ccuguacugcccccacac

SEQ ID NO: 64560 - RNA, 18 nt, Artificial Sequence
  Description of Artificial Sequence: Synthetic oligonucleotide
ugugcccuguacugcccc

SEQ ID NO: 64561 - RNA, 18 nt, Artificial Sequence
  Description of Artificial Sequence: Synthetic oligonucleotide
cauccugugcccuguacu

SEQ ID NO: 64562 - RNA, 18 nt, Artificial Sequence
  Description of Artificial Sequence: Synthetic oligonucleotide
acaugcauccugugcccu

SEQ ID NO: 64563 - RNA, 18 nt, Artificial Sequence
  Description of Artificial Sequence: Synthetic oligonucleotide
cccucacaugcauccugu

SEQ ID NO: 64564 - RNA, 18 nt, Artificial Sequence
  Description of Artificial Sequence: Synthetic oligonucleotide
ccaaccccucacaugcau

SEQ ID NO: 64565 - RNA, 18 nt, Artificial Sequence
  Description of Artificial Sequence: Synthetic oligonucleotide
uacccccaaccccucaca

SEQ ID NO: 64566 - RNA, 18 nt, Artificial Sequence
  Description of Artificial Sequence: Synthetic oligonucleotide
ccacauacccccaacccc

SEQ ID NO: 64567 - RNA, 18 nt, Artificial Sequence
  Description of Artificial Sequence: Synthetic oligonucleotide
cuguaccacauaccccca

SEQ ID NO: 64568 - RNA, 18 nt, Artificial Sequence
  Description of Artificial Sequence: Synthetic oligonucleotide
gcucccuguaccacauac

SEQ ID NO: 64569 - RNA, 18 nt, Artificial Sequence
  Description of Artificial Sequence: Synthetic oligonucleotide
gggaagcucccuguacca

SEQ ID NO: 64570 - RNA, 18 nt, Artificial Sequence
  Description of Artificial Sequence: Synthetic oligonucleotide
cauccugugcccuguacu

SEQ ID NO: 64571 - RNA, 18 nt, Artificial Sequence
  Description of Artificial Sequence: Synthetic oligonucleotide
acaugcauccugugcccu

SEQ ID NO: 64572 - RNA, 18 nt, Artificial Sequence
  Description of Artificial Sequence: Synthetic oligonucleotide
cccucacaugcauccugu

SEQ ID NO: 64573 - RNA, 18 nt, Artificial Sequence
  Description of Artificial Sequence: Synthetic oligonucleotide
ccaaccccucacaugcau

SEQ ID NO: 64574 - RNA, 18 nt, Artificial Sequence
  Description of Artificial Sequence: Synthetic oligonucleotide
uacccccaaccccucaca

SEQ ID NO: 64575 - RNA, 18 nt, Artificial Sequence
  Description of Artificial Sequence: Synthetic oligonucleotide
ccacauacccccaacccc

SEQ ID NO: 64576 - RNA, 18 nt, Artificial Sequence
  Description of Artificial Sequence: Synthetic oligonucleotide
cuguaccacauaccccca

SEQ ID NO: 64577 - RNA, 18 nt, Artificial Sequence
  Description of Artificial Sequence: Synthetic oligonucleotide
gcucccuguaccacauac

SEQ ID NO: 64578 - RNA, 18 nt, Artificial Sequence
  Description of Artificial Sequence: Synthetic oligonucleotide
gggaagcucccuguacca

SEQ ID NO: 64579 - RNA, 18 nt, Artificial Sequence
  Description of Artificial Sequence: Synthetic oligonucleotide
cagaugggaagcucccug

SEQ ID NO: 64580 - RNA, 18 nt, Artificial Sequence
  Description of Artificial Sequence: Synthetic oligonucleotide
gagggcagaugggaagcu

SEQ ID NO: 64581 - RNA, 18 nt, Artificial Sequence
  Description of Artificial Sequence: Synthetic oligonucleotide
ccgcuaccggcaccgaga

SEQ ID NO: 64582 - RNA, 18 nt, Artificial Sequence
  Description of Artificial Sequence: Synthetic oligonucleotide
ugcccccgcuaccggcac

SEQ ID NO: 64583 - RNA, 18 nt, Artificial Sequence
  Description of Artificial Sequence: Synthetic oligonucleotide
ugaacugcccccgcuacc

SEQ ID NO: 64584 - RNA, 18 nt, Artificial Sequence
  Description of Artificial Sequence: Synthetic oligonucleotide
ccaggugaacugcccccg

SEQ ID NO: 64585 - RNA, 18 nt, Artificial Sequence
  Description of Artificial Sequence: Synthetic oligonucleotide
uguugccaggugaacugc

SEQ ID NO: 64586 - RNA, 18 nt, Artificial Sequence
  Description of Artificial Sequence: Synthetic oligonucleotide
auagcuguugccagguga

SEQ ID NO: 64587 - RNA, 18 nt, Artificial Sequence
  Description of Artificial Sequence: Synthetic oligonucleotide
ucagaauagcuguugcca

SEQ ID NO: 64588 - RNA, 18 nt, Artificial Sequence
  Description of Artificial Sequence: Synthetic oligonucleotide
guuuuucagaauagcugu

SEQ ID NO: 64589 - RNA, 18 nt, Artificial Sequence
  Description of Artificial Sequence: Synthetic oligonucleotide
ucuggguuuuucagaaua

SEQ ID NO: 64590 - RNA, 18 nt, Artificial Sequence
  Description of Artificial Sequence: Synthetic oligonucleotide
ucaccucuggguuuuuca

SEQ ID NO: 64591 - RNA, 18 nt, Artificial Sequence
  Description of Artificial Sequence: Synthetic oligonucleotide
cagcuucaccucuggguu

SEQ ID NO: 64592 - RNA, 18 nt, Artificial Sequence
  Description of Artificial Sequence: Synthetic oligonucleotide
ccugccagcuucaccucu

SEQ ID NO: 64593 - RNA, 18 nt, Artificial Sequence
  Description of Artificial Sequence: Synthetic oligonucleotide
ccagcccugccagcuuca

SEQ ID NO: 64594 - RNA, 18 nt, Artificial Sequence
  Description of Artificial Sequence: Synthetic oligonucleotide
ggcugccagcccugccag

SEQ ID NO: 64595 - RNA, 18 nt, Artificial Sequence
  Description of Artificial Sequence: Synthetic oligonucleotide
ucccuggcugccagcccu

SEQ ID NO: 64596 - RNA, 18 nt, Artificial Sequence
  Description of Artificial Sequence: Synthetic oligonucleotide
ggcugucccuggcugcca

SEQ ID NO: 64597 - RNA, 18 nt, Artificial Sequence
  Description of Artificial Sequence: Synthetic oligonucleotide
gcgcaggcugucccuggc

SEQ ID NO: 64598 - RNA, 18 nt, Artificial Sequence
  Description of Artificial Sequence: Synthetic oligonucleotide
uccaggcgcaggcugucc

SEQ ID NO: 64599 - RNA, 18 nt, Artificial Sequence
  Description of Artificial Sequence: Synthetic oligonucleotide
cugccuccaggcgcaggc

SEQ ID NO: 64600 - RNA, 18 nt, Artificial Sequence
  Description of Artificial Sequence: Synthetic oligonucleotide
gaggccugccuccaggcg

SEQ ID NO: 64601 - RNA, 18 nt, Artificial Sequence
  Description of Artificial Sequence: Synthetic oligonucleotide
aggcagaggccugccucc

SEQ ID NO: 64602 - RNA, 18 nt, Artificial Sequence
  Description of Artificial Sequence: Synthetic oligonucleotide
cauacaggcagaggccug

SEQ ID NO: 64603 - RNA, 18 nt, Artificial Sequence
  Description of Artificial Sequence: Synthetic oligonucleotide
auucccauacaggcagag

SEQ ID NO: 64604 - RNA, 18 nt, Artificial Sequence
  Description of Artificial Sequence: Synthetic oligonucleotide
augucauucccauacagg

SEQ ID NO: 64605 - RNA, 18 nt, Artificial Sequence
  Description of Artificial Sequence: Synthetic oligonucleotide
caucaaugucauucccau

SEQ ID NO: 64606 - RNA, 18 nt, Artificial Sequence
  Description of Artificial Sequence: Synthetic oligonucleotide
guguucaucaaugucauu

SEQ ID NO: 64607 - RNA, 18 nt, Artificial Sequence
  Description of Artificial Sequence: Synthetic oligonucleotide
guaguguguucaucaaug

SEQ ID NO: 64608 - RNA, 18 nt, Artificial Sequence
  Description of Artificial Sequence: Synthetic oligonucleotide
cagguguaguguguucau

SEQ ID NO: 64609 - RNA, 18 nt, Artificial Sequence
  Description of Artificial Sequence: Synthetic oligonucleotide
cuccacagguguagugug

SEQ ID NO: 64610 - RNA, 18 nt, Artificial Sequence
  Description of Artificial Sequence: Synthetic oligonucleotide
cugcccuccacaggugua

SEQ ID NO: 64611 - RNA, 18 nt, Artificial Sequence
  Description of Artificial Sequence: Synthetic oligonucleotide
ugaggcugcccuccacag

SEQ ID NO: 64612 - RNA, 18 nt, Artificial Sequence
  Description of Artificial Sequence: Synthetic oligonucleotide
ccaacugaggcugcccuc

SEQ ID NO: 64613 - RNA, 18 nt, Artificial Sequence
  Description of Artificial Sequence: Synthetic oligonucleotide
aguguccaacugaggcug

SEQ ID NO: 64614 - RNA, 18 nt, Artificial Sequence
  Description of Artificial Sequence: Synthetic oligonucleotide
uaaacagcgacagugucc

SEQ ID NO: 64615 - RNA, 18 nt, Artificial Sequence
  Description of Artificial Sequence: Synthetic oligonucleotide
guugguaaacagcgacag

SEQ ID NO: 64616 - RNA, 18 nt, Artificial Sequence
  Description of Artificial Sequence: Synthetic oligonucleotide
gccucguugguaaacagc

SEQ ID NO: 64617 - RNA, 18 nt, Artificial Sequence
  Description of Artificial Sequence: Synthetic oligonucleotide
cuccagccucguugguaa

SEQ ID NO: 64618 - RNA, 18 nt, Artificial Sequence
  Description of Artificial Sequence: Synthetic oligonucleotide
gaugccuccagccucguu

SEQ ID NO: 64619 - RNA, 18 nt, Artificial Sequence
  Description of Artificial Sequence: Synthetic oligonucleotide
ucuaagaugccuccagcc

SEQ ID NO: 64620 - RNA, 18 nt, Artificial Sequence
  Description of Artificial Sequence: Synthetic oligonucleotide
agucaucuaagaugccuc

SEQ ID NO: 64621 - RNA, 18 nt, Artificial Sequence
  Description of Artificial Sequence: Synthetic oligonucleotide
aaucaagucaucuaagau

SEQ ID NO: 64622 - RNA, 18 nt, Artificial Sequence
  Description of Artificial Sequence: Synthetic oligonucleotide
guuacaaucaagucaucu

SEQ ID NO: 64623 - RNA, 18 nt, Artificial Sequence
  Description of Artificial Sequence: Synthetic oligonucleotide
uauugguuacaaucaagu

SEQ ID NO: 64624 - RNA, 18 nt, Artificial Sequence
  Description of Artificial Sequence: Synthetic oligonucleotide
agaaguauugguuacaau

SEQ ID NO: 64625 - RNA, 18 nt, Artificial Sequence
  Description of Artificial Sequence: Synthetic oligonucleotide
cccucagaaguauugguu

SEQ ID NO: 64626 - RNA, 18 nt, Artificial Sequence
  Description of Artificial Sequence: Synthetic oligonucleotide
gguggcccucagaaguau

SEQ ID NO: 64627 - RNA, 18 nt, Artificial Sequence
  Description of Artificial Sequence: Synthetic oligonucleotide
auacagguggcccucaga

SEQ ID NO: 64628 - RNA, 18 nt, Artificial Sequence
  Description of Artificial Sequence: Synthetic oligonucleotide
accacauacagguggccc

SEQ ID NO: 64629 - RNA, 18 nt, Artificial Sequence
  Description of Artificial Sequence: Synthetic oligonucleotide
uggacaccacauacaggu

SEQ ID NO: 64630 - RNA, 18 nt, Artificial Sequence
  Description of Artificial Sequence: Synthetic oligonucleotide
agcguuggacaccacaua

SEQ ID NO: 64631 - RNA, 18 nt, Artificial Sequence
  Description of Artificial Sequence: Synthetic oligonucleotide
cagccagcguuggacacc

SEQ ID NO: 64632 - RNA, 18 nt, Artificial Sequence
  Description of Artificial Sequence: Synthetic oligonucleotide
cccagcagccagcguugg

SEQ ID NO: 64633 - RNA, 18 nt, Artificial Sequence
  Description of Artificial Sequence: Synthetic oligonucleotide
uuucucccagcagccagc

SEQ ID NO: 64634 - RNA, 18 nt, Artificial Sequence
  Description of Artificial Sequence: Synthetic oligonucleotide
aaaucuuucucccagcag

SEQ ID NO: 64635 - RNA, 18 nt, Artificial Sequence
  Description of Artificial Sequence: Synthetic oligonucleotide
gggccaaaucuuucuccc

SEQ ID NO: 64636 - RNA, 18 nt, Artificial Sequence
  Description of Artificial Sequence: Synthetic oligonucleotide
caugagggccaaaucuuu

SEQ ID NO: 64637 - RNA, 18 nt, Artificial Sequence
  Description of Artificial Sequence: Synthetic oligonucleotide
aggugucuagaacacaga

SEQ ID NO: 64638 - RNA, 18 nt, Artificial Sequence
  Description of Artificial Sequence: Synthetic oligonucleotide
agacaaggugucuagaac

SEQ ID NO: 64639 - RNA, 18 nt, Artificial Sequence
  Description of Artificial Sequence: Synthetic oligonucleotide
aaggaagacaaggugucu

SEQ ID NO: 64640 - RNA, 18 nt, Artificial Sequence
  Description of Artificial Sequence: Synthetic oligonucleotide
ugaacaaggaagacaagg

SEQ ID NO: 64641 - RNA, 18 nt, Artificial Sequence
  Description of Artificial Sequence: Synthetic oligonucleotide
cucuaugaacaaggaaga

SEQ ID NO: 64642 - RNA, 18 nt, Artificial Sequence
  Description of Artificial Sequence: Synthetic oligonucleotide
uacugcucuaugaacaag

SEQ ID NO: 64643 - RNA, 18 nt, Artificial Sequence
  Description of Artificial Sequence: Synthetic oligonucleotide
aaggauacugcucuauga

SEQ ID NO: 64644 - RNA, 18 nt, Artificial Sequence
  Description of Artificial Sequence: Synthetic oligonucleotide
acaacaaggauacugcuc

SEQ ID NO: 64645 - RNA, 18 nt, Artificial Sequence
  Description of Artificial Sequence: Synthetic oligonucleotide
cuuggacaacaaggauac

SEQ ID NO: 64646 - RNA, 18 nt, Artificial Sequence
  Description of Artificial Sequence: Synthetic oligonucleotide
ccugucuuggacaacaag

SEQ ID NO: 64647 - RNA, 18 nt, Artificial Sequence
  Description of Artificial Sequence: Synthetic oligonucleotide
ccaacccugucuuggaca

SEQ ID NO: 64648 - RNA, 18 nt, Artificial Sequence
  Description of Artificial Sequence: Synthetic oligonucleotide
cugugccaacccugucuu

SEQ ID NO: 64649 - RNA, 18 nt, Artificial Sequence
  Description of Artificial Sequence: Synthetic oligonucleotide
cuugucugugccaacccu

SEQ ID NO: 64650 - RNA, 18 nt, Artificial Sequence
  Description of Artificial Sequence: Synthetic oligonucleotide
ggucccuugucugugcca

SEQ ID NO: 64651 - RNA, 18 nt, Artificial Sequence
  Description of Artificial Sequence: Synthetic oligonucleotide
uuccaggucccuugucug

SEQ ID NO: 64652 - RNA, 18 nt, Artificial Sequence
  Description of Artificial Sequence: Synthetic oligonucleotide
ccauuuuccaggucccuu

SEQ ID NO: 64653 - RNA, 18 nt, Artificial Sequence
  Description of Artificial Sequence: Synthetic oligonucleotide
aagagccauuuuccaggu

SEQ ID NO: 64654 - RNA, 18 nt, Artificial Sequence
  Description of Artificial Sequence: Synthetic oligonucleotide
acugaaagagccauuuuc

SEQ ID NO: 64655 - RNA, 18 nt, Artificial Sequence
  Description of Artificial Sequence: Synthetic oligonucleotide
cauucacugaaagagcca

SEQ ID NO: 64656 - RNA, 18 nt, Artificial Sequence
  Description of Artificial Sequence: Synthetic oligonucleotide
cuguucauucacugaaag

SEQ ID NO: 64657 - RNA, 18 nt, Artificial Sequence
  Description of Artificial Sequence: Synthetic oligonucleotide
cauagcuguucauucacu

SEQ ID NO: 64658 - RNA, 18 nt, Artificial Sequence
  Description of Artificial Sequence: Synthetic oligonucleotide
agucucauagcuguucau

SEQ ID NO: 64659 - RNA, 18 nt, Artificial Sequence
  Description of Artificial Sequence: Synthetic oligonucleotide
ucuugagucucauagcug

SEQ ID NO: 64660 - RNA, 18 nt, Artificial Sequence
  Description of Artificial Sequence: Synthetic oligonucleotide
ccugcucuugagucucau

SEQ ID NO: 64661 - RNA, 18 nt, Artificial Sequence
  Description of Artificial Sequence: Synthetic oligonucleotide
gagggccugcucuugagu

SEQ ID NO: 64662 - RNA, 18 nt, Artificial Sequence
  Description of Artificial Sequence: Synthetic oligonucleotide
ccagagagggccugcucu

SEQ ID NO: 64663 - RNA, 18 nt, Artificial Sequence
  Description of Artificial Sequence: Synthetic oligonucleotide
gugcuccagagagggccu

SEQ ID NO: 64664 - RNA, 18 nt, Artificial Sequence
  Description of Artificial Sequence: Synthetic oligonucleotide
cuggcgugcuccagagag

SEQ ID NO: 64665 - RNA, 18 nt, Artificial Sequence
  Description of Artificial Sequence: Synthetic oligonucleotide
aaacccuggcgugcucca

SEQ ID NO: 64666 - RNA, 18 nt, Artificial Sequence
  Description of Artificial Sequence: Synthetic oligonucleotide
ccaccaaacccuggcgug

SEQ ID NO: 64667 - RNA, 18 nt, Artificial Sequence
  Description of Artificial Sequence: Synthetic oligonucleotide
ccccaccaccaaacccug

SEQ ID NO: 64668 - RNA, 18 nt, Artificial Sequence
  Description of Artificial Sequence: Synthetic oligonucleotide
uaaucccccaccaccaaa

SEQ ID NO: 64669 - RNA, 18 nt, Artificial Sequence
  Description of Artificial Sequence: Synthetic oligonucleotide
ccugguaaucccccacca

SEQ ID NO: 64670 - RNA, 18 nt, Artificial Sequence
  Description of Artificial Sequence: Synthetic oligonucleotide
ccaugccugguaaucccc

SEQ ID NO: 64671 - RNA, 18 nt, Artificial Sequence
  Description of Artificial Sequence: Synthetic oligonucleotide
ccuccccaugccugguaa

SEQ ID NO: 64672 - RNA, 18 nt, Artificial Sequence
  Description of Artificial Sequence: Synthetic oligonucleotide
gacccccuccccaugccu

SEQ ID NO: 64673 - RNA, 18 nt, Artificial Sequence
  Description of Artificial Sequence: Synthetic oligonucleotide
gccaagacccccucccca

SEQ ID NO: 64674 - RNA, 18 nt, Artificial Sequence
  Description of Artificial Sequence: Synthetic oligonucleotide
gggccaagacccccuccc

SEQ ID NO: 64675 - RNA, 18 nt, Artificial Sequence
  Description of Artificial Sequence: Synthetic oligonucleotide
ccaccucacaccagaggg

SEQ ID NO: 64676 - RNA, 18 nt, Artificial Sequence
  Description of Artificial Sequence: Synthetic oligonucleotide
uucugccaccucacacca

SEQ ID NO: 64677 - RNA, 18 nt, Artificial Sequence
  Description of Artificial Sequence: Synthetic oligonucleotide
cccaguucugccaccuca

SEQ ID NO: 64678 - RNA, 18 nt, Artificial Sequence
  Description of Artificial Sequence: Synthetic oligonucleotide
ccaagcccaguucugcca

SEQ ID NO: 64679 - RNA, 18 nt, Artificial Sequence
  Description of Artificial Sequence: Synthetic oligonucleotide
ccccuccccaugccuggu

SEQ ID NO: 64680 - RNA, 18 nt, Artificial Sequence
  Description of Artificial Sequence: Synthetic oligonucleotide
aagacccccuccccaugc

SEQ ID NO: 64681 - RNA, 18 nt, Artificial Sequence
  Description of Artificial Sequence: Synthetic oligonucleotide
gggccaagacccccuccc

SEQ ID NO: 64682 - RNA, 18 nt, Artificial Sequence
  Description of Artificial Sequence: Synthetic oligonucleotide
ccaccucacaccagaggg

SEQ ID NO: 64683 - RNA, 18 nt, Artificial Sequence
  Description of Artificial Sequence: Synthetic oligonucleotide
cugccaccucacaccaga

SEQ ID NO: 64684 - RNA, 18 nt, Artificial Sequence
  Description of Artificial Sequence: Synthetic oligonucleotide
caguucugccaccucaca

SEQ ID NO: 64685 - RNA, 18 nt, Artificial Sequence
  Description of Artificial Sequence: Synthetic oligonucleotide
aagcccaguucugccacc

SEQ ID NO: 64686 - RNA, 18 nt, Artificial Sequence
  Description of Artificial Sequence: Synthetic oligonucleotide
gacccaagcccaguucug

SEQ ID NO: 64687 - RNA, 18 nt, Artificial Sequence
  Description of Artificial Sequence: Synthetic oligonucleotide
gagaugacccaagcccag

SEQ ID NO: 64688 - RNA, 18 nt, Artificial Sequence
  Description of Artificial Sequence: Synthetic oligonucleotide
ugauagagaugacccaag

SEQ ID NO: 64689 - RNA, 18 nt, Artificial Sequence
  Description of Artificial Sequence: Synthetic oligonucleotide
cuaagugauagagaugac

SEQ ID NO: 64690 - RNA, 18 nt, Artificial Sequence
  Description of Artificial Sequence: Synthetic oligonucleotide
agcuacuaagugauagag

SEQ ID NO: 64691 - RNA, 18 nt, Artificial Sequence
  Description of Artificial Sequence: Synthetic oligonucleotide
cacauagcuacuaaguga

SEQ ID NO: 64692 - RNA, 18 nt, Artificial Sequence
  Description of Artificial Sequence: Synthetic oligonucleotide
aaggucacauagcuacua

SEQ ID NO: 64693 - RNA, 18 nt, Artificial Sequence
  Description of Artificial Sequence: Synthetic oligonucleotide
cuuacaaggucacauagc

SEQ ID NO: 64694 - RNA, 18 nt, Artificial Sequence
  Description of Artificial Sequence: Synthetic oligonucleotide
cccaucuuacaaggucac

SEQ ID NO: 64695 - RNA, 18 nt, Artificial Sequence
  Description of Artificial Sequence: Synthetic oligonucleotide
ugguucccaucuuacaag

SEQ ID NO: 64696 - RNA, 18 nt, Artificial Sequence
  Description of Artificial Sequence: Synthetic oligonucleotide
uaggcugguucccaucuu

SEQ ID NO: 64697 - RNA, 18 nt, Artificial Sequence
  Description of Artificial Sequence: Synthetic oligonucleotide
gguaguaggcugguuccc

SEQ ID NO: 64698 - RNA, 18 nt, Artificial Sequence
  Description of Artificial Sequence: Synthetic oligonucleotide
aaaaagguaguaggcugg

SEQ ID NO: 64699 - RNA, 18 nt, Artificial Sequence
  Description of Artificial Sequence: Synthetic oligonucleotide
gaaaaaaaaagguaguag

SEQ ID NO: 64700 - RNA, 18 nt, Artificial Sequence
  Description of Artificial Sequence: Synthetic oligonucleotide
gggaggaaaaaaaaaggu

SEQ ID NO: 64701 - RNA, 18 nt, Artificial Sequence
  Description of Artificial Sequence: Synthetic oligonucleotide
gaggagggaggaaaaaaa

SEQ ID NO: 64702 - RNA, 18 nt, Artificial Sequence
  Description of Artificial Sequence: Synthetic oligonucleotide
aggaggaggagggaggaa

SEQ ID NO: 64703 - RNA, 18 nt, Artificial Sequence
  Description of Artificial Sequence: Synthetic oligonucleotide
agaggaggaggaggaggg

SEQ ID NO: 64704 - RNA, 18 nt, Artificial Sequence
  Description of Artificial Sequence: Synthetic oligonucleotide
aguggagaggaggaggag

SEQ ID NO: 64705 - RNA, 18 nt, Artificial Sequence
  Description of Artificial Sequence: Synthetic oligonucleotide
aggacaguggagaggagg

SEQ ID NO: 64706 - RNA, 18 nt, Artificial Sequence
  Description of Artificial Sequence: Synthetic oligonucleotide
guaguaggacaguggaga

SEQ ID NO: 64707 - RNA, 18 nt, Artificial Sequence
  Description of Artificial Sequence: Synthetic oligonucleotide
ggacaguaguaggacagu

SEQ ID NO: 64708 - RNA, 18 nt, Artificial Sequence
  Description of Artificial Sequence: Synthetic oligonucleotide
gagcuggacaguaguagg

SEQ ID NO: 64709 - RNA, 18 nt, Artificial Sequence
  Description of Artificial Sequence: Synthetic oligonucleotide
cugcagagcuggacagua

SEQ ID NO: 64710 - RNA, 18 nt, Artificial Sequence
  Description of Artificial Sequence: Synthetic oligonucleotide
ggacgcugcagagcugga

SEQ ID NO: 64711 - RNA, 18 nt, Artificial Sequence
  Description of Artificial Sequence: Synthetic oligonucleotide
gggcuggacgcugcagag

SEQ ID NO: 64712 - RNA, 18 nt, Artificial Sequence
  Description of Artificial Sequence: Synthetic oligonucleotide
accaugggcuggacgcug

SEQ ID NO: 64713 - RNA, 18 nt, Artificial Sequence
  Description of Artificial Sequence: Synthetic oligonucleotide
cagcuaccaugggcugga

SEQ ID NO: 64714 - RNA, 18 nt, Artificial Sequence
  Description of Artificial Sequence: Synthetic oligonucleotide
cugagcagcuaccauggg

SEQ ID NO: 64715 - RNA, 18 nt, Artificial Sequence
  Description of Artificial Sequence: Synthetic oligonucleotide
acuuacugagcagcuacc

SEQ ID NO: 64716 - RNA, 18 nt, Artificial Sequence
  Description of Artificial Sequence: Synthetic oligonucleotide
gggccacuuacugagcag

SEQ ID NO: 64717 - RNA, 18 nt, Artificial Sequence
  Description of Artificial Sequence: Synthetic oligonucleotide
aacacaagagcaucuggg

SEQ ID NO: 64718 - RNA, 18 nt, Artificial Sequence
  Description of Artificial Sequence: Synthetic oligonucleotide
gaagcucccugaccuugu

SEQ ID NO: 64719 - RNA, 18 nt, Artificial Sequence
  Description of Artificial Sequence: Synthetic oligonucleotide
guucugaagcucccugac

SEQ ID NO: 64720 - RNA, 18 nt, Artificial Sequence
  Description of Artificial Sequence: Synthetic oligonucleotide
cccugguucugaagcucc

SEQ ID NO: 64721 - RNA, 18 nt, Artificial Sequence
  Description of Artificial Sequence: Synthetic oligonucleotide
cucugcccugguucugaa

SEQ ID NO: 64722 - RNA, 18 nt, Artificial Sequence
  Description of Artificial Sequence: Synthetic oligonucleotide
cacaucucugcccugguu

SEQ ID NO: 64723 - RNA, 18 nt, Artificial Sequence
  Description of Artificial Sequence: Synthetic oligonucleotide
aggcccacaucucugccc

SEQ ID NO: 64724 - RNA, 18 nt, Artificial Sequence
  Description of Artificial Sequence: Synthetic oligonucleotide
ccuccaggcccacaucuc

SEQ ID NO: 64725 - RNA, 18 nt, Artificial Sequence
  Description of Artificial Sequence: Synthetic oligonucleotide
caacaccuccaggcccac

SEQ ID NO: 64726 - RNA, 18 nt, Artificial Sequence
  Description of Artificial Sequence: Synthetic oligonucleotide
uuauccaacaccuccagg

SEQ ID NO: 64727 - RNA, 18 nt, Artificial Sequence
  Description of Artificial Sequence: Synthetic oligonucleotide
gggcauuauccaacaccu

SEQ ID NO: 64728 - RNA, 18 nt, Artificial Sequence
  Description of Artificial Sequence: Synthetic oligonucleotide
uagcagggcauuauccaa

SEQ ID NO: 64729 - RNA, 18 nt, Artificial Sequence
  Description of Artificial Sequence: Synthetic oligonucleotide
agagcuagcagggcauua

SEQ ID NO: 64730 - RNA, 18 nt, Artificial Sequence
  Description of Artificial Sequence: Synthetic oligonucleotide
cuugcagagcuagcaggg

SEQ ID NO: 64731 - RNA, 18 nt, Artificial Sequence
  Description of Artificial Sequence: Synthetic oligonucleotide
uaccugggcugcaguggg

SEQ ID NO: 64732 - RNA, 18 nt, Artificial Sequence
  Description of Artificial Sequence: Synthetic oligonucleotide
uaguaccugggcugcagu

SEQ ID NO: 64733 - RNA, 18 nt, Artificial Sequence
  Description of Artificial Sequence: Synthetic oligonucleotide
gccuguaguaccugggcu

SEQ ID NO: 64734 - RNA, 18 nt, Artificial Sequence
  Description of Artificial Sequence: Synthetic oligonucleotide
cgccggccuguaguaccu

SEQ ID NO: 64735 - RNA, 18 nt, Artificial Sequence
  Description of Artificial Sequence: Synthetic oligonucleotide
ugccacgccggccuguag

SEQ ID NO: 64736 - RNA, 18 nt, Artificial Sequence
  Description of Artificial Sequence: Synthetic oligonucleotide
ucaucugccacgccggcc

SEQ ID NO: 64737 - RNA, 18 nt, Artificial Sequence
  Description of Artificial Sequence: Synthetic oligonucleotide
ucaggucaucugccacgc

SEQ ID NO: 64738 - RNA, 18 nt, Artificial Sequence
  Description of Artificial Sequence: Synthetic oligonucleotide
uuuccucaggucaucugc

SEQ ID NO: 64739 - RNA, 18 nt, Artificial Sequence
  Description of Artificial Sequence: Synthetic oligonucleotide
ggcaguuuccucagguca

SEQ ID NO: 64740 - RNA, 18 nt, Artificial Sequence
  Description of Artificial Sequence: Synthetic oligonucleotide
ugaagggcaguuuccuca

SEQ ID NO: 64741 - RNA, 18 nt, Artificial Sequence
  Description of Artificial Sequence: Synthetic oligonucleotide
ggucaugaagggcaguuu

SEQ ID NO: 64742 - RNA, 18 nt, Artificial Sequence
  Description of Artificial Sequence: Synthetic oligonucleotide
gcacuggucaugaagggc

SEQ ID NO: 64743 - RNA, 18 nt, Artificial Sequence
  Description of Artificial Sequence: Synthetic oligonucleotide
ucacagcacuggucauga

SEQ ID NO: 64744 - RNA, 18 nt, Artificial Sequence
  Description of Artificial Sequence: Synthetic oligonucleotide
cuccaucacagcacuggu

SEQ ID NO: 64745 - RNA, 18 nt, Artificial Sequence
  Description of Artificial Sequence: Synthetic oligonucleotide
aacaccuccaucacagca

SEQ ID NO: 64746 - RNA, 18 nt, Artificial Sequence
  Description of Artificial Sequence: Synthetic oligonucleotide
cgccaaacaccuccauca

SEQ ID NO: 64747 - RNA, 18 nt, Artificial Sequence
  Description of Artificial Sequence: Synthetic oligonucleotide
agacacgccaaacaccuc

SEQ ID NO: 64748 - RNA, 18 nt, Artificial Sequence
  Description of Artificial Sequence: Synthetic oligonucleotide
cagccagacacgccaaac

SEQ ID NO: 64749 - RNA, 18 nt, Artificial Sequence
  Description of Artificial Sequence: Synthetic oligonucleotide
cgcggcagccagacacgc

SEQ ID NO: 64750 - RNA, 18 nt, Artificial Sequence
  Description of Artificial Sequence: Synthetic oligonucleotide
ggucacgcggcagccaga

SEQ ID NO: 64751 - RNA, 18 nt, Artificial Sequence
  Description of Artificial Sequence: Synthetic oligonucleotide
cagcgggucacgcggcag

SEQ ID NO: 64752 - RNA, 18 nt, Artificial Sequence
  Description of Artificial Sequence: Synthetic oligonucleotide
agccacagcgggucacgc

SEQ ID NO: 64753 - RNA, 18 nt, Artificial Sequence
  Description of Artificial Sequence: Synthetic oligonucleotide
uguguagccacagcgggu

SEQ ID NO: 64754 - RNA, 18 nt, Artificial Sequence
  Description of Artificial Sequence: Synthetic oligonucleotide
ucuccuguguagccacag

SEQ ID NO: 64755 - RNA, 18 nt, Artificial Sequence
  Description of Artificial Sequence: Synthetic oligonucleotide
cauccucuccuguguagc

SEQ ID NO: 64756 - RNA, 18 nt, Artificial Sequence
  Description of Artificial Sequence: Synthetic oligonucleotide
cacaccauccucuccugu

SEQ ID NO: 64757 - RNA, 18 nt, Artificial Sequence
  Description of Artificial Sequence: Synthetic oligonucleotide
ccccacaccacuucuuga

SEQ ID NO: 64758 - RNA, 18 nt, Artificial Sequence
  Description of Artificial Sequence: Synthetic oligonucleotide
acugcccccacaccacuu

SEQ ID NO: 64759 - RNA, 18 nt, Artificial Sequence
  Description of Artificial Sequence: Synthetic oligonucleotide
ccuguacugcccccacac

SEQ ID NO: 64760 - RNA, 18 nt, Artificial Sequence
  Description of Artificial Sequence: Synthetic oligonucleotide
ugugcccuguacugcccc

SEQ ID NO: 64761 - RNA, 18 nt, Artificial Sequence
  Description of Artificial Sequence: Synthetic oligonucleotide
cauccugugcccuguacu

SEQ ID NO: 64762 - RNA, 18 nt, Artificial Sequence
  Description of Artificial Sequence: Synthetic oligonucleotide
acaugcauccugugcccu

SEQ ID NO: 64763 - RNA, 18 nt, Artificial Sequence
  Description of Artificial Sequence: Synthetic oligonucleotide
cccucacaugcauccugu

SEQ ID NO: 64764 - RNA, 18 nt, Artificial Sequence
  Description of Artificial Sequence: Synthetic oligonucleotide
ccaaccccucacaugcau

SEQ ID NO: 64765 - RNA, 18 nt, Artificial Sequence
  Description of Artificial Sequence: Synthetic oligonucleotide
uacccccaaccccucaca

SEQ ID NO: 64766 - RNA, 18 nt, Artificial Sequence
  Description of Artificial Sequence: Synthetic oligonucleotide
ccacauacccccaacccc

SEQ ID NO: 64767 - RNA, 18 nt, Artificial Sequence
  Description of Artificial Sequence: Synthetic oligonucleotide
cuguaccacauaccccca

SEQ ID NO: 64768 - RNA, 18 nt, Artificial Sequence
  Description of Artificial Sequence: Synthetic oligonucleotide
gcucccuguaccacauac

SEQ ID NO: 64769 - RNA, 18 nt, Artificial Sequence
  Description of Artificial Sequence: Synthetic oligonucleotide
gggaagcucccuguacca

SEQ ID NO: 64770 - RNA, 18 nt, Artificial Sequence
  Description of Artificial Sequence: Synthetic oligonucleotide
cauccugugcccuguacu

SEQ ID NO: 64771 - RNA, 18 nt, Artificial Sequence
  Description of Artificial Sequence: Synthetic oligonucleotide
acaugcauccugugcccu

SEQ ID NO: 64772 - RNA, 18 nt, Artificial Sequence
  Description of Artificial Sequence: Synthetic oligonucleotide
cccucacaugcauccugu

SEQ ID NO: 64773 - RNA, 18 nt, Artificial Sequence
  Description of Artificial Sequence: Synthetic oligonucleotide
ccaaccccucacaugcau

SEQ ID NO: 64774 - RNA, 18 nt, Artificial Sequence
  Description of Artificial Sequence: Synthetic oligonucleotide
uacccccaaccccucaca

SEQ ID NO: 64775 - RNA, 18 nt, Artificial Sequence
  Description of Artificial Sequence: Synthetic oligonucleotide
ccacauacccccaacccc

SEQ ID NO: 64776 - RNA, 18 nt, Artificial Sequence
  Description of Artificial Sequence: Synthetic oligonucleotide
cuguaccacauaccccca

SEQ ID NO: 64777 - RNA, 18 nt, Artificial Sequence
  Description of Artificial Sequence: Synthetic oligonucleotide
gcucccuguaccacauac

SEQ ID NO: 64778 - RNA, 18 nt, Artificial Sequence
  Description of Artificial Sequence: Synthetic oligonucleotide
gggaagcucccuguacca

SEQ ID NO: 64779 - RNA, 18 nt, Artificial Sequence
  Description of Artificial Sequence: Synthetic oligonucleotide
cagaugggaagcucccug

SEQ ID NO: 64780 - RNA, 18 nt, Artificial Sequence
  Description of Artificial Sequence: Synthetic oligonucleotide
gagggcagaugggaagcu

SEQ ID NO: 64781 - RNA, 18 nt, Artificial Sequence
  Description of Artificial Sequence: Synthetic oligonucleotide
ccgcuaccggcaccgaga

SEQ ID NO: 64782 - RNA, 18 nt, Artificial Sequence
  Description of Artificial Sequence: Synthetic oligonucleotide
ugcccccgcuaccggcac

SEQ ID NO: 64783 - RNA, 18 nt, Artificial Sequence
  Description of Artificial Sequence: Synthetic oligonucleotide
ugaacugcccccgcuacc

SEQ ID NO: 64784 - RNA, 18 nt, Artificial Sequence
  Description of Artificial Sequence: Synthetic oligonucleotide
ccaggugaacugcccccg

SEQ ID NO: 64785 - RNA, 18 nt, Artificial Sequence
  Description of Artificial Sequence: Synthetic oligonucleotide
uguugccaggugaacugc

SEQ ID NO: 64786 - RNA, 18 nt, Artificial Sequence
  Description of Artificial Sequence: Synthetic oligonucleotide
auagcuguugccagguga

SEQ ID NO: 64787 - RNA, 18 nt, Artificial Sequence
  Description of Artificial Sequence: Synthetic oligonucleotide
ucagaauagcuguugcca

SEQ ID NO: 64788 - RNA, 18 nt, Artificial Sequence
  Description of Artificial Sequence: Synthetic oligonucleotide
guuuuucagaauagcugu

SEQ ID NO: 64789 - RNA, 18 nt, Artificial Sequence
  Description of Artificial Sequence: Synthetic oligonucleotide
ucuggguuuuucagaaua

SEQ ID NO: 64790 - RNA, 18 nt, Artificial Sequence
  Description of Artificial Sequence: Synthetic oligonucleotide
ucaccucuggguuuuuca

SEQ ID NO: 64791 - RNA, 18 nt, Artificial Sequence
  Description of Artificial Sequence: Synthetic oligonucleotide
cagcuucaccucuggguu

SEQ ID NO: 64792 - RNA, 18 nt, Artificial Sequence
  Description of Artificial Sequence: Synthetic oligonucleotide
ccugccagcuucaccucu

SEQ ID NO: 64793 - RNA, 18 nt, Artificial Sequence
  Description of Artificial Sequence: Synthetic oligonucleotide
ccagcccugccagcuuca

SEQ ID NO: 64794 - RNA, 18 nt, Artificial Sequence
  Description of Artificial Sequence: Synthetic oligonucleotide
ggcugccagcccugccag

SEQ ID NO: 64795 - RNA, 18 nt, Artificial Sequence
  Description of Artificial Sequence: Synthetic oligonucleotide
ucccuggcugccagcccu

SEQ ID NO: 64796 - RNA, 18 nt, Artificial Sequence
  Description of Artificial Sequence: Synthetic oligonucleotide
ggcugucccuggcugcca

SEQ ID NO: 64797 - RNA, 18 nt, Artificial Sequence
  Description of Artificial Sequence: Synthetic oligonucleotide
gcgcaggcugucccuggc

SEQ ID NO: 64798 - RNA, 18 nt, Artificial Sequence
  Description of Artificial Sequence: Synthetic oligonucleotide
uccaggcgcaggcugucc

SEQ ID NO: 64799 - RNA, 18 nt, Artificial Sequence
  Description of Artificial Sequence: Synthetic oligonucleotide
cugccuccaggcgcaggc

SEQ ID NO: 64800 - RNA, 18 nt, Artificial Sequence
  Description of Artificial Sequence: Synthetic oligonucleotide
gaggccugccuccaggcg

SEQ ID NO: 64801 - RNA, 18 nt, Artificial Sequence
  Description of Artificial Sequence: Synthetic oligonucleotide
aggcagaggccugccucc

SEQ ID NO: 64802 - RNA, 18 nt, Artificial Sequence
  Description of Artificial Sequence: Synthetic oligonucleotide
cauacaggcagaggccug

SEQ ID NO: 64803 - RNA, 18 nt, Artificial Sequence
  Description of Artificial Sequence: Synthetic oligonucleotide
auucccauacaggcagag

SEQ ID NO: 64804 - RNA, 18 nt, Artificial Sequence
  Description of Artificial Sequence: Synthetic oligonucleotide
augucauucccauacagg

SEQ ID NO: 64805 - RNA, 18 nt, Artificial Sequence
  Description of Artificial Sequence: Synthetic oligonucleotide
caucaaugucauucccau

SEQ ID NO: 64806 - RNA, 18 nt, Artificial Sequence
  Description of Artificial Sequence: Synthetic oligonucleotide
guguucaucaaugucauu

SEQ ID NO: 64807 - RNA, 18 nt, Artificial Sequence
  Description of Artificial Sequence: Synthetic oligonucleotide
guaguguguucaucaaug

SEQ ID NO: 64808 - RNA, 18 nt, Artificial Sequence
  Description of Artificial Sequence: Synthetic oligonucleotide
cagguguaguguguucau

SEQ ID NO: 64809 - RNA, 18 nt, Artificial Sequence
  Description of Artificial Sequence: Synthetic oligonucleotide
cuccacagguguagugug

SEQ ID NO: 64810 - RNA, 18 nt, Artificial Sequence
  Description of Artificial Sequence: Synthetic oligonucleotide
cugcccuccacaggugua

SEQ ID NO: 64811 - RNA, 18 nt, Artificial Sequence
  Description of Artificial Sequence: Synthetic oligonucleotide
ugaggcugcccuccacag

SEQ ID NO: 64812 - RNA, 18 nt, Artificial Sequence
  Description of Artificial Sequence: Synthetic oligonucleotide
ccaacugaggcugcccuc

SEQ ID NO: 64813 - RNA, 18 nt, Artificial Sequence
  Description of Artificial Sequence: Synthetic oligonucleotide
aguguccaacugaggcug

SEQ ID NO: 64814 - RNA, 18 nt, Artificial Sequence
  Description of Artificial Sequence: Synthetic oligonucleotide
uaaacagcgacagugucc

SEQ ID NO: 64815 - RNA, 18 nt, Artificial Sequence
  Description of Artificial Sequence: Synthetic oligonucleotide
guugguaaacagcgacag

SEQ ID NO: 64816 - RNA, 18 nt, Artificial Sequence
  Description of Artificial Sequence: Synthetic oligonucleotide
gccucguugguaaacagc

SEQ ID NO: 64817 - RNA, 18 nt, Artificial Sequence
  Description of Artificial Sequence: Synthetic oligonucleotide
cuccagccucguugguaa

SEQ ID NO: 64818 - RNA, 18 nt, Artificial Sequence
  Description of Artificial Sequence: Synthetic oligonucleotide
gaugccuccagccucguu

SEQ ID NO: 64819 - RNA, 18 nt, Artificial Sequence
  Description of Artificial Sequence: Synthetic oligonucleotide
ucuaagaugccuccagcc

SEQ ID NO: 64820 - RNA, 18 nt, Artificial Sequence
  Description of Artificial Sequence: Synthetic oligonucleotide
agucaucuaagaugccuc

SEQ ID NO: 64821 - RNA, 18 nt, Artificial Sequence
  Description of Artificial Sequence: Synthetic oligonucleotide
aaucaagucaucuaagau

SEQ ID NO: 64822 - RNA, 18 nt, Artificial Sequence
  Description of Artificial Sequence: Synthetic oligonucleotide
guuacaaucaagucaucu

SEQ ID NO: 64823 - RNA, 18 nt, Artificial Sequence
  Description of Artificial Sequence: Synthetic oligonucleotide
uauugguuacaaucaagu

SEQ ID NO: 64824 - RNA, 18 nt, Artificial Sequence
  Description of Artificial Sequence: Synthetic oligonucleotide
agaaguauugguuacaau

SEQ ID NO: 64825 - RNA, 18 nt, Artificial Sequence
  Description of Artificial Sequence: Synthetic oligonucleotide
cccucagaaguauugguu

SEQ ID NO: 64826 - RNA, 18 nt, Artificial Sequence
  Description of Artificial Sequence: Synthetic oligonucleotide
gguggcccucagaaguau

SEQ ID NO: 64827 - RNA, 18 nt, Artificial Sequence
  Description of Artificial Sequence: Synthetic oligonucleotide
auacagguggcccucaga

SEQ ID NO: 64828 - RNA, 18 nt, Artificial Sequence
  Description of Artificial Sequence: Synthetic oligonucleotide
accacauacagguggccc

SEQ ID NO: 64829 - RNA, 18 nt, Artificial Sequence
  Description of Artificial Sequence: Synthetic oligonucleotide
uggacaccacauacaggu

SEQ ID NO: 64830 - RNA, 18 nt, Artificial Sequence
  Description of Artificial Sequence: Synthetic oligonucleotide
agcguuggacaccacaua

SEQ ID NO: 64831 - RNA, 18 nt, Artificial Sequence
  Description of Artificial Sequence: Synthetic oligonucleotide
cagccagcguuggacacc

SEQ ID NO: 64832 - RNA, 18 nt, Artificial Sequence
  Description of Artificial Sequence: Synthetic oligonucleotide
cccagcagccagcguugg

SEQ ID NO: 64833 - RNA, 18 nt, Artificial Sequence
  Description of Artificial Sequence: Synthetic oligonucleotide
uuucucccagcagccagc

SEQ ID NO: 64834 - RNA, 18 nt, Artificial Sequence
  Description of Artificial Sequence: Synthetic oligonucleotide
aaaucuuucucccagcag

SEQ ID NO: 64835 - RNA, 18 nt, Artificial Sequence
  Description of Artificial Sequence: Synthetic oligonucleotide
gggccaaaucuuucuccc

SEQ ID NO: 64836 - RNA, 18 nt, Artificial Sequence
  Description of Artificial Sequence: Synthetic oligonucleotide
caugagggccaaaucuuu

SEQ ID NO: 64837 - RNA, 18 nt, Artificial Sequence
  Description of Artificial Sequence: Synthetic oligonucleotide
aggugucuagaacacaga

SEQ ID NO: 64838 - RNA, 18 nt, Artificial Sequence
  Description of Artificial Sequence: Synthetic oligonucleotide
agacaaggugucuagaac

SEQ ID NO: 64839 - RNA, 18 nt, Artificial Sequence
  Description of Artificial Sequence: Synthetic oligonucleotide
aaggaagacaaggugucu

SEQ ID NO: 64840 - RNA, 18 nt, Artificial Sequence
  Description of Artificial Sequence: Synthetic oligonucleotide
ugaacaaggaagacaagg

SEQ ID NO: 64841 - RNA, 18 nt, Artificial Sequence
  Description of Artificial Sequence: Synthetic oligonucleotide
cucuaugaacaaggaaga

SEQ ID NO: 64842 - RNA, 18 nt, Artificial Sequence
  Description of Artificial Sequence: Synthetic oligonucleotide
uacugcucuaugaacaag

SEQ ID NO: 64843 - RNA, 18 nt, Artificial Sequence
  Description of Artificial Sequence: Synthetic oligonucleotide
aaggauacugcucuauga

SEQ ID NO: 64844 - RNA, 18 nt, Artificial Sequence
  Description of Artificial Sequence: Synthetic oligonucleotide
acaacaaggauacugcuc

SEQ ID NO: 64845 - RNA, 18 nt, Artificial Sequence
  Description of Artificial Sequence: Synthetic oligonucleotide
cuuggacaacaaggauac

SEQ ID NO: 64846 - RNA, 18 nt, Artificial Sequence
  Description of Artificial Sequence: Synthetic oligonucleotide
ccugucuuggacaacaag

SEQ ID NO: 64847 - RNA, 18 nt, Artificial Sequence
  Description of Artificial Sequence: Synthetic oligonucleotide
ccaacccugucuuggaca

SEQ ID NO: 64848 - RNA, 18 nt, Artificial Sequence
  Description of Artificial Sequence: Synthetic oligonucleotide
cugugccaacccugucuu

SEQ ID NO: 64849 - RNA, 18 nt, Artificial Sequence
  Description of Artificial Sequence: Synthetic oligonucleotide
cuugucugugccaacccu

SEQ ID NO: 64850 - RNA, 18 nt, Artificial Sequence
  Description of Artificial Sequence: Synthetic oligonucleotide
ggucccuugucugugcca

SEQ ID NO: 64851 - RNA, 18 nt, Artificial Sequence
  Description of Artificial Sequence: Synthetic oligonucleotide
uuccaggucccuugucug

SEQ ID NO: 64852 - RNA, 18 nt, Artificial Sequence
  Description of Artificial Sequence: Synthetic oligonucleotide
ccauuuuccaggucccuu

SEQ ID NO: 64853 - RNA, 18 nt, Artificial Sequence
  Description of Artificial Sequence: Synthetic oligonucleotide
aagagccauuuuccaggu

SEQ ID NO: 64854 - RNA, 18 nt, Artificial Sequence
  Description of Artificial Sequence: Synthetic oligonucleotide
acugaaagagccauuuuc

SEQ ID NO: 64855 - RNA, 18 nt, Artificial Sequence
  Description of Artificial Sequence: Synthetic oligonucleotide
cauucacugaaagagcca

SEQ ID NO: 64856 - RNA, 18 nt, Artificial Sequence
  Description of Artificial Sequence: Synthetic oligonucleotide
cuguucauucacugaaag

SEQ ID NO: 64857 - RNA, 18 nt, Artificial Sequence
  Description of Artificial Sequence: Synthetic oligonucleotide
cauagcuguucauucacu

SEQ ID NO: 64858 - RNA, 18 nt, Artificial Sequence
  Description of Artificial Sequence: Synthetic oligonucleotide
agucucauagcuguucau

SEQ ID NO: 64859 - RNA, 18 nt, Artificial Sequence
  Description of Artificial Sequence: Synthetic oligonucleotide
ucuugagucucauagcug

SEQ ID NO: 64860 - RNA, 18 nt, Artificial Sequence
  Description of Artificial Sequence: Synthetic oligonucleotide
ccugcucuugagucucau

SEQ ID NO: 64861 - RNA, 18 nt, Artificial Sequence
  Description of Artificial Sequence: Synthetic oligonucleotide
gagggccugcucuugagu

SEQ ID NO: 64862 - RNA, 18 nt, Artificial Sequence
  Description of Artificial Sequence: Synthetic oligonucleotide
ccagagagggccugcucu

SEQ ID NO: 64863 - RNA, 18 nt, Artificial Sequence
  Description of Artificial Sequence: Synthetic oligonucleotide
gugcuccagagagggccu

SEQ ID NO: 64864 - RNA, 18 nt, Artificial Sequence
  Description of Artificial Sequence: Synthetic oligonucleotide
cuggcgugcuccagagag

SEQ ID NO: 64865 - RNA, 18 nt, Artificial Sequence
  Description of Artificial Sequence: Synthetic oligonucleotide
aaacccuggcgugcucca

SEQ ID NO: 64866 - RNA, 18 nt, Artificial Sequence
  Description of Artificial Sequence: Synthetic oligonucleotide
ccaccaaacccuggcgug

SEQ ID NO: 64867 - RNA, 18 nt, Artificial Sequence
  Description of Artificial Sequence: Synthetic oligonucleotide
ccccaccaccaaacccug

SEQ ID NO: 64868 - RNA, 18 nt, Artificial Sequence
  Description of Artificial Sequence: Synthetic oligonucleotide
uaaucccccaccaccaaa

SEQ ID NO: 64869 - RNA, 18 nt, Artificial Sequence
  Description of Artificial Sequence: Synthetic oligonucleotide
ccugguaaucccccacca

SEQ ID NO: 64870 - RNA, 18 nt, Artificial Sequence
  Description of Artificial Sequence: Synthetic oligonucleotide
ccaugccugguaaucccc

SEQ ID NO: 64871 - RNA, 18 nt, Artificial Sequence
  Description of Artificial Sequence: Synthetic oligonucleotide
ccuccccaugccugguaa

SEQ ID NO: 64872 - RNA, 18 nt, Artificial Sequence
  Description of Artificial Sequence: Synthetic oligonucleotide
gacccccuccccaugccu

SEQ ID NO: 64873 - RNA, 18 nt, Artificial Sequence
  Description of Artificial Sequence: Synthetic oligonucleotide
gccaagacccccucccca

SEQ ID NO: 64874 - RNA, 18 nt, Artificial Sequence
  Description of Artificial Sequence: Synthetic oligonucleotide
gggccaagacccccuccc

SEQ ID NO: 64875 - RNA, 18 nt, Artificial Sequence
  Description of Artificial Sequence: Synthetic oligonucleotide
ccaccucacaccagaggg

SEQ ID NO: 64876 - RNA, 18 nt, Artificial Sequence
  Description of Artificial Sequence: Synthetic oligonucleotide
uucugccaccucacacca

SEQ ID NO: 64877 - RNA, 18 nt, Artificial Sequence
  Description of Artificial Sequence: Synthetic oligonucleotide
cccaguucugccaccuca

SEQ ID NO: 64878 - RNA, 18 nt, Artificial Sequence
  Description of Artificial Sequence: Synthetic oligonucleotide
ccaagcccaguucugcca

SEQ ID NO: 64879 - RNA, 18 nt, Artificial Sequence
  Description of Artificial Sequence: Synthetic oligonucleotide
ccccuccccaugccuggu

SEQ ID NO: 64880 - RNA, 18 nt, Artificial Sequence
  Description of Artificial Sequence: Synthetic oligonucleotide
aagacccccuccccaugc

SEQ ID NO: 64881 - RNA, 18 nt, Artificial Sequence
  Description of Artificial Sequence: Synthetic oligonucleotide
gggccaagacccccuccc

SEQ ID NO: 64882 - RNA, 18 nt, Artificial Sequence
  Description of Artificial Sequence: Synthetic oligonucleotide
ccaccucacaccagaggg

SEQ ID NO: 64883 - RNA, 18 nt, Artificial Sequence
  Description of Artificial Sequence: Synthetic oligonucleotide
cugccaccucacaccaga

SEQ ID NO: 64884 - RNA, 18 nt, Artificial Sequence
  Description of Artificial Sequence: Synthetic oligonucleotide
caguucugccaccucaca

SEQ ID NO: 64885 - RNA, 18 nt, Artificial Sequence
  Description of Artificial Sequence: Synthetic oligonucleotide
aagcccaguucugccacc

SEQ ID NO: 64886 - RNA, 18 nt, Artificial Sequence
  Description of Artificial Sequence: Synthetic oligonucleotide
gacccaagcccaguucug

SEQ ID NO: 64887 - RNA, 18 nt, Artificial Sequence
  Description of Artificial Sequence: Synthetic oligonucleotide
gagaugacccaagcccag

SEQ ID NO: 64888 - RNA, 18 nt, Artificial Sequence
  Description of Artificial Sequence: Synthetic oligonucleotide
ugauagagaugacccaag

SEQ ID NO: 64889 - RNA, 18 nt, Artificial Sequence
  Description of Artificial Sequence: Synthetic oligonucleotide
cuaagugauagagaugac

SEQ ID NO: 64890 - RNA, 18 nt, Artificial Sequence
  Description of Artificial Sequence: Synthetic oligonucleotide
agcuacuaagugauagag

SEQ ID NO: 64891 - RNA, 18 nt, Artificial Sequence
  Description of Artificial Sequence: Synthetic oligonucleotide
cacauagcuacuaaguga

SEQ ID NO: 64892 - RNA, 18 nt, Artificial Sequence
  Description of Artificial Sequence: Synthetic oligonucleotide
aaggucacauagcuacua

SEQ ID NO: 64893 - RNA, 18 nt, Artificial Sequence
  Description of Artificial Sequence: Synthetic oligonucleotide
cuuacaaggucacauagc

SEQ ID NO: 64894 - RNA, 18 nt, Artificial Sequence
  Description of Artificial Sequence: Synthetic oligonucleotide
cccaucuuacaaggucac

SEQ ID NO: 64895 - RNA, 18 nt, Artificial Sequence
  Description of Artificial Sequence: Synthetic oligonucleotide
ugguucccaucuuacaag

SEQ ID NO: 64896 - RNA, 18 nt, Artificial Sequence
  Description of Artificial Sequence: Synthetic oligonucleotide
uaggcugguucccaucuu

SEQ ID NO: 64897 - RNA, 18 nt, Artificial Sequence
  Description of Artificial Sequence: Synthetic oligonucleotide
gguaguaggcugguuccc

SEQ ID NO: 64898 - RNA, 18 nt, Artificial Sequence
  Description of Artificial Sequence: Synthetic oligonucleotide
aaaaagguaguaggcugg

SEQ ID NO: 64899 - RNA, 18 nt, Artificial Sequence
  Description of Artificial Sequence: Synthetic oligonucleotide
gaaaaaaaaagguaguag

SEQ ID NO: 64900 - RNA, 18 nt, Artificial Sequence
  Description of Artificial Sequence: Synthetic oligonucleotide
gggaggaaaaaaaaaggu

SEQ ID NO: 64901 - RNA, 18 nt, Artificial Sequence
  Description of Artificial Sequence: Synthetic oligonucleotide
gaggagggaggaaaaaaa

SEQ ID NO: 64902 - RNA, 18 nt, Artificial Sequence
  Description of Artificial Sequence: Synthetic oligonucleotide
aggaggaggagggaggaa

SEQ ID NO: 64903 - RNA, 18 nt, Artificial Sequence
  Description of Artificial Sequence: Synthetic oligonucleotide
agaggaggaggaggaggg

SEQ ID NO: 64904 - RNA, 18 nt, Artificial Sequence
  Description of Artificial Sequence: Synthetic oligonucleotide
aguggagaggaggaggag

SEQ ID NO: 64905 - RNA, 18 nt, Artificial Sequence
  Description of Artificial Sequence: Synthetic oligonucleotide
aggacaguggagaggagg

SEQ ID NO: 64906 - RNA, 18 nt, Artificial Sequence
  Description of Artificial Sequence: Synthetic oligonucleotide
guaguaggacaguggaga

SEQ ID NO: 64907 - RNA, 18 nt, Artificial Sequence
  Description of Artificial Sequence: Synthetic oligonucleotide
ggacaguaguaggacagu

SEQ ID NO: 64908 - RNA, 18 nt, Artificial Sequence
  Description of Artificial Sequence: Synthetic oligonucleotide
gagcuggacaguaguagg

SEQ ID NO: 64909 - RNA, 18 nt, Artificial Sequence
  Description of Artificial Sequence: Synthetic oligonucleotide
cugcagagcuggacagua

SEQ ID NO: 64910 - RNA, 18 nt, Artificial Sequence
  Description of Artificial Sequence: Synthetic oligonucleotide
ggacgcugcagagcugga

SEQ ID NO: 64911 - RNA, 18 nt, Artificial Sequence
  Description of Artificial Sequence: Synthetic oligonucleotide
gggcuggacgcugcagag

SEQ ID NO: 64912 - RNA, 18 nt, Artificial Sequence
  Description of Artificial Sequence: Synthetic oligonucleotide
accaugggcuggacgcug

SEQ ID NO: 64913 - RNA, 18 nt, Artificial Sequence
  Description of Artificial Sequence: Synthetic oligonucleotide
cagcuaccaugggcugga

SEQ ID NO: 64914 - RNA, 18 nt, Artificial Sequence
  Description of Artificial Sequence: Synthetic oligonucleotide
cugagcagcuaccauggg

SEQ ID NO: 64915 - RNA, 18 nt, Artificial Sequence
  Description of Artificial Sequence: Synthetic oligonucleotide
acuuacugagcagcuacc

SEQ ID NO: 64916 - RNA, 18 nt, Artificial Sequence
  Description of Artificial Sequence: Synthetic oligonucleotide
gggccacuuacugagcag

SEQ ID NO: 64917 - RNA, 18 nt, Artificial Sequence
  Description of Artificial Sequence: Synthetic oligonucleotide
aacacaagagcaucuggg

SEQ ID NO: 64918 - RNA, 18 nt, Artificial Sequence
  Description of Artificial Sequence: Synthetic oligonucleotide
gaagcucccugaccuugu

SEQ ID NO: 64919 - RNA, 18 nt, Artificial Sequence
  Description of Artificial Sequence: Synthetic oligonucleotide
guucugaagcucccugac

SEQ ID NO: 64920 - RNA, 18 nt, Artificial Sequence
  Description of Artificial Sequence: Synthetic oligonucleotide
cccugguucugaagcucc

SEQ ID NO: 64921 - RNA, 18 nt, Artificial Sequence
  Description of Artificial Sequence: Synthetic oligonucleotide
cucugcccugguucugaa

SEQ ID NO: 64922 - RNA, 18 nt, Artificial Sequence
  Description of Artificial Sequence: Synthetic oligonucleotide
cacaucucugcccugguu

SEQ ID NO: 64923 - RNA, 18 nt, Artificial Sequence
  Description of Artificial Sequence: Synthetic oligonucleotide
aggcccacaucucugccc

SEQ ID NO: 64924 - RNA, 18 nt, Artificial Sequence
  Description of Artificial Sequence: Synthetic oligonucleotide
ccuccaggcccacaucuc

SEQ ID NO: 64925 - RNA, 18 nt, Artificial Sequence
  Description of Artificial Sequence: Synthetic oligonucleotide
caacaccuccaggcccac

SEQ ID NO: 64926 - RNA, 18 nt, Artificial Sequence
  Description of Artificial Sequence: Synthetic oligonucleotide
uuauccaacaccuccagg

SEQ ID NO: 64927 - RNA, 18 nt, Artificial Sequence
  Description of Artificial Sequence: Synthetic oligonucleotide
gggcauuauccaacaccu

SEQ ID NO: 64928 - RNA, 18 nt, Artificial Sequence
  Description of Artificial Sequence: Synthetic oligonucleotide
uagcagggcauuauccaa

SEQ ID NO: 64929 - RNA, 18 nt, Artificial Sequence
  Description of Artificial Sequence: Synthetic oligonucleotide
agagcuagcagggcauua

SEQ ID NO: 64930 - RNA, 18 nt, Artificial Sequence
  Description of Artificial Sequence: Synthetic oligonucleotide
cuugcagagcuagcaggg

SEQ ID NO: 64931 - RNA, 18 nt, Artificial Sequence
  Description of Artificial Sequence: Synthetic oligonucleotide
uaccugggcugcaguggg

SEQ ID NO: 64932 - RNA, 18 nt, Artificial Sequence
  Description of Artificial Sequence: Synthetic oligonucleotide
uaguaccugggcugcagu

SEQ ID NO: 64933 - RNA, 18 nt, Artificial Sequence
  Description of Artificial Sequence: Synthetic oligonucleotide
gccuguaguaccugggcu

SEQ ID NO: 64934 - RNA, 18 nt, Artificial Sequence
  Description of Artificial Sequence: Synthetic oligonucleotide
cgccggccuguaguaccu

SEQ ID NO: 64935 - RNA, 18 nt, Artificial Sequence
  Description of Artificial Sequence: Synthetic oligonucleotide
ugccacgccggccuguag

SEQ ID NO: 64936 - RNA, 18 nt, Artificial Sequence
  Description of Artificial Sequence: Synthetic oligonucleotide
ucaucugccacgccggcc

SEQ ID NO: 64937 - RNA, 18 nt, Artificial Sequence
  Description of Artificial Sequence: Synthetic oligonucleotide
ucaggucaucugccacgc

SEQ ID NO: 64938 - RNA, 18 nt, Artificial Sequence
  Description of Artificial Sequence: Synthetic oligonucleotide
uuuccucaggucaucugc

SEQ ID NO: 64939 - RNA, 18 nt, Artificial Sequence
  Description of Artificial Sequence: Synthetic oligonucleotide
ggcaguuuccucagguca

SEQ ID NO: 64940 - RNA, 18 nt, Artificial Sequence
  Description of Artificial Sequence: Synthetic oligonucleotide
ugaagggcaguuuccuca

SEQ ID NO: 64941 - RNA, 18 nt, Artificial Sequence
  Description of Artificial Sequence: Synthetic oligonucleotide
ggucaugaagggcaguuu

SEQ ID NO: 64942 - RNA, 18 nt, Artificial Sequence
  Description of Artificial Sequence: Synthetic oligonucleotide
gcacuggucaugaagggc

SEQ ID NO: 64943 - RNA, 18 nt, Artificial Sequence
  Description of Artificial Sequence: Synthetic oligonucleotide
ucacagcacuggucauga

SEQ ID NO: 64944 - RNA, 18 nt, Artificial Sequence
  Description of Artificial Sequence: Synthetic oligonucleotide
cuccaucacagcacuggu

SEQ ID NO: 64945 - RNA, 18 nt, Artificial Sequence
  Description of Artificial Sequence: Synthetic oligonucleotide
aacaccuccaucacagca

SEQ ID NO: 64946 - RNA, 18 nt, Artificial Sequence
  Description of Artificial Sequence: Synthetic oligonucleotide
cgccaaacaccuccauca

SEQ ID NO: 64947 - RNA, 18 nt, Artificial Sequence
  Description of Artificial Sequence: Synthetic oligonucleotide
agacacgccaaacaccuc

SEQ ID NO: 64948 - RNA, 18 nt, Artificial Sequence
  Description of Artificial Sequence: Synthetic oligonucleotide
cagccagacacgccaaac

SEQ ID NO: 64949 - RNA, 18 nt, Artificial Sequence
  Description of Artificial Sequence: Synthetic oligonucleotide
cgcggcagccagacacgc

SEQ ID NO: 64950 - RNA, 18 nt, Artificial Sequence
  Description of Artificial Sequence: Synthetic oligonucleotide
ggucacgcggcagccaga

SEQ ID NO: 64951 - RNA, 18 nt, Artificial Sequence
  Description of Artificial Sequence: Synthetic oligonucleotide
cagcgggucacgcggcag

SEQ ID NO: 64952 - RNA, 18 nt, Artificial Sequence
  Description of Artificial Sequence: Synthetic oligonucleotide
agccacagcgggucacgc

SEQ ID NO: 64953 - RNA, 18 nt, Artificial Sequence
  Description of Artificial Sequence: Synthetic oligonucleotide
uguguagccacagcgggu

SEQ ID NO: 64954 - RNA, 18 nt, Artificial Sequence
  Description of Artificial Sequence: Synthetic oligonucleotide
ucuccuguguagccacag

SEQ ID NO: 64955 - RNA, 18 nt, Artificial Sequence
  Description of Artificial Sequence: Synthetic oligonucleotide
cauccucuccuguguagc

SEQ ID NO: 64956 - RNA, 18 nt, Artificial Sequence
  Description of Artificial Sequence: Synthetic oligonucleotide
cacaccauccucuccugu

SEQ ID NO: 64957 - RNA, 18 nt, Artificial Sequence
  Description of Artificial Sequence: Synthetic oligonucleotide
ccccacaccacuucuuga

SEQ ID NO: 64958 - RNA, 18 nt, Artificial Sequence
  Description of Artificial Sequence: Synthetic oligonucleotide
acugcccccacaccacuu

SEQ ID NO: 64959 - RNA, 18 nt, Artificial Sequence
  Description of Artificial Sequence: Synthetic oligonucleotide
ccuguacugcccccacac

SEQ ID NO: 64960 - RNA, 18 nt, Artificial Sequence
  Description of Artificial Sequence: Synthetic oligonucleotide
ugugcccuguacugcccc

SEQ ID NO: 64961 - RNA, 18 nt, Artificial Sequence
  Description of Artificial Sequence: Synthetic oligonucleotide
cauccugugcccuguacu

SEQ ID NO: 64962 - RNA, 18 nt, Artificial Sequence
  Description of Artificial Sequence: Synthetic oligonucleotide
acaugcauccugugcccu

SEQ ID NO: 64963 - RNA, 18 nt, Artificial Sequence
  Description of Artificial Sequence: Synthetic oligonucleotide
cccucacaugcauccugu

SEQ ID NO: 64964 - RNA, 18 nt, Artificial Sequence
  Description of Artificial Sequence: Synthetic oligonucleotide
ccaaccccucacaugcau

SEQ ID NO: 64965 - RNA, 18 nt, Artificial Sequence
  Description of Artificial Sequence: Synthetic oligonucleotide
uacccccaaccccucaca

SEQ ID NO: 64966 - RNA, 18 nt, Artificial Sequence
  Description of Artificial Sequence: Synthetic oligonucleotide
ccacauacccccaacccc

SEQ ID NO: 64967 - RNA, 18 nt, Artificial Sequence
  Description of Artificial Sequence: Synthetic oligonucleotide
cuguaccacauaccccca

SEQ ID NO: 64968 - RNA, 18 nt, Artificial Sequence
  Description of Artificial Sequence: Synthetic oligonucleotide
gcucccuguaccacauac

SEQ ID NO: 64969 - RNA, 18 nt, Artificial Sequence
  Description of Artificial Sequence: Synthetic oligonucleotide
gggaagcucccuguacca

SEQ ID NO: 64970 - RNA, 18 nt, Artificial Sequence
  Description of Artificial Sequence: Synthetic oligonucleotide
cauccugugcccuguacu

SEQ ID NO: 64971 - RNA, 18 nt, Artificial Sequence
  Description of Artificial Sequence: Synthetic oligonucleotide
acaugcauccugugcccu

SEQ ID NO: 64972 - RNA, 18 nt, Artificial Sequence
  Description of Artificial Sequence: Synthetic oligonucleotide
cccucacaugcauccugu

SEQ ID NO: 64973 - RNA, 18 nt, Artificial Sequence
  Description of Artificial Sequence: Synthetic oligonucleotide
ccaaccccucacaugcau

SEQ ID NO: 64974 - RNA, 18 nt, Artificial Sequence
  Description of Artificial Sequence: Synthetic oligonucleotide
uacccccaaccccucaca

SEQ ID NO: 64975 - RNA, 18 nt, Artificial Sequence
  Description of Artificial Sequence: Synthetic oligonucleotide
ccacauacccccaacccc

SEQ ID NO: 64976 - RNA, 18 nt, Artificial Sequence
  Description of Artificial Sequence: Synthetic oligonucleotide
cuguaccacauaccccca

SEQ ID NO: 64977 - RNA, 18 nt, Artificial Sequence
  Description of Artificial Sequence: Synthetic oligonucleotide
gcucccuguaccacauac

SEQ ID NO: 64978 - RNA, 18 nt, Artificial Sequence
  Description of Artificial Sequence: Synthetic oligonucleotide
gggaagcucccuguacca

SEQ ID NO: 64979 - RNA, 18 nt, Artificial Sequence
  Description of Artificial Sequence: Synthetic oligonucleotide
cagaugggaagcucccug

SEQ ID NO: 64980 - RNA, 18 nt, Artificial Sequence
  Description of Artificial Sequence: Synthetic oligonucleotide
gagggcagaugggaagcu

SEQ ID NO: 64981 - RNA, 18 nt, Artificial Sequence
  Description of Artificial Sequence: Synthetic oligonucleotide
ccgcuaccggcaccgaga

SEQ ID NO: 64982 - RNA, 18 nt, Artificial Sequence
  Description of Artificial Sequence: Synthetic oligonucleotide
ugcccccgcuaccggcac

SEQ ID NO: 64983 - RNA, 18 nt, Artificial Sequence
  Description of Artificial Sequence: Synthetic oligonucleotide
ugaacugcccccgcuacc

SEQ ID NO: 64984 - RNA, 18 nt, Artificial Sequence
  Description of Artificial Sequence: Synthetic oligonucleotide
ccaggugaacugcccccg

SEQ ID NO: 64985 - RNA, 18 nt, Artificial Sequence
  Description of Artificial Sequence: Synthetic oligonucleotide
uguugccaggugaacugc

SEQ ID NO: 64986 - RNA, 18 nt, Artificial Sequence
  Description of Artificial Sequence: Synthetic oligonucleotide
auagcuguugccagguga

SEQ ID NO: 64987 - RNA, 18 nt, Artificial Sequence
  Description of Artificial Sequence: Synthetic oligonucleotide
ucagaauagcuguugcca

SEQ ID NO: 64988 - RNA, 18 nt, Artificial Sequence
  Description of Artificial Sequence: Synthetic oligonucleotide
guuuuucagaauagcugu

SEQ ID NO: 64989 - RNA, 18 nt, Artificial Sequence
  Description of Artificial Sequence: Synthetic oligonucleotide
ucuggguuuuucagaaua

SEQ ID NO: 64990 - RNA, 18 nt, Artificial Sequence
  Description of Artificial Sequence: Synthetic oligonucleotide
ucaccucuggguuuuuca

SEQ ID NO: 64991 - RNA, 18 nt, Artificial Sequence
  Description of Artificial Sequence: Synthetic oligonucleotide
cagcuucaccucuggguu

SEQ ID NO: 64992 - RNA, 18 nt, Artificial Sequence
  Description of Artificial Sequence: Synthetic oligonucleotide
ccugccagcuucaccucu

SEQ ID NO: 64993 - RNA, 18 nt, Artificial Sequence
  Description of Artificial Sequence: Synthetic oligonucleotide
ccagcccugccagcuuca

SEQ ID NO: 64994 - RNA, 18 nt, Artificial Sequence
  Description of Artificial Sequence: Synthetic oligonucleotide
ggcugccagcccugccag

SEQ ID NO: 64995 - RNA, 18 nt, Artificial Sequence
  Description of Artificial Sequence: Synthetic oligonucleotide
ucccuggcugccagcccu

SEQ ID NO: 64996 - RNA, 18 nt, Artificial Sequence
  Description of Artificial Sequence: Synthetic oligonucleotide
ggcugucccuggcugcca

SEQ ID NO: 64997 - RNA, 18 nt, Artificial Sequence
  Description of Artificial Sequence: Synthetic oligonucleotide
gcgcaggcugucccuggc

SEQ ID NO: 64998 - RNA, 18 nt, Artificial Sequence
  Description of Artificial Sequence: Synthetic oligonucleotide
uccaggcgcaggcugucc

SEQ ID NO: 64999 - RNA, 18 nt, Artificial Sequence
  Description of Artificial Sequence: Synthetic oligonucleotide
cugccuccaggcgcaggc

SEQ ID NO: 65000 - RNA, 18 nt, Artificial Sequence
  Description of Artificial Sequence: Synthetic oligonucleotide
gaggccugccuccaggcg

SEQ ID NO: 65001 - RNA, 18 nt, Artificial Sequence
  Description of Artificial Sequence: Synthetic oligonucleotide
aggcagaggccugccucc

SEQ ID NO: 65002 - RNA, 18 nt, Artificial Sequence
  Description of Artificial Sequence: Synthetic oligonucleotide
cauacaggcagaggccug

SEQ ID NO: 65003 - RNA, 18 nt, Artificial Sequence
  Description of Artificial Sequence: Synthetic oligonucleotide
auucccauacaggcagag

SEQ ID NO: 65004 - RNA, 18 nt, Artificial Sequence
  Description of Artificial Sequence: Synthetic oligonucleotide
augucauucccauacagg

SEQ ID NO: 65005 - RNA, 18 nt, Artificial Sequence
  Description of Artificial Sequence: Synthetic oligonucleotide
caucaaugucauucccau

SEQ ID NO: 65006 - RNA, 18 nt, Artificial Sequence
  Description of Artificial Sequence: Synthetic oligonucleotide
guguucaucaaugucauu

SEQ ID NO: 65007 - RNA, 18 nt, Artificial Sequence
  Description of Artificial Sequence: Synthetic oligonucleotide
guaguguguucaucaaug

SEQ ID NO: 65008 - RNA, 18 nt, Artificial Sequence
  Description of Artificial Sequence: Synthetic oligonucleotide
cagguguaguguguucau

SEQ ID NO: 65009 - RNA, 18 nt, Artificial Sequence
  Description of Artificial Sequence: Synthetic oligonucleotide
cuccacagguguagugug

SEQ ID NO: 65010 - RNA, 18 nt, Artificial Sequence
  Description of Artificial Sequence: Synthetic oligonucleotide
cugcccuccacaggugua

SEQ ID NO: 65011 - RNA, 18 nt, Artificial Sequence
  Description of Artificial Sequence: Synthetic oligonucleotide
ugaggcugcccuccacag

SEQ ID NO: 65012 - RNA, 18 nt, Artificial Sequence
  Description of Artificial Sequence: Synthetic oligonucleotide
ccaacugaggcugcccuc

SEQ ID NO: 65013 - RNA, 18 nt, Artificial Sequence
  Description of Artificial Sequence: Synthetic oligonucleotide
aguguccaacugaggcug

SEQ ID NO: 65014 - RNA, 18 nt, Artificial Sequence
  Description of Artificial Sequence: Synthetic oligonucleotide
uaaacagcgacagugucc

SEQ ID NO: 65015 - RNA, 18 nt, Artificial Sequence
  Description of Artificial Sequence: Synthetic oligonucleotide
guugguaaacagcgacag

SEQ ID NO: 65016 - RNA, 18 nt, Artificial Sequence
  Description of Artificial Sequence: Synthetic oligonucleotide
gccucguugguaaacagc

SEQ ID NO: 65017 - RNA, 18 nt, Artificial Sequence
  Description of Artificial Sequence: Synthetic oligonucleotide
cuccagccucguugguaa

SEQ ID NO: 65018 - RNA, 18 nt, Artificial Sequence
  Description of Artificial Sequence: Synthetic oligonucleotide
gaugccuccagccucguu

SEQ ID NO: 65019 - RNA, 18 nt, Artificial Sequence
  Description of Artificial Sequence: Synthetic oligonucleotide
ucuaagaugccuccagcc

SEQ ID NO: 65020 - RNA, 18 nt, Artificial Sequence
  Description of Artificial Sequence: Synthetic oligonucleotide
agucaucuaagaugccuc

SEQ ID NO: 65021 - RNA, 18 nt, Artificial Sequence
  Description of Artificial Sequence: Synthetic oligonucleotide
aaucaagucaucuaagau

SEQ ID NO: 65022 - RNA, 18 nt, Artificial Sequence
  Description of Artificial Sequence: Synthetic oligonucleotide
guuacaaucaagucaucu

SEQ ID NO: 65023 - RNA, 18 nt, Artificial Sequence
  Description of Artificial Sequence: Synthetic oligonucleotide
uauugguuacaaucaagu

SEQ ID NO: 65024 - RNA, 18 nt, Artificial Sequence
  Description of Artificial Sequence: Synthetic oligonucleotide
agaaguauugguuacaau

SEQ ID NO: 65025 - RNA, 18 nt, Artificial Sequence
  Description of Artificial Sequence: Synthetic oligonucleotide
cccucagaaguauugguu

SEQ ID NO: 65026 - RNA, 18 nt, Artificial Sequence
  Description of Artificial Sequence: Synthetic oligonucleotide
gguggcccucagaaguau

SEQ ID NO: 65027 - RNA, 18 nt, Artificial Sequence
  Description of Artificial Sequence: Synthetic oligonucleotide
auacagguggcccucaga

SEQ ID NO: 65028 - RNA, 18 nt, Artificial Sequence
  Description of Artificial Sequence: Synthetic oligonucleotide
accacauacagguggccc

SEQ ID NO: 65029 - RNA, 18 nt, Artificial Sequence
  Description of Artificial Sequence: Synthetic oligonucleotide
uggacaccacauacaggu

SEQ ID NO: 65030 - RNA, 18 nt, Artificial Sequence
  Description of Artificial Sequence: Synthetic oligonucleotide
agcguuggacaccacaua

SEQ ID NO: 65031 - RNA, 18 nt, Artificial Sequence
  Description of Artificial Sequence: Synthetic oligonucleotide
cagccagcguuggacacc

SEQ ID NO: 65032 - RNA, 18 nt, Artificial Sequence
  Description of Artificial Sequence: Synthetic oligonucleotide
cccagcagccagcguugg

SEQ ID NO: 65033 - RNA, 18 nt, Artificial Sequence
  Description of Artificial Sequence: Synthetic oligonucleotide
uuucucccagcagccagc

SEQ ID NO: 65034 - RNA, 18 nt, Artificial Sequence
  Description of Artificial Sequence: Synthetic oligonucleotide
aaaucuuucucccagcag

SEQ ID NO: 65035 - RNA, 18 nt, Artificial Sequence
  Description of Artificial Sequence: Synthetic oligonucleotide
gggccaaaucuuucuccc

SEQ ID NO: 65036 - RNA, 18 nt, Artificial Sequence
  Description of Artificial Sequence: Synthetic oligonucleotide
caugagggccaaaucuuu

SEQ ID NO: 65037 - RNA, 18 nt, Artificial Sequence
  Description of Artificial Sequence: Synthetic oligonucleotide
aggugucuagaacacaga

SEQ ID NO: 65038 - RNA, 18 nt, Artificial Sequence
  Description of Artificial Sequence: Synthetic oligonucleotide
agacaaggugucuagaac

SEQ ID NO: 65039 - RNA, 18 nt, Artificial Sequence
  Description of Artificial Sequence: Synthetic oligonucleotide
aaggaagacaaggugucu

SEQ ID NO: 65040 - RNA, 18 nt, Artificial Sequence
  Description of Artificial Sequence: Synthetic oligonucleotide
ugaacaaggaagacaagg

SEQ ID NO: 65041 - RNA, 18 nt, Artificial Sequence
  Description of Artificial Sequence: Synthetic oligonucleotide
cucuaugaacaaggaaga

SEQ ID NO: 65042 - RNA, 18 nt, Artificial Sequence
  Description of Artificial Sequence: Synthetic oligonucleotide
uacugcucuaugaacaag

SEQ ID NO: 65043 - RNA, 18 nt, Artificial Sequence
  Description of Artificial Sequence: Synthetic oligonucleotide
aaggauacugcucuauga

SEQ ID NO: 65044 - RNA, 18 nt, Artificial Sequence
  Description of Artificial Sequence: Synthetic oligonucleotide
acaacaaggauacugcuc

SEQ ID NO: 65045 - RNA, 18 nt, Artificial Sequence
  Description of Artificial Sequence: Synthetic oligonucleotide
cuuggacaacaaggauac

SEQ ID NO: 65046 - RNA, 18 nt, Artificial Sequence
  Description of Artificial Sequence: Synthetic oligonucleotide
ccugucuuggacaacaag

SEQ ID NO: 65047 - RNA, 18 nt, Artificial Sequence
  Description of Artificial Sequence: Synthetic oligonucleotide
ccaacccugucuuggaca

SEQ ID NO: 65048 - RNA, 18 nt, Artificial Sequence
  Description of Artificial Sequence: Synthetic oligonucleotide
cugugccaacccugucuu

SEQ ID NO: 65049 - RNA, 18 nt, Artificial Sequence
  Description of Artificial Sequence: Synthetic oligonucleotide
cuugucugugccaacccu

SEQ ID NO: 65050 - RNA, 18 nt, Artificial Sequence
  Description of Artificial Sequence: Synthetic oligonucleotide
ggucccuugucugugcca

SEQ ID NO: 65051 - RNA, 18 nt, Artificial Sequence
  Description of Artificial Sequence: Synthetic oligonucleotide
uuccaggucccuugucug

SEQ ID NO: 65052 - RNA, 18 nt, Artificial Sequence
  Description of Artificial Sequence: Synthetic oligonucleotide
ccauuuuccaggucccuu

SEQ ID NO: 65053 - RNA, 18 nt, Artificial Sequence
  Description of Artificial Sequence: Synthetic oligonucleotide
aagagccauuuuccaggu

SEQ ID NO: 65054 - RNA, 18 nt, Artificial Sequence
  Description of Artificial Sequence: Synthetic oligonucleotide
acugaaagagccauuuuc

SEQ ID NO: 65055 - RNA, 18 nt, Artificial Sequence
  Description of Artificial Sequence: Synthetic oligonucleotide
cauucacugaaagagcca

SEQ ID NO: 65056 - RNA, 18 nt, Artificial Sequence
  Description of Artificial Sequence: Synthetic oligonucleotide
cuguucauucacugaaag

SEQ ID NO: 65057 - RNA, 18 nt, Artificial Sequence
  Description of Artificial Sequence: Synthetic oligonucleotide
cauagcuguucauucacu

SEQ ID NO: 65058 - RNA, 18 nt, Artificial Sequence
  Description of Artificial Sequence: Synthetic oligonucleotide
agucucauagcuguucau

SEQ ID NO: 65059 - RNA, 18 nt, Artificial Sequence
  Description of Artificial Sequence: Synthetic oligonucleotide
ucuugagucucauagcug

SEQ ID NO: 65060 - RNA, 18 nt, Artificial Sequence
  Description of Artificial Sequence: Synthetic oligonucleotide
ccugcucuugagucucau

SEQ ID NO: 65061 - RNA, 18 nt, Artificial Sequence
  Description of Artificial Sequence: Synthetic oligonucleotide
gagggccugcucuugagu

SEQ ID NO: 65062 - RNA, 18 nt, Artificial Sequence
  Description of Artificial Sequence: Synthetic oligonucleotide
ccagagagggccugcucu

SEQ ID NO: 65063 - RNA, 18 nt, Artificial Sequence
  Description of Artificial Sequence: Synthetic oligonucleotide
gugcuccagagagggccu

SEQ ID NO: 65064 - RNA, 18 nt, Artificial Sequence
  Description of Artificial Sequence: Synthetic oligonucleotide
cuggcgugcuccagagag

SEQ ID NO: 65065 - RNA, 18 nt, Artificial Sequence
  Description of Artificial Sequence: Synthetic oligonucleotide
aaacccuggcgugcucca

SEQ ID NO: 65066 - RNA, 18 nt, Artificial Sequence
  Description of Artificial Sequence: Synthetic oligonucleotide
ccaccaaacccuggcgug

SEQ ID NO: 65067 - RNA, 18 nt, Artificial Sequence
  Description of Artificial Sequence: Synthetic oligonucleotide
ccccaccaccaaacccug

SEQ ID NO: 65068 - RNA, 18 nt, Artificial Sequence
  Description of Artificial Sequence: Synthetic oligonucleotide
uaaucccccaccaccaaa

SEQ ID NO: 65069 - RNA, 18 nt, Artificial Sequence
  Description of Artificial Sequence: Synthetic oligonucleotide
ccugguaaucccccacca

SEQ ID NO: 65070 - RNA, 18 nt, Artificial Sequence
  Description of Artificial Sequence: Synthetic oligonucleotide
ccaugccugguaaucccc

SEQ ID NO: 65071 - RNA, 18 nt, Artificial Sequence
  Description of Artificial Sequence: Synthetic oligonucleotide
ccuccccaugccugguaa

SEQ ID NO: 65072 - RNA, 18 nt, Artificial Sequence
  Description of Artificial Sequence: Synthetic oligonucleotide
gacccccuccccaugccu

SEQ ID NO: 65073 - RNA, 18 nt, Artificial Sequence
  Description of Artificial Sequence: Synthetic oligonucleotide
gccaagacccccucccca

SEQ ID NO: 65074 - RNA, 18 nt, Artificial Sequence
  Description of Artificial Sequence: Synthetic oligonucleotide
gggccaagacccccuccc

SEQ ID NO: 65075 - RNA, 18 nt, Artificial Sequence
  Description of Artificial Sequence: Synthetic oligonucleotide
ccaccucacaccagaggg

SEQ ID NO: 65076 - RNA, 18 nt, Artificial Sequence
  Description of Artificial Sequence: Synthetic oligonucleotide
uucugccaccucacacca

SEQ ID NO: 65077 - RNA, 18 nt, Artificial Sequence
  Description of Artificial Sequence: Synthetic oligonucleotide
cccaguucugccaccuca

SEQ ID NO: 65078 - RNA, 18 nt, Artificial Sequence
  Description of Artificial Sequence: Synthetic oligonucleotide
ccaagcccaguucugcca

SEQ ID NO: 65079 - RNA, 18 nt, Artificial Sequence
  Description of Artificial Sequence: Synthetic oligonucleotide
ccccuccccaugccuggu

SEQ ID NO: 65080 - RNA, 18 nt, Artificial Sequence
  Description of Artificial Sequence: Synthetic oligonucleotide
aagacccccuccccaugc

SEQ ID NO: 65081 - RNA, 18 nt, Artificial Sequence
  Description of Artificial Sequence: Synthetic oligonucleotide
gggccaagacccccuccc

SEQ ID NO: 65082 - RNA, 18 nt, Artificial Sequence
  Description of Artificial Sequence: Synthetic oligonucleotide
ccaccucacaccagaggg

SEQ ID NO: 65083 - RNA, 18 nt, Artificial Sequence
  Description of Artificial Sequence: Synthetic oligonucleotide
cugccaccucacaccaga

SEQ ID NO: 65084 - RNA, 18 nt, Artificial Sequence
  Description of Artificial Sequence: Synthetic oligonucleotide
caguucugccaccucaca

SEQ ID NO: 65085 - RNA, 18 nt, Artificial Sequence
  Description of Artificial Sequence: Synthetic oligonucleotide
aagcccaguucugccacc

SEQ ID NO: 65086 - RNA, 18 nt, Artificial Sequence
  Description of Artificial Sequence: Synthetic oligonucleotide
gacccaagcccaguucug

SEQ ID NO: 65087 - RNA, 18 nt, Artificial Sequence
  Description of Artificial Sequence: Synthetic oligonucleotide
gagaugacccaagcccag

SEQ ID NO: 65088 - RNA, 18 nt, Artificial Sequence
  Description of Artificial Sequence: Synthetic oligonucleotide
ugauagagaugacccaag

SEQ ID NO: 65089 - RNA, 18 nt, Artificial Sequence
  Description of Artificial Sequence: Synthetic oligonucleotide
cuaagugauagagaugac

SEQ ID NO: 65090 - RNA, 18 nt, Artificial Sequence
  Description of Artificial Sequence: Synthetic oligonucleotide
agcuacuaagugauagag

SEQ ID NO: 65091 - RNA, 18 nt, Artificial Sequence
  Description of Artificial Sequence: Synthetic oligonucleotide
cacauagcuacuaaguga

SEQ ID NO: 65092 - RNA, 18 nt, Artificial Sequence
  Description of Artificial Sequence: Synthetic oligonucleotide
aaggucacauagcuacua

SEQ ID NO: 65093 - RNA, 18 nt, Artificial Sequence
  Description of Artificial Sequence: Synthetic oligonucleotide
cuuacaaggucacauagc

SEQ ID NO: 65094 - RNA, 18 nt, Artificial Sequence
  Description of Artificial Sequence: Synthetic oligonucleotide
cccaucuuacaaggucac

SEQ ID NO: 65095 - RNA, 18 nt, Artificial Sequence
  Description of Artificial Sequence: Synthetic oligonucleotide
ugguucccaucuuacaag

SEQ ID NO: 65096 - RNA, 18 nt, Artificial Sequence
  Description of Artificial Sequence: Synthetic oligonucleotide
uaggcugguucccaucuu

SEQ ID NO: 65097 - RNA, 18 nt, Artificial Sequence
  Description of Artificial Sequence: Synthetic oligonucleotide
gguaguaggcugguuccc

SEQ ID NO: 65098 - RNA, 18 nt, Artificial Sequence
  Description of Artificial Sequence: Synthetic oligonucleotide
aaaaagguaguaggcugg

SEQ ID NO: 65099 - RNA, 18 nt, Artificial Sequence
  Description of Artificial Sequence: Synthetic oligonucleotide
gaaaaaaaaagguaguag

SEQ ID NO: 65100 - RNA, 18 nt, Artificial Sequence
  Description of Artificial Sequence: Synthetic oligonucleotide
gggaggaaaaaaaaaggu

SEQ ID NO: 65101 - RNA, 18 nt, Artificial Sequence
  Description of Artificial Sequence: Synthetic oligonucleotide
gaggagggaggaaaaaaa

SEQ ID NO: 65102 - RNA, 18 nt, Artificial Sequence
  Description of Artificial Sequence: Synthetic oligonucleotide
aggaggaggagggaggaa

SEQ ID NO: 65103 - RNA, 18 nt, Artificial Sequence
  Description of Artificial Sequence: Synthetic oligonucleotide
agaggaggaggaggaggg

SEQ ID NO: 65104 - RNA, 18 nt, Artificial Sequence
  Description of Artificial Sequence: Synthetic oligonucleotide
aguggagaggaggaggag

SEQ ID NO: 65105 - RNA, 18 nt, Artificial Sequence
  Description of Artificial Sequence: Synthetic oligonucleotide
aggacaguggagaggagg

SEQ ID NO: 65106 - RNA, 18 nt, Artificial Sequence
  Description of Artificial Sequence: Synthetic oligonucleotide
guaguaggacaguggaga

SEQ ID NO: 65107 - RNA, 18 nt, Artificial Sequence
  Description of Artificial Sequence: Synthetic oligonucleotide
ggacaguaguaggacagu

SEQ ID NO: 65108 - RNA, 18 nt, Artificial Sequence
  Description of Artificial Sequence: Synthetic oligonucleotide
gagcuggacaguaguagg

SEQ ID NO: 65109 - RNA, 18 nt, Artificial Sequence
  Description of Artificial Sequence: Synthetic oligonucleotide
cugcagagcuggacagua

SEQ ID NO: 65110 - RNA, 18 nt, Artificial Sequence
  Description of Artificial Sequence: Synthetic oligonucleotide
ggacgcugcagagcugga

SEQ ID NO: 65111 - RNA, 18 nt, Artificial Sequence
  Description of Artificial Sequence: Synthetic oligonucleotide
gggcuggacgcugcagag

SEQ ID NO: 65112 - RNA, 18 nt, Artificial Sequence
  Description of Artificial Sequence: Synthetic oligonucleotide
accaugggcuggacgcug

SEQ ID NO: 65113 - RNA, 18 nt, Artificial Sequence
  Description of Artificial Sequence: Synthetic oligonucleotide
cagcuaccaugggcugga

SEQ ID NO: 65114 - RNA, 18 nt, Artificial Sequence
  Description of Artificial Sequence: Synthetic oligonucleotide
cugagcagcuaccauggg

SEQ ID NO: 65115 - RNA, 18 nt, Artificial Sequence
  Description of Artificial Sequence: Synthetic oligonucleotide
acuuacugagcagcuacc

SEQ ID NO: 65116 - RNA, 18 nt, Artificial Sequence
  Description of Artificial Sequence: Synthetic oligonucleotide
gggccacuuacugagcag

SEQ ID NO: 65117 - RNA, 18 nt, Artificial Sequence
  Description of Artificial Sequence: Synthetic oligonucleotide
aacacaagagcaucuggg

SEQ ID NO: 65118 - RNA, 18 nt, Artificial Sequence
  Description of Artificial Sequence: Synthetic oligonucleotide
gaagcucccugaccuugu

SEQ ID NO: 65119 - RNA, 18 nt, Artificial Sequence
  Description of Artificial Sequence: Synthetic oligonucleotide
guucugaagcucccugac

SEQ ID NO: 65120 - RNA, 18 nt, Artificial Sequence
  Description of Artificial Sequence: Synthetic oligonucleotide
cccugguucugaagcucc

SEQ ID NO: 65121 - RNA, 18 nt, Artificial Sequence
  Description of Artificial Sequence: Synthetic oligonucleotide
cucugcccugguucugaa

SEQ ID NO: 65122 - RNA, 18 nt, Artificial Sequence
  Description of Artificial Sequence: Synthetic oligonucleotide
cacaucucugcccugguu

SEQ ID NO: 65123 - RNA, 18 nt, Artificial Sequence
  Description of Artificial Sequence: Synthetic oligonucleotide
aggcccacaucucugccc

SEQ ID NO: 65124 - RNA, 18 nt, Artificial Sequence
  Description of Artificial Sequence: Synthetic oligonucleotide
ccuccaggcccacaucuc

SEQ ID NO: 65125 - RNA, 18 nt, Artificial Sequence
  Description of Artificial Sequence: Synthetic oligonucleotide
caacaccuccaggcccac

SEQ ID NO: 65126 - RNA, 18 nt, Artificial Sequence
  Description of Artificial Sequence: Synthetic oligonucleotide
uuauccaacaccuccagg

SEQ ID NO: 65127 - RNA, 18 nt, Artificial Sequence
  Description of Artificial Sequence: Synthetic oligonucleotide
gggcauuauccaacaccu

SEQ ID NO: 65128 - RNA, 18 nt, Artificial Sequence
  Description of Artificial Sequence: Synthetic oligonucleotide
uagcagggcauuauccaa

SEQ ID NO: 65129 - RNA, 18 nt, Artificial Sequence
  Description of Artificial Sequence: Synthetic oligonucleotide
agagcuagcagggcauua

SEQ ID NO: 65130 - RNA, 18 nt, Artificial Sequence
  Description of Artificial Sequence: Synthetic oligonucleotide
cuugcagagcuagcaggg

SEQ ID NO: 65131 - RNA, 18 nt, Artificial Sequence
  Description of Artificial Sequence: Synthetic oligonucleotide
uaccugggcugcaguggg

SEQ ID NO: 65132 - RNA, 18 nt, Artificial Sequence
  Description of Artificial Sequence: Synthetic oligonucleotide
uaguaccugggcugcagu

SEQ ID NO: 65133 - RNA, 18 nt, Artificial Sequence
  Description of Artificial Sequence: Synthetic oligonucleotide
gccuguaguaccugggcu

SEQ ID NO: 65134 - RNA, 18 nt, Artificial Sequence
  Description of Artificial Sequence: Synthetic oligonucleotide
cgccggccuguaguaccu

SEQ ID NO: 65135 - RNA, 18 nt, Artificial Sequence
  Description of Artificial Sequence: Synthetic oligonucleotide
ugccacgccggccuguag

SEQ ID NO: 65136 - RNA, 18 nt, Artificial Sequence
  Description of Artificial Sequence: Synthetic oligonucleotide
ucaucugccacgccggcc

SEQ ID NO: 65137 - RNA, 18 nt, Artificial Sequence
  Description of Artificial Sequence: Synthetic oligonucleotide
ucaggucaucugccacgc

SEQ ID NO: 65138 - RNA, 18 nt, Artificial Sequence
  Description of Artificial Sequence: Synthetic oligonucleotide
uuuccucaggucaucugc

SEQ ID NO: 65139 - RNA, 18 nt, Artificial Sequence
  Description of Artificial Sequence: Synthetic oligonucleotide
ggcaguuuccucagguca

SEQ ID NO: 65140 - RNA, 18 nt, Artificial Sequence
  Description of Artificial Sequence: Synthetic oligonucleotide
ugaagggcaguuuccuca

SEQ ID NO: 65141 - RNA, 18 nt, Artificial Sequence
  Description of Artificial Sequence: Synthetic oligonucleotide
ggucaugaagggcaguuu

SEQ ID NO: 65142 - RNA, 18 nt, Artificial Sequence
  Description of Artificial Sequence: Synthetic oligonucleotide
gcacuggucaugaagggc

SEQ ID NO: 65143 - RNA, 18 nt, Artificial Sequence
  Description of Artificial Sequence: Synthetic oligonucleotide
ucacagcacuggucauga

SEQ ID NO: 65144 - RNA, 18 nt, Artificial Sequence
  Description of Artificial Sequence: Synthetic oligonucleotide
cuccaucacagcacuggu

SEQ ID NO: 65145 - RNA, 18 nt, Artificial Sequence
  Description of Artificial Sequence: Synthetic oligonucleotide
aacaccuccaucacagca

SEQ ID NO: 65146 - RNA, 18 nt, Artificial Sequence
  Description of Artificial Sequence: Synthetic oligonucleotide
cgccaaacaccuccauca

SEQ ID NO: 65147 - RNA, 18 nt, Artificial Sequence
  Description of Artificial Sequence: Synthetic oligonucleotide
agacacgccaaacaccuc

SEQ ID NO: 65148 - RNA, 18 nt, Artificial Sequence
  Description of Artificial Sequence: Synthetic oligonucleotide
cagccagacacgccaaac

SEQ ID NO: 65149 - RNA, 18 nt, Artificial Sequence
  Description of Artificial Sequence: Synthetic oligonucleotide
cgcggcagccagacacgc

SEQ ID NO: 65150 - RNA, 18 nt, Artificial Sequence
  Description of Artificial Sequence: Synthetic oligonucleotide
ggucacgcggcagccaga

SEQ ID NO: 65151 - RNA, 18 nt, Artificial Sequence
  Description of Artificial Sequence: Synthetic oligonucleotide
cagcgggucacgcggcag

SEQ ID NO: 65152 - RNA, 18 nt, Artificial Sequence
  Description of Artificial Sequence: Synthetic oligonucleotide
agccacagcgggucacgc

SEQ ID NO: 65153 - RNA, 18 nt, Artificial Sequence
  Description of Artificial Sequence: Synthetic oligonucleotide
uguguagccacagcgggu

SEQ ID NO: 65154 - RNA, 18 nt, Artificial Sequence
  Description of Artificial Sequence: Synthetic oligonucleotide
ucuccuguguagccacag

SEQ ID NO: 65155 - RNA, 18 nt, Artificial Sequence
  Description of Artificial Sequence: Synthetic oligonucleotide
cauccucuccuguguagc

SEQ ID NO: 65156 - RNA, 18 nt, Artificial Sequence
  Description of Artificial Sequence: Synthetic oligonucleotide
cacaccauccucuccugu

SEQ ID NO: 65157 - RNA, 18 nt, Artificial Sequence
  Description of Artificial Sequence: Synthetic oligonucleotide
ccccacaccacuucuuga

SEQ ID NO: 65158 - RNA, 18 nt, Artificial Sequence
  Description of Artificial Sequence: Synthetic oligonucleotide
acugcccccacaccacuu

SEQ ID NO: 65159 - RNA, 18 nt, Artificial Sequence
  Description of Artificial Sequence: Synthetic oligonucleotide
ccuguacugcccccacac

SEQ ID NO: 65160 - RNA, 18 nt, Artificial Sequence
  Description of Artificial Sequence: Synthetic oligonucleotide
ugugcccuguacugcccc

SEQ ID NO: 65161 - RNA, 18 nt, Artificial Sequence
  Description of Artificial Sequence: Synthetic oligonucleotide
cauccugugcccuguacu

SEQ ID NO: 65162 - RNA, 18 nt, Artificial Sequence
  Description of Artificial Sequence: Synthetic oligonucleotide
acaugcauccugugcccu

SEQ ID NO: 65163 - RNA, 18 nt, Artificial Sequence
  Description of Artificial Sequence: Synthetic oligonucleotide
cccucacaugcauccugu

SEQ ID NO: 65164 - RNA, 18 nt, Artificial Sequence
  Description of Artificial Sequence: Synthetic oligonucleotide
ccaaccccucacaugcau

SEQ ID NO: 65165 - RNA, 18 nt, Artificial Sequence
  Description of Artificial Sequence: Synthetic oligonucleotide
uacccccaaccccucaca

SEQ ID NO: 65166 - RNA, 18 nt, Artificial Sequence
  Description of Artificial Sequence: Synthetic oligonucleotide
ccacauacccccaacccc

SEQ ID NO: 65167 - RNA, 18 nt, Artificial Sequence
  Description of Artificial Sequence: Synthetic oligonucleotide
cuguaccacauaccccca

SEQ ID NO: 65168 - RNA, 18 nt, Artificial Sequence
  Description of Artificial Sequence: Synthetic oligonucleotide
gcucccuguaccacauac

SEQ ID NO: 65169 - RNA, 18 nt, Artificial Sequence
  Description of Artificial Sequence: Synthetic oligonucleotide
gggaagcucccuguacca

SEQ ID NO: 65170 - RNA, 18 nt, Artificial Sequence
  Description of Artificial Sequence: Synthetic oligonucleotide
cauccugugcccuguacu

SEQ ID NO: 65171 - RNA, 18 nt, Artificial Sequence
  Description of Artificial Sequence: Synthetic oligonucleotide
acaugcauccugugcccu

SEQ ID NO: 65172 - RNA, 18 nt, Artificial Sequence
  Description of Artificial Sequence: Synthetic oligonucleotide
cccucacaugcauccugu

SEQ ID NO: 65173 - RNA, 18 nt, Artificial Sequence
  Description of Artificial Sequence: Synthetic oligonucleotide
ccaaccccucacaugcau

SEQ ID NO: 65174 - RNA, 18 nt, Artificial Sequence
  Description of Artificial Sequence: Synthetic oligonucleotide
uacccccaaccccucaca

SEQ ID NO: 65175 - RNA, 18 nt, Artificial Sequence
  Description of Artificial Sequence: Synthetic oligonucleotide
ccacauacccccaacccc

SEQ ID NO: 65176 - RNA, 18 nt, Artificial Sequence
  Description of Artificial Sequence: Synthetic oligonucleotide
cuguaccacauaccccca

SEQ ID NO: 65177 - RNA, 18 nt, Artificial Sequence
  Description of Artificial Sequence: Synthetic oligonucleotide
gcucccuguaccacauac

SEQ ID NO: 65178 - RNA, 18 nt, Artificial Sequence
  Description of Artificial Sequence: Synthetic oligonucleotide
gggaagcucccuguacca

SEQ ID NO: 65179 - RNA, 18 nt, Artificial Sequence
  Description of Artificial Sequence: Synthetic oligonucleotide
cagaugggaagcucccug

SEQ ID NO: 65180 - RNA, 18 nt, Artificial Sequence
  Description of Artificial Sequence: Synthetic oligonucleotide
gagggcagaugggaagcu

SEQ ID NO: 65181 - RNA, 18 nt, Artificial Sequence
  Description of Artificial Sequence: Synthetic oligonucleotide
ccgcuaccggcaccgaga

SEQ ID NO: 65182 - RNA, 18 nt, Artificial Sequence
  Description of Artificial Sequence: Synthetic oligonucleotide
ugcccccgcuaccggcac

SEQ ID NO: 65183 - RNA, 18 nt, Artificial Sequence
  Description of Artificial Sequence: Synthetic oligonucleotide
ugaacugcccccgcuacc

SEQ ID NO: 65184 - RNA, 18 nt, Artificial Sequence
  Description of Artificial Sequence: Synthetic oligonucleotide
ccaggugaacugcccccg

SEQ ID NO: 65185 - RNA, 18 nt, Artificial Sequence
  Description of Artificial Sequence: Synthetic oligonucleotide
uguugccaggugaacugc

SEQ ID NO: 65186 - RNA, 18 nt, Artificial Sequence
  Description of Artificial Sequence: Synthetic oligonucleotide
auagcuguugccagguga

SEQ ID NO: 65187 - RNA, 18 nt, Artificial Sequence
  Description of Artificial Sequence: Synthetic oligonucleotide
ucagaauagcuguugcca

SEQ ID NO: 65188 - RNA, 18 nt, Artificial Sequence
  Description of Artificial Sequence: Synthetic oligonucleotide
guuuuucagaauagcugu

SEQ ID NO: 65189 - RNA, 18 nt, Artificial Sequence
  Description of Artificial Sequence: Synthetic oligonucleotide
ucuggguuuuucagaaua

SEQ ID NO: 65190 - RNA, 18 nt, Artificial Sequence
  Description of Artificial Sequence: Synthetic oligonucleotide
ucaccucuggguuuuuca

SEQ ID NO: 65191 - RNA, 18 nt, Artificial Sequence
  Description of Artificial Sequence: Synthetic oligonucleotide
cagcuucaccucuggguu

SEQ ID NO: 65192 - RNA, 18 nt, Artificial Sequence
  Description of Artificial Sequence: Synthetic oligonucleotide
ccugccagcuucaccucu

SEQ ID NO: 65193 - RNA, 18 nt, Artificial Sequence
  Description of Artificial Sequence: Synthetic oligonucleotide
ccagcccugccagcuuca

SEQ ID NO: 65194 - RNA, 18 nt, Artificial Sequence
  Description of Artificial Sequence: Synthetic oligonucleotide
ggcugccagcccugccag

SEQ ID NO: 65195 - RNA, 18 nt, Artificial Sequence
  Description of Artificial Sequence: Synthetic oligonucleotide
ucccuggcugccagcccu

SEQ ID NO: 65196 - RNA, 18 nt, Artificial Sequence
  Description of Artificial Sequence: Synthetic oligonucleotide
ggcugucccuggcugcca

SEQ ID NO: 65197 - RNA, 18 nt, Artificial Sequence
  Description of Artificial Sequence: Synthetic oligonucleotide
gcgcaggcugucccuggc

SEQ ID NO: 65198 - RNA, 18 nt, Artificial Sequence
  Description of Artificial Sequence: Synthetic oligonucleotide
uccaggcgcaggcugucc

SEQ ID NO: 65199 - RNA, 18 nt, Artificial Sequence
  Description of Artificial Sequence: Synthetic oligonucleotide
cugccuccaggcgcaggc

SEQ ID NO: 65200 - RNA, 18 nt, Artificial Sequence
  Description of Artificial Sequence: Synthetic oligonucleotide
gaggccugccuccaggcg

SEQ ID NO: 65201 - RNA, 18 nt, Artificial Sequence
  Description of Artificial Sequence: Synthetic oligonucleotide
aggcagaggccugccucc

SEQ ID NO: 65202 - RNA, 18 nt, Artificial Sequence
  Description of Artificial Sequence: Synthetic oligonucleotide
cauacaggcagaggccug

SEQ ID NO: 65203 - RNA, 18 nt, Artificial Sequence
  Description of Artificial Sequence: Synthetic oligonucleotide
auucccauacaggcagag

SEQ ID NO: 65204 - RNA, 18 nt, Artificial Sequence
  Description of Artificial Sequence: Synthetic oligonucleotide
augucauucccauacagg

SEQ ID NO: 65205 - RNA, 18 nt, Artificial Sequence
  Description of Artificial Sequence: Synthetic oligonucleotide
caucaaugucauucccau

SEQ ID NO: 65206 - RNA, 18 nt, Artificial Sequence
  Description of Artificial Sequence: Synthetic oligonucleotide
guguucaucaaugucauu

SEQ ID NO: 65207 - RNA, 18 nt, Artificial Sequence
  Description of Artificial Sequence: Synthetic oligonucleotide
guaguguguucaucaaug

SEQ ID NO: 65208 - RNA, 18 nt, Artificial Sequence
  Description of Artificial Sequence: Synthetic oligonucleotide
cagguguaguguguucau

SEQ ID NO: 65209 - RNA, 18 nt, Artificial Sequence
  Description of Artificial Sequence: Synthetic oligonucleotide
cuccacagguguagugug

SEQ ID NO: 65210 - RNA, 18 nt, Artificial Sequence
  Description of Artificial Sequence: Synthetic oligonucleotide
cugcccuccacaggugua

SEQ ID NO: 65211 - RNA, 18 nt, Artificial Sequence
  Description of Artificial Sequence: Synthetic oligonucleotide
ugaggcugcccuccacag

SEQ ID NO: 65212 - RNA, 18 nt, Artificial Sequence
  Description of Artificial Sequence: Synthetic oligonucleotide
ccaacugaggcugcccuc

SEQ ID NO: 65213 - RNA, 18 nt, Artificial Sequence
  Description of Artificial Sequence: Synthetic oligonucleotide
aguguccaacugaggcug

SEQ ID NO: 65214 - RNA, 18 nt, Artificial Sequence
  Description of Artificial Sequence: Synthetic oligonucleotide
uaaacagcgacagugucc

SEQ ID NO: 65215 - RNA, 18 nt, Artificial Sequence
  Description of Artificial Sequence: Synthetic oligonucleotide
guugguaaacagcgacag

SEQ ID NO: 65216 - RNA, 18 nt, Artificial Sequence
  Description of Artificial Sequence: Synthetic oligonucleotide
gccucguugguaaacagc

SEQ ID NO: 65217 - RNA, 18 nt, Artificial Sequence
  Description of Artificial Sequence: Synthetic oligonucleotide
cuccagccucguugguaa

SEQ ID NO: 65218 - RNA, 18 nt, Artificial Sequence
  Description of Artificial Sequence: Synthetic oligonucleotide
gaugccuccagccucguu

SEQ ID NO: 65219 - RNA, 18 nt, Artificial Sequence
  Description of Artificial Sequence: Synthetic oligonucleotide
ucuaagaugccuccagcc

SEQ ID NO: 65220 - RNA, 18 nt, Artificial Sequence
  Description of Artificial Sequence: Synthetic oligonucleotide
agucaucuaagaugccuc

SEQ ID NO: 65221 - RNA, 18 nt, Artificial Sequence
  Description of Artificial Sequence: Synthetic oligonucleotide
aaucaagucaucuaagau

SEQ ID NO: 65222 - RNA, 18 nt, Artificial Sequence
  Description of Artificial Sequence: Synthetic oligonucleotide
guuacaaucaagucaucu

SEQ ID NO: 65223 - RNA, 18 nt, Artificial Sequence
  Description of Artificial Sequence: Synthetic oligonucleotide
uauugguuacaaucaagu

SEQ ID NO: 65224 - RNA, 18 nt, Artificial Sequence
  Description of Artificial Sequence: Synthetic oligonucleotide
agaaguauugguuacaau

SEQ ID NO: 65225 - RNA, 18 nt, Artificial Sequence
  Description of Artificial Sequence: Synthetic oligonucleotide
cccucagaaguauugguu

SEQ ID NO: 65226 - RNA, 18 nt, Artificial Sequence
  Description of Artificial Sequence: Synthetic oligonucleotide
gguggcccucagaaguau

SEQ ID NO: 65227 - RNA, 18 nt, Artificial Sequence
  Description of Artificial Sequence: Synthetic oligonucleotide
auacagguggcccucaga

SEQ ID NO: 65228 - RNA, 18 nt, Artificial Sequence
  Description of Artificial Sequence: Synthetic oligonucleotide
accacauacagguggccc

SEQ ID NO: 65229 - RNA, 18 nt, Artificial Sequence
  Description of Artificial Sequence: Synthetic oligonucleotide
uggacaccacauacaggu

SEQ ID NO: 65230 - RNA, 18 nt, Artificial Sequence
  Description of Artificial Sequence: Synthetic oligonucleotide
agcguuggacaccacaua

SEQ ID NO: 65231 - RNA, 18 nt, Artificial Sequence
  Description of Artificial Sequence: Synthetic oligonucleotide
cagccagcguuggacacc

SEQ ID NO: 65232 - RNA, 18 nt, Artificial Sequence
  Description of Artificial Sequence: Synthetic oligonucleotide
cccagcagccagcguugg

SEQ ID NO: 65233 - RNA, 18 nt, Artificial Sequence
  Description of Artificial Sequence: Synthetic oligonucleotide
uuucucccagcagccagc

SEQ ID NO: 65234 - RNA, 18 nt, Artificial Sequence
  Description of Artificial Sequence: Synthetic oligonucleotide
aaaucuuucucccagcag

SEQ ID NO: 65235 - RNA, 18 nt, Artificial Sequence
  Description of Artificial Sequence: Synthetic oligonucleotide
gggccaaaucuuucuccc

SEQ ID NO: 65236 - RNA, 18 nt, Artificial Sequence
  Description of Artificial Sequence: Synthetic oligonucleotide
caugagggccaaaucuuu

SEQ ID NO: 65237 - RNA, 18 nt, Artificial Sequence
  Description of Artificial Sequence: Synthetic oligonucleotide
aggugucuagaacacaga

SEQ ID NO: 65238 - RNA, 18 nt, Artificial Sequence
  Description of Artificial Sequence: Synthetic oligonucleotide
agacaaggugucuagaac

SEQ ID NO: 65239 - RNA, 18 nt, Artificial Sequence
  Description of Artificial Sequence: Synthetic oligonucleotide
aaggaagacaaggugucu

SEQ ID NO: 65240 - RNA, 18 nt, Artificial Sequence
  Description of Artificial Sequence: Synthetic oligonucleotide
ugaacaaggaagacaagg

SEQ ID NO: 65241 - RNA, 18 nt, Artificial Sequence
  Description of Artificial Sequence: Synthetic oligonucleotide
cucuaugaacaaggaaga

SEQ ID NO: 65242 - RNA, 18 nt, Artificial Sequence
  Description of Artificial Sequence: Synthetic oligonucleotide
uacugcucuaugaacaag

SEQ ID NO: 65243 - RNA, 18 nt, Artificial Sequence
  Description of Artificial Sequence: Synthetic oligonucleotide
aaggauacugcucuauga

SEQ ID NO: 65244 - RNA, 18 nt, Artificial Sequence
  Description of Artificial Sequence: Synthetic oligonucleotide
acaacaaggauacugcuc

SEQ ID NO: 65245 - RNA, 18 nt, Artificial Sequence
  Description of Artificial Sequence: Synthetic oligonucleotide
cuuggacaacaaggauac

SEQ ID NO: 65246 - RNA, 18 nt, Artificial Sequence
  Description of Artificial Sequence: Synthetic oligonucleotide
ccugucuuggacaacaag

SEQ ID NO: 65247 - RNA, 18 nt, Artificial Sequence
  Description of Artificial Sequence: Synthetic oligonucleotide
ccaacccugucuuggaca

SEQ ID NO: 65248 - RNA, 18 nt, Artificial Sequence
  Description of Artificial Sequence: Synthetic oligonucleotide
cugugccaacccugucuu

SEQ ID NO: 65249 - RNA, 18 nt, Artificial Sequence
  Description of Artificial Sequence: Synthetic oligonucleotide
cuugucugugccaacccu

SEQ ID NO: 65250 - RNA, 18 nt, Artificial Sequence
  Description of Artificial Sequence: Synthetic oligonucleotide
ggucccuugucugugcca

SEQ ID NO: 65251 - RNA, 18 nt, Artificial Sequence
  Description of Artificial Sequence: Synthetic oligonucleotide
uuccaggucccuugucug

SEQ ID NO: 65252 - RNA, 18 nt, Artificial Sequence
  Description of Artificial Sequence: Synthetic oligonucleotide
ccauuuuccaggucccuu

SEQ ID NO: 65253 - RNA, 18 nt, Artificial Sequence
  Description of Artificial Sequence: Synthetic oligonucleotide
aagagccauuuuccaggu

SEQ ID NO: 65254 - RNA, 18 nt, Artificial Sequence
  Description of Artificial Sequence: Synthetic oligonucleotide
acugaaagagccauuuuc

SEQ ID NO: 65255 - RNA, 18 nt, Artificial Sequence
  Description of Artificial Sequence: Synthetic oligonucleotide
cauucacugaaagagcca

SEQ ID NO: 65256 - RNA, 18 nt, Artificial Sequence
  Description of Artificial Sequence: Synthetic oligonucleotide
cuguucauucacugaaag

SEQ ID NO: 65257 - RNA, 18 nt, Artificial Sequence
  Description of Artificial Sequence: Synthetic oligonucleotide
cauagcuguucauucacu

SEQ ID NO: 65258 - RNA, 18 nt, Artificial Sequence
  Description of Artificial Sequence: Synthetic oligonucleotide
agucucauagcuguucau

SEQ ID NO: 65259 - RNA, 18 nt, Artificial Sequence
  Description of Artificial Sequence: Synthetic oligonucleotide
ucuugagucucauagcug

SEQ ID NO: 65260 - RNA, 18 nt, Artificial Sequence
  Description of Artificial Sequence: Synthetic oligonucleotide
ccugcucuugagucucau

SEQ ID NO: 65261 - RNA, 18 nt, Artificial Sequence
  Description of Artificial Sequence: Synthetic oligonucleotide
gagggccugcucuugagu

SEQ ID NO: 65262 - RNA, 18 nt, Artificial Sequence
  Description of Artificial Sequence: Synthetic oligonucleotide
ccagagagggccugcucu

SEQ ID NO: 65263 - RNA, 18 nt, Artificial Sequence
  Description of Artificial Sequence: Synthetic oligonucleotide
gugcuccagagagggccu

SEQ ID NO: 65264 - RNA, 18 nt, Artificial Sequence
  Description of Artificial Sequence: Synthetic oligonucleotide
cuggcgugcuccagagag

SEQ ID NO: 65265 - RNA, 18 nt, Artificial Sequence
  Description of Artificial Sequence: Synthetic oligonucleotide
aaacccuggcgugcucca

SEQ ID NO: 65266 - RNA, 18 nt, Artificial Sequence
  Description of Artificial Sequence: Synthetic oligonucleotide
ccaccaaacccuggcgug

SEQ ID NO: 65267 - RNA, 18 nt, Artificial Sequence
  Description of Artificial Sequence: Synthetic oligonucleotide
ccccaccaccaaacccug

SEQ ID NO: 65268 - RNA, 18 nt, Artificial Sequence
  Description of Artificial Sequence: Synthetic oligonucleotide
uaaucccccaccaccaaa

SEQ ID NO: 65269 - RNA, 18 nt, Artificial Sequence
  Description of Artificial Sequence: Synthetic oligonucleotide
ccugguaaucccccacca

SEQ ID NO: 65270 - RNA, 18 nt, Artificial Sequence
  Description of Artificial Sequence: Synthetic oligonucleotide
ccaugccugguaaucccc

SEQ ID NO: 65271 - RNA, 18 nt, Artificial Sequence
  Description of Artificial Sequence: Synthetic oligonucleotide
ccuccccaugccugguaa

SEQ ID NO: 65272 - RNA, 18 nt, Artificial Sequence
  Description of Artificial Sequence: Synthetic oligonucleotide
gacccccuccccaugccu

SEQ ID NO: 65273 - RNA, 18 nt, Artificial Sequence
  Description of Artificial Sequence: Synthetic oligonucleotide
gccaagacccccucccca

SEQ ID NO: 65274 - RNA, 18 nt, Artificial Sequence
  Description of Artificial Sequence: Synthetic oligonucleotide
gggccaagacccccuccc

SEQ ID NO: 65275 - RNA, 18 nt, Artificial Sequence
  Description of Artificial Sequence: Synthetic oligonucleotide
ccaccucacaccagaggg

SEQ ID NO: 65276 - RNA, 18 nt, Artificial Sequence
  Description of Artificial Sequence: Synthetic oligonucleotide
uucugccaccucacacca

SEQ ID NO: 65277 - RNA, 18 nt, Artificial Sequence
  Description of Artificial Sequence: Synthetic oligonucleotide
cccaguucugccaccuca

SEQ ID NO: 65278 - RNA, 18 nt, Artificial Sequence
  Description of Artificial Sequence: Synthetic oligonucleotide
ccaagcccaguucugcca

SEQ ID NO: 65279 - RNA, 18 nt, Artificial Sequence
  Description of Artificial Sequence: Synthetic oligonucleotide
ccccuccccaugccuggu

SEQ ID NO: 65280 - RNA, 18 nt, Artificial Sequence
  Description of Artificial Sequence: Synthetic oligonucleotide
aagacccccuccccaugc

SEQ ID NO: 65281 - RNA, 18 nt, Artificial Sequence
  Description of Artificial Sequence: Synthetic oligonucleotide
gggccaagacccccuccc

SEQ ID NO: 65282 - RNA, 18 nt, Artificial Sequence
  Description of Artificial Sequence: Synthetic oligonucleotide
ccaccucacaccagaggg

SEQ ID NO: 65283 - RNA, 18 nt, Artificial Sequence
  Description of Artificial Sequence: Synthetic oligonucleotide
cugccaccucacaccaga

SEQ ID NO: 65284 - RNA, 18 nt, Artificial Sequence
  Description of Artificial Sequence: Synthetic oligonucleotide
caguucugccaccucaca

SEQ ID NO: 65285 - RNA, 18 nt, Artificial Sequence
  Description of Artificial Sequence: Synthetic oligonucleotide
aagcccaguucugccacc

SEQ ID NO: 65286 - RNA, 18 nt, Artificial Sequence
  Description of Artificial Sequence: Synthetic oligonucleotide
gacccaagcccaguucug

SEQ ID NO: 65287 - RNA, 18 nt, Artificial Sequence
  Description of Artificial Sequence: Synthetic oligonucleotide
gagaugacccaagcccag

SEQ ID NO: 65288 - RNA, 18 nt, Artificial Sequence
  Description of Artificial Sequence: Synthetic oligonucleotide
ugauagagaugacccaag

SEQ ID NO: 65289 - RNA, 18 nt, Artificial Sequence
  Description of Artificial Sequence: Synthetic oligonucleotide
cuaagugauagagaugac

SEQ ID NO: 65290 - RNA, 18 nt, Artificial Sequence
  Description of Artificial Sequence: Synthetic oligonucleotide
agcuacuaagugauagag

SEQ ID NO: 65291 - RNA, 18 nt, Artificial Sequence
  Description of Artificial Sequence: Synthetic oligonucleotide
cacauagcuacuaaguga

SEQ ID NO: 65292 - RNA, 18 nt, Artificial Sequence
  Description of Artificial Sequence: Synthetic oligonucleotide
aaggucacauagcuacua

SEQ ID NO: 65293 - RNA, 18 nt, Artificial Sequence
  Description of Artificial Sequence: Synthetic oligonucleotide
cuuacaaggucacauagc

SEQ ID NO: 65294 - RNA, 18 nt, Artificial Sequence
  Description of Artificial Sequence: Synthetic oligonucleotide
cccaucuuacaaggucac

SEQ ID NO: 65295 - RNA, 18 nt, Artificial Sequence
  Description of Artificial Sequence: Synthetic oligonucleotide
ugguucccaucuuacaag

SEQ ID NO: 65296 - RNA, 18 nt, Artificial Sequence
  Description of Artificial Sequence: Synthetic oligonucleotide
uaggcugguucccaucuu

SEQ ID NO: 65297 - RNA, 18 nt, Artificial Sequence
  Description of Artificial Sequence: Synthetic oligonucleotide
gguaguaggcugguuccc

SEQ ID NO: 65298 - RNA, 18 nt, Artificial Sequence
  Description of Artificial Sequence: Synthetic oligonucleotide
aaaaagguaguaggcugg

SEQ ID NO: 65299 - RNA, 18 nt, Artificial Sequence
  Description of Artificial Sequence: Synthetic oligonucleotide
gaaaaaaaaagguaguag

SEQ ID NO: 65300 - RNA, 18 nt, Artificial Sequence
  Description of Artificial Sequence: Synthetic oligonucleotide
gggaggaaaaaaaaaggu

SEQ ID NO: 65301 - RNA, 18 nt, Artificial Sequence
  Description of Artificial Sequence: Synthetic oligonucleotide
gaggagggaggaaaaaaa

SEQ ID NO: 65302 - RNA, 18 nt, Artificial Sequence
  Description of Artificial Sequence: Synthetic oligonucleotide
aggaggaggagggaggaa

SEQ ID NO: 65303 - RNA, 18 nt, Artificial Sequence
  Description of Artificial Sequence: Synthetic oligonucleotide
agaggaggaggaggaggg

SEQ ID NO: 65304 - RNA, 18 nt, Artificial Sequence
  Description of Artificial Sequence: Synthetic oligonucleotide
aguggagaggaggaggag

SEQ ID NO: 65305 - RNA, 18 nt, Artificial Sequence
  Description of Artificial Sequence: Synthetic oligonucleotide
aggacaguggagaggagg

SEQ ID NO: 65306 - RNA, 18 nt, Artificial Sequence
  Description of Artificial Sequence: Synthetic oligonucleotide
guaguaggacaguggaga

SEQ ID NO: 65307 - RNA, 18 nt, Artificial Sequence
  Description of Artificial Sequence: Synthetic oligonucleotide
ggacaguaguaggacagu

SEQ ID NO: 65308 - RNA, 18 nt, Artificial Sequence
  Description of Artificial Sequence: Synthetic oligonucleotide
gagcuggacaguaguagg

SEQ ID NO: 65309 - RNA, 18 nt, Artificial Sequence
  Description of Artificial Sequence: Synthetic oligonucleotide
cugcagagcuggacagua

SEQ ID NO: 65310 - RNA, 18 nt, Artificial Sequence
  Description of Artificial Sequence: Synthetic oligonucleotide
ggacgcugcagagcugga

SEQ ID NO: 65311 - RNA, 18 nt, Artificial Sequence
  Description of Artificial Sequence: Synthetic oligonucleotide
gggcuggacgcugcagag

SEQ ID NO: 65312 - RNA, 18 nt, Artificial Sequence
  Description of Artificial Sequence: Synthetic oligonucleotide
accaugggcuggacgcug

SEQ ID NO: 65313 - RNA, 18 nt, Artificial Sequence
  Description of Artificial Sequence: Synthetic oligonucleotide
cagcuaccaugggcugga

SEQ ID NO: 65314 - RNA, 18 nt, Artificial Sequence
  Description of Artificial Sequence: Synthetic oligonucleotide
cugagcagcuaccauggg

SEQ ID NO: 65315 - RNA, 18 nt, Artificial Sequence
  Description of Artificial Sequence: Synthetic oligonucleotide
acuuacugagcagcuacc

SEQ ID NO: 65316 - RNA, 18 nt, Artificial Sequence
  Description of Artificial Sequence: Synthetic oligonucleotide
gggccacuuacugagcag

SEQ ID NO: 65317 - RNA, 18 nt, Artificial Sequence
  Description of Artificial Sequence: Synthetic oligonucleotide
aacacaagagcaucuggg

SEQ ID NO: 65318 - RNA, 18 nt, Artificial Sequence
  Description of Artificial Sequence: Synthetic oligonucleotide
gaagcucccugaccuugu

SEQ ID NO: 65319 - RNA, 18 nt, Artificial Sequence
  Description of Artificial Sequence: Synthetic oligonucleotide
guucugaagcucccugac

SEQ ID NO: 65320 - RNA, 18 nt, Artificial Sequence
  Description of Artificial Sequence: Synthetic oligonucleotide
cccugguucugaagcucc

SEQ ID NO: 65321 - RNA, 18 nt, Artificial Sequence
  Description of Artificial Sequence: Synthetic oligonucleotide
cucugcccugguucugaa

SEQ ID NO: 65322 - RNA, 18 nt, Artificial Sequence
  Description of Artificial Sequence: Synthetic oligonucleotide
cacaucucugcccugguu

SEQ ID NO: 65323 - RNA, 18 nt, Artificial Sequence
  Description of Artificial Sequence: Synthetic oligonucleotide
aggcccacaucucugccc

SEQ ID NO: 65324 - RNA, 18 nt, Artificial Sequence
  Description of Artificial Sequence: Synthetic oligonucleotide
ccuccaggcccacaucuc

SEQ ID NO: 65325 - RNA, 18 nt, Artificial Sequence
  Description of Artificial Sequence: Synthetic oligonucleotide
caacaccuccaggcccac

SEQ ID NO: 65326 - RNA, 18 nt, Artificial Sequence
  Description of Artificial Sequence: Synthetic oligonucleotide
uuauccaacaccuccagg

SEQ ID NO: 65327 - RNA, 18 nt, Artificial Sequence
  Description of Artificial Sequence: Synthetic oligonucleotide
gggcauuauccaacaccu

SEQ ID NO: 65328 - RNA, 18 nt, Artificial Sequence
  Description of Artificial Sequence: Synthetic oligonucleotide
uagcagggcauuauccaa

SEQ ID NO: 65329 - RNA, 18 nt, Artificial Sequence
  Description of Artificial Sequence: Synthetic oligonucleotide
agagcuagcagggcauua

SEQ ID NO: 65330 - RNA, 18 nt, Artificial Sequence
  Description of Artificial Sequence: Synthetic oligonucleotide
cuugcagagcuagcaggg

SEQ ID NO: 65331 - RNA, 18 nt, Artificial Sequence
  Description of Artificial Sequence: Synthetic oligonucleotide
uaccugggcugcaguggg

SEQ ID NO: 65332 - RNA, 18 nt, Artificial Sequence
  Description of Artificial Sequence: Synthetic oligonucleotide
uaguaccugggcugcagu

SEQ ID NO: 65333 - RNA, 18 nt, Artificial Sequence
  Description of Artificial Sequence: Synthetic oligonucleotide
gccuguaguaccugggcu

SEQ ID NO: 65334 - RNA, 18 nt, Artificial Sequence
  Description of Artificial Sequence: Synthetic oligonucleotide
cgccggccuguaguaccu

SEQ ID NO: 65335 - RNA, 18 nt, Artificial Sequence
  Description of Artificial Sequence: Synthetic oligonucleotide
ugccacgccggccuguag

SEQ ID NO: 65336 - RNA, 18 nt, Artificial Sequence
  Description of Artificial Sequence: Synthetic oligonucleotide
ucaucugccacgccggcc

SEQ ID NO: 65337 - RNA, 18 nt, Artificial Sequence
  Description of Artificial Sequence: Synthetic oligonucleotide
ucaggucaucugccacgc

SEQ ID NO: 65338 - RNA, 18 nt, Artificial Sequence
  Description of Artificial Sequence: Synthetic oligonucleotide
uuuccucaggucaucugc

SEQ ID NO: 65339 - RNA, 18 nt, Artificial Sequence
  Description of Artificial Sequence: Synthetic oligonucleotide
ggcaguuuccucagguca

SEQ ID NO: 65340 - RNA, 18 nt, Artificial Sequence
  Description of Artificial Sequence: Synthetic oligonucleotide
ugaagggcaguuuccuca

SEQ ID NO: 65341 - RNA, 18 nt, Artificial Sequence
  Description of Artificial Sequence: Synthetic oligonucleotide
ggucaugaagggcaguuu

SEQ ID NO: 65342 - RNA, 18 nt, Artificial Sequence
  Description of Artificial Sequence: Synthetic oligonucleotide
gcacuggucaugaagggc

SEQ ID NO: 65343 - RNA, 18 nt, Artificial Sequence
  Description of Artificial Sequence: Synthetic oligonucleotide
ucacagcacuggucauga

SEQ ID NO: 65344 - RNA, 18 nt, Artificial Sequence
  Description of Artificial Sequence: Synthetic oligonucleotide
cuccaucacagcacuggu

SEQ ID NO: 65345 - RNA, 18 nt, Artificial Sequence
  Description of Artificial Sequence: Synthetic oligonucleotide
aacaccuccaucacagca

SEQ ID NO: 65346 - RNA, 18 nt, Artificial Sequence
  Description of Artificial Sequence: Synthetic oligonucleotide
cgccaaacaccuccauca

SEQ ID NO: 65347 - RNA, 18 nt, Artificial Sequence
  Description of Artificial Sequence: Synthetic oligonucleotide
agacacgccaaacaccuc

SEQ ID NO: 65348 - RNA, 18 nt, Artificial Sequence
  Description of Artificial Sequence: Synthetic oligonucleotide
cagccagacacgccaaac

SEQ ID NO: 65349 - RNA, 18 nt, Artificial Sequence
  Description of Artificial Sequence: Synthetic oligonucleotide
cgcggcagccagacacgc

SEQ ID NO: 65350 - RNA, 18 nt, Artificial Sequence
  Description of Artificial Sequence: Synthetic oligonucleotide
ggucacgcggcagccaga

SEQ ID NO: 65351 - RNA, 18 nt, Artificial Sequence
  Description of Artificial Sequence: Synthetic oligonucleotide
cagcgggucacgcggcag

SEQ ID NO: 65352 - RNA, 18 nt, Artificial Sequence
  Description of Artificial Sequence: Synthetic oligonucleotide
agccacagcgggucacgc

SEQ ID NO: 65353 - RNA, 18 nt, Artificial Sequence
  Description of Artificial Sequence: Synthetic oligonucleotide
uguguagccacagcgggu

SEQ ID NO: 65354 - RNA, 18 nt, Artificial Sequence
  Description of Artificial Sequence: Synthetic oligonucleotide
ucuccuguguagccacag

SEQ ID NO: 65355 - RNA, 18 nt, Artificial Sequence
  Description of Artificial Sequence: Synthetic oligonucleotide
cauccucuccuguguagc

SEQ ID NO: 65356 - RNA, 18 nt, Artificial Sequence
  Description of Artificial Sequence: Synthetic oligonucleotide
cacaccauccucuccugu

SEQ ID NO: 65357 - RNA, 18 nt, Artificial Sequence
  Description of Artificial Sequence: Synthetic oligonucleotide
ccccacaccacuucuuga

SEQ ID NO: 65358 - RNA, 18 nt, Artificial Sequence
  Description of Artificial Sequence: Synthetic oligonucleotide
acugcccccacaccacuu

SEQ ID NO: 65359 - RNA, 18 nt, Artificial Sequence
  Description of Artificial Sequence: Synthetic oligonucleotide
ccuguacugcccccacac

SEQ ID NO: 65360 - RNA, 18 nt, Artificial Sequence
  Description of Artificial Sequence: Synthetic oligonucleotide
ugugcccuguacugcccc

SEQ ID NO: 65361 - RNA, 18 nt, Artificial Sequence
  Description of Artificial Sequence: Synthetic oligonucleotide
cauccugugcccuguacu

SEQ ID NO: 65362 - RNA, 18 nt, Artificial Sequence
  Description of Artificial Sequence: Synthetic oligonucleotide
acaugcauccugugcccu

SEQ ID NO: 65363 - RNA, 18 nt, Artificial Sequence
  Description of Artificial Sequence: Synthetic oligonucleotide
cccucacaugcauccugu

SEQ ID NO: 65364 - RNA, 18 nt, Artificial Sequence
  Description of Artificial Sequence: Synthetic oligonucleotide
ccaaccccucacaugcau

SEQ ID NO: 65365 - RNA, 18 nt, Artificial Sequence
  Description of Artificial Sequence: Synthetic oligonucleotide
uacccccaaccccucaca

SEQ ID NO: 65366 - RNA, 18 nt, Artificial Sequence
  Description of Artificial Sequence: Synthetic oligonucleotide
ccacauacccccaacccc

SEQ ID NO: 65367 - RNA, 18 nt, Artificial Sequence
  Description of Artificial Sequence: Synthetic oligonucleotide
cuguaccacauaccccca

SEQ ID NO: 65368 - RNA, 18 nt, Artificial Sequence
  Description of Artificial Sequence: Synthetic oligonucleotide
gcucccuguaccacauac

SEQ ID NO: 65369 - RNA, 18 nt, Artificial Sequence
  Description of Artificial Sequence: Synthetic oligonucleotide
gggaagcucccuguacca

SEQ ID NO: 65370 - RNA, 18 nt, Artificial Sequence
  Description of Artificial Sequence: Synthetic oligonucleotide
cauccugugcccuguacu

SEQ ID NO: 65371 - RNA, 18 nt, Artificial Sequence
  Description of Artificial Sequence: Synthetic oligonucleotide
acaugcauccugugcccu

SEQ ID NO: 65372 - RNA, 18 nt, Artificial Sequence
  Description of Artificial Sequence: Synthetic oligonucleotide
cccucacaugcauccugu

SEQ ID NO: 65373 - RNA, 18 nt, Artificial Sequence
  Description of Artificial Sequence: Synthetic oligonucleotide
ccaaccccucacaugcau

SEQ ID NO: 65374 - RNA, 18 nt, Artificial Sequence
  Description of Artificial Sequence: Synthetic oligonucleotide
uacccccaaccccucaca

SEQ ID NO: 65375 - RNA, 18 nt, Artificial Sequence
  Description of Artificial Sequence: Synthetic oligonucleotide
ccacauacccccaacccc

SEQ ID NO: 65376 - RNA, 18 nt, Artificial Sequence
  Description of Artificial Sequence: Synthetic oligonucleotide
cuguaccacauaccccca

SEQ ID NO: 65377 - RNA, 18 nt, Artificial Sequence
  Description of Artificial Sequence: Synthetic oligonucleotide
gcucccuguaccacauac

SEQ ID NO: 65378 - RNA, 18 nt, Artificial Sequence
  Description of Artificial Sequence: Synthetic oligonucleotide
gggaagcucccuguacca

SEQ ID NO: 65379 - RNA, 18 nt, Artificial Sequence
  Description of Artificial Sequence: Synthetic oligonucleotide
cagaugggaagcucccug

SEQ ID NO: 65380 - RNA, 18 nt, Artificial Sequence
  Description of Artificial Sequence: Synthetic oligonucleotide
gagggcagaugggaagcu

SEQ ID NO: 65381 - RNA, 18 nt, Artificial Sequence
  Description of Artificial Sequence: Synthetic oligonucleotide
ccgcuaccggcaccgaga

SEQ ID NO: 65382 - RNA, 18 nt, Artificial Sequence
  Description of Artificial Sequence: Synthetic oligonucleotide
ugcccccgcuaccggcac

SEQ ID NO: 65383 - RNA, 18 nt, Artificial Sequence
  Description of Artificial Sequence: Synthetic oligonucleotide
ugaacugcccccgcuacc

SEQ ID NO: 65384 - RNA, 18 nt, Artificial Sequence
  Description of Artificial Sequence: Synthetic oligonucleotide
ccaggugaacugcccccg

SEQ ID NO: 65385 - RNA, 18 nt, Artificial Sequence
  Description of Artificial Sequence: Synthetic oligonucleotide
uguugccaggugaacugc

SEQ ID NO: 65386 - RNA, 18 nt, Artificial Sequence
  Description of Artificial Sequence: Synthetic oligonucleotide
auagcuguugccagguga

SEQ ID NO: 65387 - RNA, 18 nt, Artificial Sequence
  Description of Artificial Sequence: Synthetic oligonucleotide
ucagaauagcuguugcca

SEQ ID NO: 65388 - RNA, 18 nt, Artificial Sequence
  Description of Artificial Sequence: Synthetic oligonucleotide
guuuuucagaauagcugu

SEQ ID NO: 65389 - RNA, 18 nt, Artificial Sequence
  Description of Artificial Sequence: Synthetic oligonucleotide
ucuggguuuuucagaaua

SEQ ID NO: 65390 - RNA, 18 nt, Artificial Sequence
  Description of Artificial Sequence: Synthetic oligonucleotide
ucaccucuggguuuuuca

SEQ ID NO: 65391 - RNA, 18 nt, Artificial Sequence
  Description of Artificial Sequence: Synthetic oligonucleotide
cagcuucaccucuggguu

SEQ ID NO: 65392 - RNA, 18 nt, Artificial Sequence
  Description of Artificial Sequence: Synthetic oligonucleotide
ccugccagcuucaccucu

SEQ ID NO: 65393 - RNA, 18 nt, Artificial Sequence
  Description of Artificial Sequence: Synthetic oligonucleotide
ccagcccugccagcuuca

SEQ ID NO: 65394 - RNA, 18 nt, Artificial Sequence
  Description of Artificial Sequence: Synthetic oligonucleotide
ggcugccagcccugccag

SEQ ID NO: 65395 - RNA, 18 nt, Artificial Sequence
  Description of Artificial Sequence: Synthetic oligonucleotide
ucccuggcugccagcccu

SEQ ID NO: 65396 - RNA, 18 nt, Artificial Sequence
  Description of Artificial Sequence: Synthetic oligonucleotide
ggcugucccuggcugcca

SEQ ID NO: 65397 - RNA, 18 nt, Artificial Sequence
  Description of Artificial Sequence: Synthetic oligonucleotide
gcgcaggcugucccuggc

SEQ ID NO: 65398 - RNA, 18 nt, Artificial Sequence
  Description of Artificial Sequence: Synthetic oligonucleotide
uccaggcgcaggcugucc

SEQ ID NO: 65399 - RNA, 18 nt, Artificial Sequence
  Description of Artificial Sequence: Synthetic oligonucleotide
cugccuccaggcgcaggc

SEQ ID NO: 65400 - RNA, 18 nt, Artificial Sequence
  Description of Artificial Sequence: Synthetic oligonucleotide
gaggccugccuccaggcg

SEQ ID NO: 65401 - RNA, 18 nt, Artificial Sequence
  Description of Artificial Sequence: Synthetic oligonucleotide
aggcagaggccugccucc

SEQ ID NO: 65402 - RNA, 18 nt, Artificial Sequence
  Description of Artificial Sequence: Synthetic oligonucleotide
cauacaggcagaggccug

SEQ ID NO: 65403 - RNA, 18 nt, Artificial Sequence
  Description of Artificial Sequence: Synthetic oligonucleotide
auucccauacaggcagag

SEQ ID NO: 65404 - RNA, 18 nt, Artificial Sequence
  Description of Artificial Sequence: Synthetic oligonucleotide
augucauucccauacagg

SEQ ID NO: 65405 - RNA, 18 nt, Artificial Sequence
  Description of Artificial Sequence: Synthetic oligonucleotide
caucaaugucauucccau

SEQ ID NO: 65406 - RNA, 18 nt, Artificial Sequence
  Description of Artificial Sequence: Synthetic oligonucleotide
guguucaucaaugucauu

SEQ ID NO: 65407 - RNA, 18 nt, Artificial Sequence
  Description of Artificial Sequence: Synthetic oligonucleotide
guaguguguucaucaaug

SEQ ID NO: 65408 - RNA, 18 nt, Artificial Sequence
  Description of Artificial Sequence: Synthetic oligonucleotide
cagguguaguguguucau

SEQ ID NO: 65409 - RNA, 18 nt, Artificial Sequence
  Description of Artificial Sequence: Synthetic oligonucleotide
cuccacagguguagugug

SEQ ID NO: 65410 - RNA, 18 nt, Artificial Sequence
  Description of Artificial Sequence: Synthetic oligonucleotide
cugcccuccacaggugua

SEQ ID NO: 65411 - RNA, 18 nt, Artificial Sequence
  Description of Artificial Sequence: Synthetic oligonucleotide
ugaggcugcccuccacag

SEQ ID NO: 65412 - RNA, 18 nt, Artificial Sequence
  Description of Artificial Sequence: Synthetic oligonucleotide
ccaacugaggcugcccuc

SEQ ID NO: 65413 - RNA, 18 nt, Artificial Sequence
  Description of Artificial Sequence: Synthetic oligonucleotide
aguguccaacugaggcug

SEQ ID NO: 65414 - RNA, 18 nt, Artificial Sequence
  Description of Artificial Sequence: Synthetic oligonucleotide
auggcccgggagccgcag

SEQ ID NO: 65415 - RNA, 18 nt, Artificial Sequence
  Description of Artificial Sequence: Synthetic oligonucleotide
caaagauggcccgggagc

SEQ ID NO: 65416 - RNA, 18 nt, Artificial Sequence
  Description of Artificial Sequence: Synthetic oligonucleotide
ccgcacaaagauggcccg

SEQ ID NO: 65417 - RNA, 18 nt, Artificial Sequence
  Description of Artificial Sequence: Synthetic oligonucleotide
cggccccgcacaaagaug

SEQ ID NO: 65418 - RNA, 18 nt, Artificial Sequence
  Description of Artificial Sequence: Synthetic oligonucleotide
aagcgcggccccgcacaa

SEQ ID NO: 65419 - RNA, 18 nt, Artificial Sequence
  Description of Artificial Sequence: Synthetic oligonucleotide
ggcggaagcgcggccccg

SEQ ID NO: 65420 - RNA, 18 nt, Artificial Sequence
  Description of Artificial Sequence: Synthetic oligonucleotide
gcgcuggcggaagcgcgg

SEQ ID NO: 65421 - RNA, 18 nt, Artificial Sequence
  Description of Artificial Sequence: Synthetic oligonucleotide
cugcggcgcuggcggaag

SEQ ID NO: 65422 - RNA, 18 nt, Artificial Sequence
  Description of Artificial Sequence: Synthetic oligonucleotide
ccccgcugcggcgcuggc

SEQ ID NO: 65423 - RNA, 18 nt, Artificial Sequence
  Description of Artificial Sequence: Synthetic oligonucleotide
agauuccccgcugcggcg

SEQ ID NO: 65424 - RNA, 18 nt, Artificial Sequence
  Description of Artificial Sequence: Synthetic oligonucleotide
acugcagauuccccgcug

SEQ ID NO: 65425 - RNA, 18 nt, Artificial Sequence
  Description of Artificial Sequence: Synthetic oligonucleotide
gaccuacugcagauuccc

SEQ ID NO: 65426 - RNA, 18 nt, Artificial Sequence
  Description of Artificial Sequence: Synthetic oligonucleotide
cggcagaccuacugcaga

SEQ ID NO: 65427 - RNA, 18 nt, Artificial Sequence
  Description of Artificial Sequence: Synthetic oligonucleotide
aucgccggcagaccuacu

SEQ ID NO: 65428 - RNA, 18 nt, Artificial Sequence
  Description of Artificial Sequence: Synthetic oligonucleotide
acuccaucgccggcagac

SEQ ID NO: 65429 - RNA, 18 nt, Artificial Sequence
  Description of Artificial Sequence: Synthetic oligonucleotide
ccaccacuccaucgccgg

SEQ ID NO: 65430 - RNA, 18 nt, Artificial Sequence
  Description of Artificial Sequence: Synthetic oligonucleotide
cuagcccaccacuccauc

SEQ ID NO: 65431 - RNA, 18 nt, Artificial Sequence
  Description of Artificial Sequence: Synthetic oligonucleotide
gcgagcuagcccaccacu

SEQ ID NO: 65432 - RNA, 18 nt, Artificial Sequence
  Description of Artificial Sequence: Synthetic oligonucleotide
aagcggcgagcuagccca

SEQ ID NO: 65433 - RNA, 18 nt, Artificial Sequence
  Description of Artificial Sequence: Synthetic oligonucleotide
agccgaagcggcgagcua

SEQ ID NO: 65434 - RNA, 18 nt, Artificial Sequence
  Description of Artificial Sequence: Synthetic oligonucleotide
gccagagccgaagcggcg

SEQ ID NO: 65435 - RNA, 18 nt, Artificial Sequence
  Description of Artificial Sequence: Synthetic oligonucleotide
cagcagccagagccgaag

SEQ ID NO: 65436 - RNA, 18 nt, Artificial Sequence
  Description of Artificial Sequence: Synthetic oligonucleotide
aacaacagcagccagagc

SEQ ID NO: 65437 - RNA, 18 nt, Artificial Sequence
  Description of Artificial Sequence: Synthetic oligonucleotide
ggaggaacaacagcagcc

SEQ ID NO: 65438 - RNA, 18 nt, Artificial Sequence
  Description of Artificial Sequence: Synthetic oligonucleotide
gggcaggaggaacaacag

SEQ ID NO: 65439 - RNA, 18 nt, Artificial Sequence
  Description of Artificial Sequence: Synthetic oligonucleotide
gcugagggcaggaggaac

SEQ ID NO: 65440 - RNA, 18 nt, Artificial Sequence
  Description of Artificial Sequence: Synthetic oligonucleotide
ccugcgcugagggcagga

SEQ ID NO: 65441 - RNA, 18 nt, Artificial Sequence
  Description of Artificial Sequence: Synthetic oligonucleotide
gcggcccugcgcugaggg

SEQ ID NO: 65442 - RNA, 18 nt, Artificial Sequence
  Description of Artificial Sequence: Synthetic oligonucleotide
uucuggcggcccugcgcu

SEQ ID NO: 65443 - RNA, 18 nt, Artificial Sequence
  Description of Artificial Sequence: Synthetic oligonucleotide
acuccuucuggcggcccu

SEQ ID NO: 65444 - RNA, 18 nt, Artificial Sequence
  Description of Artificial Sequence: Synthetic oligonucleotide
gcucggcacugcccggag

SEQ ID NO: 65445 - RNA, 18 nt, Artificial Sequence
  Description of Artificial Sequence: Synthetic oligonucleotide
ggcaggcucggcacugcc

SEQ ID NO: 65446 - RNA, 18 nt, Artificial Sequence
  Description of Artificial Sequence: Synthetic oligonucleotide
gggcaggcucggcacugc

SEQ ID NO: 65447 - RNA, 18 nt, Artificial Sequence
  Description of Artificial Sequence: Synthetic oligonucleotide
agaccccgagcccaaggg

SEQ ID NO: 65448 - RNA, 18 nt, Artificial Sequence
  Description of Artificial Sequence: Synthetic oligonucleotide
cggccagaccccgagccc

SEQ ID NO: 65449 - RNA, 18 nt, Artificial Sequence
  Description of Artificial Sequence: Synthetic oligonucleotide
gacuccggccagaccccg

SEQ ID NO: 65450 - RNA, 18 nt, Artificial Sequence
  Description of Artificial Sequence: Synthetic oligonucleotide
cucgggacuccggccaga

SEQ ID NO: 65451 - RNA, 18 nt, Artificial Sequence
  Description of Artificial Sequence: Synthetic oligonucleotide
agcgccucgggacuccgg

SEQ ID NO: 65452 - RNA, 18 nt, Artificial Sequence
  Description of Artificial Sequence: Synthetic oligonucleotide
gggagcgccucgggacuc

SEQ ID NO: 65453 - RNA, 18 nt, Artificial Sequence
  Description of Artificial Sequence: Synthetic oligonucleotide
gggagccggccgcgcggg

SEQ ID NO: 65454 - RNA, 18 nt, Artificial Sequence
  Description of Artificial Sequence: Synthetic oligonucleotide
uucccgggagccggccgc

SEQ ID NO: 65455 - RNA, 18 nt, Artificial Sequence
  Description of Artificial Sequence: Synthetic oligonucleotide
gcaucuucccgggagccg

SEQ ID NO: 65456 - RNA, 18 nt, Artificial Sequence
  Description of Artificial Sequence: Synthetic oligonucleotide
ccacggcaucuucccggg

SEQ ID NO: 65457 - RNA, 18 nt, Artificial Sequence
  Description of Artificial Sequence: Synthetic oligonucleotide
agcggccacggcaucuuc

SEQ ID NO: 65458 - RNA, 18 nt, Artificial Sequence
  Description of Artificial Sequence: Synthetic oligonucleotide
gcuacagcggccacggca

SEQ ID NO: 65459 - RNA, 18 nt, Artificial Sequence
  Description of Artificial Sequence: Synthetic oligonucleotide
uccgagcuacagcggcca

SEQ ID NO: 65460 - RNA, 18 nt, Artificial Sequence
  Description of Artificial Sequence: Synthetic oligonucleotide
ccagcuccgagcuacagc

SEQ ID NO: 65461 - RNA, 18 nt, Artificial Sequence
  Description of Artificial Sequence: Synthetic oligonucleotide
ucugcccagcuccgagcu

SEQ ID NO: 65462 - RNA, 18 nt, Artificial Sequence
  Description of Artificial Sequence: Synthetic oligonucleotide
ugccuucugcccagcucc

SEQ ID NO: 65463 - RNA, 18 nt, Artificial Sequence
  Description of Artificial Sequence: Synthetic oligonucleotide
cccggugccuucugccca

SEQ ID NO: 65464 - RNA, 18 nt, Artificial Sequence
  Description of Artificial Sequence: Synthetic oligonucleotide
ggcgccccggugccuucu

SEQ ID NO: 65465 - RNA, 18 nt, Artificial Sequence
  Description of Artificial Sequence: Synthetic oligonucleotide
cgcaaggcgccccggugc

SEQ ID NO: 65466 - RNA, 18 nt, Artificial Sequence
  Description of Artificial Sequence: Synthetic oligonucleotide
uccgccgcaaggcgcccc

SEQ ID NO: 65467 - RNA, 18 nt, Artificial Sequence
  Description of Artificial Sequence: Synthetic oligonucleotide
cacucuccgccgcaaggc

SEQ ID NO: 65468 - RNA, 18 nt, Artificial Sequence
  Description of Artificial Sequence: Synthetic oligonucleotide
caccucacucuccgccgc

SEQ ID NO: 65469 - RNA, 18 nt, Artificial Sequence
  Description of Artificial Sequence: Synthetic oligonucleotide
cccggcaccucacucucc

SEQ ID NO: 65470 - RNA, 18 nt, Artificial Sequence
  Description of Artificial Sequence: Synthetic oligonucleotide
gagaccccggcaccucac

SEQ ID NO: 65471 - RNA, 18 nt, Artificial Sequence
  Description of Artificial Sequence: Synthetic oligonucleotide
gagcagagaccccggcac

SEQ ID NO: 65472 - RNA, 18 nt, Artificial Sequence
  Description of Artificial Sequence: Synthetic oligonucleotide
agcaggagcagagacccc

SEQ ID NO: 65473 - RNA, 18 nt, Artificial Sequence
  Description of Artificial Sequence: Synthetic oligonucleotide
uccagagcaggagcagag

SEQ ID NO: 65474 - RNA, 18 nt, Artificial Sequence
  Description of Artificial Sequence: Synthetic oligonucleotide
caggguccagagcaggag

SEQ ID NO: 65475 - RNA, 18 nt, Artificial Sequence
  Description of Artificial Sequence: Synthetic oligonucleotide
cucuccaggguccagagc

SEQ ID NO: 65476 - RNA, 18 nt, Artificial Sequence
  Description of Artificial Sequence: Synthetic oligonucleotide
gguuacucuccagggucc

SEQ ID NO: 65477 - RNA, 18 nt, Artificial Sequence
  Description of Artificial Sequence: Synthetic oligonucleotide
gaauggguuacucuccag

SEQ ID NO: 65478 - RNA, 18 nt, Artificial Sequence
  Description of Artificial Sequence: Synthetic oligonucleotide
gggaauggguuacucucc

SEQ ID NO: 65479 - RNA, 18 nt, Artificial Sequence
  Description of Artificial Sequence: Synthetic oligonucleotide
gucauucugaauuccggg

SEQ ID NO: 65480 - RNA, 18 nt, Artificial Sequence
  Description of Artificial Sequence: Synthetic oligonucleotide
ucccugucauucugaauu

SEQ ID NO: 65481 - RNA, 18 nt, Artificial Sequence
  Description of Artificial Sequence: Synthetic oligonucleotide
ucuccucccugucauucu

SEQ ID NO: 65482 - RNA, 18 nt, Artificial Sequence
  Description of Artificial Sequence: Synthetic oligonucleotide
uucccucuccucccuguc

SEQ ID NO: 65483 - RNA, 18 nt, Artificial Sequence
  Description of Artificial Sequence: Synthetic oligonucleotide
gggaauucccucuccucc

SEQ ID NO: 65484 - RNA, 18 nt, Artificial Sequence
  Description of Artificial Sequence: Synthetic oligonucleotide
acgccuccugcgggugaa

SEQ ID NO: 65485 - RNA, 18 nt, Artificial Sequence
  Description of Artificial Sequence: Synthetic oligonucleotide
gggccacgccuccugcgg

SEQ ID NO: 65486 - RNA, 18 nt, Artificial Sequence
  Description of Artificial Sequence: Synthetic oligonucleotide
agcacgggccacgccucc

SEQ ID NO: 65487 - RNA, 18 nt, Artificial Sequence
  Description of Artificial Sequence: Synthetic oligonucleotide
agccaagcacgggccacg

SEQ ID NO: 65488 - RNA, 18 nt, Artificial Sequence
  Description of Artificial Sequence: Synthetic oligonucleotide
agaguagccaagcacggg

SEQ ID NO: 65489 - RNA, 18 nt, Artificial Sequence
  Description of Artificial Sequence: Synthetic oligonucleotide
gguccagaguagccaagc

SEQ ID NO: 65490 - RNA, 18 nt, Artificial Sequence
  Description of Artificial Sequence: Synthetic oligonucleotide
aggcagguccagaguagc

SEQ ID NO: 65491 - RNA, 18 nt, Artificial Sequence
  Description of Artificial Sequence: Synthetic oligonucleotide
guuucaggcagguccaga

SEQ ID NO: 65492 - RNA, 18 nt, Artificial Sequence
  Description of Artificial Sequence: Synthetic oligonucleotide
ucaguguuucaggcaggu

SEQ ID NO: 65493 - RNA, 18 nt, Artificial Sequence
  Description of Artificial Sequence: Synthetic oligonucleotide
accccucaguguuucagg

SEQ ID NO: 65494 - RNA, 18 nt, Artificial Sequence
  Description of Artificial Sequence: Synthetic oligonucleotide
ccccgaccccucaguguu

SEQ ID NO: 65495 - RNA, 18 nt, Artificial Sequence
  Description of Artificial Sequence: Synthetic oligonucleotide
cccauccccgaccccuca

SEQ ID NO: 65496 - RNA, 18 nt, Artificial Sequence
  Description of Artificial Sequence: Synthetic oligonucleotide
uugcccccauccccgacc

SEQ ID NO: 65497 - RNA, 18 nt, Artificial Sequence
  Description of Artificial Sequence: Synthetic oligonucleotide
gacauuugcccccauccc

SEQ ID NO: 65498 - RNA, 18 nt, Artificial Sequence
  Description of Artificial Sequence: Synthetic oligonucleotide
cgcacgacauuugccccc

SEQ ID NO: 65499 - RNA, 18 nt, Artificial Sequence
  Description of Artificial Sequence: Synthetic oligonucleotide
ucgcgcgcacgacauuug

SEQ ID NO: 65500 - RNA, 18 nt, Artificial Sequence
  Description of Artificial Sequence: Synthetic oligonucleotide
cacgcucgcgcgcacgac

SEQ ID NO: 65501 - RNA, 18 nt, Artificial Sequence
  Description of Artificial Sequence: Synthetic oligonucleotide
acacacacgcucgcgcgc

SEQ ID NO: 65502 - RNA, 18 nt, Artificial Sequence
  Description of Artificial Sequence: Synthetic oligonucleotide
cauauacacacacgcucg

SEQ ID NO: 65503 - RNA, 18 nt, Artificial Sequence
  Description of Artificial Sequence: Synthetic oligonucleotide
caacgcauauacacacac

SEQ ID NO: 65504 - RNA, 18 nt, Artificial Sequence
  Description of Artificial Sequence: Synthetic oligonucleotide
ucuggcaacgcauauaca

SEQ ID NO: 65505 - RNA, 18 nt, Artificial Sequence
  Description of Artificial Sequence: Synthetic oligonucleotide
ucucuucuggcaacgcau

SEQ ID NO: 65506 - RNA, 18 nt, Artificial Sequence
  Description of Artificial Sequence: Synthetic oligonucleotide
ccucuucucuucuggcaa

SEQ ID NO: 65507 - RNA, 18 nt, Artificial Sequence
  Description of Artificial Sequence: Synthetic oligonucleotide
aaaccccucuucucuucu

SEQ ID NO: 65508 - RNA, 18 nt, Artificial Sequence
  Description of Artificial Sequence: Synthetic oligonucleotide
acauuaaaccccucuucu

SEQ ID NO: 65509 - RNA, 18 nt, Artificial Sequence
  Description of Artificial Sequence: Synthetic oligonucleotide
cacgcucgcgcgcacgac

SEQ ID NO: 65510 - RNA, 18 nt, Artificial Sequence
  Description of Artificial Sequence: Synthetic oligonucleotide
acacacacgcucgcgcgc

SEQ ID NO: 65511 - RNA, 18 nt, Artificial Sequence
  Description of Artificial Sequence: Synthetic oligonucleotide
cauauacacacacgcucg

SEQ ID NO: 65512 - RNA, 18 nt, Artificial Sequence
  Description of Artificial Sequence: Synthetic oligonucleotide
caacgcauauacacacac

SEQ ID NO: 65513 - RNA, 18 nt, Artificial Sequence
  Description of Artificial Sequence: Synthetic oligonucleotide
ucuggcaacgcauauaca

SEQ ID NO: 65514 - RNA, 18 nt, Artificial Sequence
  Description of Artificial Sequence: Synthetic oligonucleotide
ucucuucuggcaacgcau

SEQ ID NO: 65515 - RNA, 18 nt, Artificial Sequence
  Description of Artificial Sequence: Synthetic oligonucleotide
ccucuucucuucuggcaa

SEQ ID NO: 65516 - RNA, 18 nt, Artificial Sequence
  Description of Artificial Sequence: Synthetic oligonucleotide
aaaccccucuucucuucu

SEQ ID NO: 65517 - RNA, 18 nt, Artificial Sequence
  Description of Artificial Sequence: Synthetic oligonucleotide
acauuaaaccccucuucu

SEQ ID NO: 65518 - RNA, 18 nt, Artificial Sequence
  Description of Artificial Sequence: Synthetic oligonucleotide
uacagacauuaaaccccu

SEQ ID NO: 65519 - RNA, 18 nt, Artificial Sequence
  Description of Artificial Sequence: Synthetic oligonucleotide
aaagcuacagacauuaaa

SEQ ID NO: 65520 - RNA, 18 nt, Artificial Sequence
  Description of Artificial Sequence: Synthetic oligonucleotide
aguuaaaagcuacagaca

SEQ ID NO: 65521 - RNA, 18 nt, Artificial Sequence
  Description of Artificial Sequence: Synthetic oligonucleotide
ggaucaguuaaaagcuac

SEQ ID NO: 65522 - RNA, 18 nt, Artificial Sequence
  Description of Artificial Sequence: Synthetic oligonucleotide
aaagaggaucaguuaaaa

SEQ ID NO: 65523 - RNA, 18 nt, Artificial Sequence
  Description of Artificial Sequence: Synthetic oligonucleotide
uccacaaagaggaucagu

SEQ ID NO: 65524 - RNA, 18 nt, Artificial Sequence
  Description of Artificial Sequence: Synthetic oligonucleotide
ugaacuccacaaagagga

SEQ ID NO: 65525 - RNA, 18 nt, Artificial Sequence
  Description of Artificial Sequence: Synthetic oligonucleotide
caaauugaacuccacaaa

SEQ ID NO: 65526 - RNA, 18 nt, Artificial Sequence
  Description of Artificial Sequence: Synthetic oligonucleotide
cuaaucaaauugaacucc

SEQ ID NO: 65527 - RNA, 18 nt, Artificial Sequence
  Description of Artificial Sequence: Synthetic oligonucleotide
uucuacuaaucaaauuga

SEQ ID NO: 65528 - RNA, 18 nt, Artificial Sequence
  Description of Artificial Sequence: Synthetic oligonucleotide
ucacuuucuacuaaucaa

SEQ ID NO: 65529 - RNA, 18 nt, Artificial Sequence
  Description of Artificial Sequence: Synthetic oligonucleotide
gacucucacuuucuacua

SEQ ID NO: 65530 - RNA, 18 nt, Artificial Sequence
  Description of Artificial Sequence: Synthetic oligonucleotide
acgcggacucucacuuuc

SEQ ID NO: 65531 - RNA, 18 nt, Artificial Sequence
  Description of Artificial Sequence: Synthetic oligonucleotide
uagugacgcggacucuca

SEQ ID NO: 65532 - RNA, 18 nt, Artificial Sequence
  Description of Artificial Sequence: Synthetic oligonucleotide
auggauagugacgcggac

SEQ ID NO: 65533 - RNA, 18 nt, Artificial Sequence
  Description of Artificial Sequence: Synthetic oligonucleotide
augcuauggauagugacg

SEQ ID NO: 65534 - RNA, 18 nt, Artificial Sequence
  Description of Artificial Sequence: Synthetic oligonucleotide
ucagaaugcuauggauag

SEQ ID NO: 65535 - RNA, 18 nt, Artificial Sequence
  Description of Artificial Sequence: Synthetic oligonucleotide
aacccucagaaugcuaug

SEQ ID NO: 65536 - RNA, 18 nt, Artificial Sequence
  Description of Artificial Sequence: Synthetic oligonucleotide
ugcucaacccucagaaug

SEQ ID NO: 65537 - RNA, 18 nt, Artificial Sequence
  Description of Artificial Sequence: Synthetic oligonucleotide
cuuaaugcucaacccuca

SEQ ID NO: 65538 - RNA, 18 nt, Artificial Sequence
  Description of Artificial Sequence: Synthetic oligonucleotide
ccaagcuuaaugcucaac

SEQ ID NO: 65539 - RNA, 18 nt, Artificial Sequence
  Description of Artificial Sequence: Synthetic oligonucleotide
aauucccaagcuuaaugc

SEQ ID NO: 65540 - RNA, 18 nt, Artificial Sequence
  Description of Artificial Sequence: Synthetic oligonucleotide
uggaaaauucccaagcuu

SEQ ID NO: 65541 - RNA, 18 nt, Artificial Sequence
  Description of Artificial Sequence: Synthetic oligonucleotide
gaaacuggaaaauuccca

SEQ ID NO: 65542 - RNA, 18 nt, Artificial Sequence
  Description of Artificial Sequence: Synthetic oligonucleotide
uccaagaaacuggaaaau

SEQ ID NO: 65543 - RNA, 18 nt, Artificial Sequence
  Description of Artificial Sequence: Synthetic oligonucleotide
agguguccaagaaacugg

SEQ ID NO: 65544 - RNA, 18 nt, Artificial Sequence
  Description of Artificial Sequence: Synthetic oligonucleotide
cugucagguguccaagaa

SEQ ID NO: 65545 - RNA, 18 nt, Artificial Sequence
  Description of Artificial Sequence: Synthetic oligonucleotide
uccggcugucaggugucc

SEQ ID NO: 65546 - RNA, 18 nt, Artificial Sequence
  Description of Artificial Sequence: Synthetic oligonucleotide
cucuauccggcugucagg

SEQ ID NO: 65547 - RNA, 18 nt, Artificial Sequence
  Description of Artificial Sequence: Synthetic oligonucleotide
uguuccucuauccggcug

SEQ ID NO: 65548 - RNA, 18 nt, Artificial Sequence
  Description of Artificial Sequence: Synthetic oligonucleotide
aagucuguuccucuaucc

SEQ ID NO: 65549 - RNA, 18 nt, Artificial Sequence
  Description of Artificial Sequence: Synthetic oligonucleotide
acgucaagucuguuccuc

SEQ ID NO: 65550 - RNA, 18 nt, Artificial Sequence
  Description of Artificial Sequence: Synthetic oligonucleotide
cgcucacgucaagucugu

SEQ ID NO: 65551 - RNA, 18 nt, Artificial Sequence
  Description of Artificial Sequence: Synthetic oligonucleotide
ucccacgcucacgucaag

SEQ ID NO: 65552 - RNA, 18 nt, Artificial Sequence
  Description of Artificial Sequence: Synthetic oligonucleotide
gcaacucccacgcucacg

SEQ ID NO: 65553 - RNA, 18 nt, Artificial Sequence
  Description of Artificial Sequence: Synthetic oligonucleotide
ugugugcaacucccacgc

SEQ ID NO: 65554 - RNA, 18 nt, Artificial Sequence
  Description of Artificial Sequence: Synthetic oligonucleotide
uuuugugugugcaacucc

SEQ ID NO: 65555 - RNA, 18 nt, Artificial Sequence
  Description of Artificial Sequence: Synthetic oligonucleotide
ggaauuuuugugugugca

SEQ ID NO: 65556 - RNA, 18 nt, Artificial Sequence
  Description of Artificial Sequence: Synthetic oligonucleotide
agggaggaauuuuugugu

SEQ ID NO: 65557 - RNA, 18 nt, Artificial Sequence
  Description of Artificial Sequence: Synthetic oligonucleotide
acgcuagggaggaauuuu

SEQ ID NO: 65558 - RNA, 18 nt, Artificial Sequence
  Description of Artificial Sequence: Synthetic oligonucleotide
acgaaacgcuagggagga

SEQ ID NO: 65559 - RNA, 18 nt, Artificial Sequence
  Description of Artificial Sequence: Synthetic oligonucleotide
uggaaacgaaacgcuagg

SEQ ID NO: 65560 - RNA, 18 nt, Artificial Sequence
  Description of Artificial Sequence: Synthetic oligonucleotide
acugauggaaacgaaacg

SEQ ID NO: 65561 - RNA, 18 nt, Artificial Sequence
  Description of Artificial Sequence: Synthetic oligonucleotide
aucccacugauggaaacg

SEQ ID NO: 65562 - RNA, 18 nt, Artificial Sequence
  Description of Artificial Sequence: Synthetic oligonucleotide
uucccaucccacugaugg

SEQ ID NO: 65563 - RNA, 18 nt, Artificial Sequence
  Description of Artificial Sequence: Synthetic oligonucleotide
uccccuucccaucccacu

SEQ ID NO: 65564 - RNA, 18 nt, Artificial Sequence
  Description of Artificial Sequence: Synthetic oligonucleotide
agaaauccccuucccauc

SEQ ID NO: 65565 - RNA, 18 nt, Artificial Sequence
  Description of Artificial Sequence: Synthetic oligonucleotide
cuuucagaaauccccuuc

SEQ ID NO: 65566 - RNA, 18 nt, Artificial Sequence
  Description of Artificial Sequence: Synthetic oligonucleotide
caaaacuuucagaaaucc

SEQ ID NO: 65567 - RNA, 18 nt, Artificial Sequence
  Description of Artificial Sequence: Synthetic oligonucleotide
aagaccaaaacuuucaga

SEQ ID NO: 65568 - RNA, 18 nt, Artificial Sequence
  Description of Artificial Sequence: Synthetic oligonucleotide
aacagaagaccaaaacuu

SEQ ID NO: 65569 - RNA, 18 nt, Artificial Sequence
  Description of Artificial Sequence: Synthetic oligonucleotide
gaagaaacagaagaccaa

SEQ ID NO: 65570 - RNA, 18 nt, Artificial Sequence
  Description of Artificial Sequence: Synthetic oligonucleotide
caacagaagaaacagaag

SEQ ID NO: 65571 - RNA, 18 nt, Artificial Sequence
  Description of Artificial Sequence: Synthetic oligonucleotide
cacaccaacagaagaaac

SEQ ID NO: 65572 - RNA, 18 nt, Artificial Sequence
  Description of Artificial Sequence: Synthetic oligonucleotide
gacaccacaccaacagaa

SEQ ID NO: 65573 - RNA, 18 nt, Artificial Sequence
  Description of Artificial Sequence: Synthetic oligonucleotide
uugcugacaccacaccaa

SEQ ID NO: 65574 - RNA, 18 nt, Artificial Sequence
  Description of Artificial Sequence: Synthetic oligonucleotide
guuauuugcugacaccac

SEQ ID NO: 65575 - RNA, 18 nt, Artificial Sequence
  Description of Artificial Sequence: Synthetic oligonucleotide
ugaauguuauuugcugac

SEQ ID NO: 65576 - RNA, 18 nt, Artificial Sequence
  Description of Artificial Sequence: Synthetic oligonucleotide
uuuccugaauguuauuug

SEQ ID NO: 65577 - RNA, 18 nt, Artificial Sequence
  Description of Artificial Sequence: Synthetic oligonucleotide
aaaauuuuccugaauguu

SEQ ID NO: 65578 - RNA, 18 nt, Artificial Sequence
  Description of Artificial Sequence: Synthetic oligonucleotide
uuaaaaaaauuuuccuga

SEQ ID NO: 65579 - RNA, 18 nt, Artificial Sequence
  Description of Artificial Sequence: Synthetic oligonucleotide
gagaguuaaaaaaauuuu

SEQ ID NO: 65580 - RNA, 18 nt, Artificial Sequence
  Description of Artificial Sequence: Synthetic oligonucleotide
uaaaugagaguuaaaaaa

SEQ ID NO: 65581 - RNA, 18 nt, Artificial Sequence
  Description of Artificial Sequence: Synthetic oligonucleotide
aauacuuuccauuuugaa

SEQ ID NO: 65582 - RNA, 18 nt, Artificial Sequence
  Description of Artificial Sequence: Synthetic oligonucleotide
caauaaauacuuuccauu

SEQ ID NO: 65583 - RNA, 18 nt, Artificial Sequence
  Description of Artificial Sequence: Synthetic oligonucleotide
uuggucaauaaauacuuu

SEQ ID NO: 65584 - RNA, 18 nt, Artificial Sequence
  Description of Artificial Sequence: Synthetic oligonucleotide
uuaauuuggucaauaaau

SEQ ID NO: 65585 - RNA, 18 nt, Artificial Sequence
  Description of Artificial Sequence: Synthetic oligonucleotide
accuguuaauuuggucaa

SEQ ID NO: 65586 - RNA, 18 nt, Artificial Sequence
  Description of Artificial Sequence: Synthetic oligonucleotide
caaagaccuguuaauuug

SEQ ID NO: 65587 - RNA, 18 nt, Artificial Sequence
  Description of Artificial Sequence: Synthetic oligonucleotide
uucuccaaagaccuguua

SEQ ID NO: 65588 - RNA, 18 nt, Artificial Sequence
  Description of Artificial Sequence: Synthetic oligonucleotide
cguaauucuccaaagacc

SEQ ID NO: 65589 - RNA, 18 nt, Artificial Sequence
  Description of Artificial Sequence: Synthetic oligonucleotide
ugguucguaauucuccaa

SEQ ID NO: 65590 - RNA, 18 nt, Artificial Sequence
  Description of Artificial Sequence: Synthetic oligonucleotide
gaacaugguucguaauuc

SEQ ID NO: 65591 - RNA, 18 nt, Artificial Sequence
  Description of Artificial Sequence: Synthetic oligonucleotide
gacuugaacaugguucgu

SEQ ID NO: 65592 - RNA, 18 nt, Artificial Sequence
  Description of Artificial Sequence: Synthetic oligonucleotide
guuuugacuugaacaugg

SEQ ID NO: 65593 - RNA, 18 nt, Artificial Sequence
  Description of Artificial Sequence: Synthetic oligonucleotide
cugcaguuuugacuugaa

SEQ ID NO: 65594 - RNA, 18 nt, Artificial Sequence
  Description of Artificial Sequence: Synthetic oligonucleotide
agcagcugcaguuuugac

SEQ ID NO: 65595 - RNA, 18 nt, Artificial Sequence
  Description of Artificial Sequence: Synthetic oligonucleotide
augguagcagcugcaguu

SEQ ID NO: 65596 - RNA, 18 nt, Artificial Sequence
  Description of Artificial Sequence: Synthetic oligonucleotide
ugcucaacaccacuacac

SEQ ID NO: 65597 - RNA, 18 nt, Artificial Sequence
  Description of Artificial Sequence: Synthetic oligonucleotide
uaaagugcucaacaccac

SEQ ID NO: 65598 - RNA, 18 nt, Artificial Sequence
  Description of Artificial Sequence: Synthetic oligonucleotide
caaaauaaagugcucaac

SEQ ID NO: 65599 - RNA, 18 nt, Artificial Sequence
  Description of Artificial Sequence: Synthetic oligonucleotide
acuuccaaaauaaagugc

SEQ ID NO: 65600 - RNA, 18 nt, Artificial Sequence
  Description of Artificial Sequence: Synthetic oligonucleotide
cgaucacuuccaaaauaa

SEQ ID NO: 65601 - RNA, 18 nt, Artificial Sequence
  Description of Artificial Sequence: Synthetic oligonucleotide
acgcccgaucacuuccaa

SEQ ID NO: 65602 - RNA, 18 nt, Artificial Sequence
  Description of Artificial Sequence: Synthetic oligonucleotide
gggagacgcccgaucacu

SEQ ID NO: 65603 - RNA, 18 nt, Artificial Sequence
  Description of Artificial Sequence: Synthetic oligonucleotide
ugucagggagacgcccga

SEQ ID NO: 65604 - RNA, 18 nt, Artificial Sequence
  Description of Artificial Sequence: Synthetic oligonucleotide
cuccaugucagggagacg

SEQ ID NO: 65605 - RNA, 18 nt, Artificial Sequence
  Description of Artificial Sequence: Synthetic oligonucleotide
accaucuccaugucaggg

SEQ ID NO: 65606 - RNA, 18 nt, Artificial Sequence
  Description of Artificial Sequence: Synthetic oligonucleotide
ugaucaccaucuccaugu

SEQ ID NO: 65607 - RNA, 18 nt, Artificial Sequence
  Description of Artificial Sequence: Synthetic oligonucleotide
uacauugaucaccaucuc

SEQ ID NO: 65608 - RNA, 18 nt, Artificial Sequence
  Description of Artificial Sequence: Synthetic oligonucleotide
ucucguacauugaucacc

SEQ ID NO: 65609 - RNA, 18 nt, Artificial Sequence
  Description of Artificial Sequence: Synthetic oligonucleotide
gauaaucucguacauuga

SEQ ID NO: 65610 - RNA, 18 nt, Artificial Sequence
  Description of Artificial Sequence: Synthetic oligonucleotide
cugaggauaaucucguac

SEQ ID NO: 65611 - RNA, 18 nt, Artificial Sequence
  Description of Artificial Sequence: Synthetic oligonucleotide
ggaaccugaggauaaucu

SEQ ID NO: 65612 - RNA, 18 nt, Artificial Sequence
  Description of Artificial Sequence: Synthetic oligonucleotide
auuuaggaaccugaggau

SEQ ID NO: 65613 - RNA, 18 nt, Artificial Sequence
  Description of Artificial Sequence: Synthetic oligonucleotide
cauccauuuaggaaccug

SEQ ID NO: 65614 - RNA, 18 nt, Artificial Sequence
  Description of Artificial Sequence: Synthetic oligonucleotide
ggcuccauccauuuagga

SEQ ID NO: 65615 - RNA, 18 nt, Artificial Sequence
  Description of Artificial Sequence: Synthetic oligonucleotide
uggcaggcuccauccauu

SEQ ID NO: 65616 - RNA, 18 nt, Artificial Sequence
  Description of Artificial Sequence: Synthetic oligonucleotide
ugggauggcaggcuccau

SEQ ID NO: 65617 - RNA, 18 nt, Artificial Sequence
  Description of Artificial Sequence: Synthetic oligonucleotide
aagacugggauggcaggc

SEQ ID NO: 65618 - RNA, 18 nt, Artificial Sequence
  Description of Artificial Sequence: Synthetic oligonucleotide
aggagaagacugggaugg

SEQ ID NO: 65619 - RNA, 18 nt, Artificial Sequence
  Description of Artificial Sequence: Synthetic oligonucleotide
acugaaggagaagacugg

SEQ ID NO: 65620 - RNA, 18 nt, Artificial Sequence
  Description of Artificial Sequence: Synthetic oligonucleotide
cauguggcucucccugua

SEQ ID NO: 65621 - RNA, 18 nt, Artificial Sequence
  Description of Artificial Sequence: Synthetic oligonucleotide
ccacccauguggcucucc

SEQ ID NO: 65622 - RNA, 18 nt, Artificial Sequence
  Description of Artificial Sequence: Synthetic oligonucleotide
uccauccacccauguggc

SEQ ID NO: 65623 - RNA, 18 nt, Artificial Sequence
  Description of Artificial Sequence: Synthetic oligonucleotide
cacucuccauccacccau

SEQ ID NO: 65624 - RNA, 18 nt, Artificial Sequence
  Description of Artificial Sequence: Synthetic oligonucleotide
aggaccacucuccaucca

SEQ ID NO: 65625 - RNA, 18 nt, Artificial Sequence
  Description of Artificial Sequence: Synthetic oligonucleotide
ccuagaggaccacucucc

SEQ ID NO: 65626 - RNA, 18 nt, Artificial Sequence
  Description of Artificial Sequence: Synthetic oligonucleotide
cauauccuagaggaccac

SEQ ID NO: 65627 - RNA, 18 nt, Artificial Sequence
  Description of Artificial Sequence: Synthetic oligonucleotide
augcucauauccuagagg

SEQ ID NO: 65628 - RNA, 18 nt, Artificial Sequence
  Description of Artificial Sequence: Synthetic oligonucleotide
aucucaugcucauauccu

SEQ ID NO: 65629 - RNA, 18 nt, Artificial Sequence
  Description of Artificial Sequence: Synthetic oligonucleotide
caaagaucucaugcucau

SEQ ID NO: 65630 - RNA, 18 nt, Artificial Sequence
  Description of Artificial Sequence: Synthetic oligonucleotide
ccggacaaagaucucaug

SEQ ID NO: 65631 - RNA, 18 nt, Artificial Sequence
  Description of Artificial Sequence: Synthetic oligonucleotide
ugucaccggacaaagauc

SEQ ID NO: 65632 - RNA, 18 nt, Artificial Sequence
  Description of Artificial Sequence: Synthetic oligonucleotide
gacuaugucaccggacaa

SEQ ID NO: 65633 - RNA, 18 nt, Artificial Sequence
  Description of Artificial Sequence: Synthetic oligonucleotide
caucagacuaugucaccg

SEQ ID NO: 65634 - RNA, 18 nt, Artificial Sequence
  Description of Artificial Sequence: Synthetic oligonucleotide
uuauccaucagacuaugu

SEQ ID NO: 65635 - RNA, 18 nt, Artificial Sequence
  Description of Artificial Sequence: Synthetic oligonucleotide
uaccauuauccaucagac

SEQ ID NO: 65636 - RNA, 18 nt, Artificial Sequence
  Description of Artificial Sequence: Synthetic oligonucleotide
auccuuaccauuauccau

SEQ ID NO: 65637 - RNA, 18 nt, Artificial Sequence
  Description of Artificial Sequence: Synthetic oligonucleotide
uccucauccuuaccauua

SEQ ID NO: 65638 - RNA, 18 nt, Artificial Sequence
  Description of Artificial Sequence: Synthetic oligonucleotide
cucaguccucauccuuac

SEQ ID NO: 65639 - RNA, 18 nt, Artificial Sequence
  Description of Artificial Sequence: Synthetic oligonucleotide
uggaccucaguccucauc

SEQ ID NO: 65640 - RNA, 18 nt, Artificial Sequence
  Description of Artificial Sequence: Synthetic oligonucleotide
auuucuggaccucagucc

SEQ ID NO: 65641 - RNA, 18 nt, Artificial Sequence
  Description of Artificial Sequence: Synthetic oligonucleotide
gacccauuucuggaccuc

SEQ ID NO: 65642 - RNA, 18 nt, Artificial Sequence
  Description of Artificial Sequence: Synthetic oligonucleotide
acacagacccauuucugg

SEQ ID NO: 65643 - RNA, 18 nt, Artificial Sequence
  Description of Artificial Sequence: Synthetic oligonucleotide
uagagacacagacccauu

SEQ ID NO: 65644 - RNA, 18 nt, Artificial Sequence
  Description of Artificial Sequence: Synthetic oligonucleotide
gcuaauagagacacagac

SEQ ID NO: 65645 - RNA, 18 nt, Artificial Sequence
  Description of Artificial Sequence: Synthetic oligonucleotide
gugaugcuaauagagaca

SEQ ID NO: 65646 - RNA, 18 nt, Artificial Sequence
  Description of Artificial Sequence: Synthetic oligonucleotide
ucacugugaugcuaauag

SEQ ID NO: 65647 - RNA, 18 nt, Artificial Sequence
  Description of Artificial Sequence: Synthetic oligonucleotide
cucaaucacugugaugcu

SEQ ID NO: 65648 - RNA, 18 nt, Artificial Sequence
  Description of Artificial Sequence: Synthetic oligonucleotide
uuuugcucaaucacugug

SEQ ID NO: 65649 - RNA, 18 nt, Artificial Sequence
  Description of Artificial Sequence: Synthetic oligonucleotide
ugucuuuuugcucaauca

SEQ ID NO: 65650 - RNA, 18 nt, Artificial Sequence
  Description of Artificial Sequence: Synthetic oligonucleotide
uccucugucuuuuugcuc

SEQ ID NO: 65651 - RNA, 18 nt, Artificial Sequence
  Description of Artificial Sequence: Synthetic oligonucleotide
ucaucuccucugucuuuu

SEQ ID NO: 65652 - RNA, 18 nt, Artificial Sequence
  Description of Artificial Sequence: Synthetic oligonucleotide
caacuucaucuccucugu

SEQ ID NO: 65653 - RNA, 18 nt, Artificial Sequence
  Description of Artificial Sequence: Synthetic oligonucleotide
gcucucaacuucaucucc

SEQ ID NO: 65654 - RNA, 18 nt, Artificial Sequence
  Description of Artificial Sequence: Synthetic oligonucleotide
uaccagcucucaacuuca

SEQ ID NO: 65655 - RNA, 18 nt, Artificial Sequence
  Description of Artificial Sequence: Synthetic oligonucleotide
cuacuuaccagcucucaa

SEQ ID NO: 65656 - RNA, 18 nt, Artificial Sequence
  Description of Artificial Sequence: Synthetic oligonucleotide
uuacacuacuuaccagcu

SEQ ID NO: 65657 - RNA, 18 nt, Artificial Sequence
  Description of Artificial Sequence: Synthetic oligonucleotide
caaucuuacacuacuuac

SEQ ID NO: 65658 - RNA, 18 nt, Artificial Sequence
  Description of Artificial Sequence: Synthetic oligonucleotide
ucaagcaaucuuacacua

SEQ ID NO: 65659 - RNA, 18 nt, Artificial Sequence
  Description of Artificial Sequence: Synthetic oligonucleotide
gacacucaagcaaucuua

SEQ ID NO: 65660 - RNA, 18 nt, Artificial Sequence
  Description of Artificial Sequence: Synthetic oligonucleotide
cuauagacacucaagcaa

SEQ ID NO: 65661 - RNA, 18 nt, Artificial Sequence
  Description of Artificial Sequence: Synthetic oligonucleotide
uagcccuauagacacuca

SEQ ID NO: 65662 - RNA, 18 nt, Artificial Sequence
  Description of Artificial Sequence: Synthetic oligonucleotide
aucucuagcccuauagac

SEQ ID NO: 65663 - RNA, 18 nt, Artificial Sequence
  Description of Artificial Sequence: Synthetic oligonucleotide
ccuccaucucuagcccua

SEQ ID NO: 65664 - RNA, 18 nt, Artificial Sequence
  Description of Artificial Sequence: Synthetic oligonucleotide
ccuagccuccaucucuag

SEQ ID NO: 65665 - RNA, 18 nt, Artificial Sequence
  Description of Artificial Sequence: Synthetic oligonucleotide
cacgcccuagccuccauc

SEQ ID NO: 65666 - RNA, 18 nt, Artificial Sequence
  Description of Artificial Sequence: Synthetic oligonucleotide
ccucucacgcccuagccu

SEQ ID NO: 65667 - RNA, 18 nt, Artificial Sequence
  Description of Artificial Sequence: Synthetic oligonucleotide
ucaggccucucacgcccu

SEQ ID NO: 65668 - RNA, 18 nt, Artificial Sequence
  Description of Artificial Sequence: Synthetic oligonucleotide
guuucucaggccucucac

SEQ ID NO: 65669 - RNA, 18 nt, Artificial Sequence
  Description of Artificial Sequence: Synthetic oligonucleotide
uguagguuucucaggccu

SEQ ID NO: 65670 - RNA, 18 nt, Artificial Sequence
  Description of Artificial Sequence: Synthetic oligonucleotide
auuccuguagguuucuca

SEQ ID NO: 65671 - RNA, 18 nt, Artificial Sequence
  Description of Artificial Sequence: Synthetic oligonucleotide
cucuaauuccuguagguu

SEQ ID NO: 65672 - RNA, 18 nt, Artificial Sequence
  Description of Artificial Sequence: Synthetic oligonucleotide
cccaccucuaauuccugu

SEQ ID NO: 65673 - RNA, 18 nt, Artificial Sequence
  Description of Artificial Sequence: Synthetic oligonucleotide
caagacccaccucuaauu

SEQ ID NO: 65674 - RNA, 18 nt, Artificial Sequence
  Description of Artificial Sequence: Synthetic oligonucleotide
aucuucaagacccaccuc

SEQ ID NO: 65675 - RNA, 18 nt, Artificial Sequence
  Description of Artificial Sequence: Synthetic oligonucleotide
guaagaucuucaagaccc

SEQ ID NO: 65676 - RNA, 18 nt, Artificial Sequence
  Description of Artificial Sequence: Synthetic oligonucleotide
gcucuguaagaucuucaa

SEQ ID NO: 65677 - RNA, 18 nt, Artificial Sequence
  Description of Artificial Sequence: Synthetic oligonucleotide
cccaugcucuguaagauc

SEQ ID NO: 65678 - RNA, 18 nt, Artificial Sequence
  Description of Artificial Sequence: Synthetic oligonucleotide
uuccucccaugcucugua

SEQ ID NO: 65679 - RNA, 18 nt, Artificial Sequence
  Description of Artificial Sequence: Synthetic oligonucleotide
accccuuccucccaugcu

SEQ ID NO: 65680 - RNA, 18 nt, Artificial Sequence
  Description of Artificial Sequence: Synthetic oligonucleotide
cuuggaccccuuccuccc

SEQ ID NO: 65681 - RNA, 18 nt, Artificial Sequence
  Description of Artificial Sequence: Synthetic oligonucleotide
gcuuucuuggaccccuuc

SEQ ID NO: 65682 - RNA, 18 nt, Artificial Sequence
  Description of Artificial Sequence: Synthetic oligonucleotide
uccaagcuuucuuggacc

SEQ ID NO: 65683 - RNA, 18 nt, Artificial Sequence
  Description of Artificial Sequence: Synthetic oligonucleotide
cuaacuccaagcuuucuu

SEQ ID NO: 65684 - RNA, 18 nt, Artificial Sequence
  Description of Artificial Sequence: Synthetic oligonucleotide
guucccuaacuccaagcu

SEQ ID NO: 65685 - RNA, 18 nt, Artificial Sequence
  Description of Artificial Sequence: Synthetic oligonucleotide
aagguguucccuaacucc

SEQ ID NO: 65686 - RNA, 18 nt, Artificial Sequence
  Description of Artificial Sequence: Synthetic oligonucleotide
gaaugaagguguucccua

SEQ ID NO: 65687 - RNA, 18 nt, Artificial Sequence
  Description of Artificial Sequence: Synthetic oligonucleotide
uuuuggaaugaagguguu

SEQ ID NO: 65688 - RNA, 18 nt, Artificial Sequence
  Description of Artificial Sequence: Synthetic oligonucleotide
caaacuuuuggaaugaag

SEQ ID NO: 65689 - RNA, 18 nt, Artificial Sequence
  Description of Artificial Sequence: Synthetic oligonucleotide
cucaacaaacuuuuggaa

SEQ ID NO: 65690 - RNA, 18 nt, Artificial Sequence
  Description of Artificial Sequence: Synthetic oligonucleotide
aggagcucaacaaacuuu

SEQ ID NO: 65691 - RNA, 18 nt, Artificial Sequence
  Description of Artificial Sequence: Synthetic oligonucleotide
auaguaggagcucaacaa

SEQ ID NO: 65692 - RNA, 18 nt, Artificial Sequence
  Description of Artificial Sequence: Synthetic oligonucleotide
uauacauaguaggagcuc

SEQ ID NO: 65693 - RNA, 18 nt, Artificial Sequence
  Description of Artificial Sequence: Synthetic oligonucleotide
gaauauauacauaguagg

SEQ ID NO: 65694 - RNA, 18 nt, Artificial Sequence
  Description of Artificial Sequence: Synthetic oligonucleotide
uggcugaauauauacaua

SEQ ID NO: 65695 - RNA, 18 nt, Artificial Sequence
  Description of Artificial Sequence: Synthetic oligonucleotide
cacuauggcugaauauau

SEQ ID NO: 65696 - RNA, 18 nt, Artificial Sequence
  Description of Artificial Sequence: Synthetic oligonucleotide
cccagcacuauggcugaa

SEQ ID NO: 65697 - RNA, 18 nt, Artificial Sequence
  Description of Artificial Sequence: Synthetic oligonucleotide
ugauacccagcacuaugg

SEQ ID NO: 65698 - RNA, 18 nt, Artificial Sequence
  Description of Artificial Sequence: Synthetic oligonucleotide
acagcugauacccagcac

SEQ ID NO: 65699 - RNA, 18 nt, Artificial Sequence
  Description of Artificial Sequence: Synthetic oligonucleotide
augggacagcugauaccc

SEQ ID NO: 65700 - RNA, 18 nt, Artificial Sequence
  Description of Artificial Sequence: Synthetic oligonucleotide
gacagaugggacagcuga

SEQ ID NO: 65701 - RNA, 18 nt, Artificial Sequence
  Description of Artificial Sequence: Synthetic oligonucleotide
auggugacagaugggaca

SEQ ID NO: 65702 - RNA, 18 nt, Artificial Sequence
  Description of Artificial Sequence: Synthetic oligonucleotide
ggaauauggugacagaug

SEQ ID NO: 65703 - RNA, 18 nt, Artificial Sequence
  Description of Artificial Sequence: Synthetic oligonucleotide
cccccggaauauggugac

SEQ ID NO: 65704 - RNA, 18 nt, Artificial Sequence
  Description of Artificial Sequence: Synthetic oligonucleotide
cugggcccccggaauaug

SEQ ID NO: 65705 - RNA, 18 nt, Artificial Sequence
  Description of Artificial Sequence: Synthetic oligonucleotide
ccacccugggcccccgga

SEQ ID NO: 65706 - RNA, 18 nt, Artificial Sequence
  Description of Artificial Sequence: Synthetic oligonucleotide
uuuagccacccugggccc

SEQ ID NO: 65707 - RNA, 18 nt, Artificial Sequence
  Description of Artificial Sequence: Synthetic oligonucleotide
ucacuuuuagccacccug

SEQ ID NO: 65708 - RNA, 18 nt, Artificial Sequence
  Description of Artificial Sequence: Synthetic oligonucleotide
cagguucacuuuuagcca

SEQ ID NO: 65709 - RNA, 18 nt, Artificial Sequence
  Description of Artificial Sequence: Synthetic oligonucleotide
accuucagguucacuuuu

SEQ ID NO: 65710 - RNA, 18 nt, Artificial Sequence
  Description of Artificial Sequence: Synthetic oligonucleotide
cuggcaccuucagguuca

SEQ ID NO: 65711 - RNA, 18 nt, Artificial Sequence
  Description of Artificial Sequence: Synthetic oligonucleotide
guuaucuggcaccuucag

SEQ ID NO: 65712 - RNA, 18 nt, Artificial Sequence
  Description of Artificial Sequence: Synthetic oligonucleotide
guggaguuaucuggcacc

SEQ ID NO: 65713 - RNA, 18 nt, Artificial Sequence
  Description of Artificial Sequence: Synthetic oligonucleotide
accguguggaguuaucug

SEQ ID NO: 65714 - RNA, 18 nt, Artificial Sequence
  Description of Artificial Sequence: Synthetic oligonucleotide
cacacaccguguggaguu

SEQ ID NO: 65715 - RNA, 18 nt, Artificial Sequence
  Description of Artificial Sequence: Synthetic oligonucleotide
uuguacacacaccgugug

SEQ ID NO: 65716 - RNA, 18 nt, Artificial Sequence
  Description of Artificial Sequence: Synthetic oligonucleotide
acggcuuguacacacacc

SEQ ID NO: 65717 - RNA, 18 nt, Artificial Sequence
  Description of Artificial Sequence: Synthetic oligonucleotide
aaugcacggcuuguacac

SEQ ID NO: 65718 - RNA, 18 nt, Artificial Sequence
  Description of Artificial Sequence: Synthetic oligonucleotide
ccuucaaugcacggcuug

SEQ ID NO: 65719 - RNA, 18 nt, Artificial Sequence
  Description of Artificial Sequence: Synthetic oligonucleotide
uuuacagcucuaggcaag

SEQ ID NO: 65720 - RNA, 18 nt, Artificial Sequence
  Description of Artificial Sequence: Synthetic oligonucleotide
accucuuuacagcucuag

SEQ ID NO: 65721 - RNA, 18 nt, Artificial Sequence
  Description of Artificial Sequence: Synthetic oligonucleotide
acuccaccucuuuacagc

SEQ ID NO: 65722 - RNA, 18 nt, Artificial Sequence
  Description of Artificial Sequence: Synthetic oligonucleotide
uucugacuccaccucuuu

SEQ ID NO: 65723 - RNA, 18 nt, Artificial Sequence
  Description of Artificial Sequence: Synthetic oligonucleotide
uuggauucugacuccacc

SEQ ID NO: 65724 - RNA, 18 nt, Artificial Sequence
  Description of Artificial Sequence: Synthetic oligonucleotide
uggguuuggauucugacu

SEQ ID NO: 65725 - RNA, 18 nt, Artificial Sequence
  Description of Artificial Sequence: Synthetic oligonucleotide
ucacauggguuuggauuc

SEQ ID NO: 65726 - RNA, 18 nt, Artificial Sequence
  Description of Artificial Sequence: Synthetic oligonucleotide
guggaucacauggguuug

SEQ ID NO: 65727 - RNA, 18 nt, Artificial Sequence
  Description of Artificial Sequence: Synthetic oligonucleotide
cugauguggaucacaugg

SEQ ID NO: 65728 - RNA, 18 nt, Artificial Sequence
  Description of Artificial Sequence: Synthetic oligonucleotide
ggcuccugauguggauca

SEQ ID NO: 65729 - RNA, 18 nt, Artificial Sequence
  Description of Artificial Sequence: Synthetic oligonucleotide
gugugggcuccugaugug

SEQ ID NO: 65730 - RNA, 18 nt, Artificial Sequence
  Description of Artificial Sequence: Synthetic oligonucleotide
uaagagugugggcuccug

SEQ ID NO: 65731 - RNA, 18 nt, Artificial Sequence
  Description of Artificial Sequence: Synthetic oligonucleotide
augguuaagagugugggc

SEQ ID NO: 65732 - RNA, 18 nt, Artificial Sequence
  Description of Artificial Sequence: Synthetic oligonucleotide
augcaaugguuaagagug

SEQ ID NO: 65733 - RNA, 18 nt, Artificial Sequence
  Description of Artificial Sequence: Synthetic oligonucleotide
aauacaugcaaugguuaa

SEQ ID NO: 65734 - RNA, 18 nt, Artificial Sequence
  Description of Artificial Sequence: Synthetic oligonucleotide
caagaaauacaugcaaug

SEQ ID NO: 65735 - RNA, 18 nt, Artificial Sequence
  Description of Artificial Sequence: Synthetic oligonucleotide
agagccaagaaauacaug

SEQ ID NO: 65736 - RNA, 18 nt, Artificial Sequence
  Description of Artificial Sequence: Synthetic oligonucleotide
gaguaagagccaagaaau

SEQ ID NO: 65737 - RNA, 18 nt, Artificial Sequence
  Description of Artificial Sequence: Synthetic oligonucleotide
uuugagaguaagagccaa

SEQ ID NO: 65738 - RNA, 18 nt, Artificial Sequence
  Description of Artificial Sequence: Synthetic oligonucleotide
guuuuuuugagaguaaga

SEQ ID NO: 65739 - RNA, 18 nt, Artificial Sequence
  Description of Artificial Sequence: Synthetic oligonucleotide
aauggguuuuuuugagag

SEQ ID NO: 65740 - RNA, 18 nt, Artificial Sequence
  Description of Artificial Sequence: Synthetic oligonucleotide
uucccaauggguuuuuuu

SEQ ID NO: 65741 - RNA, 18 nt, Artificial Sequence
  Description of Artificial Sequence: Synthetic oligonucleotide
guuauuucccaauggguu

SEQ ID NO: 65742 - RNA, 18 nt, Artificial Sequence
  Description of Artificial Sequence: Synthetic oligonucleotide
uuuugguuauuucccaau

SEQ ID NO: 65743 - RNA, 18 nt, Artificial Sequence
  Description of Artificial Sequence: Synthetic oligonucleotide
ccaguuuuugguuauuuc

SEQ ID NO: 65744 - RNA, 18 nt, Artificial Sequence
  Description of Artificial Sequence: Synthetic oligonucleotide
ucuuaccaguuuuugguu

SEQ ID NO: 65745 - RNA, 18 nt, Artificial Sequence
  Description of Artificial Sequence: Synthetic oligonucleotide
cacugucuuaccaguuuu

SEQ ID NO: 65746 - RNA, 18 nt, Artificial Sequence
  Description of Artificial Sequence: Synthetic oligonucleotide
guuuacacugucuuacca

SEQ ID NO: 65747 - RNA, 18 nt, Artificial Sequence
  Description of Artificial Sequence: Synthetic oligonucleotide
uaagaguuuacacugucu

SEQ ID NO: 65748 - RNA, 18 nt, Artificial Sequence
  Description of Artificial Sequence: Synthetic oligonucleotide
acauuuaagaguuuacac

SEQ ID NO: 65749 - RNA, 18 nt, Artificial Sequence
  Description of Artificial Sequence: Synthetic oligonucleotide
cuauuacauuuaagaguu

SEQ ID NO: 65750 - RNA, 18 nt, Artificial Sequence
  Description of Artificial Sequence: Synthetic oligonucleotide
uuuaacuauuacauuuaa

SEQ ID NO: 65751 - RNA, 18 nt, Artificial Sequence
  Description of Artificial Sequence: Synthetic oligonucleotide
cauuguuuaacuauuaca

SEQ ID NO: 65752 - RNA, 18 nt, Artificial Sequence
  Description of Artificial Sequence: Synthetic oligonucleotide
ucucucauuguuuaacua

SEQ ID NO: 65753 - RNA, 18 nt, Artificial Sequence
  Description of Artificial Sequence: Synthetic oligonucleotide
agagcucucucauuguuu

SEQ ID NO: 65754 - RNA, 18 nt, Artificial Sequence
  Description of Artificial Sequence: Synthetic oligonucleotide
aucacagagcucucucau

SEQ ID NO: 65755 - RNA, 18 nt, Artificial Sequence
  Description of Artificial Sequence: Synthetic oligonucleotide
gaauaaucacagagcucu

SEQ ID NO: 65756 - RNA, 18 nt, Artificial Sequence
  Description of Artificial Sequence: Synthetic oligonucleotide
auucugaauaaucacaga

SEQ ID NO: 65757 - RNA, 18 nt, Artificial Sequence
  Description of Artificial Sequence: Synthetic oligonucleotide
gcccaauucugaauaauc

SEQ ID NO: 65758 - RNA, 18 nt, Artificial Sequence
  Description of Artificial Sequence: Synthetic oligonucleotide
aauaugcccaauucugaa

SEQ ID NO: 65759 - RNA, 18 nt, Artificial Sequence
  Description of Artificial Sequence: Synthetic oligonucleotide
gaaacaauaugcccaauu

SEQ ID NO: 65760 - RNA, 18 nt, Artificial Sequence
  Description of Artificial Sequence: Synthetic oligonucleotide
uuaaggaaacaauaugcc

SEQ ID NO: 65761 - RNA, 18 nt, Artificial Sequence
  Description of Artificial Sequence: Synthetic oligonucleotide
ccaauuuaaggaaacaau

SEQ ID NO: 65762 - RNA, 18 nt, Artificial Sequence
  Description of Artificial Sequence: Synthetic oligonucleotide
gauuuccaauuuaaggaa

SEQ ID NO: 65763 - RNA, 18 nt, Artificial Sequence
  Description of Artificial Sequence: Synthetic oligonucleotide
guuaagauuuccaauuua

SEQ ID NO: 65764 - RNA, 18 nt, Artificial Sequence
  Description of Artificial Sequence: Synthetic oligonucleotide
auacuguuaagauuucca

SEQ ID NO: 65765 - RNA, 18 nt, Artificial Sequence
  Description of Artificial Sequence: Synthetic oligonucleotide
gauauauacuguuaagau

SEQ ID NO: 65766 - RNA, 18 nt, Artificial Sequence
  Description of Artificial Sequence: Synthetic oligonucleotide
uagaggauauauacuguu

SEQ ID NO: 65767 - RNA, 18 nt, Artificial Sequence
  Description of Artificial Sequence: Synthetic oligonucleotide
uuuucuagaggauauaua

SEQ ID NO: 65768 - RNA, 18 nt, Artificial Sequence
  Description of Artificial Sequence: Synthetic oligonucleotide
ucuguuuuucuagaggau

SEQ ID NO: 65769 - RNA, 18 nt, Artificial Sequence
  Description of Artificial Sequence: Synthetic oligonucleotide
caaauucuguuuuucuag

SEQ ID NO: 65770 - RNA, 18 nt, Artificial Sequence
  Description of Artificial Sequence: Synthetic oligonucleotide
ucccccaaauucuguuuu

SEQ ID NO: 65771 - RNA, 18 nt, Artificial Sequence
  Description of Artificial Sequence: Synthetic oligonucleotide
ucaguucccccaaauucu

SEQ ID NO: 65772 - RNA, 18 nt, Artificial Sequence
  Description of Artificial Sequence: Synthetic oligonucleotide
cuuuuucaguucccccaa

SEQ ID NO: 65773 - RNA, 18 nt, Artificial Sequence
  Description of Artificial Sequence: Synthetic oligonucleotide
gucagcuuuuucaguucc

SEQ ID NO: 65774 - RNA, 18 nt, Artificial Sequence
  Description of Artificial Sequence: Synthetic oligonucleotide
uaaaggucagcuuuuuca

SEQ ID NO: 65775 - RNA, 18 nt, Artificial Sequence
  Description of Artificial Sequence: Synthetic oligonucleotide
cacauuaaaggucagcuu

SEQ ID NO: 65776 - RNA, 18 nt, Artificial Sequence
  Description of Artificial Sequence: Synthetic oligonucleotide
agaaucacauuaaagguc

SEQ ID NO: 65777 - RNA, 18 nt, Artificial Sequence
  Description of Artificial Sequence: Synthetic oligonucleotide
aauucagaaucacauuaa

SEQ ID NO: 65778 - RNA, 18 nt, Artificial Sequence
  Description of Artificial Sequence: Synthetic oligonucleotide
uccagaauucagaaucac

SEQ ID NO: 65779 - RNA, 18 nt, Artificial Sequence
  Description of Artificial Sequence: Synthetic oligonucleotide
ugaauuccagaauucaga

SEQ ID NO: 65780 - RNA, 18 nt, Artificial Sequence
  Description of Artificial Sequence: Synthetic oligonucleotide
cucacugaauuccagaau

SEQ ID NO: 65781 - RNA, 18 nt, Artificial Sequence
  Description of Artificial Sequence: Synthetic oligonucleotide
augggcucacugaauucc

SEQ ID NO: 65782 - RNA, 18 nt, Artificial Sequence
  Description of Artificial Sequence: Synthetic oligonucleotide
aagucaugggcucacuga

SEQ ID NO: 65783 - RNA, 18 nt, Artificial Sequence
  Description of Artificial Sequence: Synthetic oligonucleotide
auuaaaagucaugggcuc

SEQ ID NO: 65784 - RNA, 18 nt, Artificial Sequence
  Description of Artificial Sequence: Synthetic oligonucleotide
uauggauuaaaagucaug

SEQ ID NO: 65785 - RNA, 18 nt, Artificial Sequence
  Description of Artificial Sequence: Synthetic oligonucleotide
gugacuauggauuaaaag

SEQ ID NO: 65786 - RNA, 18 nt, Artificial Sequence
  Description of Artificial Sequence: Synthetic oligonucleotide
caaaagugacuauggauu

SEQ ID NO: 65787 - RNA, 18 nt, Artificial Sequence
  Description of Artificial Sequence: Synthetic oligonucleotide
aaaggcaaaagugacuau

SEQ ID NO: 65788 - RNA, 18 nt, Artificial Sequence
  Description of Artificial Sequence: Synthetic oligonucleotide
cauuaaaaggcaaaagug

SEQ ID NO: 65789 - RNA, 18 nt, Artificial Sequence
  Description of Artificial Sequence: Synthetic oligonucleotide
guagacauuaaaaggcaa

SEQ ID NO: 65790 - RNA, 18 nt, Artificial Sequence
  Description of Artificial Sequence: Synthetic oligonucleotide
agccuguagacauuaaaa

SEQ ID NO: 65791 - RNA, 18 nt, Artificial Sequence
  Description of Artificial Sequence: Synthetic oligonucleotide
agucuagccuguagacau

SEQ ID NO: 65792 - RNA, 18 nt, Artificial Sequence
  Description of Artificial Sequence: Synthetic oligonucleotide
uccaaagucuagccugua

SEQ ID NO: 65793 - RNA, 18 nt, Artificial Sequence
  Description of Artificial Sequence: Synthetic oligonucleotide
uauuuuccaaagucuagc

SEQ ID NO: 65794 - RNA, 18 nt, Artificial Sequence
  Description of Artificial Sequence: Synthetic oligonucleotide
uucccuauuuuccaaagu

SEQ ID NO: 65795 - RNA, 18 nt, Artificial Sequence
  Description of Artificial Sequence: Synthetic oligonucleotide
auauuuucccuauuuucc

SEQ ID NO: 65796 - RNA, 18 nt, Artificial Sequence
  Description of Artificial Sequence: Synthetic oligonucleotide
aagauauauuuucccuau

SEQ ID NO: 65797 - RNA, 18 nt, Artificial Sequence
  Description of Artificial Sequence: Synthetic oligonucleotide
ugucaaagauauauuuuc

SEQ ID NO: 65798 - RNA, 18 nt, Artificial Sequence
  Description of Artificial Sequence: Synthetic oligonucleotide
cacauugucaaagauaua

SEQ ID NO: 65799 - RNA, 18 nt, Artificial Sequence
  Description of Artificial Sequence: Synthetic oligonucleotide
agugucacauugucaaag

SEQ ID NO: 65800 - RNA, 18 nt, Artificial Sequence
  Description of Artificial Sequence: Synthetic oligonucleotide
gguuuagugucacauugu

SEQ ID NO: 65801 - RNA, 18 nt, Artificial Sequence
  Description of Artificial Sequence: Synthetic oligonucleotide
gccuugguuuagugucac

SEQ ID NO: 65802 - RNA, 18 nt, Artificial Sequence
  Description of Artificial Sequence: Synthetic oligonucleotide
ggacagccuugguuuagu

SEQ ID NO: 65803 - RNA, 18 nt, Artificial Sequence
  Description of Artificial Sequence: Synthetic oligonucleotide
gaucuggacagccuuggu

SEQ ID NO: 65804 - RNA, 18 nt, Artificial Sequence
  Description of Artificial Sequence: Synthetic oligonucleotide
cacaggaucuggacagcc

SEQ ID NO: 65805 - RNA, 18 nt, Artificial Sequence
  Description of Artificial Sequence: Synthetic oligonucleotide
caugccacaggaucugga

SEQ ID NO: 65806 - RNA, 18 nt, Artificial Sequence
  Description of Artificial Sequence: Synthetic oligonucleotide
gcaaucaugccacaggau

SEQ ID NO: 65807 - RNA, 18 nt, Artificial Sequence
  Description of Artificial Sequence: Synthetic oligonucleotide
caacugcaaucaugccac

SEQ ID NO: 65808 - RNA, 18 nt, Artificial Sequence
  Description of Artificial Sequence: Synthetic oligonucleotide
agaggcaacugcaaucau

SEQ ID NO: 65809 - RNA, 18 nt, Artificial Sequence
  Description of Artificial Sequence: Synthetic oligonucleotide
ugaaaagaggcaacugca

SEQ ID NO: 65810 - RNA, 18 nt, Artificial Sequence
  Description of Artificial Sequence: Synthetic oligonucleotide
aacagugaaaagaggcaa

SEQ ID NO: 65811 - RNA, 18 nt, Artificial Sequence
  Description of Artificial Sequence: Synthetic oligonucleotide
cuuggaacagugaaaaga

SEQ ID NO: 65812 - RNA, 18 nt, Artificial Sequence
  Description of Artificial Sequence: Synthetic oligonucleotide
ucagucuuggaacaguga

SEQ ID NO: 65813 - RNA, 18 nt, Artificial Sequence
  Description of Artificial Sequence: Synthetic oligonucleotide
cuaaaucagucuuggaac

SEQ ID NO: 65814 - RNA, 18 nt, Artificial Sequence
  Description of Artificial Sequence: Synthetic oligonucleotide
ucguccuaaaucagucuu

SEQ ID NO: 65815 - RNA, 18 nt, Artificial Sequence
  Description of Artificial Sequence: Synthetic oligonucleotide
acaggucguccuaaauca

SEQ ID NO: 65816 - RNA, 18 nt, Artificial Sequence
  Description of Artificial Sequence: Synthetic oligonucleotide
uaucaugguacucugaug

SEQ ID NO: 65817 - RNA, 18 nt, Artificial Sequence
  Description of Artificial Sequence: Synthetic oligonucleotide
caugauaucaugguacuc

SEQ ID NO: 65818 - RNA, 18 nt, Artificial Sequence
  Description of Artificial Sequence: Synthetic oligonucleotide
ggauacaugauaucaugg

SEQ ID NO: 65819 - RNA, 18 nt, Artificial Sequence
  Description of Artificial Sequence: Synthetic oligonucleotide
aagcaggauacaugauau

SEQ ID NO: 65820 - RNA, 18 nt, Artificial Sequence
  Description of Artificial Sequence: Synthetic oligonucleotide
uguccaagcaggauacau

SEQ ID NO: 65821 - RNA, 18 nt, Artificial Sequence
  Description of Artificial Sequence: Synthetic oligonucleotide
caaaauguccaagcagga

SEQ ID NO: 65822 - RNA, 18 nt, Artificial Sequence
  Description of Artificial Sequence: Synthetic oligonucleotide
cuucccaaaauguccaag

SEQ ID NO: 65823 - RNA, 18 nt, Artificial Sequence
  Description of Artificial Sequence: Synthetic oligonucleotide
ucccccuucccaaaaugu

SEQ ID NO: 65824 - RNA, 18 nt, Artificial Sequence
  Description of Artificial Sequence: Synthetic oligonucleotide
gcaggucccccuucccaa

SEQ ID NO: 65825 - RNA, 18 nt, Artificial Sequence
  Description of Artificial Sequence: Synthetic oligonucleotide
aaacagcaggucccccuu

SEQ ID NO: 65826 - RNA, 18 nt, Artificial Sequence
  Description of Artificial Sequence: Synthetic oligonucleotide
uggccaaacagcaggucc

SEQ ID NO: 65827 - RNA, 18 nt, Artificial Sequence
  Description of Artificial Sequence: Synthetic oligonucleotide
uaaauuggccaaacagca

SEQ ID NO: 65828 - RNA, 18 nt, Artificial Sequence
  Description of Artificial Sequence: Synthetic oligonucleotide
uaggauaaauuggccaaa

SEQ ID NO: 65829 - RNA, 18 nt, Artificial Sequence
  Description of Artificial Sequence: Synthetic oligonucleotide
accuguaggauaaauugg

SEQ ID NO: 65830 - RNA, 18 nt, Artificial Sequence
  Description of Artificial Sequence: Synthetic oligonucleotide
ccaagaccuguaggauaa

SEQ ID NO: 65831 - RNA, 18 nt, Artificial Sequence
  Description of Artificial Sequence: Synthetic oligonucleotide
accguccaagaccuguag

SEQ ID NO: 65832 - RNA, 18 nt, Artificial Sequence
  Description of Artificial Sequence: Synthetic oligonucleotide
gucccaccguccaagacc

SEQ ID NO: 65833 - RNA, 18 nt, Artificial Sequence
  Description of Artificial Sequence: Synthetic oligonucleotide
aagaggucccaccgucca

SEQ ID NO: 65834 - RNA, 18 nt, Artificial Sequence
  Description of Artificial Sequence: Synthetic oligonucleotide
cucugaagaggucccacc

SEQ ID NO: 65835 - RNA, 18 nt, Artificial Sequence
  Description of Artificial Sequence: Synthetic oligonucleotide
aucuucucugaagagguc

SEQ ID NO: 65836 - RNA, 18 nt, Artificial Sequence
  Description of Artificial Sequence: Synthetic oligonucleotide
accagaucuucucugaag

SEQ ID NO: 65837 - RNA, 18 nt, Artificial Sequence
  Description of Artificial Sequence: Synthetic oligonucleotide
uaucaugguacucugaug

SEQ ID NO: 65838 - RNA, 18 nt, Artificial Sequence
  Description of Artificial Sequence: Synthetic oligonucleotide
caugauaucaugguacuc

SEQ ID NO: 65839 - RNA, 18 nt, Artificial Sequence
  Description of Artificial Sequence: Synthetic oligonucleotide
ggauacaugauaucaugg

SEQ ID NO: 65840 - RNA, 18 nt, Artificial Sequence
  Description of Artificial Sequence: Synthetic oligonucleotide
aagcaggauacaugauau

SEQ ID NO: 65841 - RNA, 18 nt, Artificial Sequence
  Description of Artificial Sequence: Synthetic oligonucleotide
uguccaagcaggauacau

SEQ ID NO: 65842 - RNA, 18 nt, Artificial Sequence
  Description of Artificial Sequence: Synthetic oligonucleotide
caaaauguccaagcagga

SEQ ID NO: 65843 - RNA, 18 nt, Artificial Sequence
  Description of Artificial Sequence: Synthetic oligonucleotide
cuucccaaaauguccaag

SEQ ID NO: 65844 - RNA, 18 nt, Artificial Sequence
  Description of Artificial Sequence: Synthetic oligonucleotide
ucccccuucccaaaaugu

SEQ ID NO: 65845 - RNA, 18 nt, Artificial Sequence
  Description of Artificial Sequence: Synthetic oligonucleotide
gcaggucccccuucccaa

SEQ ID NO: 65846 - RNA, 18 nt, Artificial Sequence
  Description of Artificial Sequence: Synthetic oligonucleotide
aaacagcaggucccccuu

SEQ ID NO: 65847 - RNA, 18 nt, Artificial Sequence
  Description of Artificial Sequence: Synthetic oligonucleotide
uggccaaacagcaggucc

SEQ ID NO: 65848 - RNA, 18 nt, Artificial Sequence
  Description of Artificial Sequence: Synthetic oligonucleotide
uaaauuggccaaacagca

SEQ ID NO: 65849 - RNA, 18 nt, Artificial Sequence
  Description of Artificial Sequence: Synthetic oligonucleotide
uaggauaaauuggccaaa

SEQ ID NO: 65850 - RNA, 18 nt, Artificial Sequence
  Description of Artificial Sequence: Synthetic oligonucleotide
accuguaggauaaauugg

SEQ ID NO: 65851 - RNA, 18 nt, Artificial Sequence
  Description of Artificial Sequence: Synthetic oligonucleotide
ccaagaccuguaggauaa

SEQ ID NO: 65852 - RNA, 18 nt, Artificial Sequence
  Description of Artificial Sequence: Synthetic oligonucleotide
accguccaagaccuguag

SEQ ID NO: 65853 - RNA, 18 nt, Artificial Sequence
  Description of Artificial Sequence: Synthetic oligonucleotide
gucccaccguccaagacc

SEQ ID NO: 65854 - RNA, 18 nt, Artificial Sequence
  Description of Artificial Sequence: Synthetic oligonucleotide
aagaggucccaccgucca

SEQ ID NO: 65855 - RNA, 18 nt, Artificial Sequence
  Description of Artificial Sequence: Synthetic oligonucleotide
cucugaagaggucccacc

SEQ ID NO: 65856 - RNA, 18 nt, Artificial Sequence
  Description of Artificial Sequence: Synthetic oligonucleotide
aucuucucugaagagguc

SEQ ID NO: 65857 - RNA, 18 nt, Artificial Sequence
  Description of Artificial Sequence: Synthetic oligonucleotide
accagaucuucucugaag

SEQ ID NO: 65858 - RNA, 18 nt, Artificial Sequence
  Description of Artificial Sequence: Synthetic oligonucleotide
uaaaaccucuuuaaagga

SEQ ID NO: 65859 - RNA, 18 nt, Artificial Sequence
  Description of Artificial Sequence: Synthetic oligonucleotide
aaaaauaaaaccucuuua

SEQ ID NO: 65860 - RNA, 18 nt, Artificial Sequence
  Description of Artificial Sequence: Synthetic oligonucleotide
agagaaaaaauaaaaccu

SEQ ID NO: 65861 - RNA, 18 nt, Artificial Sequence
  Description of Artificial Sequence: Synthetic oligonucleotide
cagaaagagaaaaaauaa

SEQ ID NO: 65862 - RNA, 18 nt, Artificial Sequence
  Description of Artificial Sequence: Synthetic oligonucleotide
aaacccagaaagagaaaa

SEQ ID NO: 65863 - RNA, 18 nt, Artificial Sequence
  Description of Artificial Sequence: Synthetic oligonucleotide
caagaaaacccagaaaga

SEQ ID NO: 65864 - RNA, 18 nt, Artificial Sequence
  Description of Artificial Sequence: Synthetic oligonucleotide
uauuucaagaaaacccag

SEQ ID NO: 65865 - RNA, 18 nt, Artificial Sequence
  Description of Artificial Sequence: Synthetic oligonucleotide
uggcuuauuucaagaaaa

SEQ ID NO: 65866 - RNA, 18 nt, Artificial Sequence
  Description of Artificial Sequence: Synthetic oligonucleotide
uucuauggcuuauuucaa

SEQ ID NO: 65867 - RNA, 18 nt, Artificial Sequence
  Description of Artificial Sequence: Synthetic oligonucleotide
uuauauucuauggcuuau

SEQ ID NO: 65868 - RNA, 18 nt, Artificial Sequence
  Description of Artificial Sequence: Synthetic oligonucleotide
auugguuauauucuaugg

SEQ ID NO: 65869 - RNA, 18 nt, Artificial Sequence
  Description of Artificial Sequence: Synthetic oligonucleotide
aaauaauugguuauauuc

SEQ ID NO: 65870 - RNA, 18 nt, Artificial Sequence
  Description of Artificial Sequence: Synthetic oligonucleotide
aaaguaaauaauugguua

SEQ ID NO: 65871 - RNA, 18 nt, Artificial Sequence
  Description of Artificial Sequence: Synthetic oligonucleotide
aaaaaaaaguaaauaauu

SEQ ID NO: 65872 - RNA, 18 nt, Artificial Sequence
  Description of Artificial Sequence: Synthetic oligonucleotide
aaaaaaaaaaaaaguaaa

SEQ ID NO: 65873 - RNA, 18 nt, Artificial Sequence
  Description of Artificial Sequence: Synthetic oligonucleotide
gucucaaaaaaaaaaaaa

SEQ ID NO: 65874 - RNA, 18 nt, Artificial Sequence
  Description of Artificial Sequence: Synthetic oligonucleotide
acuccgucucaaaaaaaa

SEQ ID NO: 65875 - RNA, 18 nt, Artificial Sequence
  Description of Artificial Sequence: Synthetic oligonucleotide
gcgaaacuccgucucaaa

SEQ ID NO: 65876 - RNA, 18 nt, Artificial Sequence
  Description of Artificial Sequence: Synthetic oligonucleotide
aaagggcgaaacuccguc

SEQ ID NO: 65877 - RNA, 18 nt, Artificial Sequence
  Description of Artificial Sequence: Synthetic oligonucleotide
ggcaaaaagggcgaaacu

SEQ ID NO: 65878 - RNA, 18 nt, Artificial Sequence
  Description of Artificial Sequence: Synthetic oligonucleotide
gccugggcaaaaagggcg

SEQ ID NO: 65879 - RNA, 18 nt, Artificial Sequence
  Description of Artificial Sequence: Synthetic oligonucleotide
cucuagccugggcaaaaa

SEQ ID NO: 65880 - RNA, 18 nt, Artificial Sequence
  Description of Artificial Sequence: Synthetic oligonucleotide
uugcacucuagccugggc

SEQ ID NO: 65881 - RNA, 18 nt, Artificial Sequence
  Description of Artificial Sequence: Synthetic oligonucleotide
cgccauugcacucuagcc

SEQ ID NO: 65882 - RNA, 18 nt, Artificial Sequence
  Description of Artificial Sequence: Synthetic oligonucleotide
gaucacgccauugcacuc

SEQ ID NO: 65883 - RNA, 18 nt, Artificial Sequence
  Description of Artificial Sequence: Synthetic oligonucleotide
gcugagaucacgccauug

SEQ ID NO: 65884 - RNA, 18 nt, Artificial Sequence
  Description of Artificial Sequence: Synthetic oligonucleotide
ggugagcugagaucacgc

SEQ ID NO: 65885 - RNA, 18 nt, Artificial Sequence
  Description of Artificial Sequence: Synthetic oligonucleotide
guugcggugagcugagau

SEQ ID NO: 65886 - RNA, 18 nt, Artificial Sequence
  Description of Artificial Sequence: Synthetic oligonucleotide
cggagguugcggugagcu

SEQ ID NO: 65887 - RNA, 18 nt, Artificial Sequence
  Description of Artificial Sequence: Synthetic oligonucleotide
ggaggcggagguugcggu

SEQ ID NO: 65888 - RNA, 18 nt, Artificial Sequence
  Description of Artificial Sequence: Synthetic oligonucleotide
accugggaggcggagguu

SEQ ID NO: 65889 - RNA, 18 nt, Artificial Sequence
  Description of Artificial Sequence: Synthetic oligonucleotide
cuugaaccugggaggcgg

SEQ ID NO: 65890 - RNA, 18 nt, Artificial Sequence
  Description of Artificial Sequence: Synthetic oligonucleotide
aaucacuugaaccuggga

SEQ ID NO: 65891 - RNA, 18 nt, Artificial Sequence
  Description of Artificial Sequence: Synthetic oligonucleotide
aagagaaucacuugaacc

SEQ ID NO: 65892 - RNA, 18 nt, Artificial Sequence
  Description of Artificial Sequence: Synthetic oligonucleotide
gaggcaagagaaucacuu

SEQ ID NO: 65893 - RNA, 18 nt, Artificial Sequence
  Description of Artificial Sequence: Synthetic oligonucleotide
aggcugaggcaagagaau

SEQ ID NO: 65894 - RNA, 18 nt, Artificial Sequence
  Description of Artificial Sequence: Synthetic oligonucleotide
ucgggaggcugaggcaag

SEQ ID NO: 65895 - RNA, 18 nt, Artificial Sequence
  Description of Artificial Sequence: Synthetic oligonucleotide
gcuacucgggaggcugag

SEQ ID NO: 65896 - RNA, 18 nt, Artificial Sequence
  Description of Artificial Sequence: Synthetic oligonucleotide
ucccagcuacucgggagg

SEQ ID NO: 65897 - RNA, 18 nt, Artificial Sequence
  Description of Artificial Sequence: Synthetic oligonucleotide
uguaaucccagcuacucg

SEQ ID NO: 65898 - RNA, 18 nt, Artificial Sequence
  Description of Artificial Sequence: Synthetic oligonucleotide
augccuguaaucccagcu

SEQ ID NO: 65899 - RNA, 18 nt, Artificial Sequence
  Description of Artificial Sequence: Synthetic oligonucleotide
ggcacaugccuguaaucc

SEQ ID NO: 65900 - RNA, 18 nt, Artificial Sequence
  Description of Artificial Sequence: Synthetic oligonucleotide
gugguggcacaugccugu

SEQ ID NO: 65901 - RNA, 18 nt, Artificial Sequence
  Description of Artificial Sequence: Synthetic oligonucleotide
cgggugugguggcacaug

SEQ ID NO: 65902 - RNA, 18 nt, Artificial Sequence
  Description of Artificial Sequence: Synthetic oligonucleotide
uuagccgggugugguggc

SEQ ID NO: 65903 - RNA, 18 nt, Artificial Sequence
  Description of Artificial Sequence: Synthetic oligonucleotide
cgaaauuagccgggugug

SEQ ID NO: 65904 - RNA, 18 nt, Artificial Sequence
  Description of Artificial Sequence: Synthetic oligonucleotide
aaauacgaaauuagccgg

SEQ ID NO: 65905 - RNA, 18 nt, Artificial Sequence
  Description of Artificial Sequence: Synthetic oligonucleotide
acuaaaaauacgaaauua

SEQ ID NO: 65906 - RNA, 18 nt, Artificial Sequence
  Description of Artificial Sequence: Synthetic oligonucleotide
ucucuacuaaaaauacga

SEQ ID NO: 65907 - RNA, 18 nt, Artificial Sequence
  Description of Artificial Sequence: Synthetic oligonucleotide
ccccgucucuacuaaaaa

SEQ ID NO: 65908 - RNA, 18 nt, Artificial Sequence
  Description of Artificial Sequence: Synthetic oligonucleotide
agacaccccgucucuacu

SEQ ID NO: 65909 - RNA, 18 nt, Artificial Sequence
  Description of Artificial Sequence: Synthetic oligonucleotide
cauggagacaccccgucu

SEQ ID NO: 65910 - RNA, 18 nt, Artificial Sequence
  Description of Artificial Sequence: Synthetic oligonucleotide
accaacauggagacaccc

SEQ ID NO: 65911 - RNA, 18 nt, Artificial Sequence
  Description of Artificial Sequence: Synthetic oligonucleotide
gccugaccaacauggaga

SEQ ID NO: 65912 - RNA, 18 nt, Artificial Sequence
  Description of Artificial Sequence: Synthetic oligonucleotide
gaccagccugaccaacau

SEQ ID NO: 65913 - RNA, 18 nt, Artificial Sequence
  Description of Artificial Sequence: Synthetic oligonucleotide
uucaagaccagccugacc

SEQ ID NO: 65914 - RNA, 18 nt, Artificial Sequence
  Description of Artificial Sequence: Synthetic oligonucleotide
aggaguucaagaccagcc

SEQ ID NO: 65915 - RNA, 18 nt, Artificial Sequence
  Description of Artificial Sequence: Synthetic oligonucleotide
aggucaggaguucaagac

SEQ ID NO: 65916 - RNA, 18 nt, Artificial Sequence
  Description of Artificial Sequence: Synthetic oligonucleotide
accugaggucaggaguuc

SEQ ID NO: 65917 - RNA, 18 nt, Artificial Sequence
  Description of Artificial Sequence: Synthetic oligonucleotide
agaucaccugaggucagg

SEQ ID NO: 65918 - RNA, 18 nt, Artificial Sequence
  Description of Artificial Sequence: Synthetic oligonucleotide
ugggcagaucaccugagg

SEQ ID NO: 65919 - RNA, 18 nt, Artificial Sequence
  Description of Artificial Sequence: Synthetic oligonucleotide
ugaggugggcagaucacc

SEQ ID NO: 65920 - RNA, 18 nt, Artificial Sequence
  Description of Artificial Sequence: Synthetic oligonucleotide
gaggcugaggugggcaga

SEQ ID NO: 65921 - RNA, 18 nt, Artificial Sequence
  Description of Artificial Sequence: Synthetic oligonucleotide
uuugggaggcugaggugg

SEQ ID NO: 65922 - RNA, 18 nt, Artificial Sequence
  Description of Artificial Sequence: Synthetic oligonucleotide
agcacuuugggaggcuga

SEQ ID NO: 65923 - RNA, 18 nt, Artificial Sequence
  Description of Artificial Sequence: Synthetic oligonucleotide
aucccagcacuuugggag

SEQ ID NO: 65924 - RNA, 18 nt, Artificial Sequence
  Description of Artificial Sequence: Synthetic oligonucleotide
cuguaaucccagcacuuu

SEQ ID NO: 65925 - RNA, 18 nt, Artificial Sequence
  Description of Artificial Sequence: Synthetic oligonucleotide
cacgccuguaaucccagc

SEQ ID NO: 65926 - RNA, 18 nt, Artificial Sequence
  Description of Artificial Sequence: Synthetic oligonucleotide
uggcucacgccuguaauc

SEQ ID NO: 65927 - RNA, 18 nt, Artificial Sequence
  Description of Artificial Sequence: Synthetic oligonucleotide
cgcgguggcucacgccug

SEQ ID NO: 65928 - RNA, 18 nt, Artificial Sequence
  Description of Artificial Sequence: Synthetic oligonucleotide
cugggcgcgguggcucac

SEQ ID NO: 65929 - RNA, 18 nt, Artificial Sequence
  Description of Artificial Sequence: Synthetic oligonucleotide
auaggcugggcgcggugg

SEQ ID NO: 65930 - RNA, 18 nt, Artificial Sequence
  Description of Artificial Sequence: Synthetic oligonucleotide
aauaaauaggcugggcgc

SEQ ID NO: 65931 - RNA, 18 nt, Artificial Sequence
  Description of Artificial Sequence: Synthetic oligonucleotide
uuaaaaauaaauaggcug

SEQ ID NO: 65932 - RNA, 18 nt, Artificial Sequence
  Description of Artificial Sequence: Synthetic oligonucleotide
gucacuuaaaaauaaaua

SEQ ID NO: 65933 - RNA, 18 nt, Artificial Sequence
  Description of Artificial Sequence: Synthetic oligonucleotide
aauuagucacuuaaaaau

SEQ ID NO: 65934 - RNA, 18 nt, Artificial Sequence
  Description of Artificial Sequence: Synthetic oligonucleotide
uuaaaaauuagucacuua

SEQ ID NO: 65935 - RNA, 18 nt, Artificial Sequence
  Description of Artificial Sequence: Synthetic oligonucleotide
uuaacuuaaaaauuaguc

SEQ ID NO: 65936 - RNA, 18 nt, Artificial Sequence
  Description of Artificial Sequence: Synthetic oligonucleotide
aauuuuuaacuuaaaaau

SEQ ID NO: 65937 - RNA, 18 nt, Artificial Sequence
  Description of Artificial Sequence: Synthetic oligonucleotide
ucuuuaauuuuuaacuua

SEQ ID NO: 65938 - RNA, 18 nt, Artificial Sequence
  Description of Artificial Sequence: Synthetic oligonucleotide
uucugucuuuaauuuuua

SEQ ID NO: 65939 - RNA, 18 nt, Artificial Sequence
  Description of Artificial Sequence: Synthetic oligonucleotide
caguuuucugucuuuaau

SEQ ID NO: 65940 - RNA, 18 nt, Artificial Sequence
  Description of Artificial Sequence: Synthetic oligonucleotide
cacuacaguuuucugucu

SEQ ID NO: 65941 - RNA, 18 nt, Artificial Sequence
  Description of Artificial Sequence: Synthetic oligonucleotide
guuuacacuacaguuuuc

SEQ ID NO: 65942 - RNA, 18 nt, Artificial Sequence
  Description of Artificial Sequence: Synthetic oligonucleotide
aaauuguuuacacuacag

SEQ ID NO: 65943 - RNA, 18 nt, Artificial Sequence
  Description of Artificial Sequence: Synthetic oligonucleotide
guacaaaauuguuuacac

SEQ ID NO: 65944 - RNA, 18 nt, Artificial Sequence
  Description of Artificial Sequence: Synthetic oligonucleotide
gacacguacaaaauuguu

SEQ ID NO: 65945 - RNA, 18 nt, Artificial Sequence
  Description of Artificial Sequence: Synthetic oligonucleotide
uauuagacacguacaaaa

SEQ ID NO: 65946 - RNA, 18 nt, Artificial Sequence
  Description of Artificial Sequence: Synthetic oligonucleotide
aauauuauuagacacgua

SEQ ID NO: 65947 - RNA, 18 nt, Artificial Sequence
  Description of Artificial Sequence: Synthetic oligonucleotide
auguaaauauuauuagac

SEQ ID NO: 65948 - RNA, 18 nt, Artificial Sequence
  Description of Artificial Sequence: Synthetic oligonucleotide
uggauauguaaauauuau

SEQ ID NO: 65949 - RNA, 18 nt, Artificial Sequence
  Description of Artificial Sequence: Synthetic oligonucleotide
uucuauggauauguaaau

SEQ ID NO: 65950 - RNA, 18 nt, Artificial Sequence
  Description of Artificial Sequence: Synthetic oligonucleotide
ccccuuucuauggauaug

SEQ ID NO: 65951 - RNA, 18 nt, Artificial Sequence
  Description of Artificial Sequence: Synthetic oligonucleotide
uucugccccuuucuaugg

SEQ ID NO: 65952 - RNA, 18 nt, Artificial Sequence
  Description of Artificial Sequence: Synthetic oligonucleotide
gacuauucugccccuuuc

SEQ ID NO: 65953 - RNA, 18 nt, Artificial Sequence
  Description of Artificial Sequence: Synthetic oligonucleotide
ggauagacuauucugccc

SEQ ID NO: 65954 - RNA, 18 nt, Artificial Sequence
  Description of Artificial Sequence: Synthetic oligonucleotide
guuuaggauagacuauuc

SEQ ID NO: 65955 - RNA, 18 nt, Artificial Sequence
  Description of Artificial Sequence: Synthetic oligonucleotide
ugauaguuuaggauagac

SEQ ID NO: 65956 - RNA, 18 nt, Artificial Sequence
  Description of Artificial Sequence: Synthetic oligonucleotide
auugcugauaguuuagga

SEQ ID NO: 65957 - RNA, 18 nt, Artificial Sequence
  Description of Artificial Sequence: Synthetic oligonucleotide
gcuacccaguuguaucua

SEQ ID NO: 65958 - RNA, 18 nt, Artificial Sequence
  Description of Artificial Sequence: Synthetic oligonucleotide
gaggugcuacccaguugu

SEQ ID NO: 65959 - RNA, 18 nt, Artificial Sequence
  Description of Artificial Sequence: Synthetic oligonucleotide
cucuggaggugcuaccca

SEQ ID NO: 65960 - RNA, 18 nt, Artificial Sequence
  Description of Artificial Sequence: Synthetic oligonucleotide
cauugcucuggaggugcu

SEQ ID NO: 65961 - RNA, 18 nt, Artificial Sequence
  Description of Artificial Sequence: Synthetic oligonucleotide
cauuucauugcucuggag

SEQ ID NO: 65962 - RNA, 18 nt, Artificial Sequence
  Description of Artificial Sequence: Synthetic oligonucleotide
gcuaccauuucauugcuc

SEQ ID NO: 65963 - RNA, 18 nt, Artificial Sequence
  Description of Artificial Sequence: Synthetic oligonucleotide
cuuuugcuaccauuucau

SEQ ID NO: 65964 - RNA, 18 nt, Artificial Sequence
  Description of Artificial Sequence: Synthetic oligonucleotide
guuuccuuuugcuaccau

SEQ ID NO: 65965 - RNA, 18 nt, Artificial Sequence
  Description of Artificial Sequence: Synthetic oligonucleotide
acuuuguuuccuuuugcu

SEQ ID NO: 65966 - RNA, 18 nt, Artificial Sequence
  Description of Artificial Sequence: Synthetic oligonucleotide
aggacacuuuguuuccuu

SEQ ID NO: 65967 - RNA, 18 nt, Artificial Sequence
  Description of Artificial Sequence: Synthetic oligonucleotide
ccuaaaggacacuuuguu

SEQ ID NO: 65968 - RNA, 18 nt, Artificial Sequence
  Description of Artificial Sequence: Synthetic oligonucleotide
aaagcccuaaaggacacu

SEQ ID NO: 65969 - RNA, 18 nt, Artificial Sequence
  Description of Artificial Sequence: Synthetic oligonucleotide
aagaaaaagcccuaaagg

SEQ ID NO: 65970 - RNA, 18 nt, Artificial Sequence
  Description of Artificial Sequence: Synthetic oligonucleotide
cucaaaagaaaaagcccu

SEQ ID NO: 65971 - RNA, 18 nt, Artificial Sequence
  Description of Artificial Sequence: Synthetic oligonucleotide
agucacucaaaagaaaaa

SEQ ID NO: 65972 - RNA, 18 nt, Artificial Sequence
  Description of Artificial Sequence: Synthetic oligonucleotide
aucaaagucacucaaaag

SEQ ID NO: 65973 - RNA, 18 nt, Artificial Sequence
  Description of Artificial Sequence: Synthetic oligonucleotide
gucuaaucaaagucacuc

SEQ ID NO: 65974 - RNA, 18 nt, Artificial Sequence
  Description of Artificial Sequence: Synthetic oligonucleotide
aguaagucuaaucaaagu

SEQ ID NO: 65975 - RNA, 18 nt, Artificial Sequence
  Description of Artificial Sequence: Synthetic oligonucleotide
uucuaaguaagucuaauc

SEQ ID NO: 65976 - RNA, 18 nt, Artificial Sequence
  Description of Artificial Sequence: Synthetic oligonucleotide
cauauuucuaaguaaguc

SEQ ID NO: 65977 - RNA, 18 nt, Artificial Sequence
  Description of Artificial Sequence: Synthetic oligonucleotide
agcuucauauuucuaagu

SEQ ID NO: 65978 - RNA, 18 nt, Artificial Sequence
  Description of Artificial Sequence: Synthetic oligonucleotide
gccagagcuucauauuuc

SEQ ID NO: 65979 - RNA, 18 nt, Artificial Sequence
  Description of Artificial Sequence: Synthetic oligonucleotide
gccuggccagagcuucau

SEQ ID NO: 65980 - RNA, 18 nt, Artificial Sequence
  Description of Artificial Sequence: Synthetic oligonucleotide
acugugccuggccagagc

SEQ ID NO: 65981 - RNA, 18 nt, Artificial Sequence
  Description of Artificial Sequence: Synthetic oligonucleotide
gagccacugugccuggcc

SEQ ID NO: 65982 - RNA, 18 nt, Artificial Sequence
  Description of Artificial Sequence: Synthetic oligonucleotide
ggcgugagccacugugcc

SEQ ID NO: 65983 - RNA, 18 nt, Artificial Sequence
  Description of Artificial Sequence: Synthetic oligonucleotide
uuacaggcgugagccacu

SEQ ID NO: 65984 - RNA, 18 nt, Artificial Sequence
  Description of Artificial Sequence: Synthetic oligonucleotide
ugggauuacaggcgugag

SEQ ID NO: 65985 - RNA, 18 nt, Artificial Sequence
  Description of Artificial Sequence: Synthetic oligonucleotide
agugcugggauuacaggc

SEQ ID NO: 65986 - RNA, 18 nt, Artificial Sequence
  Description of Artificial Sequence: Synthetic oligonucleotide
cccaaagugcugggauua

SEQ ID NO: 65987 - RNA, 18 nt, Artificial Sequence
  Description of Artificial Sequence: Synthetic oligonucleotide
ggccucccaaagugcugg

SEQ ID NO: 65988 - RNA, 18 nt, Artificial Sequence
  Description of Artificial Sequence: Synthetic oligonucleotide
gccucggccucccaaagu

SEQ ID NO: 65989 - RNA, 18 nt, Artificial Sequence
  Description of Artificial Sequence: Synthetic oligonucleotide
cgccugccucggccuccc

SEQ ID NO: 65990 - RNA, 18 nt, Artificial Sequence
  Description of Artificial Sequence: Synthetic oligonucleotide
ugauccgccugccucggc

SEQ ID NO: 65991 - RNA, 18 nt, Artificial Sequence
  Description of Artificial Sequence: Synthetic oligonucleotide
cuucgugauccgccugcc

SEQ ID NO: 65992 - RNA, 18 nt, Artificial Sequence
  Description of Artificial Sequence: Synthetic oligonucleotide
ccugacuucgugauccgc

SEQ ID NO: 65993 - RNA, 18 nt, Artificial Sequence
  Description of Artificial Sequence: Synthetic oligonucleotide
uaucuccugacuucguga

SEQ ID NO: 65994 - RNA, 18 nt, Artificial Sequence
  Description of Artificial Sequence: Synthetic oligonucleotide
gucucuaucuccugacuu

SEQ ID NO: 65995 - RNA, 18 nt, Artificial Sequence
  Description of Artificial Sequence: Synthetic oligonucleotide
ggauggucucuaucuccu

SEQ ID NO: 65996 - RNA, 18 nt, Artificial Sequence
  Description of Artificial Sequence: Synthetic oligonucleotide
agccaggauggucucuau

SEQ ID NO: 65997 - RNA, 18 nt, Artificial Sequence
  Description of Artificial Sequence: Synthetic oligonucleotide
guguuagccaggaugguc

SEQ ID NO: 65998 - RNA, 18 nt, Artificial Sequence
  Description of Artificial Sequence: Synthetic oligonucleotide
ucaccguguuagccagga

SEQ ID NO: 65999 - RNA, 18 nt, Artificial Sequence
  Description of Artificial Sequence: Synthetic oligonucleotide
ggguuucaccguguuagc

SEQ ID NO: 66000 - RNA, 18 nt, Artificial Sequence
  Description of Artificial Sequence: Synthetic oligonucleotide
agacaggguuucaccgug

SEQ ID NO: 66001 - RNA, 18 nt, Artificial Sequence
  Description of Artificial Sequence: Synthetic oligonucleotide
aguagagacaggguuuca

SEQ ID NO: 66002 - RNA, 18 nt, Artificial Sequence
  Description of Artificial Sequence: Synthetic oligonucleotide
uuuuuaguagagacaggg

SEQ ID NO: 66003 - RNA, 18 nt, Artificial Sequence
  Description of Artificial Sequence: Synthetic oligonucleotide
uguauuuuuuaguagaga

SEQ ID NO: 66004 - RNA, 18 nt, Artificial Sequence
  Description of Artificial Sequence: Synthetic oligonucleotide
uuuuguguauuuuuuagu

SEQ ID NO: 66005 - RNA, 18 nt, Artificial Sequence
  Description of Artificial Sequence: Synthetic oligonucleotide
gcuaauuuuguguauuuu

SEQ ID NO: 66006 - RNA, 18 nt, Artificial Sequence
  Description of Artificial Sequence: Synthetic oligonucleotide
gcccggcuaauuuugugu

SEQ ID NO: 66007 - RNA, 18 nt, Artificial Sequence
  Description of Artificial Sequence: Synthetic oligonucleotide
accacgcccggcuaauuu

SEQ ID NO: 66008 - RNA, 18 nt, Artificial Sequence
  Description of Artificial Sequence: Synthetic oligonucleotide
ccgccaccacgcccggcu

SEQ ID NO: 66009 - RNA, 18 nt, Artificial Sequence
  Description of Artificial Sequence: Synthetic oligonucleotide
ggcgcccgccaccacgcc

SEQ ID NO: 66010 - RNA, 18 nt, Artificial Sequence
  Description of Artificial Sequence: Synthetic oligonucleotide
ccacaggcgcccgccacc

SEQ ID NO: 66011 - RNA, 18 nt, Artificial Sequence
  Description of Artificial Sequence: Synthetic oligonucleotide
ugggaccacaggcgcccg

SEQ ID NO: 66012 - RNA, 18 nt, Artificial Sequence
  Description of Artificial Sequence: Synthetic oligonucleotide
guagcugggaccacaggc

SEQ ID NO: 66013 - RNA, 18 nt, Artificial Sequence
  Description of Artificial Sequence: Synthetic oligonucleotide
ccugaguagcugggacca

SEQ ID NO: 66014 - RNA, 18 nt, Artificial Sequence
  Description of Artificial Sequence: Synthetic oligonucleotide
agccuccugaguagcugg

SEQ ID NO: 66015 - RNA, 18 nt, Artificial Sequence
  Description of Artificial Sequence: Synthetic oligonucleotide
gccucagccuccugagua

SEQ ID NO: 66016 - RNA, 18 nt, Artificial Sequence
  Description of Artificial Sequence: Synthetic oligonucleotide
cuccugccucagccuccu

SEQ ID NO: 66017 - RNA, 18 nt, Artificial Sequence
  Description of Artificial Sequence: Synthetic oligonucleotide
ccauucuccugccucagc

SEQ ID NO: 66018 - RNA, 18 nt, Artificial Sequence
  Description of Artificial Sequence: Synthetic oligonucleotide
ucaugccauucuccugcc

SEQ ID NO: 66019 - RNA, 18 nt, Artificial Sequence
  Description of Artificial Sequence: Synthetic oligonucleotide
uggguucaugccauucuc

SEQ ID NO: 66020 - RNA, 18 nt, Artificial Sequence
  Description of Artificial Sequence: Synthetic oligonucleotide
cuuccuggguucaugcca

SEQ ID NO: 66021 - RNA, 18 nt, Artificial Sequence
  Description of Artificial Sequence: Synthetic oligonucleotide
cuccccuuccuggguuca

SEQ ID NO: 66022 - RNA, 18 nt, Artificial Sequence
  Description of Artificial Sequence: Synthetic oligonucleotide
gcaagcuccccuuccugg

SEQ ID NO: 66023 - RNA, 18 nt, Artificial Sequence
  Description of Artificial Sequence: Synthetic oligonucleotide
ugacugcaagcuccccuu

SEQ ID NO: 66024 - RNA, 18 nt, Artificial Sequence
  Description of Artificial Sequence: Synthetic oligonucleotide
uuggcugacugcaagcuc

SEQ ID NO: 66025 - RNA, 18 nt, Artificial Sequence
  Description of Artificial Sequence: Synthetic oligonucleotide
cgaucuuggcugacugca

SEQ ID NO: 66026 - RNA, 18 nt, Artificial Sequence
  Description of Artificial Sequence: Synthetic oligonucleotide
uggcgcgaucuuggcuga

SEQ ID NO: 66027 - RNA, 18 nt, Artificial Sequence
  Description of Artificial Sequence: Synthetic oligonucleotide
ugcaguggcgcgaucuug

SEQ ID NO: 66028 - RNA, 18 nt, Artificial Sequence
  Description of Artificial Sequence: Synthetic oligonucleotide
uggagugcaguggcgcga

SEQ ID NO: 66029 - RNA, 18 nt, Artificial Sequence
  Description of Artificial Sequence: Synthetic oligonucleotide
caggcuggagugcagugg

SEQ ID NO: 66030 - RNA, 18 nt, Artificial Sequence
  Description of Artificial Sequence: Synthetic oligonucleotide
ucguccaggcuggagugc

SEQ ID NO: 66031 - RNA, 18 nt, Artificial Sequence
  Description of Artificial Sequence: Synthetic oligonucleotide
cacugucguccaggcugg

SEQ ID NO: 66032 - RNA, 18 nt, Artificial Sequence
  Description of Artificial Sequence: Synthetic oligonucleotide
ucucgcacugucguccag

SEQ ID NO: 66033 - RNA, 18 nt, Artificial Sequence
  Description of Artificial Sequence: Synthetic oligonucleotide
cggagucucgcacugucg

SEQ ID NO: 66034 - RNA, 18 nt, Artificial Sequence
  Description of Artificial Sequence: Synthetic oligonucleotide
ugagacggagucucgcac

SEQ ID NO: 66035 - RNA, 18 nt, Artificial Sequence
  Description of Artificial Sequence: Synthetic oligonucleotide
uuuuuugagacggagucu

SEQ ID NO: 66036 - RNA, 18 nt, Artificial Sequence
  Description of Artificial Sequence: Synthetic oligonucleotide
uuuuuuuuuuugagacgg

SEQ ID NO: 66037 - RNA, 18 nt, Artificial Sequence
  Description of Artificial Sequence: Synthetic oligonucleotide
uuucuuuuuuuuuuuuga

SEQ ID NO: 66038 - RNA, 18 nt, Artificial Sequence
  Description of Artificial Sequence: Synthetic oligonucleotide
ucauauuucuuuuuuuuu

SEQ ID NO: 66039 - RNA, 18 nt, Artificial Sequence
  Description of Artificial Sequence: Synthetic oligonucleotide
gagcuucauauuucuuuu

SEQ ID NO: 66040 - RNA, 18 nt, Artificial Sequence
  Description of Artificial Sequence: Synthetic oligonucleotide
guucagagcuucauauuu

SEQ ID NO: 66041 - RNA, 18 nt, Artificial Sequence
  Description of Artificial Sequence: Synthetic oligonucleotide
gauuaguucagagcuuca

SEQ ID NO: 66042 - RNA, 18 nt, Artificial Sequence
  Description of Artificial Sequence: Synthetic oligonucleotide
cugaagauuaguucagag

SEQ ID NO: 66043 - RNA, 18 nt, Artificial Sequence
  Description of Artificial Sequence: Synthetic oligonucleotide
cauuucugaagauuaguu

SEQ ID NO: 66044 - RNA, 18 nt, Artificial Sequence
  Description of Artificial Sequence: Synthetic oligonucleotide
uuaaccauuucugaagau

SEQ ID NO: 66045 - RNA, 18 nt, Artificial Sequence
  Description of Artificial Sequence: Synthetic oligonucleotide
gugcuuuaaccauuucug

SEQ ID NO: 66046 - RNA, 18 nt, Artificial Sequence
  Description of Artificial Sequence: Synthetic oligonucleotide
agaaugugcuuuaaccau

SEQ ID NO: 66047 - RNA, 18 nt, Artificial Sequence
  Description of Artificial Sequence: Synthetic oligonucleotide
auauaagaaugugcuuua

SEQ ID NO: 66048 - RNA, 18 nt, Artificial Sequence
  Description of Artificial Sequence: Synthetic oligonucleotide
caacuauauaagaaugug

SEQ ID NO: 66049 - RNA, 18 nt, Artificial Sequence
  Description of Artificial Sequence: Synthetic oligonucleotide
uuuuucaacuauauaaga

SEQ ID NO: 66050 - RNA, 18 nt, Artificial Sequence
  Description of Artificial Sequence: Synthetic oligonucleotide
auaucuuuuucaacuaua

SEQ ID NO: 66051 - RNA, 18 nt, Artificial Sequence
  Description of Artificial Sequence: Synthetic oligonucleotide
ucaauauaucuuuuucaa

SEQ ID NO: 66052 - RNA, 18 nt, Artificial Sequence
  Description of Artificial Sequence: Synthetic oligonucleotide
uaguuucaauauaucuuu

SEQ ID NO: 66053 - RNA, 18 nt, Artificial Sequence
  Description of Artificial Sequence: Synthetic oligonucleotide
uuaauuaguuucaauaua

SEQ ID NO: 66054 - RNA, 18 nt, Artificial Sequence
  Description of Artificial Sequence: Synthetic oligonucleotide
uggccacugugcugcuga

SEQ ID NO: 66055 - RNA, 18 nt, Artificial Sequence
  Description of Artificial Sequence: Synthetic oligonucleotide
uuccauggccacugugcu

SEQ ID NO: 66056 - RNA, 18 nt, Artificial Sequence
  Description of Artificial Sequence: Synthetic oligonucleotide
ucuuuuuccauggccacu

SEQ ID NO: 66057 - RNA, 18 nt, Artificial Sequence
  Description of Artificial Sequence: Synthetic oligonucleotide
guuuuucuuuuuccaugg

SEQ ID NO: 66058 - RNA, 18 nt, Artificial Sequence
  Description of Artificial Sequence: Synthetic oligonucleotide
guagaguuuuucuuuuuc

SEQ ID NO: 66059 - RNA, 18 nt, Artificial Sequence
  Description of Artificial Sequence: Synthetic oligonucleotide
augcuguagaguuuuucu

SEQ ID NO: 66060 - RNA, 18 nt, Artificial Sequence
  Description of Artificial Sequence: Synthetic oligonucleotide
gaaauaugcuguagaguu

SEQ ID NO: 66061 - RNA, 18 nt, Artificial Sequence
  Description of Artificial Sequence: Synthetic oligonucleotide
ccucggaaauaugcugua

SEQ ID NO: 66062 - RNA, 18 nt, Artificial Sequence
  Description of Artificial Sequence: Synthetic oligonucleotide
uugauccucggaaauaug

SEQ ID NO: 66063 - RNA, 18 nt, Artificial Sequence
  Description of Artificial Sequence: Synthetic oligonucleotide
auggcccgggagccgcag

SEQ ID NO: 66064 - RNA, 18 nt, Artificial Sequence
  Description of Artificial Sequence: Synthetic oligonucleotide
caaagauggcccgggagc

SEQ ID NO: 66065 - RNA, 18 nt, Artificial Sequence
  Description of Artificial Sequence: Synthetic oligonucleotide
ccgcacaaagauggcccg

SEQ ID NO: 66066 - RNA, 18 nt, Artificial Sequence
  Description of Artificial Sequence: Synthetic oligonucleotide
cggccccgcacaaagaug

SEQ ID NO: 66067 - RNA, 18 nt, Artificial Sequence
  Description of Artificial Sequence: Synthetic oligonucleotide
aagcgcggccccgcacaa

SEQ ID NO: 66068 - RNA, 18 nt, Artificial Sequence
  Description of Artificial Sequence: Synthetic oligonucleotide
ggcggaagcgcggccccg

SEQ ID NO: 66069 - RNA, 18 nt, Artificial Sequence
  Description of Artificial Sequence: Synthetic oligonucleotide
gcgcuggcggaagcgcgg

SEQ ID NO: 66070 - RNA, 18 nt, Artificial Sequence
  Description of Artificial Sequence: Synthetic oligonucleotide
cugcggcgcuggcggaag

SEQ ID NO: 66071 - RNA, 18 nt, Artificial Sequence
  Description of Artificial Sequence: Synthetic oligonucleotide
ccccgcugcggcgcuggc

SEQ ID NO: 66072 - RNA, 18 nt, Artificial Sequence
  Description of Artificial Sequence: Synthetic oligonucleotide
agauuccccgcugcggcg

SEQ ID NO: 66073 - RNA, 18 nt, Artificial Sequence
  Description of Artificial Sequence: Synthetic oligonucleotide
acugcagauuccccgcug

SEQ ID NO: 66074 - RNA, 18 nt, Artificial Sequence
  Description of Artificial Sequence: Synthetic oligonucleotide
gaccuacugcagauuccc

SEQ ID NO: 66075 - RNA, 18 nt, Artificial Sequence
  Description of Artificial Sequence: Synthetic oligonucleotide
cggcagaccuacugcaga

SEQ ID NO: 66076 - RNA, 18 nt, Artificial Sequence
  Description of Artificial Sequence: Synthetic oligonucleotide
aucgccggcagaccuacu

SEQ ID NO: 66077 - RNA, 18 nt, Artificial Sequence
  Description of Artificial Sequence: Synthetic oligonucleotide
acuccaucgccggcagac

SEQ ID NO: 66078 - RNA, 18 nt, Artificial Sequence
  Description of Artificial Sequence: Synthetic oligonucleotide
ccaccacuccaucgccgg

SEQ ID NO: 66079 - RNA, 18 nt, Artificial Sequence
  Description of Artificial Sequence: Synthetic oligonucleotide
cuagcccaccacuccauc

SEQ ID NO: 66080 - RNA, 18 nt, Artificial Sequence
  Description of Artificial Sequence: Synthetic oligonucleotide
gcgagcuagcccaccacu

SEQ ID NO: 66081 - RNA, 18 nt, Artificial Sequence
  Description of Artificial Sequence: Synthetic oligonucleotide
aagcggcgagcuagccca

SEQ ID NO: 66082 - RNA, 18 nt, Artificial Sequence
  Description of Artificial Sequence: Synthetic oligonucleotide
agccgaagcggcgagcua

SEQ ID NO: 66083 - RNA, 18 nt, Artificial Sequence
  Description of Artificial Sequence: Synthetic oligonucleotide
gccagagccgaagcggcg

SEQ ID NO: 66084 - RNA, 18 nt, Artificial Sequence
  Description of Artificial Sequence: Synthetic oligonucleotide
cagcagccagagccgaag

SEQ ID NO: 66085 - RNA, 18 nt, Artificial Sequence
  Description of Artificial Sequence: Synthetic oligonucleotide
aacaacagcagccagagc

SEQ ID NO: 66086 - RNA, 18 nt, Artificial Sequence
  Description of Artificial Sequence: Synthetic oligonucleotide
ggaggaacaacagcagcc

SEQ ID NO: 66087 - RNA, 18 nt, Artificial Sequence
  Description of Artificial Sequence: Synthetic oligonucleotide
gggcaggaggaacaacag

SEQ ID NO: 66088 - RNA, 18 nt, Artificial Sequence
  Description of Artificial Sequence: Synthetic oligonucleotide
gcugagggcaggaggaac

SEQ ID NO: 66089 - RNA, 18 nt, Artificial Sequence
  Description of Artificial Sequence: Synthetic oligonucleotide
ccugcgcugagggcagga

SEQ ID NO: 66090 - RNA, 18 nt, Artificial Sequence
  Description of Artificial Sequence: Synthetic oligonucleotide
gcggcccugcgcugaggg

SEQ ID NO: 66091 - RNA, 18 nt, Artificial Sequence
  Description of Artificial Sequence: Synthetic oligonucleotide
uucuggcggcccugcgcu

SEQ ID NO: 66092 - RNA, 18 nt, Artificial Sequence
  Description of Artificial Sequence: Synthetic oligonucleotide
acuccuucuggcggcccu

SEQ ID NO: 66093 - RNA, 18 nt, Artificial Sequence
  Description of Artificial Sequence: Synthetic oligonucleotide
gcucggcacugcccggag

SEQ ID NO: 66094 - RNA, 18 nt, Artificial Sequence
  Description of Artificial Sequence: Synthetic oligonucleotide
ggcaggcucggcacugcc

SEQ ID NO: 66095 - RNA, 18 nt, Artificial Sequence
  Description of Artificial Sequence: Synthetic oligonucleotide
gggcaggcucggcacugc

SEQ ID NO: 66096 - RNA, 18 nt, Artificial Sequence
  Description of Artificial Sequence: Synthetic oligonucleotide
agaccccgagcccaaggg

SEQ ID NO: 66097 - RNA, 18 nt, Artificial Sequence
  Description of Artificial Sequence: Synthetic oligonucleotide
cggccagaccccgagccc

SEQ ID NO: 66098 - RNA, 18 nt, Artificial Sequence
  Description of Artificial Sequence: Synthetic oligonucleotide
gacuccggccagaccccg

SEQ ID NO: 66099 - RNA, 18 nt, Artificial Sequence
  Description of Artificial Sequence: Synthetic oligonucleotide
cucgggacuccggccaga

SEQ ID NO: 66100 - RNA, 18 nt, Artificial Sequence
  Description of Artificial Sequence: Synthetic oligonucleotide
agcgccucgggacuccgg

SEQ ID NO: 66101 - RNA, 18 nt, Artificial Sequence
  Description of Artificial Sequence: Synthetic oligonucleotide
gggagcgccucgggacuc

SEQ ID NO: 66102 - RNA, 18 nt, Artificial Sequence
  Description of Artificial Sequence: Synthetic oligonucleotide
gggagccggccgcgcggg

SEQ ID NO: 66103 - RNA, 18 nt, Artificial Sequence
  Description of Artificial Sequence: Synthetic oligonucleotide
uucccgggagccggccgc

SEQ ID NO: 66104 - RNA, 18 nt, Artificial Sequence
  Description of Artificial Sequence: Synthetic oligonucleotide
gcaucuucccgggagccg

SEQ ID NO: 66105 - RNA, 18 nt, Artificial Sequence
  Description of Artificial Sequence: Synthetic oligonucleotide
ccacggcaucuucccggg

SEQ ID NO: 66106 - RNA, 18 nt, Artificial Sequence
  Description of Artificial Sequence: Synthetic oligonucleotide
agcggccacggcaucuuc

SEQ ID NO: 66107 - RNA, 18 nt, Artificial Sequence
  Description of Artificial Sequence: Synthetic oligonucleotide
gcuacagcggccacggca

SEQ ID NO: 66108 - RNA, 18 nt, Artificial Sequence
  Description of Artificial Sequence: Synthetic oligonucleotide
uccgagcuacagcggcca

SEQ ID NO: 66109 - RNA, 18 nt, Artificial Sequence
  Description of Artificial Sequence: Synthetic oligonucleotide
ccagcuccgagcuacagc

SEQ ID NO: 66110 - RNA, 18 nt, Artificial Sequence
  Description of Artificial Sequence: Synthetic oligonucleotide
ucugcccagcuccgagcu

SEQ ID NO: 66111 - RNA, 18 nt, Artificial Sequence
  Description of Artificial Sequence: Synthetic oligonucleotide
ugccuucugcccagcucc

SEQ ID NO: 66112 - RNA, 18 nt, Artificial Sequence
  Description of Artificial Sequence: Synthetic oligonucleotide
cccggugccuucugccca

SEQ ID NO: 66113 - RNA, 18 nt, Artificial Sequence
  Description of Artificial Sequence: Synthetic oligonucleotide
ggcgccccggugccuucu

SEQ ID NO: 66114 - RNA, 18 nt, Artificial Sequence
  Description of Artificial Sequence: Synthetic oligonucleotide
cgcaaggcgccccggugc

SEQ ID NO: 66115 - RNA, 18 nt, Artificial Sequence
  Description of Artificial Sequence: Synthetic oligonucleotide
uccgccgcaaggcgcccc

SEQ ID NO: 66116 - RNA, 18 nt, Artificial Sequence
  Description of Artificial Sequence: Synthetic oligonucleotide
cacucuccgccgcaaggc

SEQ ID NO: 66117 - RNA, 18 nt, Artificial Sequence
  Description of Artificial Sequence: Synthetic oligonucleotide
caccucacucuccgccgc

SEQ ID NO: 66118 - RNA, 18 nt, Artificial Sequence
  Description of Artificial Sequence: Synthetic oligonucleotide
cccggcaccucacucucc

SEQ ID NO: 66119 - RNA, 18 nt, Artificial Sequence
  Description of Artificial Sequence: Synthetic oligonucleotide
gagaccccggcaccucac

SEQ ID NO: 66120 - RNA, 18 nt, Artificial Sequence
  Description of Artificial Sequence: Synthetic oligonucleotide
gagcagagaccccggcac

SEQ ID NO: 66121 - RNA, 18 nt, Artificial Sequence
  Description of Artificial Sequence: Synthetic oligonucleotide
agcaggagcagagacccc

SEQ ID NO: 66122 - RNA, 18 nt, Artificial Sequence
  Description of Artificial Sequence: Synthetic oligonucleotide
uccagagcaggagcagag

SEQ ID NO: 66123 - RNA, 18 nt, Artificial Sequence
  Description of Artificial Sequence: Synthetic oligonucleotide
caggguccagagcaggag

SEQ ID NO: 66124 - RNA, 18 nt, Artificial Sequence
  Description of Artificial Sequence: Synthetic oligonucleotide
cucuccaggguccagagc

SEQ ID NO: 66125 - RNA, 18 nt, Artificial Sequence
  Description of Artificial Sequence: Synthetic oligonucleotide
gguuacucuccagggucc

SEQ ID NO: 66126 - RNA, 18 nt, Artificial Sequence
  Description of Artificial Sequence: Synthetic oligonucleotide
gaauggguuacucuccag

SEQ ID NO: 66127 - RNA, 18 nt, Artificial Sequence
  Description of Artificial Sequence: Synthetic oligonucleotide
gggaauggguuacucucc

SEQ ID NO: 66128 - RNA, 18 nt, Artificial Sequence
  Description of Artificial Sequence: Synthetic oligonucleotide
gucauucugaauuccggg

SEQ ID NO: 66129 - RNA, 18 nt, Artificial Sequence
  Description of Artificial Sequence: Synthetic oligonucleotide
ucccugucauucugaauu

SEQ ID NO: 66130 - RNA, 18 nt, Artificial Sequence
  Description of Artificial Sequence: Synthetic oligonucleotide
ucuccucccugucauucu

SEQ ID NO: 66131 - RNA, 18 nt, Artificial Sequence
  Description of Artificial Sequence: Synthetic oligonucleotide
uucccucuccucccuguc

SEQ ID NO: 66132 - RNA, 18 nt, Artificial Sequence
  Description of Artificial Sequence: Synthetic oligonucleotide
gggaauucccucuccucc

SEQ ID NO: 66133 - RNA, 18 nt, Artificial Sequence
  Description of Artificial Sequence: Synthetic oligonucleotide
acgccuccugcgggugaa

SEQ ID NO: 66134 - RNA, 18 nt, Artificial Sequence
  Description of Artificial Sequence: Synthetic oligonucleotide
gggccacgccuccugcgg

SEQ ID NO: 66135 - RNA, 18 nt, Artificial Sequence
  Description of Artificial Sequence: Synthetic oligonucleotide
agcacgggccacgccucc

SEQ ID NO: 66136 - RNA, 18 nt, Artificial Sequence
  Description of Artificial Sequence: Synthetic oligonucleotide
agccaagcacgggccacg

SEQ ID NO: 66137 - RNA, 18 nt, Artificial Sequence
  Description of Artificial Sequence: Synthetic oligonucleotide
agaguagccaagcacggg

SEQ ID NO: 66138 - RNA, 18 nt, Artificial Sequence
  Description of Artificial Sequence: Synthetic oligonucleotide
gguccagaguagccaagc

SEQ ID NO: 66139 - RNA, 18 nt, Artificial Sequence
  Description of Artificial Sequence: Synthetic oligonucleotide
aggcagguccagaguagc

SEQ ID NO: 66140 - RNA, 18 nt, Artificial Sequence
  Description of Artificial Sequence: Synthetic oligonucleotide
guuucaggcagguccaga

SEQ ID NO: 66141 - RNA, 18 nt, Artificial Sequence
  Description of Artificial Sequence: Synthetic oligonucleotide
ucaguguuucaggcaggu

SEQ ID NO: 66142 - RNA, 18 nt, Artificial Sequence
  Description of Artificial Sequence: Synthetic oligonucleotide
accccucaguguuucagg

SEQ ID NO: 66143 - RNA, 18 nt, Artificial Sequence
  Description of Artificial Sequence: Synthetic oligonucleotide
ccccgaccccucaguguu

SEQ ID NO: 66144 - RNA, 18 nt, Artificial Sequence
  Description of Artificial Sequence: Synthetic oligonucleotide
cccauccccgaccccuca

SEQ ID NO: 66145 - RNA, 18 nt, Artificial Sequence
  Description of Artificial Sequence: Synthetic oligonucleotide
uugcccccauccccgacc

SEQ ID NO: 66146 - RNA, 18 nt, Artificial Sequence
  Description of Artificial Sequence: Synthetic oligonucleotide
gacauuugcccccauccc

SEQ ID NO: 66147 - RNA, 18 nt, Artificial Sequence
  Description of Artificial Sequence: Synthetic oligonucleotide
cgcacgacauuugccccc

SEQ ID NO: 66148 - RNA, 18 nt, Artificial Sequence
  Description of Artificial Sequence: Synthetic oligonucleotide
ucgcgcgcacgacauuug

SEQ ID NO: 66149 - RNA, 18 nt, Artificial Sequence
  Description of Artificial Sequence: Synthetic oligonucleotide
cacgcucgcgcgcacgac

SEQ ID NO: 66150 - RNA, 18 nt, Artificial Sequence
  Description of Artificial Sequence: Synthetic oligonucleotide
acacacacgcucgcgcgc

SEQ ID NO: 66151 - RNA, 18 nt, Artificial Sequence
  Description of Artificial Sequence: Synthetic oligonucleotide
cauauacacacacgcucg

SEQ ID NO: 66152 - RNA, 18 nt, Artificial Sequence
  Description of Artificial Sequence: Synthetic oligonucleotide
caacgcauauacacacac

SEQ ID NO: 66153 - RNA, 18 nt, Artificial Sequence
  Description of Artificial Sequence: Synthetic oligonucleotide
ucuggcaacgcauauaca

SEQ ID NO: 66154 - RNA, 18 nt, Artificial Sequence
  Description of Artificial Sequence: Synthetic oligonucleotide
ucucuucuggcaacgcau

SEQ ID NO: 66155 - RNA, 18 nt, Artificial Sequence
  Description of Artificial Sequence: Synthetic oligonucleotide
ccucuucucuucuggcaa

SEQ ID NO: 66156 - RNA, 18 nt, Artificial Sequence
  Description of Artificial Sequence: Synthetic oligonucleotide
aaaccccucuucucuucu

SEQ ID NO: 66157 - RNA, 18 nt, Artificial Sequence
  Description of Artificial Sequence: Synthetic oligonucleotide
acauuaaaccccucuucu

SEQ ID NO: 66158 - RNA, 18 nt, Artificial Sequence
  Description of Artificial Sequence: Synthetic oligonucleotide
cacgcucgcgcgcacgac

SEQ ID NO: 66159 - RNA, 18 nt, Artificial Sequence
  Description of Artificial Sequence: Synthetic oligonucleotide
acacacacgcucgcgcgc

SEQ ID NO: 66160 - RNA, 18 nt, Artificial Sequence
  Description of Artificial Sequence: Synthetic oligonucleotide
cauauacacacacgcucg

SEQ ID NO: 66161 - RNA, 18 nt, Artificial Sequence
  Description of Artificial Sequence: Synthetic oligonucleotide
caacgcauauacacacac

SEQ ID NO: 66162 - RNA, 18 nt, Artificial Sequence
  Description of Artificial Sequence: Synthetic oligonucleotide
ucuggcaacgcauauaca

SEQ ID NO: 66163 - RNA, 18 nt, Artificial Sequence
  Description of Artificial Sequence: Synthetic oligonucleotide
ucucuucuggcaacgcau

SEQ ID NO: 66164 - RNA, 18 nt, Artificial Sequence
  Description of Artificial Sequence: Synthetic oligonucleotide
ccucuucucuucuggcaa

SEQ ID NO: 66165 - RNA, 18 nt, Artificial Sequence
  Description of Artificial Sequence: Synthetic oligonucleotide
aaaccccucuucucuucu

SEQ ID NO: 66166 - RNA, 18 nt, Artificial Sequence
  Description of Artificial Sequence: Synthetic oligonucleotide
acauuaaaccccucuucu

SEQ ID NO: 66167 - RNA, 18 nt, Artificial Sequence
  Description of Artificial Sequence: Synthetic oligonucleotide
uacagacauuaaaccccu

SEQ ID NO: 66168 - RNA, 18 nt, Artificial Sequence
  Description of Artificial Sequence: Synthetic oligonucleotide
aaagcuacagacauuaaa

SEQ ID NO: 66169 - RNA, 18 nt, Artificial Sequence
  Description of Artificial Sequence: Synthetic oligonucleotide
aguuaaaagcuacagaca

SEQ ID NO: 66170 - RNA, 18 nt, Artificial Sequence
  Description of Artificial Sequence: Synthetic oligonucleotide
ggaucaguuaaaagcuac

SEQ ID NO: 66171 - RNA, 18 nt, Artificial Sequence
  Description of Artificial Sequence: Synthetic oligonucleotide
aaagaggaucaguuaaaa

SEQ ID NO: 66172 - RNA, 18 nt, Artificial Sequence
  Description of Artificial Sequence: Synthetic oligonucleotide
uccacaaagaggaucagu

SEQ ID NO: 66173 - RNA, 18 nt, Artificial Sequence
  Description of Artificial Sequence: Synthetic oligonucleotide
ugaacuccacaaagagga

SEQ ID NO: 66174 - RNA, 18 nt, Artificial Sequence
  Description of Artificial Sequence: Synthetic oligonucleotide
caaauugaacuccacaaa

SEQ ID NO: 66175 - RNA, 18 nt, Artificial Sequence
  Description of Artificial Sequence: Synthetic oligonucleotide
cuaaucaaauugaacucc

SEQ ID NO: 66176 - RNA, 18 nt, Artificial Sequence
  Description of Artificial Sequence: Synthetic oligonucleotide
uucuacuaaucaaauuga

SEQ ID NO: 66177 - RNA, 18 nt, Artificial Sequence
  Description of Artificial Sequence: Synthetic oligonucleotide
ucacuuucuacuaaucaa

SEQ ID NO: 66178 - RNA, 18 nt, Artificial Sequence
  Description of Artificial Sequence: Synthetic oligonucleotide
gacucucacuuucuacua

SEQ ID NO: 66179 - RNA, 18 nt, Artificial Sequence
  Description of Artificial Sequence: Synthetic oligonucleotide
acgcggacucucacuuuc

SEQ ID NO: 66180 - RNA, 18 nt, Artificial Sequence
  Description of Artificial Sequence: Synthetic oligonucleotide
uagugacgcggacucuca

SEQ ID NO: 66181 - RNA, 18 nt, Artificial Sequence
  Description of Artificial Sequence: Synthetic oligonucleotide
auggauagugacgcggac

SEQ ID NO: 66182 - RNA, 18 nt, Artificial Sequence
  Description of Artificial Sequence: Synthetic oligonucleotide
augcuauggauagugacg

SEQ ID NO: 66183 - RNA, 18 nt, Artificial Sequence
  Description of Artificial Sequence: Synthetic oligonucleotide
ucagaaugcuauggauag

SEQ ID NO: 66184 - RNA, 18 nt, Artificial Sequence
  Description of Artificial Sequence: Synthetic oligonucleotide
aacccucagaaugcuaug

SEQ ID NO: 66185 - RNA, 18 nt, Artificial Sequence
  Description of Artificial Sequence: Synthetic oligonucleotide
ugcucaacccucagaaug

SEQ ID NO: 66186 - RNA, 18 nt, Artificial Sequence
  Description of Artificial Sequence: Synthetic oligonucleotide
cuuaaugcucaacccuca

SEQ ID NO: 66187 - RNA, 18 nt, Artificial Sequence
  Description of Artificial Sequence: Synthetic oligonucleotide
ccaagcuuaaugcucaac

SEQ ID NO: 66188 - RNA, 18 nt, Artificial Sequence
  Description of Artificial Sequence: Synthetic oligonucleotide
aauucccaagcuuaaugc

SEQ ID NO: 66189 - RNA, 18 nt, Artificial Sequence
  Description of Artificial Sequence: Synthetic oligonucleotide
uggaaaauucccaagcuu

SEQ ID NO: 66190 - RNA, 18 nt, Artificial Sequence
  Description of Artificial Sequence: Synthetic oligonucleotide
gaaacuggaaaauuccca

SEQ ID NO: 66191 - RNA, 18 nt, Artificial Sequence
  Description of Artificial Sequence: Synthetic oligonucleotide
uccaagaaacuggaaaau

SEQ ID NO: 66192 - RNA, 18 nt, Artificial Sequence
  Description of Artificial Sequence: Synthetic oligonucleotide
agguguccaagaaacugg

SEQ ID NO: 66193 - RNA, 18 nt, Artificial Sequence
  Description of Artificial Sequence: Synthetic oligonucleotide
cugucagguguccaagaa

SEQ ID NO: 66194 - RNA, 18 nt, Artificial Sequence
  Description of Artificial Sequence: Synthetic oligonucleotide
uccggcugucaggugucc

SEQ ID NO: 66195 - RNA, 18 nt, Artificial Sequence
  Description of Artificial Sequence: Synthetic oligonucleotide
cucuauccggcugucagg

SEQ ID NO: 66196 - RNA, 18 nt, Artificial Sequence
  Description of Artificial Sequence: Synthetic oligonucleotide
uguuccucuauccggcug

SEQ ID NO: 66197 - RNA, 18 nt, Artificial Sequence
  Description of Artificial Sequence: Synthetic oligonucleotide
aagucuguuccucuaucc

SEQ ID NO: 66198 - RNA, 18 nt, Artificial Sequence
  Description of Artificial Sequence: Synthetic oligonucleotide
acgucaagucuguuccuc

SEQ ID NO: 66199 - RNA, 18 nt, Artificial Sequence
  Description of Artificial Sequence: Synthetic oligonucleotide
cgcucacgucaagucugu

SEQ ID NO: 66200 - RNA, 18 nt, Artificial Sequence
  Description of Artificial Sequence: Synthetic oligonucleotide
ucccacgcucacgucaag

SEQ ID NO: 66201 - RNA, 18 nt, Artificial Sequence
  Description of Artificial Sequence: Synthetic oligonucleotide
gcaacucccacgcucacg

SEQ ID NO: 66202 - RNA, 18 nt, Artificial Sequence
  Description of Artificial Sequence: Synthetic oligonucleotide
ugugugcaacucccacgc

SEQ ID NO: 66203 - RNA, 18 nt, Artificial Sequence
  Description of Artificial Sequence: Synthetic oligonucleotide
uuuugugugugcaacucc

SEQ ID NO: 66204 - RNA, 18 nt, Artificial Sequence
  Description of Artificial Sequence: Synthetic oligonucleotide
ggaauuuuugugugugca

SEQ ID NO: 66205 - RNA, 18 nt, Artificial Sequence
  Description of Artificial Sequence: Synthetic oligonucleotide
agggaggaauuuuugugu

SEQ ID NO: 66206 - RNA, 18 nt, Artificial Sequence
  Description of Artificial Sequence: Synthetic oligonucleotide
acgcuagggaggaauuuu

SEQ ID NO: 66207 - RNA, 18 nt, Artificial Sequence
  Description of Artificial Sequence: Synthetic oligonucleotide
acgaaacgcuagggagga

SEQ ID NO: 66208 - RNA, 18 nt, Artificial Sequence
  Description of Artificial Sequence: Synthetic oligonucleotide
uggaaacgaaacgcuagg

SEQ ID NO: 66209 - RNA, 18 nt, Artificial Sequence
  Description of Artificial Sequence: Synthetic oligonucleotide
acugauggaaacgaaacg

SEQ ID NO: 66210 - RNA, 18 nt, Artificial Sequence
  Description of Artificial Sequence: Synthetic oligonucleotide
aucccacugauggaaacg

SEQ ID NO: 66211 - RNA, 18 nt, Artificial Sequence
  Description of Artificial Sequence: Synthetic oligonucleotide
uucccaucccacugaugg

SEQ ID NO: 66212 - RNA, 18 nt, Artificial Sequence
  Description of Artificial Sequence: Synthetic oligonucleotide
uccccuucccaucccacu

SEQ ID NO: 66213 - RNA, 18 nt, Artificial Sequence
  Description of Artificial Sequence: Synthetic oligonucleotide
agaaauccccuucccauc

SEQ ID NO: 66214 - RNA, 18 nt, Artificial Sequence
  Description of Artificial Sequence: Synthetic oligonucleotide
cuuucagaaauccccuuc

SEQ ID NO: 66215 - RNA, 18 nt, Artificial Sequence
  Description of Artificial Sequence: Synthetic oligonucleotide
caaaacuuucagaaaucc

SEQ ID NO: 66216 - RNA, 18 nt, Artificial Sequence
  Description of Artificial Sequence: Synthetic oligonucleotide
aagaccaaaacuuucaga

SEQ ID NO: 66217 - RNA, 18 nt, Artificial Sequence
  Description of Artificial Sequence: Synthetic oligonucleotide
aacagaagaccaaaacuu

SEQ ID NO: 66218 - RNA, 18 nt, Artificial Sequence
  Description of Artificial Sequence: Synthetic oligonucleotide
gaagaaacagaagaccaa

SEQ ID NO: 66219 - RNA, 18 nt, Artificial Sequence
  Description of Artificial Sequence: Synthetic oligonucleotide
caacagaagaaacagaag

SEQ ID NO: 66220 - RNA, 18 nt, Artificial Sequence
  Description of Artificial Sequence: Synthetic oligonucleotide
cacaccaacagaagaaac

SEQ ID NO: 66221 - RNA, 18 nt, Artificial Sequence
  Description of Artificial Sequence: Synthetic oligonucleotide
gacaccacaccaacagaa

SEQ ID NO: 66222 - RNA, 18 nt, Artificial Sequence
  Description of Artificial Sequence: Synthetic oligonucleotide
uugcugacaccacaccaa

SEQ ID NO: 66223 - RNA, 18 nt, Artificial Sequence
  Description of Artificial Sequence: Synthetic oligonucleotide
guuauuugcugacaccac

SEQ ID NO: 66224 - RNA, 18 nt, Artificial Sequence
  Description of Artificial Sequence: Synthetic oligonucleotide
ugaauguuauuugcugac

SEQ ID NO: 66225 - RNA, 18 nt, Artificial Sequence
  Description of Artificial Sequence: Synthetic oligonucleotide
uuuccugaauguuauuug

SEQ ID NO: 66226 - RNA, 18 nt, Artificial Sequence
  Description of Artificial Sequence: Synthetic oligonucleotide
aaaauuuuccugaauguu

SEQ ID NO: 66227 - RNA, 18 nt, Artificial Sequence
  Description of Artificial Sequence: Synthetic oligonucleotide
uuaaaaaaauuuuccuga

SEQ ID NO: 66228 - RNA, 18 nt, Artificial Sequence
  Description of Artificial Sequence: Synthetic oligonucleotide
gagaguuaaaaaaauuuu

SEQ ID NO: 66229 - RNA, 18 nt, Artificial Sequence
  Description of Artificial Sequence: Synthetic oligonucleotide
uaaaugagaguuaaaaaa

SEQ ID NO: 66230 - RNA, 18 nt, Artificial Sequence
  Description of Artificial Sequence: Synthetic oligonucleotide
aauacuuuccauuuugaa

SEQ ID NO: 66231 - RNA, 18 nt, Artificial Sequence
  Description of Artificial Sequence: Synthetic oligonucleotide
caauaaauacuuuccauu

SEQ ID NO: 66232 - RNA, 18 nt, Artificial Sequence
  Description of Artificial Sequence: Synthetic oligonucleotide
uuggucaauaaauacuuu

SEQ ID NO: 66233 - RNA, 18 nt, Artificial Sequence
  Description of Artificial Sequence: Synthetic oligonucleotide
uuaauuuggucaauaaau

SEQ ID NO: 66234 - RNA, 18 nt, Artificial Sequence
  Description of Artificial Sequence: Synthetic oligonucleotide
accuguuaauuuggucaa

SEQ ID NO: 66235 - RNA, 18 nt, Artificial Sequence
  Description of Artificial Sequence: Synthetic oligonucleotide
caaagaccuguuaauuug

SEQ ID NO: 66236 - RNA, 18 nt, Artificial Sequence
  Description of Artificial Sequence: Synthetic oligonucleotide
uucuccaaagaccuguua

SEQ ID NO: 66237 - RNA, 18 nt, Artificial Sequence
  Description of Artificial Sequence: Synthetic oligonucleotide
cguaauucuccaaagacc

SEQ ID NO: 66238 - RNA, 18 nt, Artificial Sequence
  Description of Artificial Sequence: Synthetic oligonucleotide
ugguucguaauucuccaa

SEQ ID NO: 66239 - RNA, 18 nt, Artificial Sequence
  Description of Artificial Sequence: Synthetic oligonucleotide
gaacaugguucguaauuc

SEQ ID NO: 66240 - RNA, 18 nt, Artificial Sequence
  Description of Artificial Sequence: Synthetic oligonucleotide
gacuugaacaugguucgu

SEQ ID NO: 66241 - RNA, 18 nt, Artificial Sequence
  Description of Artificial Sequence: Synthetic oligonucleotide
guuuugacuugaacaugg

SEQ ID NO: 66242 - RNA, 18 nt, Artificial Sequence
  Description of Artificial Sequence: Synthetic oligonucleotide
cugcaguuuugacuugaa

SEQ ID NO: 66243 - RNA, 18 nt, Artificial Sequence
  Description of Artificial Sequence: Synthetic oligonucleotide
agcagcugcaguuuugac

SEQ ID NO: 66244 - RNA, 18 nt, Artificial Sequence
  Description of Artificial Sequence: Synthetic oligonucleotide
augguagcagcugcaguu

SEQ ID NO: 66245 - RNA, 18 nt, Artificial Sequence
  Description of Artificial Sequence: Synthetic oligonucleotide
ugcucaacaccacuacac

SEQ ID NO: 66246 - RNA, 18 nt, Artificial Sequence
  Description of Artificial Sequence: Synthetic oligonucleotide
uaaagugcucaacaccac

SEQ ID NO: 66247 - RNA, 18 nt, Artificial Sequence
  Description of Artificial Sequence: Synthetic oligonucleotide
caaaauaaagugcucaac

SEQ ID NO: 66248 - RNA, 18 nt, Artificial Sequence
  Description of Artificial Sequence: Synthetic oligonucleotide
acuuccaaaauaaagugc

SEQ ID NO: 66249 - RNA, 18 nt, Artificial Sequence
  Description of Artificial Sequence: Synthetic oligonucleotide
cgaucacuuccaaaauaa

SEQ ID NO: 66250 - RNA, 18 nt, Artificial Sequence
  Description of Artificial Sequence: Synthetic oligonucleotide
acgcccgaucacuuccaa

SEQ ID NO: 66251 - RNA, 18 nt, Artificial Sequence
  Description of Artificial Sequence: Synthetic oligonucleotide
gggagacgcccgaucacu

SEQ ID NO: 66252 - RNA, 18 nt, Artificial Sequence
  Description of Artificial Sequence: Synthetic oligonucleotide
ugucagggagacgcccga

SEQ ID NO: 66253 - RNA, 18 nt, Artificial Sequence
  Description of Artificial Sequence: Synthetic oligonucleotide
cuccaugucagggagacg

SEQ ID NO: 66254 - RNA, 18 nt, Artificial Sequence
  Description of Artificial Sequence: Synthetic oligonucleotide
accaucuccaugucaggg

SEQ ID NO: 66255 - RNA, 18 nt, Artificial Sequence
  Description of Artificial Sequence: Synthetic oligonucleotide
ugaucaccaucuccaugu

SEQ ID NO: 66256 - RNA, 18 nt, Artificial Sequence
  Description of Artificial Sequence: Synthetic oligonucleotide
uacauugaucaccaucuc

SEQ ID NO: 66257 - RNA, 18 nt, Artificial Sequence
  Description of Artificial Sequence: Synthetic oligonucleotide
ucucguacauugaucacc

SEQ ID NO: 66258 - RNA, 18 nt, Artificial Sequence
  Description of Artificial Sequence: Synthetic oligonucleotide
gauaaucucguacauuga

SEQ ID NO: 66259 - RNA, 18 nt, Artificial Sequence
  Description of Artificial Sequence: Synthetic oligonucleotide
cugaggauaaucucguac

SEQ ID NO: 66260 - RNA, 18 nt, Artificial Sequence
  Description of Artificial Sequence: Synthetic oligonucleotide
ggaaccugaggauaaucu

SEQ ID NO: 66261 - RNA, 18 nt, Artificial Sequence
  Description of Artificial Sequence: Synthetic oligonucleotide
auuuaggaaccugaggau

SEQ ID NO: 66262 - RNA, 18 nt, Artificial Sequence
  Description of Artificial Sequence: Synthetic oligonucleotide
cauccauuuaggaaccug

SEQ ID NO: 66263 - RNA, 18 nt, Artificial Sequence
  Description of Artificial Sequence: Synthetic oligonucleotide
ggcuccauccauuuagga

SEQ ID NO: 66264 - RNA, 18 nt, Artificial Sequence
  Description of Artificial Sequence: Synthetic oligonucleotide
uggcaggcuccauccauu

SEQ ID NO: 66265 - RNA, 18 nt, Artificial Sequence
  Description of Artificial Sequence: Synthetic oligonucleotide
ugggauggcaggcuccau

SEQ ID NO: 66266 - RNA, 18 nt, Artificial Sequence
  Description of Artificial Sequence: Synthetic oligonucleotide
aagacugggauggcaggc

SEQ ID NO: 66267 - RNA, 18 nt, Artificial Sequence
  Description of Artificial Sequence: Synthetic oligonucleotide
aggagaagacugggaugg

SEQ ID NO: 66268 - RNA, 18 nt, Artificial Sequence
  Description of Artificial Sequence: Synthetic oligonucleotide
acugaaggagaagacugg

SEQ ID NO: 66269 - RNA, 18 nt, Artificial Sequence
  Description of Artificial Sequence: Synthetic oligonucleotide
cauguggcucucccugua

SEQ ID NO: 66270 - RNA, 18 nt, Artificial Sequence
  Description of Artificial Sequence: Synthetic oligonucleotide
ccacccauguggcucucc

SEQ ID NO: 66271 - RNA, 18 nt, Artificial Sequence
  Description of Artificial Sequence: Synthetic oligonucleotide
uccauccacccauguggc

SEQ ID NO: 66272 - RNA, 18 nt, Artificial Sequence
  Description of Artificial Sequence: Synthetic oligonucleotide
cacucuccauccacccau

SEQ ID NO: 66273 - RNA, 18 nt, Artificial Sequence
  Description of Artificial Sequence: Synthetic oligonucleotide
aggaccacucuccaucca

SEQ ID NO: 66274 - RNA, 18 nt, Artificial Sequence
  Description of Artificial Sequence: Synthetic oligonucleotide
ccuagaggaccacucucc

SEQ ID NO: 66275 - RNA, 18 nt, Artificial Sequence
  Description of Artificial Sequence: Synthetic oligonucleotide
cauauccuagaggaccac

SEQ ID NO: 66276 - RNA, 18 nt, Artificial Sequence
  Description of Artificial Sequence: Synthetic oligonucleotide
augcucauauccuagagg

SEQ ID NO: 66277 - RNA, 18 nt, Artificial Sequence
  Description of Artificial Sequence: Synthetic oligonucleotide
aucucaugcucauauccu

SEQ ID NO: 66278 - RNA, 18 nt, Artificial Sequence
  Description of Artificial Sequence: Synthetic oligonucleotide
caaagaucucaugcucau

SEQ ID NO: 66279 - RNA, 18 nt, Artificial Sequence
  Description of Artificial Sequence: Synthetic oligonucleotide
ccggacaaagaucucaug

SEQ ID NO: 66280 - RNA, 18 nt, Artificial Sequence
  Description of Artificial Sequence: Synthetic oligonucleotide
ugucaccggacaaagauc

SEQ ID NO: 66281 - RNA, 18 nt, Artificial Sequence
  Description of Artificial Sequence: Synthetic oligonucleotide
gacuaugucaccggacaa

SEQ ID NO: 66282 - RNA, 18 nt, Artificial Sequence
  Description of Artificial Sequence: Synthetic oligonucleotide
caucagacuaugucaccg

SEQ ID NO: 66283 - RNA, 18 nt, Artificial Sequence
  Description of Artificial Sequence: Synthetic oligonucleotide
uuauccaucagacuaugu

SEQ ID NO: 66284 - RNA, 18 nt, Artificial Sequence
  Description of Artificial Sequence: Synthetic oligonucleotide
uaccauuauccaucagac

SEQ ID NO: 66285 - RNA, 18 nt, Artificial Sequence
  Description of Artificial Sequence: Synthetic oligonucleotide
auccuuaccauuauccau

SEQ ID NO: 66286 - RNA, 18 nt, Artificial Sequence
  Description of Artificial Sequence: Synthetic oligonucleotide
uccucauccuuaccauua

SEQ ID NO: 66287 - RNA, 18 nt, Artificial Sequence
  Description of Artificial Sequence: Synthetic oligonucleotide
cucaguccucauccuuac

SEQ ID NO: 66288 - RNA, 18 nt, Artificial Sequence
  Description of Artificial Sequence: Synthetic oligonucleotide
uggaccucaguccucauc

SEQ ID NO: 66289 - RNA, 18 nt, Artificial Sequence
  Description of Artificial Sequence: Synthetic oligonucleotide
auuucuggaccucagucc

SEQ ID NO: 66290 - RNA, 18 nt, Artificial Sequence
  Description of Artificial Sequence: Synthetic oligonucleotide
gacccauuucuggaccuc

SEQ ID NO: 66291 - RNA, 18 nt, Artificial Sequence
  Description of Artificial Sequence: Synthetic oligonucleotide
acacagacccauuucugg

SEQ ID NO: 66292 - RNA, 18 nt, Artificial Sequence
  Description of Artificial Sequence: Synthetic oligonucleotide
uagagacacagacccauu

SEQ ID NO: 66293 - RNA, 18 nt, Artificial Sequence
  Description of Artificial Sequence: Synthetic oligonucleotide
gcuaauagagacacagac

SEQ ID NO: 66294 - RNA, 18 nt, Artificial Sequence
  Description of Artificial Sequence: Synthetic oligonucleotide
gugaugcuaauagagaca

SEQ ID NO: 66295 - RNA, 18 nt, Artificial Sequence
  Description of Artificial Sequence: Synthetic oligonucleotide
ucacugugaugcuaauag

SEQ ID NO: 66296 - RNA, 18 nt, Artificial Sequence
  Description of Artificial Sequence: Synthetic oligonucleotide
cucaaucacugugaugcu

SEQ ID NO: 66297 - RNA, 18 nt, Artificial Sequence
  Description of Artificial Sequence: Synthetic oligonucleotide
uuuugcucaaucacugug

SEQ ID NO: 66298 - RNA, 18 nt, Artificial Sequence
  Description of Artificial Sequence: Synthetic oligonucleotide
ugucuuuuugcucaauca

SEQ ID NO: 66299 - RNA, 18 nt, Artificial Sequence
  Description of Artificial Sequence: Synthetic oligonucleotide
uccucugucuuuuugcuc

SEQ ID NO: 66300 - RNA, 18 nt, Artificial Sequence
  Description of Artificial Sequence: Synthetic oligonucleotide
ucaucuccucugucuuuu

SEQ ID NO: 66301 - RNA, 18 nt, Artificial Sequence
  Description of Artificial Sequence: Synthetic oligonucleotide
caacuucaucuccucugu

SEQ ID NO: 66302 - RNA, 18 nt, Artificial Sequence
  Description of Artificial Sequence: Synthetic oligonucleotide
gcucucaacuucaucucc

SEQ ID NO: 66303 - RNA, 18 nt, Artificial Sequence
  Description of Artificial Sequence: Synthetic oligonucleotide
uaccagcucucaacuuca

SEQ ID NO: 66304 - RNA, 18 nt, Artificial Sequence
  Description of Artificial Sequence: Synthetic oligonucleotide
cuacuuaccagcucucaa

SEQ ID NO: 66305 - RNA, 18 nt, Artificial Sequence
  Description of Artificial Sequence: Synthetic oligonucleotide
uuacacuacuuaccagcu

SEQ ID NO: 66306 - RNA, 18 nt, Artificial Sequence
  Description of Artificial Sequence: Synthetic oligonucleotide
caaucuuacacuacuuac

SEQ ID NO: 66307 - RNA, 18 nt, Artificial Sequence
  Description of Artificial Sequence: Synthetic oligonucleotide
ucaagcaaucuuacacua

SEQ ID NO: 66308 - RNA, 18 nt, Artificial Sequence
  Description of Artificial Sequence: Synthetic oligonucleotide
gacacucaagcaaucuua

SEQ ID NO: 66309 - RNA, 18 nt, Artificial Sequence
  Description of Artificial Sequence: Synthetic oligonucleotide
cuauagacacucaagcaa

SEQ ID NO: 66310 - RNA, 18 nt, Artificial Sequence
  Description of Artificial Sequence: Synthetic oligonucleotide
uagcccuauagacacuca

SEQ ID NO: 66311 - RNA, 18 nt, Artificial Sequence
  Description of Artificial Sequence: Synthetic oligonucleotide
aucucuagcccuauagac

SEQ ID NO: 66312 - RNA, 18 nt, Artificial Sequence
  Description of Artificial Sequence: Synthetic oligonucleotide
ccuccaucucuagcccua

SEQ ID NO: 66313 - RNA, 18 nt, Artificial Sequence
  Description of Artificial Sequence: Synthetic oligonucleotide
ccuagccuccaucucuag

SEQ ID NO: 66314 - RNA, 18 nt, Artificial Sequence
  Description of Artificial Sequence: Synthetic oligonucleotide
cacgcccuagccuccauc

SEQ ID NO: 66315 - RNA, 18 nt, Artificial Sequence
  Description of Artificial Sequence: Synthetic oligonucleotide
ccucucacgcccuagccu

SEQ ID NO: 66316 - RNA, 18 nt, Artificial Sequence
  Description of Artificial Sequence: Synthetic oligonucleotide
ucaggccucucacgcccu

SEQ ID NO: 66317 - RNA, 18 nt, Artificial Sequence
  Description of Artificial Sequence: Synthetic oligonucleotide
guuucucaggccucucac

SEQ ID NO: 66318 - RNA, 18 nt, Artificial Sequence
  Description of Artificial Sequence: Synthetic oligonucleotide
uguagguuucucaggccu

SEQ ID NO: 66319 - RNA, 18 nt, Artificial Sequence
  Description of Artificial Sequence: Synthetic oligonucleotide
auuccuguagguuucuca

SEQ ID NO: 66320 - RNA, 18 nt, Artificial Sequence
  Description of Artificial Sequence: Synthetic oligonucleotide
cucuaauuccuguagguu

SEQ ID NO: 66321 - RNA, 18 nt, Artificial Sequence
  Description of Artificial Sequence: Synthetic oligonucleotide
cccaccucuaauuccugu

SEQ ID NO: 66322 - RNA, 18 nt, Artificial Sequence
  Description of Artificial Sequence: Synthetic oligonucleotide
caagacccaccucuaauu

SEQ ID NO: 66323 - RNA, 18 nt, Artificial Sequence
  Description of Artificial Sequence: Synthetic oligonucleotide
aucuucaagacccaccuc

SEQ ID NO: 66324 - RNA, 18 nt, Artificial Sequence
  Description of Artificial Sequence: Synthetic oligonucleotide
guaagaucuucaagaccc

SEQ ID NO: 66325 - RNA, 18 nt, Artificial Sequence
  Description of Artificial Sequence: Synthetic oligonucleotide
gcucuguaagaucuucaa

SEQ ID NO: 66326 - RNA, 18 nt, Artificial Sequence
  Description of Artificial Sequence: Synthetic oligonucleotide
cccaugcucuguaagauc

SEQ ID NO: 66327 - RNA, 18 nt, Artificial Sequence
  Description of Artificial Sequence: Synthetic oligonucleotide
uuccucccaugcucugua

SEQ ID NO: 66328 - RNA, 18 nt, Artificial Sequence
  Description of Artificial Sequence: Synthetic oligonucleotide
accccuuccucccaugcu

SEQ ID NO: 66329 - RNA, 18 nt, Artificial Sequence
  Description of Artificial Sequence: Synthetic oligonucleotide
cuuggaccccuuccuccc

SEQ ID NO: 66330 - RNA, 18 nt, Artificial Sequence
  Description of Artificial Sequence: Synthetic oligonucleotide
gcuuucuuggaccccuuc

SEQ ID NO: 66331 - RNA, 18 nt, Artificial Sequence
  Description of Artificial Sequence: Synthetic oligonucleotide
uccaagcuuucuuggacc

SEQ ID NO: 66332 - RNA, 18 nt, Artificial Sequence
  Description of Artificial Sequence: Synthetic oligonucleotide
cuaacuccaagcuuucuu

SEQ ID NO: 66333 - RNA, 18 nt, Artificial Sequence
  Description of Artificial Sequence: Synthetic oligonucleotide
guucccuaacuccaagcu

SEQ ID NO: 66334 - RNA, 18 nt, Artificial Sequence
  Description of Artificial Sequence: Synthetic oligonucleotide
aagguguucccuaacucc

SEQ ID NO: 66335 - RNA, 18 nt, Artificial Sequence
  Description of Artificial Sequence: Synthetic oligonucleotide
gaaugaagguguucccua

SEQ ID NO: 66336 - RNA, 18 nt, Artificial Sequence
  Description of Artificial Sequence: Synthetic oligonucleotide
uuuuggaaugaagguguu

SEQ ID NO: 66337 - RNA, 18 nt, Artificial Sequence
  Description of Artificial Sequence: Synthetic oligonucleotide
caaacuuuuggaaugaag

SEQ ID NO: 66338 - RNA, 18 nt, Artificial Sequence
  Description of Artificial Sequence: Synthetic oligonucleotide
cucaacaaacuuuuggaa

SEQ ID NO: 66339 - RNA, 18 nt, Artificial Sequence
  Description of Artificial Sequence: Synthetic oligonucleotide
aggagcucaacaaacuuu

SEQ ID NO: 66340 - RNA, 18 nt, Artificial Sequence
  Description of Artificial Sequence: Synthetic oligonucleotide
auaguaggagcucaacaa

SEQ ID NO: 66341 - RNA, 18 nt, Artificial Sequence
  Description of Artificial Sequence: Synthetic oligonucleotide
uauacauaguaggagcuc

SEQ ID NO: 66342 - RNA, 18 nt, Artificial Sequence
  Description of Artificial Sequence: Synthetic oligonucleotide
gaauauauacauaguagg

SEQ ID NO: 66343 - RNA, 18 nt, Artificial Sequence
  Description of Artificial Sequence: Synthetic oligonucleotide
uggcugaauauauacaua

SEQ ID NO: 66344 - RNA, 18 nt, Artificial Sequence
  Description of Artificial Sequence: Synthetic oligonucleotide
cacuauggcugaauauau

SEQ ID NO: 66345 - RNA, 18 nt, Artificial Sequence
  Description of Artificial Sequence: Synthetic oligonucleotide
cccagcacuauggcugaa

SEQ ID NO: 66346 - RNA, 18 nt, Artificial Sequence
  Description of Artificial Sequence: Synthetic oligonucleotide
ugauacccagcacuaugg

SEQ ID NO: 66347 - RNA, 18 nt, Artificial Sequence
  Description of Artificial Sequence: Synthetic oligonucleotide
acagcugauacccagcac

SEQ ID NO: 66348 - RNA, 18 nt, Artificial Sequence
  Description of Artificial Sequence: Synthetic oligonucleotide
augggacagcugauaccc

SEQ ID NO: 66349 - RNA, 18 nt, Artificial Sequence
  Description of Artificial Sequence: Synthetic oligonucleotide
gacagaugggacagcuga

SEQ ID NO: 66350 - RNA, 18 nt, Artificial Sequence
  Description of Artificial Sequence: Synthetic oligonucleotide
auggugacagaugggaca

SEQ ID NO: 66351 - RNA, 18 nt, Artificial Sequence
  Description of Artificial Sequence: Synthetic oligonucleotide
ggaauauggugacagaug

SEQ ID NO: 66352 - RNA, 18 nt, Artificial Sequence
  Description of Artificial Sequence: Synthetic oligonucleotide
cccccggaauauggugac

SEQ ID NO: 66353 - RNA, 18 nt, Artificial Sequence
  Description of Artificial Sequence: Synthetic oligonucleotide
cugggcccccggaauaug

SEQ ID NO: 66354 - RNA, 18 nt, Artificial Sequence
  Description of Artificial Sequence: Synthetic oligonucleotide
ccacccugggcccccgga

SEQ ID NO: 66355 - RNA, 18 nt, Artificial Sequence
  Description of Artificial Sequence: Synthetic oligonucleotide
uuuagccacccugggccc

SEQ ID NO: 66356 - RNA, 18 nt, Artificial Sequence
  Description of Artificial Sequence: Synthetic oligonucleotide
ucacuuuuagccacccug

SEQ ID NO: 66357 - RNA, 18 nt, Artificial Sequence
  Description of Artificial Sequence: Synthetic oligonucleotide
cagguucacuuuuagcca

SEQ ID NO: 66358 - RNA, 18 nt, Artificial Sequence
  Description of Artificial Sequence: Synthetic oligonucleotide
accuucagguucacuuuu

SEQ ID NO: 66359 - RNA, 18 nt, Artificial Sequence
  Description of Artificial Sequence: Synthetic oligonucleotide
cuggcaccuucagguuca

SEQ ID NO: 66360 - RNA, 18 nt, Artificial Sequence
  Description of Artificial Sequence: Synthetic oligonucleotide
guuaucuggcaccuucag

SEQ ID NO: 66361 - RNA, 18 nt, Artificial Sequence
  Description of Artificial Sequence: Synthetic oligonucleotide
guggaguuaucuggcacc

SEQ ID NO: 66362 - RNA, 18 nt, Artificial Sequence
  Description of Artificial Sequence: Synthetic oligonucleotide
accguguggaguuaucug

SEQ ID NO: 66363 - RNA, 18 nt, Artificial Sequence
  Description of Artificial Sequence: Synthetic oligonucleotide
cacacaccguguggaguu

SEQ ID NO: 66364 - RNA, 18 nt, Artificial Sequence
  Description of Artificial Sequence: Synthetic oligonucleotide
uuguacacacaccgugug

SEQ ID NO: 66365 - RNA, 18 nt, Artificial Sequence
  Description of Artificial Sequence: Synthetic oligonucleotide
acggcuuguacacacacc

SEQ ID NO: 66366 - RNA, 18 nt, Artificial Sequence
  Description of Artificial Sequence: Synthetic oligonucleotide
aaugcacggcuuguacac

SEQ ID NO: 66367 - RNA, 18 nt, Artificial Sequence
  Description of Artificial Sequence: Synthetic oligonucleotide
ccuucaaugcacggcuug

SEQ ID NO: 66368 - RNA, 18 nt, Artificial Sequence
  Description of Artificial Sequence: Synthetic oligonucleotide
caguagcuggcacauugu

SEQ ID NO: 66369 - RNA, 18 nt, Artificial Sequence
  Description of Artificial Sequence: Synthetic oligonucleotide
uagaacaguagcuggcac

SEQ ID NO: 66370 - RNA, 18 nt, Artificial Sequence
  Description of Artificial Sequence: Synthetic oligonucleotide
auucuuagaacaguagcu

SEQ ID NO: 66371 - RNA, 18 nt, Artificial Sequence
  Description of Artificial Sequence: Synthetic oligonucleotide
guaaaauucuuagaacag

SEQ ID NO: 66372 - RNA, 18 nt, Artificial Sequence
  Description of Artificial Sequence: Synthetic oligonucleotide
uacacguaaaauucuuag

SEQ ID NO: 66373 - RNA, 18 nt, Artificial Sequence
  Description of Artificial Sequence: Synthetic oligonucleotide
guugauacacguaaaauu

SEQ ID NO: 66374 - RNA, 18 nt, Artificial Sequence
  Description of Artificial Sequence: Synthetic oligonucleotide
aaugaguugauacacgua

SEQ ID NO: 66375 - RNA, 18 nt, Artificial Sequence
  Description of Artificial Sequence: Synthetic oligonucleotide
uauuaaaugaguugauac

SEQ ID NO: 66376 - RNA, 18 nt, Artificial Sequence
  Description of Artificial Sequence: Synthetic oligonucleotide
uugaauauuaaaugaguu

SEQ ID NO: 66377 - RNA, 18 nt, Artificial Sequence
  Description of Artificial Sequence: Synthetic oligonucleotide
uuauuuugaauauuaaau

SEQ ID NO: 66378 - RNA, 18 nt, Artificial Sequence
  Description of Artificial Sequence: Synthetic oligonucleotide
aagguuuauuuugaauau

SEQ ID NO: 66379 - RNA, 18 nt, Artificial Sequence
  Description of Artificial Sequence: Synthetic oligonucleotide
acuaaaagguuuauuuug

SEQ ID NO: 66380 - RNA, 18 nt, Artificial Sequence
  Description of Artificial Sequence: Synthetic oligonucleotide
aucuaacuaaaagguuua

SEQ ID NO: 66381 - RNA, 18 nt, Artificial Sequence
  Description of Artificial Sequence: Synthetic oligonucleotide
auaugaucuaacuaaaag

SEQ ID NO: 66382 - RNA, 18 nt, Artificial Sequence
  Description of Artificial Sequence: Synthetic oligonucleotide
caauaauaugaucuaacu

SEQ ID NO: 66383 - RNA, 18 nt, Artificial Sequence
  Description of Artificial Sequence: Synthetic oligonucleotide
aauaucaauaauaugauc

SEQ ID NO: 66384 - RNA, 18 nt, Artificial Sequence
  Description of Artificial Sequence: Synthetic oligonucleotide
acaauaauaucaauaaua

SEQ ID NO: 66385 - RNA, 18 nt, Artificial Sequence
  Description of Artificial Sequence: Synthetic oligonucleotide
gggaaacaauaauaucaa

SEQ ID NO: 66386 - RNA, 18 nt, Artificial Sequence
  Description of Artificial Sequence: Synthetic oligonucleotide
ccuuaucacuguaauggg

SEQ ID NO: 66387 - RNA, 18 nt, Artificial Sequence
  Description of Artificial Sequence: Synthetic oligonucleotide
uuccuuaucacuguaaug

SEQ ID NO: 66388 - RNA, 18 nt, Artificial Sequence
  Description of Artificial Sequence: Synthetic oligonucleotide
ucagcuuccuuaucacug

SEQ ID NO: 66389 - RNA, 18 nt, Artificial Sequence
  Description of Artificial Sequence: Synthetic oligonucleotide
augccucagcuuccuuau

SEQ ID NO: 66390 - RNA, 18 nt, Artificial Sequence
  Description of Artificial Sequence: Synthetic oligonucleotide
guucuaugccucagcuuc

SEQ ID NO: 66391 - RNA, 18 nt, Artificial Sequence
  Description of Artificial Sequence: Synthetic oligonucleotide
uaaugguucuaugccuca

SEQ ID NO: 66392 - RNA, 18 nt, Artificial Sequence
  Description of Artificial Sequence: Synthetic oligonucleotide
uuacuuaaugguucuaug

SEQ ID NO: 66393 - RNA, 18 nt, Artificial Sequence
  Description of Artificial Sequence: Synthetic oligonucleotide
gcaaguuacuuaaugguu

SEQ ID NO: 66394 - RNA, 18 nt, Artificial Sequence
  Description of Artificial Sequence: Synthetic oligonucleotide
ucuaggcaaguuacuuaa

SEQ ID NO: 66395 - RNA, 18 nt, Artificial Sequence
  Description of Artificial Sequence: Synthetic oligonucleotide
acagcucuaggcaaguua

SEQ ID NO: 66396 - RNA, 18 nt, Artificial Sequence
  Description of Artificial Sequence: Synthetic oligonucleotide
ucuuuacagcucuaggca

SEQ ID NO: 66397 - RNA, 18 nt, Artificial Sequence
  Description of Artificial Sequence: Synthetic oligonucleotide
ccaccucuuuacagcucu

SEQ ID NO: 66398 - RNA, 18 nt, Artificial Sequence
  Description of Artificial Sequence: Synthetic oligonucleotide
ugacuccaccucuuuaca

SEQ ID NO: 66399 - RNA, 18 nt, Artificial Sequence
  Description of Artificial Sequence: Synthetic oligonucleotide
gauucugacuccaccucu

SEQ ID NO: 66400 - RNA, 18 nt, Artificial Sequence
  Description of Artificial Sequence: Synthetic oligonucleotide
guuuggauucugacucca

SEQ ID NO: 66401 - RNA, 18 nt, Artificial Sequence
  Description of Artificial Sequence: Synthetic oligonucleotide
cauggguuuggauucuga

SEQ ID NO: 66402 - RNA, 18 nt, Artificial Sequence
  Description of Artificial Sequence: Synthetic oligonucleotide
gaucacauggguuuggau

SEQ ID NO: 66403 - RNA, 18 nt, Artificial Sequence
  Description of Artificial Sequence: Synthetic oligonucleotide
auguggaucacauggguu

SEQ ID NO: 66404 - RNA, 18 nt, Artificial Sequence
  Description of Artificial Sequence: Synthetic oligonucleotide
uccugauguggaucacau

SEQ ID NO: 66405 - RNA, 18 nt, Artificial Sequence
  Description of Artificial Sequence: Synthetic oligonucleotide
ugggcuccugauguggau

SEQ ID NO: 66406 - RNA, 18 nt, Artificial Sequence
  Description of Artificial Sequence: Synthetic oligonucleotide
gagugugggcuccugaug

SEQ ID NO: 66407 - RNA, 18 nt, Artificial Sequence
  Description of Artificial Sequence: Synthetic oligonucleotide
guuaagagugugggcucc

SEQ ID NO: 66408 - RNA, 18 nt, Artificial Sequence
  Description of Artificial Sequence: Synthetic oligonucleotide
caaugguuaagagugugg

SEQ ID NO: 66409 - RNA, 18 nt, Artificial Sequence
  Description of Artificial Sequence: Synthetic oligonucleotide
acaugcaaugguuaagag

SEQ ID NO: 66410 - RNA, 18 nt, Artificial Sequence
  Description of Artificial Sequence: Synthetic oligonucleotide
gaaauacaugcaaugguu

SEQ ID NO: 66411 - RNA, 18 nt, Artificial Sequence
  Description of Artificial Sequence: Synthetic oligonucleotide
gccaagaaauacaugcaa

SEQ ID NO: 66412 - RNA, 18 nt, Artificial Sequence
  Description of Artificial Sequence: Synthetic oligonucleotide
uaagagccaagaaauaca

SEQ ID NO: 66413 - RNA, 18 nt, Artificial Sequence
  Description of Artificial Sequence: Synthetic oligonucleotide
gagaguaagagccaagaa

SEQ ID NO: 66414 - RNA, 18 nt, Artificial Sequence
  Description of Artificial Sequence: Synthetic oligonucleotide
uuuuugagaguaagagcc

SEQ ID NO: 66415 - RNA, 18 nt, Artificial Sequence
  Description of Artificial Sequence: Synthetic oligonucleotide
ggguuuuuuugagaguaa

SEQ ID NO: 66416 - RNA, 18 nt, Artificial Sequence
  Description of Artificial Sequence: Synthetic oligonucleotide
ccaauggguuuuuuugag

SEQ ID NO: 66417 - RNA, 18 nt, Artificial Sequence
  Description of Artificial Sequence: Synthetic oligonucleotide
auuucccaauggguuuuu

SEQ ID NO: 66418 - RNA, 18 nt, Artificial Sequence
  Description of Artificial Sequence: Synthetic oligonucleotide
ugguuauuucccaauggg

SEQ ID NO: 66419 - RNA, 18 nt, Artificial Sequence
  Description of Artificial Sequence: Synthetic oligonucleotide
guuuuugguuauuuccca

SEQ ID NO: 66420 - RNA, 18 nt, Artificial Sequence
  Description of Artificial Sequence: Synthetic oligonucleotide
uaccaguuuuugguuauu

SEQ ID NO: 66421 - RNA, 18 nt, Artificial Sequence
  Description of Artificial Sequence: Synthetic oligonucleotide
ugucuuaccaguuuuugg

SEQ ID NO: 66422 - RNA, 18 nt, Artificial Sequence
  Description of Artificial Sequence: Synthetic oligonucleotide
uacacugucuuaccaguu

SEQ ID NO: 66423 - RNA, 18 nt, Artificial Sequence
  Description of Artificial Sequence: Synthetic oligonucleotide
gaguuuacacugucuuac

SEQ ID NO: 66424 - RNA, 18 nt, Artificial Sequence
  Description of Artificial Sequence: Synthetic oligonucleotide
uuuaagaguuuacacugu

SEQ ID NO: 66425 - RNA, 18 nt, Artificial Sequence
  Description of Artificial Sequence: Synthetic oligonucleotide
uuacauuuaagaguuuac

SEQ ID NO: 66426 - RNA, 18 nt, Artificial Sequence
  Description of Artificial Sequence: Synthetic oligonucleotide
aacuauuacauuuaagag

SEQ ID NO: 66427 - RNA, 18 nt, Artificial Sequence
  Description of Artificial Sequence: Synthetic oligonucleotide
uguuuaacuauuacauuu

SEQ ID NO: 66428 - RNA, 18 nt, Artificial Sequence
  Description of Artificial Sequence: Synthetic oligonucleotide
cucauuguuuaacuauua

SEQ ID NO: 66429 - RNA, 18 nt, Artificial Sequence
  Description of Artificial Sequence: Synthetic oligonucleotide
gcucucucauuguuuaac

SEQ ID NO: 66430 - RNA, 18 nt, Artificial Sequence
  Description of Artificial Sequence: Synthetic oligonucleotide
acagagcucucucauugu

SEQ ID NO: 66431 - RNA, 18 nt, Artificial Sequence
  Description of Artificial Sequence: Synthetic oligonucleotide
uaaucacagagcucucuc

SEQ ID NO: 66432 - RNA, 18 nt, Artificial Sequence
  Description of Artificial Sequence: Synthetic oligonucleotide
cugaauaaucacagagcu

SEQ ID NO: 66433 - RNA, 18 nt, Artificial Sequence
  Description of Artificial Sequence: Synthetic oligonucleotide
caauucugaauaaucaca

SEQ ID NO: 66434 - RNA, 18 nt, Artificial Sequence
  Description of Artificial Sequence: Synthetic oligonucleotide
augcccaauucugaauaa

SEQ ID NO: 66435 - RNA, 18 nt, Artificial Sequence
  Description of Artificial Sequence: Synthetic oligonucleotide
acaauaugcccaauucug

SEQ ID NO: 66436 - RNA, 18 nt, Artificial Sequence
  Description of Artificial Sequence: Synthetic oligonucleotide
aggaaacaauaugcccaa

SEQ ID NO: 66437 - RNA, 18 nt, Artificial Sequence
  Description of Artificial Sequence: Synthetic oligonucleotide
auuuaaggaaacaauaug

SEQ ID NO: 66438 - RNA, 18 nt, Artificial Sequence
  Description of Artificial Sequence: Synthetic oligonucleotide
uuccaauuuaaggaaaca

SEQ ID NO: 66439 - RNA, 18 nt, Artificial Sequence
  Description of Artificial Sequence: Synthetic oligonucleotide
aagauuuccaauuuaagg

SEQ ID NO: 66440 - RNA, 18 nt, Artificial Sequence
  Description of Artificial Sequence: Synthetic oligonucleotide
cuguuaagauuuccaauu

SEQ ID NO: 66441 - RNA, 18 nt, Artificial Sequence
  Description of Artificial Sequence: Synthetic oligonucleotide
auauacuguuaagauuuc

SEQ ID NO: 66442 - RNA, 18 nt, Artificial Sequence
  Description of Artificial Sequence: Synthetic oligonucleotide
aggauauauacuguuaag

SEQ ID NO: 66443 - RNA, 18 nt, Artificial Sequence
  Description of Artificial Sequence: Synthetic oligonucleotide
ucuagaggauauauacug

SEQ ID NO: 66444 - RNA, 18 nt, Artificial Sequence
  Description of Artificial Sequence: Synthetic oligonucleotide
guuuuucuagaggauaua

SEQ ID NO: 66445 - RNA, 18 nt, Artificial Sequence
  Description of Artificial Sequence: Synthetic oligonucleotide
auucuguuuuucuagagg

SEQ ID NO: 66446 - RNA, 18 nt, Artificial Sequence
  Description of Artificial Sequence: Synthetic oligonucleotide
cccaaauucuguuuuucu

SEQ ID NO: 66447 - RNA, 18 nt, Artificial Sequence
  Description of Artificial Sequence: Synthetic oligonucleotide
guucccccaaauucuguu

SEQ ID NO: 66448 - RNA, 18 nt, Artificial Sequence
  Description of Artificial Sequence: Synthetic oligonucleotide
uuucaguucccccaaauu

SEQ ID NO: 66449 - RNA, 18 nt, Artificial Sequence
  Description of Artificial Sequence: Synthetic oligonucleotide
agcuuuuucaguuccccc

SEQ ID NO: 66450 - RNA, 18 nt, Artificial Sequence
  Description of Artificial Sequence: Synthetic oligonucleotide
aggucagcuuuuucaguu

SEQ ID NO: 66451 - RNA, 18 nt, Artificial Sequence
  Description of Artificial Sequence: Synthetic oligonucleotide
auuaaaggucagcuuuuu

SEQ ID NO: 66452 - RNA, 18 nt, Artificial Sequence
  Description of Artificial Sequence: Synthetic oligonucleotide
aucacauuaaaggucagc

SEQ ID NO: 66453 - RNA, 18 nt, Artificial Sequence
  Description of Artificial Sequence: Synthetic oligonucleotide
ucagaaucacauuaaagg

SEQ ID NO: 66454 - RNA, 18 nt, Artificial Sequence
  Description of Artificial Sequence: Synthetic oligonucleotide
agaauucagaaucacauu

SEQ ID NO: 66455 - RNA, 18 nt, Artificial Sequence
  Description of Artificial Sequence: Synthetic oligonucleotide
auuccagaauucagaauc

SEQ ID NO: 66456 - RNA, 18 nt, Artificial Sequence
  Description of Artificial Sequence: Synthetic oligonucleotide
acugaauuccagaauuca

SEQ ID NO: 66457 - RNA, 18 nt, Artificial Sequence
  Description of Artificial Sequence: Synthetic oligonucleotide
ggcucacugaauuccaga

SEQ ID NO: 66458 - RNA, 18 nt, Artificial Sequence
  Description of Artificial Sequence: Synthetic oligonucleotide
ucaugggcucacugaauu

SEQ ID NO: 66459 - RNA, 18 nt, Artificial Sequence
  Description of Artificial Sequence: Synthetic oligonucleotide
aaaagucaugggcucacu

SEQ ID NO: 66460 - RNA, 18 nt, Artificial Sequence
  Description of Artificial Sequence: Synthetic oligonucleotide
ggauuaaaagucaugggc

SEQ ID NO: 66461 - RNA, 18 nt, Artificial Sequence
  Description of Artificial Sequence: Synthetic oligonucleotide
acuauggauuaaaaguca

SEQ ID NO: 66462 - RNA, 18 nt, Artificial Sequence
  Description of Artificial Sequence: Synthetic oligonucleotide
aagugacuauggauuaaa

SEQ ID NO: 66463 - RNA, 18 nt, Artificial Sequence
  Description of Artificial Sequence: Synthetic oligonucleotide
ggcaaaagugacuaugga

SEQ ID NO: 66464 - RNA, 18 nt, Artificial Sequence
  Description of Artificial Sequence: Synthetic oligonucleotide
cuauuuuccaaagucuag

SEQ ID NO: 66465 - RNA, 18 nt, Artificial Sequence
  Description of Artificial Sequence: Synthetic oligonucleotide
uuucccuauuuuccaaag

SEQ ID NO: 66466 - RNA, 18 nt, Artificial Sequence
  Description of Artificial Sequence: Synthetic oligonucleotide
uauauuuucccuauuuuc

SEQ ID NO: 66467 - RNA, 18 nt, Artificial Sequence
  Description of Artificial Sequence: Synthetic oligonucleotide
aaagauauauuuucccua

SEQ ID NO: 66468 - RNA, 18 nt, Artificial Sequence
  Description of Artificial Sequence: Synthetic oligonucleotide
uugucaaagauauauuuu

SEQ ID NO: 66469 - RNA, 18 nt, Artificial Sequence
  Description of Artificial Sequence: Synthetic oligonucleotide
ucacauugucaaagauau

SEQ ID NO: 66470 - RNA, 18 nt, Artificial Sequence
  Description of Artificial Sequence: Synthetic oligonucleotide
uagugucacauugucaaa

SEQ ID NO: 66471 - RNA, 18 nt, Artificial Sequence
  Description of Artificial Sequence: Synthetic oligonucleotide
ugguuuagugucacauug

SEQ ID NO: 66472 - RNA, 18 nt, Artificial Sequence
  Description of Artificial Sequence: Synthetic oligonucleotide
agccuugguuuaguguca

SEQ ID NO: 66473 - RNA, 18 nt, Artificial Sequence
  Description of Artificial Sequence: Synthetic oligonucleotide
uggacagccuugguuuag

SEQ ID NO: 66474 - RNA, 18 nt, Artificial Sequence
  Description of Artificial Sequence: Synthetic oligonucleotide
ggaucuggacagccuugg

SEQ ID NO: 66475 - RNA, 18 nt, Artificial Sequence
  Description of Artificial Sequence: Synthetic oligonucleotide
ccacaggaucuggacagc

SEQ ID NO: 66476 - RNA, 18 nt, Artificial Sequence
  Description of Artificial Sequence: Synthetic oligonucleotide
ucaugccacaggaucugg

SEQ ID NO: 66477 - RNA, 18 nt, Artificial Sequence
  Description of Artificial Sequence: Synthetic oligonucleotide
ugcaaucaugccacagga

SEQ ID NO: 66478 - RNA, 18 nt, Artificial Sequence
  Description of Artificial Sequence: Synthetic oligonucleotide
gcaacugcaaucaugcca

SEQ ID NO: 66479 - RNA, 18 nt, Artificial Sequence
  Description of Artificial Sequence: Synthetic oligonucleotide
aagaggcaacugcaauca

SEQ ID NO: 66480 - RNA, 18 nt, Artificial Sequence
  Description of Artificial Sequence: Synthetic oligonucleotide
gugaaaagaggcaacugc

SEQ ID NO: 66481 - RNA, 18 nt, Artificial Sequence
  Description of Artificial Sequence: Synthetic oligonucleotide
gaacagugaaaagaggca

SEQ ID NO: 66482 - RNA, 18 nt, Artificial Sequence
  Description of Artificial Sequence: Synthetic oligonucleotide
ucuuggaacagugaaaag

SEQ ID NO: 66483 - RNA, 18 nt, Artificial Sequence
  Description of Artificial Sequence: Synthetic oligonucleotide
aucagucuuggaacagug

SEQ ID NO: 66484 - RNA, 18 nt, Artificial Sequence
  Description of Artificial Sequence: Synthetic oligonucleotide
ccuaaaucagucuuggaa

SEQ ID NO: 66485 - RNA, 18 nt, Artificial Sequence
  Description of Artificial Sequence: Synthetic oligonucleotide
gucguccuaaaucagucu

SEQ ID NO: 66486 - RNA, 18 nt, Artificial Sequence
  Description of Artificial Sequence: Synthetic oligonucleotide
gacaggucguccuaaauc

SEQ ID NO: 66487 - RNA, 18 nt, Artificial Sequence
  Description of Artificial Sequence: Synthetic oligonucleotide
aaacagacaggucguccu

SEQ ID NO: 66488 - RNA, 18 nt, Artificial Sequence
  Description of Artificial Sequence: Synthetic oligonucleotide
aacaaaaacagacagguc

SEQ ID NO: 66489 - RNA, 18 nt, Artificial Sequence
  Description of Artificial Sequence: Synthetic oligonucleotide
ucuucaacaaaaacagac

SEQ ID NO: 66490 - RNA, 18 nt, Artificial Sequence
  Description of Artificial Sequence: Synthetic oligonucleotide
ugaugucuucaacaaaaa

SEQ ID NO: 66491 - RNA, 18 nt, Artificial Sequence
  Description of Artificial Sequence: Synthetic oligonucleotide
uacucugaugucuucaac

SEQ ID NO: 66492 - RNA, 18 nt, Artificial Sequence
  Description of Artificial Sequence: Synthetic oligonucleotide
caugguacucugaugucu

SEQ ID NO: 66493 - RNA, 18 nt, Artificial Sequence
  Description of Artificial Sequence: Synthetic oligonucleotide
gauaucaugguacucuga

SEQ ID NO: 66494 - RNA, 18 nt, Artificial Sequence
  Description of Artificial Sequence: Synthetic oligonucleotide
uacaugauaucaugguac

SEQ ID NO: 66495 - RNA, 18 nt, Artificial Sequence
  Description of Artificial Sequence: Synthetic oligonucleotide
caggauacaugauaucau

SEQ ID NO: 66496 - RNA, 18 nt, Artificial Sequence
  Description of Artificial Sequence: Synthetic oligonucleotide
ccaagcaggauacaugau

SEQ ID NO: 66497 - RNA, 18 nt, Artificial Sequence
  Description of Artificial Sequence: Synthetic oligonucleotide
aauguccaagcaggauac

SEQ ID NO: 66498 - RNA, 18 nt, Artificial Sequence
  Description of Artificial Sequence: Synthetic oligonucleotide
cccaaaauguccaagcag

SEQ ID NO: 66499 - RNA, 18 nt, Artificial Sequence
  Description of Artificial Sequence: Synthetic oligonucleotide
cccuucccaaaaugucca

SEQ ID NO: 66500 - RNA, 18 nt, Artificial Sequence
  Description of Artificial Sequence: Synthetic oligonucleotide
ggucccccuucccaaaau

SEQ ID NO: 66501 - RNA, 18 nt, Artificial Sequence
  Description of Artificial Sequence: Synthetic oligonucleotide
cagcaggucccccuuccc

SEQ ID NO: 66502 - RNA, 18 nt, Artificial Sequence
  Description of Artificial Sequence: Synthetic oligonucleotide
ccaaacagcagguccccc

SEQ ID NO: 66503 - RNA, 18 nt, Artificial Sequence
  Description of Artificial Sequence: Synthetic oligonucleotide
auuggccaaacagcaggu

SEQ ID NO: 66504 - RNA, 18 nt, Artificial Sequence
  Description of Artificial Sequence: Synthetic oligonucleotide
gauaaauuggccaaacag

SEQ ID NO: 66505 - RNA, 18 nt, Artificial Sequence
  Description of Artificial Sequence: Synthetic oligonucleotide
uguaggauaaauuggcca

SEQ ID NO: 66506 - RNA, 18 nt, Artificial Sequence
  Description of Artificial Sequence: Synthetic oligonucleotide
agaccuguaggauaaauu

SEQ ID NO: 66507 - RNA, 18 nt, Artificial Sequence
  Description of Artificial Sequence: Synthetic oligonucleotide
guccaagaccuguaggau

SEQ ID NO: 66508 - RNA, 18 nt, Artificial Sequence
  Description of Artificial Sequence: Synthetic oligonucleotide
ccaccguccaagaccugu

SEQ ID NO: 66509 - RNA, 18 nt, Artificial Sequence
  Description of Artificial Sequence: Synthetic oligonucleotide
aggucccaccguccaaga

SEQ ID NO: 66510 - RNA, 18 nt, Artificial Sequence
  Description of Artificial Sequence: Synthetic oligonucleotide
ugaagaggucccaccguc

SEQ ID NO: 66511 - RNA, 18 nt, Artificial Sequence
  Description of Artificial Sequence: Synthetic oligonucleotide
uucucugaagagguccca

SEQ ID NO: 66512 - RNA, 18 nt, Artificial Sequence
  Description of Artificial Sequence: Synthetic oligonucleotide
agaucuucucugaagagg

SEQ ID NO: 66513 - RNA, 18 nt, Artificial Sequence
  Description of Artificial Sequence: Synthetic oligonucleotide
uuaccagaucuucucuga

SEQ ID NO: 66514 - RNA, 18 nt, Artificial Sequence
  Description of Artificial Sequence: Synthetic oligonucleotide
ucccuauuuuccaaaguc

SEQ ID NO: 66515 - RNA, 18 nt, Artificial Sequence
  Description of Artificial Sequence: Synthetic oligonucleotide
uauuuucccuauuuucca

SEQ ID NO: 66516 - RNA, 18 nt, Artificial Sequence
  Description of Artificial Sequence: Synthetic oligonucleotide
agauauauuuucccuauu

SEQ ID NO: 66517 - RNA, 18 nt, Artificial Sequence
  Description of Artificial Sequence: Synthetic oligonucleotide
gucaaagauauauuuucc

SEQ ID NO: 66518 - RNA, 18 nt, Artificial Sequence
  Description of Artificial Sequence: Synthetic oligonucleotide
acauugucaaagauauau

SEQ ID NO: 66519 - RNA, 18 nt, Artificial Sequence
  Description of Artificial Sequence: Synthetic oligonucleotide
gugucacauugucaaaga

SEQ ID NO: 66520 - RNA, 18 nt, Artificial Sequence
  Description of Artificial Sequence: Synthetic oligonucleotide
guuuagugucacauuguc

SEQ ID NO: 66521 - RNA, 18 nt, Artificial Sequence
  Description of Artificial Sequence: Synthetic oligonucleotide
ccuugguuuagugucaca

SEQ ID NO: 66522 - RNA, 18 nt, Artificial Sequence
  Description of Artificial Sequence: Synthetic oligonucleotide
gacagccuugguuuagug

SEQ ID NO: 66523 - RNA, 18 nt, Artificial Sequence
  Description of Artificial Sequence: Synthetic oligonucleotide
aucuggacagccuugguu

SEQ ID NO: 66524 - RNA, 18 nt, Artificial Sequence
  Description of Artificial Sequence: Synthetic oligonucleotide
acaggaucuggacagccu

SEQ ID NO: 66525 - RNA, 18 nt, Artificial Sequence
  Description of Artificial Sequence: Synthetic oligonucleotide
augccacaggaucuggac

SEQ ID NO: 66526 - RNA, 18 nt, Artificial Sequence
  Description of Artificial Sequence: Synthetic oligonucleotide
caaucaugccacaggauc

SEQ ID NO: 66527 - RNA, 18 nt, Artificial Sequence
  Description of Artificial Sequence: Synthetic oligonucleotide
aacugcaaucaugccaca

SEQ ID NO: 66528 - RNA, 18 nt, Artificial Sequence
  Description of Artificial Sequence: Synthetic oligonucleotide
gaggcaacugcaaucaug

SEQ ID NO: 66529 - RNA, 18 nt, Artificial Sequence
  Description of Artificial Sequence: Synthetic oligonucleotide
gaaaagaggcaacugcaa

SEQ ID NO: 66530 - RNA, 18 nt, Artificial Sequence
  Description of Artificial Sequence: Synthetic oligonucleotide
acagugaaaagaggcaac

SEQ ID NO: 66531 - RNA, 18 nt, Artificial Sequence
  Description of Artificial Sequence: Synthetic oligonucleotide
uuggaacagugaaaagag

SEQ ID NO: 66532 - RNA, 18 nt, Artificial Sequence
  Description of Artificial Sequence: Synthetic oligonucleotide
cagucuuggaacagugaa

SEQ ID NO: 66533 - RNA, 18 nt, Artificial Sequence
  Description of Artificial Sequence: Synthetic oligonucleotide
uaaaucagucuuggaaca

SEQ ID NO: 66534 - RNA, 18 nt, Artificial Sequence
  Description of Artificial Sequence: Synthetic oligonucleotide
cguccuaaaucagucuug

SEQ ID NO: 66535 - RNA, 18 nt, Artificial Sequence
  Description of Artificial Sequence: Synthetic oligonucleotide
caggucguccuaaaucag

SEQ ID NO: 66536 - RNA, 18 nt, Artificial Sequence
  Description of Artificial Sequence: Synthetic oligonucleotide
acagacaggucguccuaa

SEQ ID NO: 66537 - RNA, 18 nt, Artificial Sequence
  Description of Artificial Sequence: Synthetic oligonucleotide
caaaaacagacaggucgu

SEQ ID NO: 66538 - RNA, 18 nt, Artificial Sequence
  Description of Artificial Sequence: Synthetic oligonucleotide
uucaacaaaaacagacag

SEQ ID NO: 66539 - RNA, 18 nt, Artificial Sequence
  Description of Artificial Sequence: Synthetic oligonucleotide
augucuucaacaaaaaca

SEQ ID NO: 66540 - RNA, 18 nt, Artificial Sequence
  Description of Artificial Sequence: Synthetic oligonucleotide
cucugaugucuucaacaa

SEQ ID NO: 66541 - RNA, 18 nt, Artificial Sequence
  Description of Artificial Sequence: Synthetic oligonucleotide
ugguacucugaugucuuc

SEQ ID NO: 66542 - RNA, 18 nt, Artificial Sequence
  Description of Artificial Sequence: Synthetic oligonucleotide
uaucaugguacucugaug

SEQ ID NO: 66543 - RNA, 18 nt, Artificial Sequence
  Description of Artificial Sequence: Synthetic oligonucleotide
caugauaucaugguacuc

SEQ ID NO: 66544 - RNA, 18 nt, Artificial Sequence
  Description of Artificial Sequence: Synthetic oligonucleotide
ggauacaugauaucaugg

SEQ ID NO: 66545 - RNA, 18 nt, Artificial Sequence
  Description of Artificial Sequence: Synthetic oligonucleotide
aagcaggauacaugauau

SEQ ID NO: 66546 - RNA, 18 nt, Artificial Sequence
  Description of Artificial Sequence: Synthetic oligonucleotide
uguccaagcaggauacau

SEQ ID NO: 66547 - RNA, 18 nt, Artificial Sequence
  Description of Artificial Sequence: Synthetic oligonucleotide
caaaauguccaagcagga

SEQ ID NO: 66548 - RNA, 18 nt, Artificial Sequence
  Description of Artificial Sequence: Synthetic oligonucleotide
cuucccaaaauguccaag

SEQ ID NO: 66549 - RNA, 18 nt, Artificial Sequence
  Description of Artificial Sequence: Synthetic oligonucleotide
ucccccuucccaaaaugu

SEQ ID NO: 66550 - RNA, 18 nt, Artificial Sequence
  Description of Artificial Sequence: Synthetic oligonucleotide
gcaggucccccuucccaa

SEQ ID NO: 66551 - RNA, 18 nt, Artificial Sequence
  Description of Artificial Sequence: Synthetic oligonucleotide
aaacagcaggucccccuu

SEQ ID NO: 66552 - RNA, 18 nt, Artificial Sequence
  Description of Artificial Sequence: Synthetic oligonucleotide
uggccaaacagcaggucc

SEQ ID NO: 66553 - RNA, 18 nt, Artificial Sequence
  Description of Artificial Sequence: Synthetic oligonucleotide
uaaauuggccaaacagca

SEQ ID NO: 66554 - RNA, 18 nt, Artificial Sequence
  Description of Artificial Sequence: Synthetic oligonucleotide
uaggauaaauuggccaaa

SEQ ID NO: 66555 - RNA, 18 nt, Artificial Sequence
  Description of Artificial Sequence: Synthetic oligonucleotide
accuguaggauaaauugg

SEQ ID NO: 66556 - RNA, 18 nt, Artificial Sequence
  Description of Artificial Sequence: Synthetic oligonucleotide
ccaagaccuguaggauaa

SEQ ID NO: 66557 - RNA, 18 nt, Artificial Sequence
  Description of Artificial Sequence: Synthetic oligonucleotide
accguccaagaccuguag

SEQ ID NO: 66558 - RNA, 18 nt, Artificial Sequence
  Description of Artificial Sequence: Synthetic oligonucleotide
gucccaccguccaagacc

SEQ ID NO: 66559 - RNA, 18 nt, Artificial Sequence
  Description of Artificial Sequence: Synthetic oligonucleotide
aagaggucccaccgucca

SEQ ID NO: 66560 - RNA, 18 nt, Artificial Sequence
  Description of Artificial Sequence: Synthetic oligonucleotide
cucugaagaggucccacc

SEQ ID NO: 66561 - RNA, 18 nt, Artificial Sequence
  Description of Artificial Sequence: Synthetic oligonucleotide
aucuucucugaagagguc

SEQ ID NO: 66562 - RNA, 18 nt, Artificial Sequence
  Description of Artificial Sequence: Synthetic oligonucleotide
accagaucuucucugaag

SEQ ID NO: 66563 - RNA, 18 nt, Artificial Sequence
  Description of Artificial Sequence: Synthetic oligonucleotide
uaaaaccucuuuaaagga

SEQ ID NO: 66564 - RNA, 18 nt, Artificial Sequence
  Description of Artificial Sequence: Synthetic oligonucleotide
aaaaauaaaaccucuuua

SEQ ID NO: 66565 - RNA, 18 nt, Artificial Sequence
  Description of Artificial Sequence: Synthetic oligonucleotide
agagaaaaaauaaaaccu

SEQ ID NO: 66566 - RNA, 18 nt, Artificial Sequence
  Description of Artificial Sequence: Synthetic oligonucleotide
cagaaagagaaaaaauaa

SEQ ID NO: 66567 - RNA, 18 nt, Artificial Sequence
  Description of Artificial Sequence: Synthetic oligonucleotide
aaacccagaaagagaaaa

SEQ ID NO: 66568 - RNA, 18 nt, Artificial Sequence
  Description of Artificial Sequence: Synthetic oligonucleotide
caagaaaacccagaaaga

SEQ ID NO: 66569 - RNA, 18 nt, Artificial Sequence
  Description of Artificial Sequence: Synthetic oligonucleotide
uauuucaagaaaacccag

SEQ ID NO: 66570 - RNA, 18 nt, Artificial Sequence
  Description of Artificial Sequence: Synthetic oligonucleotide
uggcuuauuucaagaaaa

SEQ ID NO: 66571 - RNA, 18 nt, Artificial Sequence
  Description of Artificial Sequence: Synthetic oligonucleotide
uucuauggcuuauuucaa

SEQ ID NO: 66572 - RNA, 18 nt, Artificial Sequence
  Description of Artificial Sequence: Synthetic oligonucleotide
uuauauucuauggcuuau

SEQ ID NO: 66573 - RNA, 18 nt, Artificial Sequence
  Description of Artificial Sequence: Synthetic oligonucleotide
auugguuauauucuaugg

SEQ ID NO: 66574 - RNA, 18 nt, Artificial Sequence
  Description of Artificial Sequence: Synthetic oligonucleotide
aaauaauugguuauauuc

SEQ ID NO: 66575 - RNA, 18 nt, Artificial Sequence
  Description of Artificial Sequence: Synthetic oligonucleotide
aaaguaaauaauugguua

SEQ ID NO: 66576 - RNA, 18 nt, Artificial Sequence
  Description of Artificial Sequence: Synthetic oligonucleotide
aaaaaaaaguaaauaauu

SEQ ID NO: 66577 - RNA, 18 nt, Artificial Sequence
  Description of Artificial Sequence: Synthetic oligonucleotide
aaaaaaaaaaaaaguaaa

SEQ ID NO: 66578 - RNA, 18 nt, Artificial Sequence
  Description of Artificial Sequence: Synthetic oligonucleotide
gucucaaaaaaaaaaaaa

SEQ ID NO: 66579 - RNA, 18 nt, Artificial Sequence
  Description of Artificial Sequence: Synthetic oligonucleotide
acuccgucucaaaaaaaa

SEQ ID NO: 66580 - RNA, 18 nt, Artificial Sequence
  Description of Artificial Sequence: Synthetic oligonucleotide
gcgaaacuccgucucaaa

SEQ ID NO: 66581 - RNA, 18 nt, Artificial Sequence
  Description of Artificial Sequence: Synthetic oligonucleotide
aaagggcgaaacuccguc

SEQ ID NO: 66582 - RNA, 18 nt, Artificial Sequence
  Description of Artificial Sequence: Synthetic oligonucleotide
ggcaaaaagggcgaaacu

SEQ ID NO: 66583 - RNA, 18 nt, Artificial Sequence
  Description of Artificial Sequence: Synthetic oligonucleotide
gccugggcaaaaagggcg

SEQ ID NO: 66584 - RNA, 18 nt, Artificial Sequence
  Description of Artificial Sequence: Synthetic oligonucleotide
cucuagccugggcaaaaa

SEQ ID NO: 66585 - RNA, 18 nt, Artificial Sequence
  Description of Artificial Sequence: Synthetic oligonucleotide
uugcacucuagccugggc

SEQ ID NO: 66586 - RNA, 18 nt, Artificial Sequence
  Description of Artificial Sequence: Synthetic oligonucleotide
cgccauugcacucuagcc

SEQ ID NO: 66587 - RNA, 18 nt, Artificial Sequence
  Description of Artificial Sequence: Synthetic oligonucleotide
gaucacgccauugcacuc

SEQ ID NO: 66588 - RNA, 18 nt, Artificial Sequence
  Description of Artificial Sequence: Synthetic oligonucleotide
gcugagaucacgccauug

SEQ ID NO: 66589 - RNA, 18 nt, Artificial Sequence
  Description of Artificial Sequence: Synthetic oligonucleotide
ggugagcugagaucacgc

SEQ ID NO: 66590 - RNA, 18 nt, Artificial Sequence
  Description of Artificial Sequence: Synthetic oligonucleotide
guugcggugagcugagau

SEQ ID NO: 66591 - RNA, 18 nt, Artificial Sequence
  Description of Artificial Sequence: Synthetic oligonucleotide
cggagguugcggugagcu

SEQ ID NO: 66592 - RNA, 18 nt, Artificial Sequence
  Description of Artificial Sequence: Synthetic oligonucleotide
ggaggcggagguugcggu

SEQ ID NO: 66593 - RNA, 18 nt, Artificial Sequence
  Description of Artificial Sequence: Synthetic oligonucleotide
accugggaggcggagguu

SEQ ID NO: 66594 - RNA, 18 nt, Artificial Sequence
  Description of Artificial Sequence: Synthetic oligonucleotide
cuugaaccugggaggcgg

SEQ ID NO: 66595 - RNA, 18 nt, Artificial Sequence
  Description of Artificial Sequence: Synthetic oligonucleotide
aaucacuugaaccuggga

SEQ ID NO: 66596 - RNA, 18 nt, Artificial Sequence
  Description of Artificial Sequence: Synthetic oligonucleotide
aagagaaucacuugaacc

SEQ ID NO: 66597 - RNA, 18 nt, Artificial Sequence
  Description of Artificial Sequence: Synthetic oligonucleotide
gaggcaagagaaucacuu

SEQ ID NO: 66598 - RNA, 18 nt, Artificial Sequence
  Description of Artificial Sequence: Synthetic oligonucleotide
aggcugaggcaagagaau

SEQ ID NO: 66599 - RNA, 18 nt, Artificial Sequence
  Description of Artificial Sequence: Synthetic oligonucleotide
ucgggaggcugaggcaag

SEQ ID NO: 66600 - RNA, 18 nt, Artificial Sequence
  Description of Artificial Sequence: Synthetic oligonucleotide
gcuacucgggaggcugag

SEQ ID NO: 66601 - RNA, 18 nt, Artificial Sequence
  Description of Artificial Sequence: Synthetic oligonucleotide
ucccagcuacucgggagg

SEQ ID NO: 66602 - RNA, 18 nt, Artificial Sequence
  Description of Artificial Sequence: Synthetic oligonucleotide
uguaaucccagcuacucg

SEQ ID NO: 66603 - RNA, 18 nt, Artificial Sequence
  Description of Artificial Sequence: Synthetic oligonucleotide
augccuguaaucccagcu

SEQ ID NO: 66604 - RNA, 18 nt, Artificial Sequence
  Description of Artificial Sequence: Synthetic oligonucleotide
ggcacaugccuguaaucc

SEQ ID NO: 66605 - RNA, 18 nt, Artificial Sequence
  Description of Artificial Sequence: Synthetic oligonucleotide
gugguggcacaugccugu

SEQ ID NO: 66606 - RNA, 18 nt, Artificial Sequence
  Description of Artificial Sequence: Synthetic oligonucleotide
cgggugugguggcacaug

SEQ ID NO: 66607 - RNA, 18 nt, Artificial Sequence
  Description of Artificial Sequence: Synthetic oligonucleotide
uuagccgggugugguggc

SEQ ID NO: 66608 - RNA, 18 nt, Artificial Sequence
  Description of Artificial Sequence: Synthetic oligonucleotide
cgaaauuagccgggugug

SEQ ID NO: 66609 - RNA, 18 nt, Artificial Sequence
  Description of Artificial Sequence: Synthetic oligonucleotide
aaauacgaaauuagccgg

SEQ ID NO: 66610 - RNA, 18 nt, Artificial Sequence
  Description of Artificial Sequence: Synthetic oligonucleotide
acuaaaaauacgaaauua

SEQ ID NO: 66611 - RNA, 18 nt, Artificial Sequence
  Description of Artificial Sequence: Synthetic oligonucleotide
ucucuacuaaaaauacga

SEQ ID NO: 66612 - RNA, 18 nt, Artificial Sequence
  Description of Artificial Sequence: Synthetic oligonucleotide
ccccgucucuacuaaaaa

SEQ ID NO: 66613 - RNA, 18 nt, Artificial Sequence
  Description of Artificial Sequence: Synthetic oligonucleotide
agacaccccgucucuacu

SEQ ID NO: 66614 - RNA, 18 nt, Artificial Sequence
  Description of Artificial Sequence: Synthetic oligonucleotide
cauggagacaccccgucu

SEQ ID NO: 66615 - RNA, 18 nt, Artificial Sequence
  Description of Artificial Sequence: Synthetic oligonucleotide
accaacauggagacaccc

SEQ ID NO: 66616 - RNA, 18 nt, Artificial Sequence
  Description of Artificial Sequence: Synthetic oligonucleotide
gccugaccaacauggaga

SEQ ID NO: 66617 - RNA, 18 nt, Artificial Sequence
  Description of Artificial Sequence: Synthetic oligonucleotide
gaccagccugaccaacau

SEQ ID NO: 66618 - RNA, 18 nt, Artificial Sequence
  Description of Artificial Sequence: Synthetic oligonucleotide
uucaagaccagccugacc

SEQ ID NO: 66619 - RNA, 18 nt, Artificial Sequence
  Description of Artificial Sequence: Synthetic oligonucleotide
aggaguucaagaccagcc

SEQ ID NO: 66620 - RNA, 18 nt, Artificial Sequence
  Description of Artificial Sequence: Synthetic oligonucleotide
aggucaggaguucaagac

SEQ ID NO: 66621 - RNA, 18 nt, Artificial Sequence
  Description of Artificial Sequence: Synthetic oligonucleotide
accugaggucaggaguuc

SEQ ID NO: 66622 - RNA, 18 nt, Artificial Sequence
  Description of Artificial Sequence: Synthetic oligonucleotide
agaucaccugaggucagg

SEQ ID NO: 66623 - RNA, 18 nt, Artificial Sequence
  Description of Artificial Sequence: Synthetic oligonucleotide
ugggcagaucaccugagg

SEQ ID NO: 66624 - RNA, 18 nt, Artificial Sequence
  Description of Artificial Sequence: Synthetic oligonucleotide
ugaggugggcagaucacc

SEQ ID NO: 66625 - RNA, 18 nt, Artificial Sequence
  Description of Artificial Sequence: Synthetic oligonucleotide
gaggcugaggugggcaga

SEQ ID NO: 66626 - RNA, 18 nt, Artificial Sequence
  Description of Artificial Sequence: Synthetic oligonucleotide
uuugggaggcugaggugg

SEQ ID NO: 66627 - RNA, 18 nt, Artificial Sequence
  Description of Artificial Sequence: Synthetic oligonucleotide
agcacuuugggaggcuga

SEQ ID NO: 66628 - RNA, 18 nt, Artificial Sequence
  Description of Artificial Sequence: Synthetic oligonucleotide
aucccagcacuuugggag

SEQ ID NO: 66629 - RNA, 18 nt, Artificial Sequence
  Description of Artificial Sequence: Synthetic oligonucleotide
cuguaaucccagcacuuu

SEQ ID NO: 66630 - RNA, 18 nt, Artificial Sequence
  Description of Artificial Sequence: Synthetic oligonucleotide
cacgccuguaaucccagc

SEQ ID NO: 66631 - RNA, 18 nt, Artificial Sequence
  Description of Artificial Sequence: Synthetic oligonucleotide
uggcucacgccuguaauc

SEQ ID NO: 66632 - RNA, 18 nt, Artificial Sequence
  Description of Artificial Sequence: Synthetic oligonucleotide
cgcgguggcucacgccug

SEQ ID NO: 66633 - RNA, 18 nt, Artificial Sequence
  Description of Artificial Sequence: Synthetic oligonucleotide
cugggcgcgguggcucac

SEQ ID NO: 66634 - RNA, 18 nt, Artificial Sequence
  Description of Artificial Sequence: Synthetic oligonucleotide
auaggcugggcgcggugg

SEQ ID NO: 66635 - RNA, 18 nt, Artificial Sequence
  Description of Artificial Sequence: Synthetic oligonucleotide
aauaaauaggcugggcgc

SEQ ID NO: 66636 - RNA, 18 nt, Artificial Sequence
  Description of Artificial Sequence: Synthetic oligonucleotide
uuaaaaauaaauaggcug

SEQ ID NO: 66637 - RNA, 18 nt, Artificial Sequence
  Description of Artificial Sequence: Synthetic oligonucleotide
gucacuuaaaaauaaaua

SEQ ID NO: 66638 - RNA, 18 nt, Artificial Sequence
  Description of Artificial Sequence: Synthetic oligonucleotide
aauuagucacuuaaaaau

SEQ ID NO: 66639 - RNA, 18 nt, Artificial Sequence
  Description of Artificial Sequence: Synthetic oligonucleotide
uuaaaaauuagucacuua

SEQ ID NO: 66640 - RNA, 18 nt, Artificial Sequence
  Description of Artificial Sequence: Synthetic oligonucleotide
uuaacuuaaaaauuaguc

SEQ ID NO: 66641 - RNA, 18 nt, Artificial Sequence
  Description of Artificial Sequence: Synthetic oligonucleotide
aauuuuuaacuuaaaaau

SEQ ID NO: 66642 - RNA, 18 nt, Artificial Sequence
  Description of Artificial Sequence: Synthetic oligonucleotide
ucuuuaauuuuuaacuua

SEQ ID NO: 66643 - RNA, 18 nt, Artificial Sequence
  Description of Artificial Sequence: Synthetic oligonucleotide
uucugucuuuaauuuuua

SEQ ID NO: 66644 - RNA, 18 nt, Artificial Sequence
  Description of Artificial Sequence: Synthetic oligonucleotide
caguuuucugucuuuaau

SEQ ID NO: 66645 - RNA, 18 nt, Artificial Sequence
  Description of Artificial Sequence: Synthetic oligonucleotide
cacuacaguuuucugucu

SEQ ID NO: 66646 - RNA, 18 nt, Artificial Sequence
  Description of Artificial Sequence: Synthetic oligonucleotide
guuuacacuacaguuuuc

SEQ ID NO: 66647 - RNA, 18 nt, Artificial Sequence
  Description of Artificial Sequence: Synthetic oligonucleotide
aaauuguuuacacuacag

SEQ ID NO: 66648 - RNA, 18 nt, Artificial Sequence
  Description of Artificial Sequence: Synthetic oligonucleotide
guacaaaauuguuuacac

SEQ ID NO: 66649 - RNA, 18 nt, Artificial Sequence
  Description of Artificial Sequence: Synthetic oligonucleotide
gacacguacaaaauuguu

SEQ ID NO: 66650 - RNA, 18 nt, Artificial Sequence
  Description of Artificial Sequence: Synthetic oligonucleotide
uauuagacacguacaaaa

SEQ ID NO: 66651 - RNA, 18 nt, Artificial Sequence
  Description of Artificial Sequence: Synthetic oligonucleotide
aauauuauuagacacgua

SEQ ID NO: 66652 - RNA, 18 nt, Artificial Sequence
  Description of Artificial Sequence: Synthetic oligonucleotide
auguaaauauuauuagac

SEQ ID NO: 66653 - RNA, 18 nt, Artificial Sequence
  Description of Artificial Sequence: Synthetic oligonucleotide
uggauauguaaauauuau

SEQ ID NO: 66654 - RNA, 18 nt, Artificial Sequence
  Description of Artificial Sequence: Synthetic oligonucleotide
uucuauggauauguaaau

SEQ ID NO: 66655 - RNA, 18 nt, Artificial Sequence
  Description of Artificial Sequence: Synthetic oligonucleotide
ccccuuucuauggauaug

SEQ ID NO: 66656 - RNA, 18 nt, Artificial Sequence
  Description of Artificial Sequence: Synthetic oligonucleotide
uucugccccuuucuaugg

SEQ ID NO: 66657 - RNA, 18 nt, Artificial Sequence
  Description of Artificial Sequence: Synthetic oligonucleotide
gacuauucugccccuuuc

SEQ ID NO: 66658 - RNA, 18 nt, Artificial Sequence
  Description of Artificial Sequence: Synthetic oligonucleotide
ggauagacuauucugccc

SEQ ID NO: 66659 - RNA, 18 nt, Artificial Sequence
  Description of Artificial Sequence: Synthetic oligonucleotide
guuuaggauagacuauuc

SEQ ID NO: 66660 - RNA, 18 nt, Artificial Sequence
  Description of Artificial Sequence: Synthetic oligonucleotide
ugauaguuuaggauagac

SEQ ID NO: 66661 - RNA, 18 nt, Artificial Sequence
  Description of Artificial Sequence: Synthetic oligonucleotide
auugcugauaguuuagga

SEQ ID NO: 66662 - RNA, 18 nt, Artificial Sequence
  Description of Artificial Sequence: Synthetic oligonucleotide
gcuacccaguuguaucua

SEQ ID NO: 66663 - RNA, 18 nt, Artificial Sequence
  Description of Artificial Sequence: Synthetic oligonucleotide
gaggugcuacccaguugu

SEQ ID NO: 66664 - RNA, 18 nt, Artificial Sequence
  Description of Artificial Sequence: Synthetic oligonucleotide
cucuggaggugcuaccca

SEQ ID NO: 66665 - RNA, 18 nt, Artificial Sequence
  Description of Artificial Sequence: Synthetic oligonucleotide
cauugcucuggaggugcu

SEQ ID NO: 66666 - RNA, 18 nt, Artificial Sequence
  Description of Artificial Sequence: Synthetic oligonucleotide
cauuucauugcucuggag

SEQ ID NO: 66667 - RNA, 18 nt, Artificial Sequence
  Description of Artificial Sequence: Synthetic oligonucleotide
gcuaccauuucauugcuc

SEQ ID NO: 66668 - RNA, 18 nt, Artificial Sequence
  Description of Artificial Sequence: Synthetic oligonucleotide
cuuuugcuaccauuucau

SEQ ID NO: 66669 - RNA, 18 nt, Artificial Sequence
  Description of Artificial Sequence: Synthetic oligonucleotide
guuuccuuuugcuaccau

SEQ ID NO: 66670 - RNA, 18 nt, Artificial Sequence
  Description of Artificial Sequence: Synthetic oligonucleotide
acuuuguuuccuuuugcu

SEQ ID NO: 66671 - RNA, 18 nt, Artificial Sequence
  Description of Artificial Sequence: Synthetic oligonucleotide
aggacacuuuguuuccuu

SEQ ID NO: 66672 - RNA, 18 nt, Artificial Sequence
  Description of Artificial Sequence: Synthetic oligonucleotide
ccuaaaggacacuuuguu

SEQ ID NO: 66673 - RNA, 18 nt, Artificial Sequence
  Description of Artificial Sequence: Synthetic oligonucleotide
aaagcccuaaaggacacu

SEQ ID NO: 66674 - RNA, 18 nt, Artificial Sequence
  Description of Artificial Sequence: Synthetic oligonucleotide
aagaaaaagcccuaaagg

SEQ ID NO: 66675 - RNA, 18 nt, Artificial Sequence
  Description of Artificial Sequence: Synthetic oligonucleotide
cucaaaagaaaaagcccu

SEQ ID NO: 66676 - RNA, 18 nt, Artificial Sequence
  Description of Artificial Sequence: Synthetic oligonucleotide
agucacucaaaagaaaaa

SEQ ID NO: 66677 - RNA, 18 nt, Artificial Sequence
  Description of Artificial Sequence: Synthetic oligonucleotide
aucaaagucacucaaaag

SEQ ID NO: 66678 - RNA, 18 nt, Artificial Sequence
  Description of Artificial Sequence: Synthetic oligonucleotide
gucuaaucaaagucacuc

SEQ ID NO: 66679 - RNA, 18 nt, Artificial Sequence
  Description of Artificial Sequence: Synthetic oligonucleotide
aguaagucuaaucaaagu

SEQ ID NO: 66680 - RNA, 18 nt, Artificial Sequence
  Description of Artificial Sequence: Synthetic oligonucleotide
uucuaaguaagucuaauc

SEQ ID NO: 66681 - RNA, 18 nt, Artificial Sequence
  Description of Artificial Sequence: Synthetic oligonucleotide
cauauuucuaaguaaguc

SEQ ID NO: 66682 - RNA, 18 nt, Artificial Sequence
  Description of Artificial Sequence: Synthetic oligonucleotide
agcuucauauuucuaagu

SEQ ID NO: 66683 - RNA, 18 nt, Artificial Sequence
  Description of Artificial Sequence: Synthetic oligonucleotide
gccagagcuucauauuuc

SEQ ID NO: 66684 - RNA, 18 nt, Artificial Sequence
  Description of Artificial Sequence: Synthetic oligonucleotide
gccuggccagagcuucau

SEQ ID NO: 66685 - RNA, 18 nt, Artificial Sequence
  Description of Artificial Sequence: Synthetic oligonucleotide
acugugccuggccagagc

SEQ ID NO: 66686 - RNA, 18 nt, Artificial Sequence
  Description of Artificial Sequence: Synthetic oligonucleotide
gagccacugugccuggcc

SEQ ID NO: 66687 - RNA, 18 nt, Artificial Sequence
  Description of Artificial Sequence: Synthetic oligonucleotide
ggcgugagccacugugcc

SEQ ID NO: 66688 - RNA, 18 nt, Artificial Sequence
  Description of Artificial Sequence: Synthetic oligonucleotide
uuacaggcgugagccacu

SEQ ID NO: 66689 - RNA, 18 nt, Artificial Sequence
  Description of Artificial Sequence: Synthetic oligonucleotide
ugggauuacaggcgugag

SEQ ID NO: 66690 - RNA, 18 nt, Artificial Sequence
  Description of Artificial Sequence: Synthetic oligonucleotide
agugcugggauuacaggc

SEQ ID NO: 66691 - RNA, 18 nt, Artificial Sequence
  Description of Artificial Sequence: Synthetic oligonucleotide
cccaaagugcugggauua

SEQ ID NO: 66692 - RNA, 18 nt, Artificial Sequence
  Description of Artificial Sequence: Synthetic oligonucleotide
ggccucccaaagugcugg

SEQ ID NO: 66693 - RNA, 18 nt, Artificial Sequence
  Description of Artificial Sequence: Synthetic oligonucleotide
gccucggccucccaaagu

SEQ ID NO: 66694 - RNA, 18 nt, Artificial Sequence
  Description of Artificial Sequence: Synthetic oligonucleotide
cgccugccucggccuccc

SEQ ID NO: 66695 - RNA, 18 nt, Artificial Sequence
  Description of Artificial Sequence: Synthetic oligonucleotide
ugauccgccugccucggc

SEQ ID NO: 66696 - RNA, 18 nt, Artificial Sequence
  Description of Artificial Sequence: Synthetic oligonucleotide
cuucgugauccgccugcc

SEQ ID NO: 66697 - RNA, 18 nt, Artificial Sequence
  Description of Artificial Sequence: Synthetic oligonucleotide
ccugacuucgugauccgc

SEQ ID NO: 66698 - RNA, 18 nt, Artificial Sequence
  Description of Artificial Sequence: Synthetic oligonucleotide
uaucuccugacuucguga

SEQ ID NO: 66699 - RNA, 18 nt, Artificial Sequence
  Description of Artificial Sequence: Synthetic oligonucleotide
gucucuaucuccugacuu

SEQ ID NO: 66700 - RNA, 18 nt, Artificial Sequence
  Description of Artificial Sequence: Synthetic oligonucleotide
ggauggucucuaucuccu

SEQ ID NO: 66701 - RNA, 18 nt, Artificial Sequence
  Description of Artificial Sequence: Synthetic oligonucleotide
agccaggauggucucuau

SEQ ID NO: 66702 - RNA, 18 nt, Artificial Sequence
  Description of Artificial Sequence: Synthetic oligonucleotide
guguuagccaggaugguc

SEQ ID NO: 66703 - RNA, 18 nt, Artificial Sequence
  Description of Artificial Sequence: Synthetic oligonucleotide
ucaccguguuagccagga

SEQ ID NO: 66704 - RNA, 18 nt, Artificial Sequence
  Description of Artificial Sequence: Synthetic oligonucleotide
ggguuucaccguguuagc

SEQ ID NO: 66705 - RNA, 18 nt, Artificial Sequence
  Description of Artificial Sequence: Synthetic oligonucleotide
agacaggguuucaccgug

SEQ ID NO: 66706 - RNA, 18 nt, Artificial Sequence
  Description of Artificial Sequence: Synthetic oligonucleotide
aguagagacaggguuuca

SEQ ID NO: 66707 - RNA, 18 nt, Artificial Sequence
  Description of Artificial Sequence: Synthetic oligonucleotide
uuuuuaguagagacaggg

SEQ ID NO: 66708 - RNA, 18 nt, Artificial Sequence
  Description of Artificial Sequence: Synthetic oligonucleotide
uguauuuuuuaguagaga

SEQ ID NO: 66709 - RNA, 18 nt, Artificial Sequence
  Description of Artificial Sequence: Synthetic oligonucleotide
uuuuguguauuuuuuagu

SEQ ID NO: 66710 - RNA, 18 nt, Artificial Sequence
  Description of Artificial Sequence: Synthetic oligonucleotide
gcuaauuuuguguauuuu

SEQ ID NO: 66711 - RNA, 18 nt, Artificial Sequence
  Description of Artificial Sequence: Synthetic oligonucleotide
gcccggcuaauuuugugu

SEQ ID NO: 66712 - RNA, 18 nt, Artificial Sequence
  Description of Artificial Sequence: Synthetic oligonucleotide
accacgcccggcuaauuu

SEQ ID NO: 66713 - RNA, 18 nt, Artificial Sequence
  Description of Artificial Sequence: Synthetic oligonucleotide
ccgccaccacgcccggcu

SEQ ID NO: 66714 - RNA, 18 nt, Artificial Sequence
  Description of Artificial Sequence: Synthetic oligonucleotide
ggcgcccgccaccacgcc

SEQ ID NO: 66715 - RNA, 18 nt, Artificial Sequence
  Description of Artificial Sequence: Synthetic oligonucleotide
ccacaggcgcccgccacc

SEQ ID NO: 66716 - RNA, 18 nt, Artificial Sequence
  Description of Artificial Sequence: Synthetic oligonucleotide
ugggaccacaggcgcccg

SEQ ID NO: 66717 - RNA, 18 nt, Artificial Sequence
  Description of Artificial Sequence: Synthetic oligonucleotide
guagcugggaccacaggc

SEQ ID NO: 66718 - RNA, 18 nt, Artificial Sequence
  Description of Artificial Sequence: Synthetic oligonucleotide
ccugaguagcugggacca

SEQ ID NO: 66719 - RNA, 18 nt, Artificial Sequence
  Description of Artificial Sequence: Synthetic oligonucleotide
agccuccugaguagcugg

SEQ ID NO: 66720 - RNA, 18 nt, Artificial Sequence
  Description of Artificial Sequence: Synthetic oligonucleotide
gccucagccuccugagua

SEQ ID NO: 66721 - RNA, 18 nt, Artificial Sequence
  Description of Artificial Sequence: Synthetic oligonucleotide
cuccugccucagccuccu

SEQ ID NO: 66722 - RNA, 18 nt, Artificial Sequence
  Description of Artificial Sequence: Synthetic oligonucleotide
ccauucuccugccucagc

SEQ ID NO: 66723 - RNA, 18 nt, Artificial Sequence
  Description of Artificial Sequence: Synthetic oligonucleotide
ucaugccauucuccugcc

SEQ ID NO: 66724 - RNA, 18 nt, Artificial Sequence
  Description of Artificial Sequence: Synthetic oligonucleotide
uggguucaugccauucuc

SEQ ID NO: 66725 - RNA, 18 nt, Artificial Sequence
  Description of Artificial Sequence: Synthetic oligonucleotide
cuuccuggguucaugcca

SEQ ID NO: 66726 - RNA, 18 nt, Artificial Sequence
  Description of Artificial Sequence: Synthetic oligonucleotide
cuccccuuccuggguuca

SEQ ID NO: 66727 - RNA, 18 nt, Artificial Sequence
  Description of Artificial Sequence: Synthetic oligonucleotide
gcaagcuccccuuccugg

SEQ ID NO: 66728 - RNA, 18 nt, Artificial Sequence
  Description of Artificial Sequence: Synthetic oligonucleotide
ugacugcaagcuccccuu

SEQ ID NO: 66729 - RNA, 18 nt, Artificial Sequence
  Description of Artificial Sequence: Synthetic oligonucleotide
uuggcugacugcaagcuc

SEQ ID NO: 66730 - RNA, 18 nt, Artificial Sequence
  Description of Artificial Sequence: Synthetic oligonucleotide
cgaucuuggcugacugca

SEQ ID NO: 66731 - RNA, 18 nt, Artificial Sequence
  Description of Artificial Sequence: Synthetic oligonucleotide
uggcgcgaucuuggcuga

SEQ ID NO: 66732 - RNA, 18 nt, Artificial Sequence
  Description of Artificial Sequence: Synthetic oligonucleotide
ugcaguggcgcgaucuug

SEQ ID NO: 66733 - RNA, 18 nt, Artificial Sequence
  Description of Artificial Sequence: Synthetic oligonucleotide
uggagugcaguggcgcga

SEQ ID NO: 66734 - RNA, 18 nt, Artificial Sequence
  Description of Artificial Sequence: Synthetic oligonucleotide
caggcuggagugcagugg

SEQ ID NO: 66735 - RNA, 18 nt, Artificial Sequence
  Description of Artificial Sequence: Synthetic oligonucleotide
ucguccaggcuggagugc

SEQ ID NO: 66736 - RNA, 18 nt, Artificial Sequence
  Description of Artificial Sequence: Synthetic oligonucleotide
cacugucguccaggcugg

SEQ ID NO: 66737 - RNA, 18 nt, Artificial Sequence
  Description of Artificial Sequence: Synthetic oligonucleotide
ucucgcacugucguccag

SEQ ID NO: 66738 - RNA, 18 nt, Artificial Sequence
  Description of Artificial Sequence: Synthetic oligonucleotide
cggagucucgcacugucg

SEQ ID NO: 66739 - RNA, 18 nt, Artificial Sequence
  Description of Artificial Sequence: Synthetic oligonucleotide
ugagacggagucucgcac

SEQ ID NO: 66740 - RNA, 18 nt, Artificial Sequence
  Description of Artificial Sequence: Synthetic oligonucleotide
uuuuuugagacggagucu

SEQ ID NO: 66741 - RNA, 18 nt, Artificial Sequence
  Description of Artificial Sequence: Synthetic oligonucleotide
uuuuuuuuuuugagacgg

SEQ ID NO: 66742 - RNA, 18 nt, Artificial Sequence
  Description of Artificial Sequence: Synthetic oligonucleotide
uuucuuuuuuuuuuuuga

SEQ ID NO: 66743 - RNA, 18 nt, Artificial Sequence
  Description of Artificial Sequence: Synthetic oligonucleotide
ucauauuucuuuuuuuuu

SEQ ID NO: 66744 - RNA, 18 nt, Artificial Sequence
  Description of Artificial Sequence: Synthetic oligonucleotide
gagcuucauauuucuuuu

SEQ ID NO: 66745 - RNA, 18 nt, Artificial Sequence
  Description of Artificial Sequence: Synthetic oligonucleotide
guucagagcuucauauuu

SEQ ID NO: 66746 - RNA, 18 nt, Artificial Sequence
  Description of Artificial Sequence: Synthetic oligonucleotide
gauuaguucagagcuuca

SEQ ID NO: 66747 - RNA, 18 nt, Artificial Sequence
  Description of Artificial Sequence: Synthetic oligonucleotide
cugaagauuaguucagag

SEQ ID NO: 66748 - RNA, 18 nt, Artificial Sequence
  Description of Artificial Sequence: Synthetic oligonucleotide
cauuucugaagauuaguu

SEQ ID NO: 66749 - RNA, 18 nt, Artificial Sequence
  Description of Artificial Sequence: Synthetic oligonucleotide
uuaaccauuucugaagau

SEQ ID NO: 66750 - RNA, 18 nt, Artificial Sequence
  Description of Artificial Sequence: Synthetic oligonucleotide
gugcuuuaaccauuucug

SEQ ID NO: 66751 - RNA, 18 nt, Artificial Sequence
  Description of Artificial Sequence: Synthetic oligonucleotide
agaaugugcuuuaaccau

SEQ ID NO: 66752 - RNA, 18 nt, Artificial Sequence
  Description of Artificial Sequence: Synthetic oligonucleotide
auauaagaaugugcuuua

SEQ ID NO: 66753 - RNA, 18 nt, Artificial Sequence
  Description of Artificial Sequence: Synthetic oligonucleotide
caacuauauaagaaugug

SEQ ID NO: 66754 - RNA, 18 nt, Artificial Sequence
  Description of Artificial Sequence: Synthetic oligonucleotide
uuuuucaacuauauaaga

SEQ ID NO: 66755 - RNA, 18 nt, Artificial Sequence
  Description of Artificial Sequence: Synthetic oligonucleotide
auaucuuuuucaacuaua

SEQ ID NO: 66756 - RNA, 18 nt, Artificial Sequence
  Description of Artificial Sequence: Synthetic oligonucleotide
ucaauauaucuuuuucaa

SEQ ID NO: 66757 - RNA, 18 nt, Artificial Sequence
  Description of Artificial Sequence: Synthetic oligonucleotide
uaguuucaauauaucuuu

SEQ ID NO: 66758 - RNA, 18 nt, Artificial Sequence
  Description of Artificial Sequence: Synthetic oligonucleotide
uuaauuaguuucaauaua

SEQ ID NO: 66759 - RNA, 18 nt, Artificial Sequence
  Description of Artificial Sequence: Synthetic oligonucleotide
uggccacugugcugcuga

SEQ ID NO: 66760 - RNA, 18 nt, Artificial Sequence
  Description of Artificial Sequence: Synthetic oligonucleotide
uuccauggccacugugcu

SEQ ID NO: 66761 - RNA, 18 nt, Artificial Sequence
  Description of Artificial Sequence: Synthetic oligonucleotide
ucuuuuuccauggccacu

SEQ ID NO: 66762 - RNA, 18 nt, Artificial Sequence
  Description of Artificial Sequence: Synthetic oligonucleotide
guuuuucuuuuuccaugg

SEQ ID NO: 66763 - RNA, 18 nt, Artificial Sequence
  Description of Artificial Sequence: Synthetic oligonucleotide
guagaguuuuucuuuuuc

SEQ ID NO: 66764 - RNA, 18 nt, Artificial Sequence
  Description of Artificial Sequence: Synthetic oligonucleotide
augcuguagaguuuuucu

SEQ ID NO: 66765 - RNA, 18 nt, Artificial Sequence
  Description of Artificial Sequence: Synthetic oligonucleotide
gaaauaugcuguagaguu

SEQ ID NO: 66766 - RNA, 18 nt, Artificial Sequence
  Description of Artificial Sequence: Synthetic oligonucleotide
ccucggaaauaugcugua

SEQ ID NO: 66767 - RNA, 18 nt, Artificial Sequence
  Description of Artificial Sequence: Synthetic oligonucleotide
uugauccucggaaauaug

SEQ ID NO: 66768 - RNA, 18 nt, Artificial Sequence
  Description of Artificial Sequence: Synthetic oligonucleotide
cuggacaugggcaaccug

SEQ ID NO: 66769 - RNA, 18 nt, Artificial Sequence
  Description of Artificial Sequence: Synthetic oligonucleotide
uuuuccuggacaugggca

SEQ ID NO: 66770 - RNA, 18 nt, Artificial Sequence
  Description of Artificial Sequence: Synthetic oligonucleotide
ccaucuuuuccuggacau

SEQ ID NO: 66771 - RNA, 18 nt, Artificial Sequence
  Description of Artificial Sequence: Synthetic oligonucleotide
gggauccaucuuuuccug

SEQ ID NO: 66772 - RNA, 18 nt, Artificial Sequence
  Description of Artificial Sequence: Synthetic oligonucleotide
gagaagauuuggauaggg

SEQ ID NO: 66773 - RNA, 18 nt, Artificial Sequence
  Description of Artificial Sequence: Synthetic oligonucleotide
cggagaagauuuggauag

SEQ ID NO: 66774 - RNA, 18 nt, Artificial Sequence
  Description of Artificial Sequence: Synthetic oligonucleotide
caccacggagaagauuug

SEQ ID NO: 66775 - RNA, 18 nt, Artificial Sequence
  Description of Artificial Sequence: Synthetic oligonucleotide
acacacaccacggagaag

SEQ ID NO: 66776 - RNA, 18 nt, Artificial Sequence
  Description of Artificial Sequence: Synthetic oligonucleotide
cacccacacacaccacgg

SEQ ID NO: 66777 - RNA, 18 nt, Artificial Sequence
  Description of Artificial Sequence: Synthetic oligonucleotide
uccuccacccacacacac

SEQ ID NO: 66778 - RNA, 18 nt, Artificial Sequence
  Description of Artificial Sequence: Synthetic oligonucleotide
uccacuccuccacccaca

SEQ ID NO: 66779 - RNA, 18 nt, Artificial Sequence
  Description of Artificial Sequence: Synthetic oligonucleotide
caggguccacuccuccac

SEQ ID NO: 66780 - RNA, 18 nt, Artificial Sequence
  Description of Artificial Sequence: Synthetic oligonucleotide
uggaccaggguccacucc

SEQ ID NO: 66781 - RNA, 18 nt, Artificial Sequence
  Description of Artificial Sequence: Synthetic oligonucleotide
cugccuggaccagggucc

SEQ ID NO: 66782 - RNA, 18 nt, Artificial Sequence
  Description of Artificial Sequence: Synthetic oligonucleotide
agccccugccuggaccag

SEQ ID NO: 66783 - RNA, 18 nt, Artificial Sequence
  Description of Artificial Sequence: Synthetic oligonucleotide
ccuggagccccugccugg

SEQ ID NO: 66784 - RNA, 18 nt, Artificial Sequence
  Description of Artificial Sequence: Synthetic oligonucleotide
ucuucccuggagccccug

SEQ ID NO: 66785 - RNA, 18 nt, Artificial Sequence
  Description of Artificial Sequence: Synthetic oligonucleotide
ccuucucuucccuggagc

SEQ ID NO: 66786 - RNA, 18 nt, Artificial Sequence
  Description of Artificial Sequence: Synthetic oligonucleotide
ugacgccuucucuucccu

SEQ ID NO: 66787 - RNA, 18 nt, Artificial Sequence
  Description of Artificial Sequence: Synthetic oligonucleotide
ggaagugacgccuucucu

SEQ ID NO: 66788 - RNA, 18 nt, Artificial Sequence
  Description of Artificial Sequence: Synthetic oligonucleotide
cccccggaagugacgccu

SEQ ID NO: 66789 - RNA, 18 nt, Artificial Sequence
  Description of Artificial Sequence: Synthetic oligonucleotide
gaaggcccccggaaguga

SEQ ID NO: 66790 - RNA, 18 nt, Artificial Sequence
  Description of Artificial Sequence: Synthetic oligonucleotide
cuggugaaggcccccgga

SEQ ID NO: 66791 - RNA, 18 nt, Artificial Sequence
  Description of Artificial Sequence: Synthetic oligonucleotide
agacacuggugaaggccc

SEQ ID NO: 66792 - RNA, 18 nt, Artificial Sequence
  Description of Artificial Sequence: Synthetic oligonucleotide
ccaccagacacuggugaa

SEQ ID NO: 66793 - RNA, 18 nt, Artificial Sequence
  Description of Artificial Sequence: Synthetic oligonucleotide
gggagccaccagacacug

SEQ ID NO: 66794 - RNA, 18 nt, Artificial Sequence
  Description of Artificial Sequence: Synthetic oligonucleotide
gagaagggagccaccaga

SEQ ID NO: 66795 - RNA, 18 nt, Artificial Sequence
  Description of Artificial Sequence: Synthetic oligonucleotide
aaucagagaagggagcca

SEQ ID NO: 66796 - RNA, 18 nt, Artificial Sequence
  Description of Artificial Sequence: Synthetic oligonucleotide
ugcccaaucagagaaggg

SEQ ID NO: 66797 - RNA, 18 nt, Artificial Sequence
  Description of Artificial Sequence: Synthetic oligonucleotide
acuucugcccaaucagag

SEQ ID NO: 66798 - RNA, 18 nt, Artificial Sequence
  Description of Artificial Sequence: Synthetic oligonucleotide
gggccacuucugcccaau

SEQ ID NO: 66799 - RNA, 18 nt, Artificial Sequence
  Description of Artificial Sequence: Synthetic oligonucleotide
ugccugggccacuucugc

SEQ ID NO: 66800 - RNA, 18 nt, Artificial Sequence
  Description of Artificial Sequence: Synthetic oligonucleotide
acgccugccugggccacu

SEQ ID NO: 66801 - RNA, 18 nt, Artificial Sequence
  Description of Artificial Sequence: Synthetic oligonucleotide
gucauacgccugccuggg

SEQ ID NO: 66802 - RNA, 18 nt, Artificial Sequence
  Description of Artificial Sequence: Synthetic oligonucleotide
agcaggucauacgccugc

SEQ ID NO: 66803 - RNA, 18 nt, Artificial Sequence
  Description of Artificial Sequence: Synthetic oligonucleotide
acagcagcaggucauacg

SEQ ID NO: 66804 - RNA, 18 nt, Artificial Sequence
  Description of Artificial Sequence: Synthetic oligonucleotide
ccuccacagcagcagguc

SEQ ID NO: 66805 - RNA, 18 nt, Artificial Sequence
  Description of Artificial Sequence: Synthetic oligonucleotide
cagccccuccacagcagc

SEQ ID NO: 66806 - RNA, 18 nt, Artificial Sequence
  Description of Artificial Sequence: Synthetic oligonucleotide
gggcacagccccuccaca

SEQ ID NO: 66807 - RNA, 18 nt, Artificial Sequence
  Description of Artificial Sequence: Synthetic oligonucleotide
aagacauguggcgguggg

SEQ ID NO: 66808 - RNA, 18 nt, Artificial Sequence
  Description of Artificial Sequence: Synthetic oligonucleotide
aggaagacauguggcggu

SEQ ID NO: 66809 - RNA, 18 nt, Artificial Sequence
  Description of Artificial Sequence: Synthetic oligonucleotide
uggguaggaagacaugug

SEQ ID NO: 66810 - RNA, 18 nt, Artificial Sequence
  Description of Artificial Sequence: Synthetic oligonucleotide
gcagauggguaggaagac

SEQ ID NO: 66811 - RNA, 18 nt, Artificial Sequence
  Description of Artificial Sequence: Synthetic oligonucleotide
agcaggcagcccucuggg

SEQ ID NO: 66812 - RNA, 18 nt, Artificial Sequence
  Description of Artificial Sequence: Synthetic oligonucleotide
ugcacagcaggcagcccu

SEQ ID NO: 66813 - RNA, 18 nt, Artificial Sequence
  Description of Artificial Sequence: Synthetic oligonucleotide
ccaagugcacagcaggca

SEQ ID NO: 66814 - RNA, 18 nt, Artificial Sequence
  Description of Artificial Sequence: Synthetic oligonucleotide
aggacccaagugcacagc

SEQ ID NO: 66815 - RNA, 18 nt, Artificial Sequence
  Description of Artificial Sequence: Synthetic oligonucleotide
gcuccaggacccaagugc

SEQ ID NO: 66816 - RNA, 18 nt, Artificial Sequence
  Description of Artificial Sequence: Synthetic oligonucleotide
gaagggcuccaggaccca

SEQ ID NO: 66817 - RNA, 18 nt, Artificial Sequence
  Description of Artificial Sequence: Synthetic oligonucleotide
guggagaagggcuccagg

SEQ ID NO: 66818 - RNA, 18 nt, Artificial Sequence
  Description of Artificial Sequence: Synthetic oligonucleotide
cccacacccugcuggcca

SEQ ID NO: 66819 - RNA, 18 nt, Artificial Sequence
  Description of Artificial Sequence: Synthetic oligonucleotide
auaaccccacacccugcu

SEQ ID NO: 66820 - RNA, 18 nt, Artificial Sequence
  Description of Artificial Sequence: Synthetic oligonucleotide
cucacauaaccccacacc

SEQ ID NO: 66821 - RNA, 18 nt, Artificial Sequence
  Description of Artificial Sequence: Synthetic oligonucleotide
cuacccucacauaacccc

SEQ ID NO: 66822 - RNA, 18 nt, Artificial Sequence
  Description of Artificial Sequence: Synthetic oligonucleotide
ccuuucuacccucacaua

SEQ ID NO: 66823 - RNA, 18 nt, Artificial Sequence
  Description of Artificial Sequence: Synthetic oligonucleotide
gcuguccuuucuacccuc

SEQ ID NO: 66824 - RNA, 18 nt, Artificial Sequence
  Description of Artificial Sequence: Synthetic oligonucleotide
ucuuugcuguccuuucua

SEQ ID NO: 66825 - RNA, 18 nt, Artificial Sequence
  Description of Artificial Sequence: Synthetic oligonucleotide
auuucucuuugcuguccu

SEQ ID NO: 66826 - RNA, 18 nt, Artificial Sequence
  Description of Artificial Sequence: Synthetic oligonucleotide
agcccauuucucuuugcu

SEQ ID NO: 66827 - RNA, 18 nt, Artificial Sequence
  Description of Artificial Sequence: Synthetic oligonucleotide
cugggagcccauuucucu

SEQ ID NO: 66828 - RNA, 18 nt, Artificial Sequence
  Description of Artificial Sequence: Synthetic oligonucleotide
cccagcugggagcccauu

SEQ ID NO: 66829 - RNA, 18 nt, Artificial Sequence
  Description of Artificial Sequence: Synthetic oligonucleotide
ccucccccagcugggagc

SEQ ID NO: 66830 - RNA, 18 nt, Artificial Sequence
  Description of Artificial Sequence: Synthetic oligonucleotide
cugccccucccccagcug

SEQ ID NO: 66831 - RNA, 18 nt, Artificial Sequence
  Description of Artificial Sequence: Synthetic oligonucleotide
uuugccugccccuccccc

SEQ ID NO: 66832 - RNA, 18 nt, Artificial Sequence
  Description of Artificial Sequence: Synthetic oligonucleotide
uccaguuugccugccccu

SEQ ID NO: 66833 - RNA, 18 nt, Artificial Sequence
  Description of Artificial Sequence: Synthetic oligonucleotide
uagguuccaguuugccug

SEQ ID NO: 66834 - RNA, 18 nt, Artificial Sequence
  Description of Artificial Sequence: Synthetic oligonucleotide
gccuguagguuccaguuu

SEQ ID NO: 66835 - RNA, 18 nt, Artificial Sequence
  Description of Artificial Sequence: Synthetic oligonucleotide
ucagugccuguagguucc

SEQ ID NO: 66836 - RNA, 18 nt, Artificial Sequence
  Description of Artificial Sequence: Synthetic oligonucleotide
aaaggucagugccuguag

SEQ ID NO: 66837 - RNA, 18 nt, Artificial Sequence
  Description of Artificial Sequence: Synthetic oligonucleotide
ucgacaaaggucagugcc

SEQ ID NO: 66838 - RNA, 18 nt, Artificial Sequence
  Description of Artificial Sequence: Synthetic oligonucleotide
ucuucucgacaaagguca

SEQ ID NO: 66839 - RNA, 18 nt, Artificial Sequence
  Description of Artificial Sequence: Synthetic oligonucleotide
uacacucuucucgacaaa

SEQ ID NO: 66840 - RNA, 18 nt, Artificial Sequence
  Description of Artificial Sequence: Synthetic oligonucleotide
aaggcuacacucuucucg

SEQ ID NO: 66841 - RNA, 18 nt, Artificial Sequence
  Description of Artificial Sequence: Synthetic oligonucleotide
cugggaaggcuacacucu

SEQ ID NO: 66842 - RNA, 18 nt, Artificial Sequence
  Description of Artificial Sequence: Synthetic oligonucleotide
ccauucugggaaggcuac

SEQ ID NO: 66843 - RNA, 18 nt, Artificial Sequence
  Description of Artificial Sequence: Synthetic oligonucleotide
uccucccauucugggaag

SEQ ID NO: 66844 - RNA, 18 nt, Artificial Sequence
  Description of Artificial Sequence: Synthetic oligonucleotide
ccugcuccucccauucug

SEQ ID NO: 66845 - RNA, 18 nt, Artificial Sequence
  Description of Artificial Sequence: Synthetic oligonucleotide
ucugcccugcuccuccca

SEQ ID NO: 66846 - RNA, 18 nt, Artificial Sequence
  Description of Artificial Sequence: Synthetic oligonucleotide
ccugcucugcccugcucc

SEQ ID NO: 66847 - RNA, 18 nt, Artificial Sequence
  Description of Artificial Sequence: Synthetic oligonucleotide
cuaccccugcucugcccu

SEQ ID NO: 66848 - RNA, 18 nt, Artificial Sequence
  Description of Artificial Sequence: Synthetic oligonucleotide
acccccuaccccugcucu

SEQ ID NO: 66849 - RNA, 18 nt, Artificial Sequence
  Description of Artificial Sequence: Synthetic oligonucleotide
accccacccccuaccccu

SEQ ID NO: 66850 - RNA, 18 nt, Artificial Sequence
  Description of Artificial Sequence: Synthetic oligonucleotide
ccagcaccccacccccua

SEQ ID NO: 66851 - RNA, 18 nt, Artificial Sequence
  Description of Artificial Sequence: Synthetic oligonucleotide
agaaaccagcaccccacc

SEQ ID NO: 66852 - RNA, 18 nt, Artificial Sequence
  Description of Artificial Sequence: Synthetic oligonucleotide
cccucagaaaccagcacc

SEQ ID NO: 66853 - RNA, 18 nt, Artificial Sequence
  Description of Artificial Sequence: Synthetic oligonucleotide
ucagucccucagaaacca

SEQ ID NO: 66854 - RNA, 18 nt, Artificial Sequence
  Description of Artificial Sequence: Synthetic oligonucleotide
agugaucagucccucaga

SEQ ID NO: 66855 - RNA, 18 nt, Artificial Sequence
  Description of Artificial Sequence: Synthetic oligonucleotide
aaguaagugaucaguccc

SEQ ID NO: 66856 - RNA, 18 nt, Artificial Sequence
  Description of Artificial Sequence: Synthetic oligonucleotide
ccaccaaguaagugauca

SEQ ID NO: 66857 - RNA, 18 nt, Artificial Sequence
  Description of Artificial Sequence: Synthetic oligonucleotide
guauuccaccaaguaagu

SEQ ID NO: 66858 - RNA, 18 nt, Artificial Sequence
  Description of Artificial Sequence: Synthetic oligonucleotide
gugcuguauuccaccaag

SEQ ID NO: 66859 - RNA, 18 nt, Artificial Sequence
  Description of Artificial Sequence: Synthetic oligonucleotide
gggcugugcuguauucca

SEQ ID NO: 66860 - RNA, 18 nt, Artificial Sequence
  Description of Artificial Sequence: Synthetic oligonucleotide
agccagggcugugcugua

SEQ ID NO: 66861 - RNA, 18 nt, Artificial Sequence
  Description of Artificial Sequence: Synthetic oligonucleotide
gggccagccagggcugug

SEQ ID NO: 66862 - RNA, 18 nt, Artificial Sequence
  Description of Artificial Sequence: Synthetic oligonucleotide
ccuuagggccagccaggg

SEQ ID NO: 66863 - RNA, 18 nt, Artificial Sequence
  Description of Artificial Sequence: Synthetic oligonucleotide
ccuuuccuuagggccagc

SEQ ID NO: 66864 - RNA, 18 nt, Artificial Sequence
  Description of Artificial Sequence: Synthetic oligonucleotide
uguccccuuuccuuaggg

SEQ ID NO: 66865 - RNA, 18 nt, Artificial Sequence
  Description of Artificial Sequence: Synthetic oligonucleotide
gcucauguccccuuuccu

SEQ ID NO: 66866 - RNA, 18 nt, Artificial Sequence
  Description of Artificial Sequence: Synthetic oligonucleotide
ccugggcucauguccccu

SEQ ID NO: 66867 - RNA, 18 nt, Artificial Sequence
  Description of Artificial Sequence: Synthetic oligonucleotide
uucucccugggcucaugu

SEQ ID NO: 66868 - RNA, 18 nt, Artificial Sequence
  Description of Artificial Sequence: Synthetic oligonucleotide
uuauuuucucccugggcu

SEQ ID NO: 66869 - RNA, 18 nt, Artificial Sequence
  Description of Artificial Sequence: Synthetic oligonucleotide
cucucuuauuuucucccu

SEQ ID NO: 66870 - RNA, 18 nt, Artificial Sequence
  Description of Artificial Sequence: Synthetic oligonucleotide
gcucccucucuuauuuuc

SEQ ID NO: 66871 - RNA, 18 nt, Artificial Sequence
  Description of Artificial Sequence: Synthetic oligonucleotide
gugcagcucccucucuua

SEQ ID NO: 66872 - RNA, 18 nt, Artificial Sequence
  Description of Artificial Sequence: Synthetic oligonucleotide
ccuaagugcagcucccuc

SEQ ID NO: 66873 - RNA, 18 nt, Artificial Sequence
  Description of Artificial Sequence: Synthetic oligonucleotide
uaagcccuaagugcagcu

SEQ ID NO: 66874 - RNA, 18 nt, Artificial Sequence
  Description of Artificial Sequence: Synthetic oligonucleotide
uuugcuaagcccuaagug

SEQ ID NO: 66875 - RNA, 18 nt, Artificial Sequence
  Description of Artificial Sequence: Synthetic oligonucleotide
cuguguuugcuaagcccu

SEQ ID NO: 66876 - RNA, 18 nt, Artificial Sequence
  Description of Artificial Sequence: Synthetic oligonucleotide
uacuacuguguuugcuaa

SEQ ID NO: 66877 - RNA, 18 nt, Artificial Sequence
  Description of Artificial Sequence: Synthetic oligonucleotide
caucuuacuacuguguuu

SEQ ID NO: 66878 - RNA, 18 nt, Artificial Sequence
  Description of Artificial Sequence: Synthetic oligonucleotide
guguccaucuuacuacug

SEQ ID NO: 66879 - RNA, 18 nt, Artificial Sequence
  Description of Artificial Sequence: Synthetic oligonucleotide
gggcuguguccaucuuac

SEQ ID NO: 66880 - RNA, 18 nt, Artificial Sequence
  Description of Artificial Sequence: Synthetic oligonucleotide
aaugaccagcuaagaaug

SEQ ID NO: 66881 - RNA, 18 nt, Artificial Sequence
  Description of Artificial Sequence: Synthetic oligonucleotide
cgaggaaugaccagcuaa

SEQ ID NO: 66882 - RNA, 18 nt, Artificial Sequence
  Description of Artificial Sequence: Synthetic oligonucleotide
gcuaacgaggaaugacca

SEQ ID NO: 66883 - RNA, 18 nt, Artificial Sequence
  Description of Artificial Sequence: Synthetic oligonucleotide
cuuaagcuaacgaggaau

SEQ ID NO: 66884 - RNA, 18 nt, Artificial Sequence
  Description of Artificial Sequence: Synthetic oligonucleotide
agaaccuuaagcuaacga

SEQ ID NO: 66885 - RNA, 18 nt, Artificial Sequence
  Description of Artificial Sequence: Synthetic oligonucleotide
gauucagaaccuuaagcu

SEQ ID NO: 66886 - RNA, 18 nt, Artificial Sequence
  Description of Artificial Sequence: Synthetic oligonucleotide
caccagauucagaaccuu

SEQ ID NO: 66887 - RNA, 18 nt, Artificial Sequence
  Description of Artificial Sequence: Synthetic oligonucleotide
cccagcaccagauucaga

SEQ ID NO: 66888 - RNA, 18 nt, Artificial Sequence
  Description of Artificial Sequence: Synthetic oligonucleotide
gcuuccccagcaccagau

SEQ ID NO: 66889 - RNA, 18 nt, Artificial Sequence
  Description of Artificial Sequence: Synthetic oligonucleotide
gcccagcuuccccagcac

SEQ ID NO: 66890 - RNA, 18 nt, Artificial Sequence
  Description of Artificial Sequence: Synthetic oligonucleotide
gccuggcccagcuucccc

SEQ ID NO: 66891 - RNA, 18 nt, Artificial Sequence
  Description of Artificial Sequence: Synthetic oligonucleotide
ggcuugccuggcccagcu

SEQ ID NO: 66892 - RNA, 18 nt, Artificial Sequence
  Description of Artificial Sequence: Synthetic oligonucleotide
gcccuggcuugccuggcc

SEQ ID NO: 66893 - RNA, 18 nt, Artificial Sequence
  Description of Artificial Sequence: Synthetic oligonucleotide
cuugcgcccuggcuugcc

SEQ ID NO: 66894 - RNA, 18 nt, Artificial Sequence
  Description of Artificial Sequence: Synthetic oligonucleotide
cucuccuugcgcccuggc

SEQ ID NO: 66895 - RNA, 18 nt, Artificial Sequence
  Description of Artificial Sequence: Synthetic oligonucleotide
uuacccucuccuugcgcc

SEQ ID NO: 66896 - RNA, 18 nt, Artificial Sequence
  Description of Artificial Sequence: Synthetic oligonucleotide
ucccauuacccucuccuu

SEQ ID NO: 66897 - RNA, 18 nt, Artificial Sequence
  Description of Artificial Sequence: Synthetic oligonucleotide
ccuccucccauuacccuc

SEQ ID NO: 66898 - RNA, 18 nt, Artificial Sequence
  Description of Artificial Sequence: Synthetic oligonucleotide
ugggcccuccucccauua

SEQ ID NO: 66899 - RNA, 18 nt, Artificial Sequence
  Description of Artificial Sequence: Synthetic oligonucleotide
augagugggcccuccucc

SEQ ID NO: 66900 - RNA, 18 nt, Artificial Sequence
  Description of Artificial Sequence: Synthetic oligonucleotide
ucaacaugagugggcccu

SEQ ID NO: 66901 - RNA, 18 nt, Artificial Sequence
  Description of Artificial Sequence: Synthetic oligonucleotide
gucugucaacaugagugg

SEQ ID NO: 66902 - RNA, 18 nt, Artificial Sequence
  Description of Artificial Sequence: Synthetic oligonucleotide
uguaggucugucaacaug

SEQ ID NO: 66903 - RNA, 18 nt, Artificial Sequence
  Description of Artificial Sequence: Synthetic oligonucleotide
uuuccuguaggucuguca

SEQ ID NO: 66904 - RNA, 18 nt, Artificial Sequence
  Description of Artificial Sequence: Synthetic oligonucleotide
ugggauuuccuguagguc

SEQ ID NO: 66905 - RNA, 18 nt, Artificial Sequence
  Description of Artificial Sequence: Synthetic oligonucleotide
aauauugggauuuccugu

SEQ ID NO: 66906 - RNA, 18 nt, Artificial Sequence
  Description of Artificial Sequence: Synthetic oligonucleotide
gauucaauauugggauuu

SEQ ID NO: 66907 - RNA, 18 nt, Artificial Sequence
  Description of Artificial Sequence: Synthetic oligonucleotide
caccugauucaauauugg

SEQ ID NO: 66908 - RNA, 18 nt, Artificial Sequence
  Description of Artificial Sequence: Synthetic oligonucleotide
gcuugcaccugauucaau

SEQ ID NO: 66909 - RNA, 18 nt, Artificial Sequence
  Description of Artificial Sequence: Synthetic oligonucleotide
aagaggcuugcaccugau

SEQ ID NO: 66910 - RNA, 18 nt, Artificial Sequence
  Description of Artificial Sequence: Synthetic oligonucleotide
gugcaaagaggcuugcac

SEQ ID NO: 66911 - RNA, 18 nt, Artificial Sequence
  Description of Artificial Sequence: Synthetic oligonucleotide
aaguugugcaaagaggcu

SEQ ID NO: 66912 - RNA, 18 nt, Artificial Sequence
  Description of Artificial Sequence: Synthetic oligonucleotide
uucacaaguugugcaaag

SEQ ID NO: 66913 - RNA, 18 nt, Artificial Sequence
  Description of Artificial Sequence: Synthetic oligonucleotide
ucuccuuuuugucaggac

SEQ ID NO: 66914 - RNA, 18 nt, Artificial Sequence
  Description of Artificial Sequence: Synthetic oligonucleotide
uggugucuccuuuuuguc

SEQ ID NO: 66915 - RNA, 18 nt, Artificial Sequence
  Description of Artificial Sequence: Synthetic oligonucleotide
gcauauggugucuccuuu

SEQ ID NO: 66916 - RNA, 18 nt, Artificial Sequence
  Description of Artificial Sequence: Synthetic oligonucleotide
agaaagcauauggugucu

SEQ ID NO: 66917 - RNA, 18 nt, Artificial Sequence
  Description of Artificial Sequence: Synthetic oligonucleotide
aagcaagaaagcauaugg

SEQ ID NO: 66918 - RNA, 18 nt, Artificial Sequence
  Description of Artificial Sequence: Synthetic oligonucleotide
aaagaaagcaagaaagca

SEQ ID NO: 66919 - RNA, 18 nt, Artificial Sequence
  Description of Artificial Sequence: Synthetic oligonucleotide
gaaagaaagaaagcaaga

SEQ ID NO: 66920 - RNA, 18 nt, Artificial Sequence
  Description of Artificial Sequence: Synthetic oligonucleotide
agaaagaaagaaagaaag

SEQ ID NO: 66921 - RNA, 18 nt, Artificial Sequence
  Description of Artificial Sequence: Synthetic oligonucleotide
aagaaagaaagaaagaaa

SEQ ID NO: 66922 - RNA, 18 nt, Artificial Sequence
  Description of Artificial Sequence: Synthetic oligonucleotide
aaagaaagaaagaaagaa

SEQ ID NO: 66923 - RNA, 18 nt, Artificial Sequence
  Description of Artificial Sequence: Synthetic oligonucleotide
aaaaaaaagaaagaaaga

SEQ ID NO: 66924 - RNA, 18 nt, Artificial Sequence
  Description of Artificial Sequence: Synthetic oligonucleotide
caaaaaaaaaaaagaaag

SEQ ID NO: 66925 - RNA, 18 nt, Artificial Sequence
  Description of Artificial Sequence: Synthetic oligonucleotide
cgucucaaaaaaaaaaaa

SEQ ID NO: 66926 - RNA, 18 nt, Artificial Sequence
  Description of Artificial Sequence: Synthetic oligonucleotide
aacuccgucucaaaaaaa

SEQ ID NO: 66927 - RNA, 18 nt, Artificial Sequence
  Description of Artificial Sequence: Synthetic oligonucleotide
agugaaacuccgucucaa

SEQ ID NO: 66928 - RNA, 18 nt, Artificial Sequence
  Description of Artificial Sequence: Synthetic oligonucleotide
auaagagugaaacuccgu

SEQ ID NO: 66929 - RNA, 18 nt, Artificial Sequence
  Description of Artificial Sequence: Synthetic oligonucleotide
gggcaauaagagugaaac

SEQ ID NO: 66930 - RNA, 18 nt, Artificial Sequence
  Description of Artificial Sequence: Synthetic oligonucleotide
agccugggcaauaagagu

SEQ ID NO: 66931 - RNA, 18 nt, Artificial Sequence
  Description of Artificial Sequence: Synthetic oligonucleotide
acuccagccugggcaaua

SEQ ID NO: 66932 - RNA, 18 nt, Artificial Sequence
  Description of Artificial Sequence: Synthetic oligonucleotide
auugcacuccagccuggg

SEQ ID NO: 66933 - RNA, 18 nt, Artificial Sequence
  Description of Artificial Sequence: Synthetic oligonucleotide
gcaccauugcacuccagc

SEQ ID NO: 66934 - RNA, 18 nt, Artificial Sequence
  Description of Artificial Sequence: Synthetic oligonucleotide
agaucgcaccauugcacu

SEQ ID NO: 66935 - RNA, 18 nt, Artificial Sequence
  Description of Artificial Sequence: Synthetic oligonucleotide
agccgagaucgcaccauu

SEQ ID NO: 66936 - RNA, 18 nt, Artificial Sequence
  Description of Artificial Sequence: Synthetic oligonucleotide
uggugagccgagaucgca

SEQ ID NO: 66937 - RNA, 18 nt, Artificial Sequence
  Description of Artificial Sequence: Synthetic oligonucleotide
gguuguggugagccgaga

SEQ ID NO: 66938 - RNA, 18 nt, Artificial Sequence
  Description of Artificial Sequence: Synthetic oligonucleotide
gcggagguuguggugagc

SEQ ID NO: 66939 - RNA, 18 nt, Artificial Sequence
  Description of Artificial Sequence: Synthetic oligonucleotide
gggaggcggagguugugg

SEQ ID NO: 66940 - RNA, 18 nt, Artificial Sequence
  Description of Artificial Sequence: Synthetic oligonucleotide
uaccugggaggcggaggu

SEQ ID NO: 66941 - RNA, 18 nt, Artificial Sequence
  Description of Artificial Sequence: Synthetic oligonucleotide
gcuuguaccugggaggcg

SEQ ID NO: 66942 - RNA, 18 nt, Artificial Sequence
  Description of Artificial Sequence: Synthetic oligonucleotide
gaaucgcuuguaccuggg

SEQ ID NO: 66943 - RNA, 18 nt, Artificial Sequence
  Description of Artificial Sequence: Synthetic oligonucleotide
caggagaaucgcuuguac

SEQ ID NO: 66944 - RNA, 18 nt, Artificial Sequence
  Description of Artificial Sequence: Synthetic oligonucleotide
ugagacaggagaaucgcu

SEQ ID NO: 66945 - RNA, 18 nt, Artificial Sequence
  Description of Artificial Sequence: Synthetic oligonucleotide
gaggcugagacaggagaa

SEQ ID NO: 66946 - RNA, 18 nt, Artificial Sequence
  Description of Artificial Sequence: Synthetic oligonucleotide
cuugggaggcugagacag

SEQ ID NO: 66947 - RNA, 18 nt, Artificial Sequence
  Description of Artificial Sequence: Synthetic oligonucleotide
agcuacuugggaggcuga

SEQ ID NO: 66948 - RNA, 18 nt, Artificial Sequence
  Description of Artificial Sequence: Synthetic oligonucleotide
auccaagcuacuugggag

SEQ ID NO: 66949 - RNA, 18 nt, Artificial Sequence
  Description of Artificial Sequence: Synthetic oligonucleotide
cuguaauccaagcuacuu

SEQ ID NO: 66950 - RNA, 18 nt, Artificial Sequence
  Description of Artificial Sequence: Synthetic oligonucleotide
caugccuguaauccaagc

SEQ ID NO: 66951 - RNA, 18 nt, Artificial Sequence
  Description of Artificial Sequence: Synthetic oligonucleotide
ugguucaugccuguaauc

SEQ ID NO: 66952 - RNA, 18 nt, Artificial Sequence
  Description of Artificial Sequence: Synthetic oligonucleotide
uguggugguucaugccug

SEQ ID NO: 66953 - RNA, 18 nt, Artificial Sequence
  Description of Artificial Sequence: Synthetic oligonucleotide
caggguguggugguucau

SEQ ID NO: 66954 - RNA, 18 nt, Artificial Sequence
  Description of Artificial Sequence: Synthetic oligonucleotide
acuagcaggguguggugg

SEQ ID NO: 66955 - RNA, 18 nt, Artificial Sequence
  Description of Artificial Sequence: Synthetic oligonucleotide
aaaaaacuagcagggugu

SEQ ID NO: 66956 - RNA, 18 nt, Artificial Sequence
  Description of Artificial Sequence: Synthetic oligonucleotide
auacaaaaaaacuagcag

SEQ ID NO: 66957 - RNA, 18 nt, Artificial Sequence
  Description of Artificial Sequence: Synthetic oligonucleotide
acgaaauacaaaaaaacu

SEQ ID NO: 66958 - RNA, 18 nt, Artificial Sequence
  Description of Artificial Sequence: Synthetic oligonucleotide
gcucuacgaaauacaaaa

SEQ ID NO: 66959 - RNA, 18 nt, Artificial Sequence
  Description of Artificial Sequence: Synthetic oligonucleotide
ccccggcucuacgaaaua

SEQ ID NO: 66960 - RNA, 18 nt, Artificial Sequence
  Description of Artificial Sequence: Synthetic oligonucleotide
ugaaaccccggcucuacg

SEQ ID NO: 66961 - RNA, 18 nt, Artificial Sequence
  Description of Artificial Sequence: Synthetic oligonucleotide
cauggugaaaccccggcu

SEQ ID NO: 66962 - RNA, 18 nt, Artificial Sequence
  Description of Artificial Sequence: Synthetic oligonucleotide
acuaacauggugaaaccc

SEQ ID NO: 66963 - RNA, 18 nt, Artificial Sequence
  Description of Artificial Sequence: Synthetic oligonucleotide
gccucacuaacaugguga

SEQ ID NO: 66964 - RNA, 18 nt, Artificial Sequence
  Description of Artificial Sequence: Synthetic oligonucleotide
caccagccucacuaacau

SEQ ID NO: 66965 - RNA, 18 nt, Artificial Sequence
  Description of Artificial Sequence: Synthetic oligonucleotide
uucgccaccagccucacu

SEQ ID NO: 66966 - RNA, 18 nt, Artificial Sequence
  Description of Artificial Sequence: Synthetic oligonucleotide
aggaguucgccaccagcc

SEQ ID NO: 66967 - RNA, 18 nt, Artificial Sequence
  Description of Artificial Sequence: Synthetic oligonucleotide
aggucaggaguucgccac

SEQ ID NO: 66968 - RNA, 18 nt, Artificial Sequence
  Description of Artificial Sequence: Synthetic oligonucleotide
accugaggucaggaguuc

SEQ ID NO: 66969 - RNA, 18 nt, Artificial Sequence
  Description of Artificial Sequence: Synthetic oligonucleotide
ggaucaccugaggucagg

SEQ ID NO: 66970 - RNA, 18 nt, Artificial Sequence
  Description of Artificial Sequence: Synthetic oligonucleotide
cggguggaucaccugagg

SEQ ID NO: 66971 - RNA, 18 nt, Artificial Sequence
  Description of Artificial Sequence: Synthetic oligonucleotide
caaggcggguggaucacc

SEQ ID NO: 66972 - RNA, 18 nt, Artificial Sequence
  Description of Artificial Sequence: Synthetic oligonucleotide
gaguccaaggcgggugga

SEQ ID NO: 66973 - RNA, 18 nt, Artificial Sequence
  Description of Artificial Sequence: Synthetic oligonucleotide
uuugggaguccaaggcgg

SEQ ID NO: 66974 - RNA, 18 nt, Artificial Sequence
  Description of Artificial Sequence: Synthetic oligonucleotide
agcacuuugggaguccaa

SEQ ID NO: 66975 - RNA, 18 nt, Artificial Sequence
  Description of Artificial Sequence: Synthetic oligonucleotide
aucccagcacuuugggag

SEQ ID NO: 66976 - RNA, 18 nt, Artificial Sequence
  Description of Artificial Sequence: Synthetic oligonucleotide
cuguaaucccagcacuuu

SEQ ID NO: 66977 - RNA, 18 nt, Artificial Sequence
  Description of Artificial Sequence: Synthetic oligonucleotide
caugccuguaaucccagc

SEQ ID NO: 66978 - RNA, 18 nt, Artificial Sequence
  Description of Artificial Sequence: Synthetic oligonucleotide
uggcucaugccuguaauc

SEQ ID NO: 66979 - RNA, 18 nt, Artificial Sequence
  Description of Artificial Sequence: Synthetic oligonucleotide
ugcaguggcucaugccug

SEQ ID NO: 66980 - RNA, 18 nt, Artificial Sequence
  Description of Artificial Sequence: Synthetic oligonucleotide
ccgggugcaguggcucau

SEQ ID NO: 66981 - RNA, 18 nt, Artificial Sequence
  Description of Artificial Sequence: Synthetic oligonucleotide
gugugccgggugcagugg

SEQ ID NO: 66982 - RNA, 18 nt, Artificial Sequence
  Description of Artificial Sequence: Synthetic oligonucleotide
auauggugugccgggugc

SEQ ID NO: 66983 - RNA, 18 nt, Artificial Sequence
  Description of Artificial Sequence: Synthetic oligonucleotide
aaagcauauggugugccg

SEQ ID NO: 66984 - RNA, 18 nt, Artificial Sequence
  Description of Artificial Sequence: Synthetic oligonucleotide
ugaugaaagcauauggug

SEQ ID NO: 66985 - RNA, 18 nt, Artificial Sequence
  Description of Artificial Sequence: Synthetic oligonucleotide
ucuugugaugaaagcaua

SEQ ID NO: 66986 - RNA, 18 nt, Artificial Sequence
  Description of Artificial Sequence: Synthetic oligonucleotide
cauuuucuugugaugaaa

SEQ ID NO: 66987 - RNA, 18 nt, Artificial Sequence
  Description of Artificial Sequence: Synthetic oligonucleotide
ucucacauuuucuuguga

SEQ ID NO: 66988 - RNA, 18 nt, Artificial Sequence
  Description of Artificial Sequence: Synthetic oligonucleotide
aauucucucacauuuucu

SEQ ID NO: 66989 - RNA, 18 nt, Artificial Sequence
  Description of Artificial Sequence: Synthetic oligonucleotide
cccugaauucucucacau

SEQ ID NO: 66990 - RNA, 18 nt, Artificial Sequence
  Description of Artificial Sequence: Synthetic oligonucleotide
caaagcccugaauucucu

SEQ ID NO: 66991 - RNA, 18 nt, Artificial Sequence
  Description of Artificial Sequence: Synthetic oligonucleotide
acugccaaagcccugaau

SEQ ID NO: 66992 - RNA, 18 nt, Artificial Sequence
  Description of Artificial Sequence: Synthetic oligonucleotide
cuggaacugccaaagccc

SEQ ID NO: 66993 - RNA, 18 nt, Artificial Sequence
  Description of Artificial Sequence: Synthetic oligonucleotide
ccagccuggaacugccaa

SEQ ID NO: 66994 - RNA, 18 nt, Artificial Sequence
  Description of Artificial Sequence: Synthetic oligonucleotide
gcugaccagccuggaacu

SEQ ID NO: 66995 - RNA, 18 nt, Artificial Sequence
  Description of Artificial Sequence: Synthetic oligonucleotide
gagaugcugaccagccug

SEQ ID NO: 66996 - RNA, 18 nt, Artificial Sequence
  Description of Artificial Sequence: Synthetic oligonucleotide
ggcuugagaugcugacca

SEQ ID NO: 66997 - RNA, 18 nt, Artificial Sequence
  Description of Artificial Sequence: Synthetic oligonucleotide
gggagggcuugagaugcu

SEQ ID NO: 66998 - RNA, 18 nt, Artificial Sequence
  Description of Artificial Sequence: Synthetic oligonucleotide
gggugaacagaugcuggg

SEQ ID NO: 66999 - RNA, 18 nt, Artificial Sequence
  Description of Artificial Sequence: Synthetic oligonucleotide
ggcagggugaacagaugc

SEQ ID NO: 67000 - RNA, 18 nt, Artificial Sequence
  Description of Artificial Sequence: Synthetic oligonucleotide
ugccuggcagggugaaca

SEQ ID NO: 67001 - RNA, 18 nt, Artificial Sequence
  Description of Artificial Sequence: Synthetic oligonucleotide
gagacugccuggcagggu

SEQ ID NO: 67002 - RNA, 18 nt, Artificial Sequence
  Description of Artificial Sequence: Synthetic oligonucleotide
aggaagagacugccuggc

SEQ ID NO: 67003 - RNA, 18 nt, Artificial Sequence
  Description of Artificial Sequence: Synthetic oligonucleotide
uuucuaggaagagacugc

SEQ ID NO: 67004 - RNA, 18 nt, Artificial Sequence
  Description of Artificial Sequence: Synthetic oligonucleotide
ccaaguuucuaggaagag

SEQ ID NO: 67005 - RNA, 18 nt, Artificial Sequence
  Description of Artificial Sequence: Synthetic oligonucleotide
uuuaaccaaguuucuagg

SEQ ID NO: 67006 - RNA, 18 nt, Artificial Sequence
  Description of Artificial Sequence: Synthetic oligonucleotide
gaacauuuaaccaaguuu

SEQ ID NO: 67007 - RNA, 18 nt, Artificial Sequence
  Description of Artificial Sequence: Synthetic oligonucleotide
agagugaacauuuaacca

SEQ ID NO: 67008 - RNA, 18 nt, Artificial Sequence
  Description of Artificial Sequence: Synthetic oligonucleotide
caagggugaagaaucuau

SEQ ID NO: 67009 - RNA, 18 nt, Artificial Sequence
  Description of Artificial Sequence: Synthetic oligonucleotide
cgggccaagggugaagaa

SEQ ID NO: 67010 - RNA, 18 nt, Artificial Sequence
  Description of Artificial Sequence: Synthetic oligonucleotide
aaaggcgggccaagggug

SEQ ID NO: 67011 - RNA, 18 nt, Artificial Sequence
  Description of Artificial Sequence: Synthetic oligonucleotide
gggcaaaggcgggccaag

SEQ ID NO: 67012 - RNA, 18 nt, Artificial Sequence
  Description of Artificial Sequence: Synthetic oligonucleotide
ugggcagaguaggguggg

SEQ ID NO: 67013 - RNA, 18 nt, Artificial Sequence
  Description of Artificial Sequence: Synthetic oligonucleotide
acuucugggcagaguagg

SEQ ID NO: 67014 - RNA, 18 nt, Artificial Sequence
  Description of Artificial Sequence: Synthetic oligonucleotide
cuugcacuucugggcaga

SEQ ID NO: 67015 - RNA, 18 nt, Artificial Sequence
  Description of Artificial Sequence: Synthetic oligonucleotide
aggcucuugcacuucugg

SEQ ID NO: 67016 - RNA, 18 nt, Artificial Sequence
  Description of Artificial Sequence: Synthetic oligonucleotide
ggcuuaggcucuugcacu

SEQ ID NO: 67017 - RNA, 18 nt, Artificial Sequence
  Description of Artificial Sequence: Synthetic oligonucleotide
gaggcggcuuaggcucuu

SEQ ID NO: 67018 - RNA, 18 nt, Artificial Sequence
  Description of Artificial Sequence: Synthetic oligonucleotide
ccauggaggcggcuuagg

SEQ ID NO: 67019 - RNA, 18 nt, Artificial Sequence
  Description of Artificial Sequence: Synthetic oligonucleotide
gggccauggaggcggcuu

SEQ ID NO: 67020 - RNA, 18 nt, Artificial Sequence
  Description of Artificial Sequence: Synthetic oligonucleotide
cccugaauccuuccuggg

SEQ ID NO: 67021 - RNA, 18 nt, Artificial Sequence
  Description of Artificial Sequence: Synthetic oligonucleotide
cucuccccugaauccuuc

SEQ ID NO: 67022 - RNA, 18 nt, Artificial Sequence
  Description of Artificial Sequence: Synthetic oligonucleotide
gggccucuccccugaauc

SEQ ID NO: 67023 - RNA, 18 nt, Artificial Sequence
  Description of Artificial Sequence: Synthetic oligonucleotide
cguggcucccuguuuggg

SEQ ID NO: 67024 - RNA, 18 nt, Artificial Sequence
  Description of Artificial Sequence: Synthetic oligonucleotide
gcuggcguggcucccugu

SEQ ID NO: 67025 - RNA, 18 nt, Artificial Sequence
  Description of Artificial Sequence: Synthetic oligonucleotide
gucuggcuggcguggcuc

SEQ ID NO: 67026 - RNA, 18 nt, Artificial Sequence
  Description of Artificial Sequence: Synthetic oligonucleotide
gggugucuggcuggcgug

SEQ ID NO: 67027 - RNA, 18 nt, Artificial Sequence
  Description of Artificial Sequence: Synthetic oligonucleotide
agcuccauucuggccggg

SEQ ID NO: 67028 - RNA, 18 nt, Artificial Sequence
  Description of Artificial Sequence: Synthetic oligonucleotide
cagucagcuccauucugg

SEQ ID NO: 67029 - RNA, 18 nt, Artificial Sequence
  Description of Artificial Sequence: Synthetic oligonucleotide
aagggugaagaaucuauc

SEQ ID NO: 67030 - RNA, 18 nt, Artificial Sequence
  Description of Artificial Sequence: Synthetic oligonucleotide
gggccaagggugaagaau

SEQ ID NO: 67031 - RNA, 18 nt, Artificial Sequence
  Description of Artificial Sequence: Synthetic oligonucleotide
aaggcgggccaaggguga

SEQ ID NO: 67032 - RNA, 18 nt, Artificial Sequence
  Description of Artificial Sequence: Synthetic oligonucleotide
gggcaaaggcgggccaag

SEQ ID NO: 67033 - RNA, 18 nt, Artificial Sequence
  Description of Artificial Sequence: Synthetic oligonucleotide
ugggcagaguaggguggg

SEQ ID NO: 67034 - RNA, 18 nt, Artificial Sequence
  Description of Artificial Sequence: Synthetic oligonucleotide
uucugggcagaguagggu

SEQ ID NO: 67035 - RNA, 18 nt, Artificial Sequence
  Description of Artificial Sequence: Synthetic oligonucleotide
ugcacuucugggcagagu

SEQ ID NO: 67036 - RNA, 18 nt, Artificial Sequence
  Description of Artificial Sequence: Synthetic oligonucleotide
gcucuugcacuucugggc

SEQ ID NO: 67037 - RNA, 18 nt, Artificial Sequence
  Description of Artificial Sequence: Synthetic oligonucleotide
cuuaggcucuugcacuuc

SEQ ID NO: 67038 - RNA, 18 nt, Artificial Sequence
  Description of Artificial Sequence: Synthetic oligonucleotide
ggcggcuuaggcucuugc

SEQ ID NO: 67039 - RNA, 18 nt, Artificial Sequence
  Description of Artificial Sequence: Synthetic oligonucleotide
auggaggcggcuuaggcu

SEQ ID NO: 67040 - RNA, 18 nt, Artificial Sequence
  Description of Artificial Sequence: Synthetic oligonucleotide
gggccauggaggcggcuu

SEQ ID NO: 67041 - RNA, 18 nt, Artificial Sequence
  Description of Artificial Sequence: Synthetic oligonucleotide
cccugaauccuuccuggg

SEQ ID NO: 67042 - RNA, 18 nt, Artificial Sequence
  Description of Artificial Sequence: Synthetic oligonucleotide
ucuccccugaauccuucc

SEQ ID NO: 67043 - RNA, 18 nt, Artificial Sequence
  Description of Artificial Sequence: Synthetic oligonucleotide
gggccucuccccugaauc

SEQ ID NO: 67044 - RNA, 18 nt, Artificial Sequence
  Description of Artificial Sequence: Synthetic oligonucleotide
cguggcucccuguuuggg

SEQ ID NO: 67045 - RNA, 18 nt, Artificial Sequence
  Description of Artificial Sequence: Synthetic oligonucleotide
cuggcguggcucccuguu

SEQ ID NO: 67046 - RNA, 18 nt, Artificial Sequence
  Description of Artificial Sequence: Synthetic oligonucleotide
ucuggcuggcguggcucc

SEQ ID NO: 67047 - RNA, 18 nt, Artificial Sequence
  Description of Artificial Sequence: Synthetic oligonucleotide
gggugucuggcuggcgug

SEQ ID NO: 67048 - RNA, 18 nt, Artificial Sequence
  Description of Artificial Sequence: Synthetic oligonucleotide
agcuccauucuggccggg

SEQ ID NO: 67049 - RNA, 18 nt, Artificial Sequence
  Description of Artificial Sequence: Synthetic oligonucleotide
ucagcuccauucuggccg

SEQ ID NO: 67050 - RNA, 18 nt, Artificial Sequence
  Description of Artificial Sequence: Synthetic oligonucleotide
uagccccucagguguguu

SEQ ID NO: 67051 - RNA, 18 nt, Artificial Sequence
  Description of Artificial Sequence: Synthetic oligonucleotide
ggcccuagccccucaggu

SEQ ID NO: 67052 - RNA, 18 nt, Artificial Sequence
  Description of Artificial Sequence: Synthetic oligonucleotide
cauauggcccuagccccu

SEQ ID NO: 67053 - RNA, 18 nt, Artificial Sequence
  Description of Artificial Sequence: Synthetic oligonucleotide
guuuccauauggcccuag

SEQ ID NO: 67054 - RNA, 18 nt, Artificial Sequence
  Description of Artificial Sequence: Synthetic oligonucleotide
gucauguuuccauauggc

SEQ ID NO: 67055 - RNA, 18 nt, Artificial Sequence
  Description of Artificial Sequence: Synthetic oligonucleotide
cuucugucauguuuccau

SEQ ID NO: 67056 - RNA, 18 nt, Artificial Sequence
  Description of Artificial Sequence: Synthetic oligonucleotide
cuccccuucugucauguu

SEQ ID NO: 67057 - RNA, 18 nt, Artificial Sequence
  Description of Artificial Sequence: Synthetic oligonucleotide
ucucucuccccuucuguc

SEQ ID NO: 67058 - RNA, 18 nt, Artificial Sequence
  Description of Artificial Sequence: Synthetic oligonucleotide
uccuuucucucuccccuu

SEQ ID NO: 67059 - RNA, 18 nt, Artificial Sequence
  Description of Artificial Sequence: Synthetic oligonucleotide
gugucuccuuucucucuc

SEQ ID NO: 67060 - RNA, 18 nt, Artificial Sequence
  Description of Artificial Sequence: Synthetic oligonucleotide
gcagcgugucuccuuucu

SEQ ID NO: 67061 - RNA, 18 nt, Artificial Sequence
  Description of Artificial Sequence: Synthetic oligonucleotide
ccccugcagcgugucucc

SEQ ID NO: 67062 - RNA, 18 nt, Artificial Sequence
  Description of Artificial Sequence: Synthetic oligonucleotide
ccugcccccugcagcgug

SEQ ID NO: 67063 - RNA, 18 nt, Artificial Sequence
  Description of Artificial Sequence: Synthetic oligonucleotide
agcuuccugcccccugca

SEQ ID NO: 67064 - RNA, 18 nt, Artificial Sequence
  Description of Artificial Sequence: Synthetic oligonucleotide
cccccagcuuccugcccc

SEQ ID NO: 67065 - RNA, 18 nt, Artificial Sequence
  Description of Artificial Sequence: Synthetic oligonucleotide
ggguucccccagcuuccu

SEQ ID NO: 67066 - RNA, 18 nt, Artificial Sequence
  Description of Artificial Sequence: Synthetic oligonucleotide
agaauggguucccccagc

SEQ ID NO: 67067 - RNA, 18 nt, Artificial Sequence
  Description of Artificial Sequence: Synthetic oligonucleotide
uugggagaauggguuccc

SEQ ID NO: 67068 - RNA, 18 nt, Artificial Sequence
  Description of Artificial Sequence: Synthetic oligonucleotide
uauuuuugggagaauggg

SEQ ID NO: 67069 - RNA, 18 nt, Artificial Sequence
  Description of Artificial Sequence: Synthetic oligonucleotide
ccccuuauuuuugggaga

SEQ ID NO: 67070 - RNA, 18 nt, Artificial Sequence
  Description of Artificial Sequence: Synthetic oligonucleotide
ucagaccccuuauuuuug

SEQ ID NO: 67071 - RNA, 18 nt, Artificial Sequence
  Description of Artificial Sequence: Synthetic oligonucleotide
accccucagaccccuuau

SEQ ID NO: 67072 - RNA, 18 nt, Artificial Sequence
  Description of Artificial Sequence: Synthetic oligonucleotide
aauccaccccucagaccc

SEQ ID NO: 67073 - RNA, 18 nt, Artificial Sequence
  Description of Artificial Sequence: Synthetic oligonucleotide
cagggaauccaccccuca

SEQ ID NO: 67074 - RNA, 18 nt, Artificial Sequence
  Description of Artificial Sequence: Synthetic oligonucleotide
aaacccagggaauccacc

SEQ ID NO: 67075 - RNA, 18 nt, Artificial Sequence
  Description of Artificial Sequence: Synthetic oligonucleotide
gggagaauggguuccccc

SEQ ID NO: 67076 - RNA, 18 nt, Artificial Sequence
  Description of Artificial Sequence: Synthetic oligonucleotide
uuuuugggagaauggguu

SEQ ID NO: 67077 - RNA, 18 nt, Artificial Sequence
  Description of Artificial Sequence: Synthetic oligonucleotide
ccuuauuuuugggagaau

SEQ ID NO: 67078 - RNA, 18 nt, Artificial Sequence
  Description of Artificial Sequence: Synthetic oligonucleotide
agaccccuuauuuuuggg

SEQ ID NO: 67079 - RNA, 18 nt, Artificial Sequence
  Description of Artificial Sequence: Synthetic oligonucleotide
cccucagaccccuuauuu

SEQ ID NO: 67080 - RNA, 18 nt, Artificial Sequence
  Description of Artificial Sequence: Synthetic oligonucleotide
uccaccccucagaccccu

SEQ ID NO: 67081 - RNA, 18 nt, Artificial Sequence
  Description of Artificial Sequence: Synthetic oligonucleotide
gggaauccaccccucaga

SEQ ID NO: 67082 - RNA, 18 nt, Artificial Sequence
  Description of Artificial Sequence: Synthetic oligonucleotide
acccagggaauccacccc

SEQ ID NO: 67083 - RNA, 18 nt, Artificial Sequence
  Description of Artificial Sequence: Synthetic oligonucleotide
cugaaacccagggaaucc

SEQ ID NO: 67084 - RNA, 18 nt, Artificial Sequence
  Description of Artificial Sequence: Synthetic oligonucleotide
cagaccugaaacccaggg

SEQ ID NO: 67085 - RNA, 18 nt, Artificial Sequence
  Description of Artificial Sequence: Synthetic oligonucleotide
ggacccagaccugaaacc

SEQ ID NO: 67086 - RNA, 18 nt, Artificial Sequence
  Description of Artificial Sequence: Synthetic oligonucleotide
auucaggacccagaccug

SEQ ID NO: 67087 - RNA, 18 nt, Artificial Sequence
  Description of Artificial Sequence: Synthetic oligonucleotide
uucccauucaggacccag

SEQ ID NO: 67088 - RNA, 18 nt, Artificial Sequence
  Description of Artificial Sequence: Synthetic oligonucleotide
aggaauucccauucagga

SEQ ID NO: 67089 - RNA, 18 nt, Artificial Sequence
  Description of Artificial Sequence: Synthetic oligonucleotide
auuccaggaauucccauu

SEQ ID NO: 67090 - RNA, 18 nt, Artificial Sequence
  Description of Artificial Sequence: Synthetic oligonucleotide
cugguauuccaggaauuc

SEQ ID NO: 67091 - RNA, 18 nt, Artificial Sequence
  Description of Artificial Sequence: Synthetic oligonucleotide
gucagcugguauuccagg

SEQ ID NO: 67092 - RNA, 18 nt, Artificial Sequence
  Description of Artificial Sequence: Synthetic oligonucleotide
ucauugucagcugguauu

SEQ ID NO: 67093 - RNA, 18 nt, Artificial Sequence
  Description of Artificial Sequence: Synthetic oligonucleotide
ggaaaucauugucagcug

SEQ ID NO: 67094 - RNA, 18 nt, Artificial Sequence
  Description of Artificial Sequence: Synthetic oligonucleotide
gaggaggaaaucauuguc

SEQ ID NO: 67095 - RNA, 18 nt, Artificial Sequence
  Description of Artificial Sequence: Synthetic oligonucleotide
aagaugaggaggaaauca

SEQ ID NO: 67096 - RNA, 18 nt, Artificial Sequence
  Description of Artificial Sequence: Synthetic oligonucleotide
guugaaagaugaggagga

SEQ ID NO: 67097 - RNA, 18 nt, Artificial Sequence
  Description of Artificial Sequence: Synthetic oligonucleotide
gugagguugaaagaugag

SEQ ID NO: 67098 - RNA, 18 nt, Artificial Sequence
  Description of Artificial Sequence: Synthetic oligonucleotide
augaccacgaggagcaau

SEQ ID NO: 67099 - RNA, 18 nt, Artificial Sequence
  Description of Artificial Sequence: Synthetic oligonucleotide
gaagcaugaccacgagga

SEQ ID NO: 67100 - RNA, 18 nt, Artificial Sequence
  Description of Artificial Sequence: Synthetic oligonucleotide
uaggagaagcaugaccac

SEQ ID NO: 67101 - RNA, 18 nt, Artificial Sequence
  Description of Artificial Sequence: Synthetic oligonucleotide
gcaguuaggagaagcaug

SEQ ID NO: 67102 - RNA, 18 nt, Artificial Sequence
  Description of Artificial Sequence: Synthetic oligonucleotide
gccuugcaguuaggagaa

SEQ ID NO: 67103 - RNA, 18 nt, Artificial Sequence
  Description of Artificial Sequence: Synthetic oligonucleotide
cguuagccuugcaguuag

SEQ ID NO: 67104 - RNA, 18 nt, Artificial Sequence
  Description of Artificial Sequence: Synthetic oligonucleotide
gacagcguuagccuugca

SEQ ID NO: 67105 - RNA, 18 nt, Artificial Sequence
  Description of Artificial Sequence: Synthetic oligonucleotide
ggcuggacagcguuagcc

SEQ ID NO: 67106 - RNA, 18 nt, Artificial Sequence
  Description of Artificial Sequence: Synthetic oligonucleotide
agccgggcuggacagcgu

SEQ ID NO: 67107 - RNA, 18 nt, Artificial Sequence
  Description of Artificial Sequence: Synthetic oligonucleotide
ggaggagccgggcuggac

SEQ ID NO: 67108 - RNA, 18 nt, Artificial Sequence
  Description of Artificial Sequence: Synthetic oligonucleotide
aagcaggaggagccgggc

SEQ ID NO: 67109 - RNA, 18 nt, Artificial Sequence
  Description of Artificial Sequence: Synthetic oligonucleotide
gucacaagcaggaggagc

SEQ ID NO: 67110 - RNA, 18 nt, Artificial Sequence
  Description of Artificial Sequence: Synthetic oligonucleotide
cggaggucacaagcagga

SEQ ID NO: 67111 - RNA, 18 nt, Artificial Sequence
  Description of Artificial Sequence: Synthetic oligonucleotide
ggacucggaggucacaag

SEQ ID NO: 67112 - RNA, 18 nt, Artificial Sequence
  Description of Artificial Sequence: Synthetic oligonucleotide
acugaggacucggagguc

SEQ ID NO: 67113 - RNA, 18 nt, Artificial Sequence
  Description of Artificial Sequence: Synthetic oligonucleotide
aguuuacugaggacucgg

SEQ ID NO: 67114 - RNA, 18 nt, Artificial Sequence
  Description of Artificial Sequence: Synthetic oligonucleotide
gaagcaguuuacugagga

SEQ ID NO: 67115 - RNA, 18 nt, Artificial Sequence
  Description of Artificial Sequence: Synthetic oligonucleotide
gucacgaagcaguuuacu

SEQ ID NO: 67116 - RNA, 18 nt, Artificial Sequence
  Description of Artificial Sequence: Synthetic oligonucleotide
ugggagucacgaagcagu

SEQ ID NO: 67117 - RNA, 18 nt, Artificial Sequence
  Description of Artificial Sequence: Synthetic oligonucleotide
ggacaugggagucacgaa

SEQ ID NO: 67118 - RNA, 18 nt, Artificial Sequence
  Description of Artificial Sequence: Synthetic oligonucleotide
gugaaggacaugggaguc

SEQ ID NO: 67119 - RNA, 18 nt, Artificial Sequence
  Description of Artificial Sequence: Synthetic oligonucleotide
cugcugugaaggacaugg

SEQ ID NO: 67120 - RNA, 18 nt, Artificial Sequence
  Description of Artificial Sequence: Synthetic oligonucleotide
caugaccacgaggagcaa

SEQ ID NO: 67121 - RNA, 18 nt, Artificial Sequence
  Description of Artificial Sequence: Synthetic oligonucleotide
agaagcaugaccacgagg

SEQ ID NO: 67122 - RNA, 18 nt, Artificial Sequence
  Description of Artificial Sequence: Synthetic oligonucleotide
uuaggagaagcaugacca

SEQ ID NO: 67123 - RNA, 18 nt, Artificial Sequence
  Description of Artificial Sequence: Synthetic oligonucleotide
ugcaguuaggagaagcau

SEQ ID NO: 67124 - RNA, 18 nt, Artificial Sequence
  Description of Artificial Sequence: Synthetic oligonucleotide
agccuugcaguuaggaga

SEQ ID NO: 67125 - RNA, 18 nt, Artificial Sequence
  Description of Artificial Sequence: Synthetic oligonucleotide
gcguuagccuugcaguua

SEQ ID NO: 67126 - RNA, 18 nt, Artificial Sequence
  Description of Artificial Sequence: Synthetic oligonucleotide
ggacagcguuagccuugc

SEQ ID NO: 67127 - RNA, 18 nt, Artificial Sequence
  Description of Artificial Sequence: Synthetic oligonucleotide
gggcuggacagcguuagc

SEQ ID NO: 67128 - RNA, 18 nt, Artificial Sequence
  Description of Artificial Sequence: Synthetic oligonucleotide
gagccgggcuggacagcg

SEQ ID NO: 67129 - RNA, 18 nt, Artificial Sequence
  Description of Artificial Sequence: Synthetic oligonucleotide
aggaggagccgggcugga

SEQ ID NO: 67130 - RNA, 18 nt, Artificial Sequence
  Description of Artificial Sequence: Synthetic oligonucleotide
caagcaggaggagccggg

SEQ ID NO: 67131 - RNA, 18 nt, Artificial Sequence
  Description of Artificial Sequence: Synthetic oligonucleotide
ggucacaagcaggaggag

SEQ ID NO: 67132 - RNA, 18 nt, Artificial Sequence
  Description of Artificial Sequence: Synthetic oligonucleotide
ucggaggucacaagcagg

SEQ ID NO: 67133 - RNA, 18 nt, Artificial Sequence
  Description of Artificial Sequence: Synthetic oligonucleotide
aggacucggaggucacaa

SEQ ID NO: 67134 - RNA, 18 nt, Artificial Sequence
  Description of Artificial Sequence: Synthetic oligonucleotide
uacugaggacucggaggu

SEQ ID NO: 67135 - RNA, 18 nt, Artificial Sequence
  Description of Artificial Sequence: Synthetic oligonucleotide
caguuuacugaggacucg

SEQ ID NO: 67136 - RNA, 18 nt, Artificial Sequence
  Description of Artificial Sequence: Synthetic oligonucleotide
cgaagcaguuuacugagg

SEQ ID NO: 67137 - RNA, 18 nt, Artificial Sequence
  Description of Artificial Sequence: Synthetic oligonucleotide
agucacgaagcaguuuac

SEQ ID NO: 67138 - RNA, 18 nt, Artificial Sequence
  Description of Artificial Sequence: Synthetic oligonucleotide
augggagucacgaagcag

SEQ ID NO: 67139 - RNA, 18 nt, Artificial Sequence
  Description of Artificial Sequence: Synthetic oligonucleotide
aggacaugggagucacga

SEQ ID NO: 67140 - RNA, 18 nt, Artificial Sequence
  Description of Artificial Sequence: Synthetic oligonucleotide
ugugaaggacaugggagu

SEQ ID NO: 67141 - RNA, 18 nt, Artificial Sequence
  Description of Artificial Sequence: Synthetic oligonucleotide
ucugcugugaaggacaug

SEQ ID NO: 67142 - RNA, 18 nt, Artificial Sequence
  Description of Artificial Sequence: Synthetic oligonucleotide
gggauaauguugggaguu

SEQ ID NO: 67143 - RNA, 18 nt, Artificial Sequence
  Description of Artificial Sequence: Synthetic oligonucleotide
uaccaguuacgcggauaa

SEQ ID NO: 67144 - RNA, 18 nt, Artificial Sequence
  Description of Artificial Sequence: Synthetic oligonucleotide
ugucuuaccaguuacgcg

SEQ ID NO: 67145 - RNA, 18 nt, Artificial Sequence
  Description of Artificial Sequence: Synthetic oligonucleotide
augggugucuuaccaguu

SEQ ID NO: 67146 - RNA, 18 nt, Artificial Sequence
  Description of Artificial Sequence: Synthetic oligonucleotide
ggaguaugggugucuuac

SEQ ID NO: 67147 - RNA, 18 nt, Artificial Sequence
  Description of Artificial Sequence: Synthetic oligonucleotide
uccugggaguaugggugu

SEQ ID NO: 67148 - RNA, 18 nt, Artificial Sequence
  Description of Artificial Sequence: Synthetic oligonucleotide
ugucuuccugggaguaug

SEQ ID NO: 67149 - RNA, 18 nt, Artificial Sequence
  Description of Artificial Sequence: Synthetic oligonucleotide
gauggugucuuccuggga

SEQ ID NO: 67150 - RNA, 18 nt, Artificial Sequence
  Description of Artificial Sequence: Synthetic oligonucleotide
gaagugauggugucuucc

SEQ ID NO: 67151 - RNA, 18 nt, Artificial Sequence
  Description of Artificial Sequence: Synthetic oligonucleotide
uagaggaagugauggugu

SEQ ID NO: 67152 - RNA, 18 nt, Artificial Sequence
  Description of Artificial Sequence: Synthetic oligonucleotide
ggaguuagaggaagugau

SEQ ID NO: 67153 - RNA, 18 nt, Artificial Sequence
  Description of Artificial Sequence: Synthetic oligonucleotide
gucaaggaguuagaggaa

SEQ ID NO: 67154 - RNA, 18 nt, Artificial Sequence
  Description of Artificial Sequence: Synthetic oligonucleotide
auugggucaaggaguuag

SEQ ID NO: 67155 - RNA, 18 nt, Artificial Sequence
  Description of Artificial Sequence: Synthetic oligonucleotide
uagucauugggucaagga

SEQ ID NO: 67156 - RNA, 18 nt, Artificial Sequence
  Description of Artificial Sequence: Synthetic oligonucleotide
aagaauagucauuggguc

SEQ ID NO: 67157 - RNA, 18 nt, Artificial Sequence
  Description of Artificial Sequence: Synthetic oligonucleotide
augggaagaauagucauu

SEQ ID NO: 67158 - RNA, 18 nt, Artificial Sequence
  Description of Artificial Sequence: Synthetic oligonucleotide
acaauaugggaagaauag

SEQ ID NO: 67159 - RNA, 18 nt, Artificial Sequence
  Description of Artificial Sequence: Synthetic oligonucleotide
gggacaauaugggaagaa

SEQ ID NO: 67160 - RNA, 18 nt, Artificial Sequence
  Description of Artificial Sequence: Synthetic oligonucleotide
gugugaucaguagguggg

SEQ ID NO: 67161 - RNA, 18 nt, Artificial Sequence
  Description of Artificial Sequence: Synthetic oligonucleotide
agagagugugaucaguag

SEQ ID NO: 67162 - RNA, 18 nt, Artificial Sequence
  Description of Artificial Sequence: Synthetic oligonucleotide
uugucagagagugugauc

SEQ ID NO: 67163 - RNA, 18 nt, Artificial Sequence
  Description of Artificial Sequence: Synthetic oligonucleotide
aauccuugucagagagug

SEQ ID NO: 67164 - RNA, 18 nt, Artificial Sequence
  Description of Artificial Sequence: Synthetic oligonucleotide
agaauaauccuugucaga

SEQ ID NO: 67165 - RNA, 18 nt, Artificial Sequence
  Description of Artificial Sequence: Synthetic oligonucleotide
ugugaagaauaauccuug

SEQ ID NO: 67166 - RNA, 18 nt, Artificial Sequence
  Description of Artificial Sequence: Synthetic oligonucleotide
uguauugugaagaauaau

SEQ ID NO: 67167 - RNA, 18 nt, Artificial Sequence
  Description of Artificial Sequence: Synthetic oligonucleotide
cgggcuguauugugaaga

SEQ ID NO: 67168 - RNA, 18 nt, Artificial Sequence
  Description of Artificial Sequence: Synthetic oligonucleotide
gugugaucaguagguggg

SEQ ID NO: 67169 - RNA, 18 nt, Artificial Sequence
  Description of Artificial Sequence: Synthetic oligonucleotide
gagagugugaucaguagg

SEQ ID NO: 67170 - RNA, 18 nt, Artificial Sequence
  Description of Artificial Sequence: Synthetic oligonucleotide
ugucagagagugugauca

SEQ ID NO: 67171 - RNA, 18 nt, Artificial Sequence
  Description of Artificial Sequence: Synthetic oligonucleotide
auccuugucagagagugu

SEQ ID NO: 67172 - RNA, 18 nt, Artificial Sequence
  Description of Artificial Sequence: Synthetic oligonucleotide
gaauaauccuugucagag

SEQ ID NO: 67173 - RNA, 18 nt, Artificial Sequence
  Description of Artificial Sequence: Synthetic oligonucleotide
gugaagaauaauccuugu

SEQ ID NO: 67174 - RNA, 18 nt, Artificial Sequence
  Description of Artificial Sequence: Synthetic oligonucleotide
guauugugaagaauaauc

SEQ ID NO: 67175 - RNA, 18 nt, Artificial Sequence
  Description of Artificial Sequence: Synthetic oligonucleotide
gggcuguauugugaagaa

SEQ ID NO: 67176 - RNA, 18 nt, Artificial Sequence
  Description of Artificial Sequence: Synthetic oligonucleotide
aaugcgggcuguauugug

SEQ ID NO: 67177 - RNA, 18 nt, Artificial Sequence
  Description of Artificial Sequence: Synthetic oligonucleotide
uuuuaaaugcgggcugua

SEQ ID NO: 67178 - RNA, 18 nt, Artificial Sequence
  Description of Artificial Sequence: Synthetic oligonucleotide
agagcuuuuaaaugcggg

SEQ ID NO: 67179 - RNA, 18 nt, Artificial Sequence
  Description of Artificial Sequence: Synthetic oligonucleotide
agacgagagcuuuuaaau

SEQ ID NO: 67180 - RNA, 18 nt, Artificial Sequence
  Description of Artificial Sequence: Synthetic oligonucleotide
ucucuagacgagagcuuu

SEQ ID NO: 67181 - RNA, 18 nt, Artificial Sequence
  Description of Artificial Sequence: Synthetic oligonucleotide
uacuaucucuagacgaga

SEQ ID NO: 67182 - RNA, 18 nt, Artificial Sequence
  Description of Artificial Sequence: Synthetic oligonucleotide
augaguacuaucucuaga

SEQ ID NO: 67183 - RNA, 18 nt, Artificial Sequence
  Description of Artificial Sequence: Synthetic oligonucleotide
ccuccaugaguacuaucu

SEQ ID NO: 67184 - RNA, 18 nt, Artificial Sequence
  Description of Artificial Sequence: Synthetic oligonucleotide
cuaguccuccaugaguac

SEQ ID NO: 67185 - RNA, 18 nt, Artificial Sequence
  Description of Artificial Sequence: Synthetic oligonucleotide
gcaggcuaguccuccaug

SEQ ID NO: 67186 - RNA, 18 nt, Artificial Sequence
  Description of Artificial Sequence: Synthetic oligonucleotide
aauaagcaggcuaguccu

SEQ ID NO: 67187 - RNA, 18 nt, Artificial Sequence
  Description of Artificial Sequence: Synthetic oligonucleotide
agccuaauaagcaggcua

SEQ ID NO: 67188 - RNA, 18 nt, Artificial Sequence
  Description of Artificial Sequence: Synthetic oligonucleotide
augguagccuaauaagca

SEQ ID NO: 67189 - RNA, 18 nt, Artificial Sequence
  Description of Artificial Sequence: Synthetic oligonucleotide
gagcuaugguagccuaau

SEQ ID NO: 67190 - RNA, 18 nt, Artificial Sequence
  Description of Artificial Sequence: Synthetic oligonucleotide
agagagagcuaugguagc

SEQ ID NO: 67191 - RNA, 18 nt, Artificial Sequence
  Description of Artificial Sequence: Synthetic oligonucleotide
gaaauagagagagcuaug

SEQ ID NO: 67192 - RNA, 18 nt, Artificial Sequence
  Description of Artificial Sequence: Synthetic oligonucleotide
gagcugaaauagagagag

SEQ ID NO: 67193 - RNA, 18 nt, Artificial Sequence
  Description of Artificial Sequence: Synthetic oligonucleotide
gaagggagcugaaauaga

SEQ ID NO: 67194 - RNA, 18 nt, Artificial Sequence
  Description of Artificial Sequence: Synthetic oligonucleotide
gaaccucugggcacuggc

SEQ ID NO: 67195 - RNA, 18 nt, Artificial Sequence
  Description of Artificial Sequence: Synthetic oligonucleotide
agggugaaccucugggca

SEQ ID NO: 67196 - RNA, 18 nt, Artificial Sequence
  Description of Artificial Sequence: Synthetic oligonucleotide
ggcaaagggugaaccucu

SEQ ID NO: 67197 - RNA, 18 nt, Artificial Sequence
  Description of Artificial Sequence: Synthetic oligonucleotide
guguaggcaaagggugaa

SEQ ID NO: 67198 - RNA, 18 nt, Artificial Sequence
  Description of Artificial Sequence: Synthetic oligonucleotide
gacagguguaggcaaagg

SEQ ID NO: 67199 - RNA, 18 nt, Artificial Sequence
  Description of Artificial Sequence: Synthetic oligonucleotide
agcaggacagguguaggc

SEQ ID NO: 67200 - RNA, 18 nt, Artificial Sequence
  Description of Artificial Sequence: Synthetic oligonucleotide
caggcagcaggacaggug

SEQ ID NO: 67201 - RNA, 18 nt, Artificial Sequence
  Description of Artificial Sequence: Synthetic oligonucleotide
cacagcaggcagcaggac

SEQ ID NO: 67202 - RNA, 18 nt, Artificial Sequence
  Description of Artificial Sequence: Synthetic oligonucleotide
aaguccacagcaggcagc

SEQ ID NO: 67203 - RNA, 18 nt, Artificial Sequence
  Description of Artificial Sequence: Synthetic oligonucleotide
agcuaaaguccacagcag

SEQ ID NO: 67204 - RNA, 18 nt, Artificial Sequence
  Description of Artificial Sequence: Synthetic oligonucleotide
ucccaagcuaaaguccac

SEQ ID NO: 67205 - RNA, 18 nt, Artificial Sequence
  Description of Artificial Sequence: Synthetic oligonucleotide
cauucucccaagcuaaag

SEQ ID NO: 67206 - RNA, 18 nt, Artificial Sequence
  Description of Artificial Sequence: Synthetic oligonucleotide
uuuuccauucucccaagc

SEQ ID NO: 67207 - RNA, 18 nt, Artificial Sequence
  Description of Artificial Sequence: Synthetic oligonucleotide
cuggguuuuccauucucc

SEQ ID NO: 67208 - RNA, 18 nt, Artificial Sequence
  Description of Artificial Sequence: Synthetic oligonucleotide
gaaccucugggcacuggc

SEQ ID NO: 67209 - RNA, 18 nt, Artificial Sequence
  Description of Artificial Sequence: Synthetic oligonucleotide
agggugaaccucugggca

SEQ ID NO: 67210 - RNA, 18 nt, Artificial Sequence
  Description of Artificial Sequence: Synthetic oligonucleotide
ggcaaagggugaaccucu

SEQ ID NO: 67211 - RNA, 18 nt, Artificial Sequence
  Description of Artificial Sequence: Synthetic oligonucleotide
guguaggcaaagggugaa

SEQ ID NO: 67212 - RNA, 18 nt, Artificial Sequence
  Description of Artificial Sequence: Synthetic oligonucleotide
gacagguguaggcaaagg

SEQ ID NO: 67213 - RNA, 18 nt, Artificial Sequence
  Description of Artificial Sequence: Synthetic oligonucleotide
agcaggacagguguaggc

SEQ ID NO: 67214 - RNA, 18 nt, Artificial Sequence
  Description of Artificial Sequence: Synthetic oligonucleotide
caggcagcaggacaggug

SEQ ID NO: 67215 - RNA, 18 nt, Artificial Sequence
  Description of Artificial Sequence: Synthetic oligonucleotide
cacagcaggcagcaggac

SEQ ID NO: 67216 - RNA, 18 nt, Artificial Sequence
  Description of Artificial Sequence: Synthetic oligonucleotide
aaguccacagcaggcagc

SEQ ID NO: 67217 - RNA, 18 nt, Artificial Sequence
  Description of Artificial Sequence: Synthetic oligonucleotide
agcuaaaguccacagcag

SEQ ID NO: 67218 - RNA, 18 nt, Artificial Sequence
  Description of Artificial Sequence: Synthetic oligonucleotide
ucccaagcuaaaguccac

SEQ ID NO: 67219 - RNA, 18 nt, Artificial Sequence
  Description of Artificial Sequence: Synthetic oligonucleotide
cauucucccaagcuaaag

SEQ ID NO: 67220 - RNA, 18 nt, Artificial Sequence
  Description of Artificial Sequence: Synthetic oligonucleotide
uuuuccauucucccaagc

SEQ ID NO: 67221 - RNA, 18 nt, Artificial Sequence
  Description of Artificial Sequence: Synthetic oligonucleotide
cuggguuuuccauucucc

SEQ ID NO: 67222 - RNA, 18 nt, Artificial Sequence
  Description of Artificial Sequence: Synthetic oligonucleotide
aagguuagggauggcuuu

SEQ ID NO: 67223 - RNA, 18 nt, Artificial Sequence
  Description of Artificial Sequence: Synthetic oligonucleotide
aagccaagguuagggaug

SEQ ID NO: 67224 - RNA, 18 nt, Artificial Sequence
  Description of Artificial Sequence: Synthetic oligonucleotide
uagggaagccaagguuag

SEQ ID NO: 67225 - RNA, 18 nt, Artificial Sequence
  Description of Artificial Sequence: Synthetic oligonucleotide
ggacuuagggaagccaag

SEQ ID NO: 67226 - RNA, 18 nt, Artificial Sequence
  Description of Artificial Sequence: Synthetic oligonucleotide
agacaggacuuagggaag

SEQ ID NO: 67227 - RNA, 18 nt, Artificial Sequence
  Description of Artificial Sequence: Synthetic oligonucleotide
acugaagacaggacuuag

SEQ ID NO: 67228 - RNA, 18 nt, Artificial Sequence
  Description of Artificial Sequence: Synthetic oligonucleotide
gggaaacugaagacagga

SEQ ID NO: 67229 - RNA, 18 nt, Artificial Sequence
  Description of Artificial Sequence: Synthetic oligonucleotide
gcagugggaaacugaaga

SEQ ID NO: 67230 - RNA, 18 nt, Artificial Sequence
  Description of Artificial Sequence: Synthetic oligonucleotide
gggaagcagugggaaacu

SEQ ID NO: 67231 - RNA, 18 nt, Artificial Sequence
  Description of Artificial Sequence: Synthetic oligonucleotide
uccaugggaagcaguggg

SEQ ID NO: 67232 - RNA, 18 nt, Artificial Sequence
  Description of Artificial Sequence: Synthetic oligonucleotide
gagaauccaugggaagca

SEQ ID NO: 67233 - RNA, 18 nt, Artificial Sequence
  Description of Artificial Sequence: Synthetic oligonucleotide
uguuggagaauccauggg

SEQ ID NO: 67234 - RNA, 18 nt, Artificial Sequence
  Description of Artificial Sequence: Synthetic oligonucleotide
aagaauguuggagaaucc

SEQ ID NO: 67235 - RNA, 18 nt, Artificial Sequence
  Description of Artificial Sequence: Synthetic oligonucleotide
agcucaagaauguuggag

SEQ ID NO: 67236 - RNA, 18 nt, Artificial Sequence
  Description of Artificial Sequence: Synthetic oligonucleotide
uaaaaagcucaagaaugu

SEQ ID NO: 67237 - RNA, 18 nt, Artificial Sequence
  Description of Artificial Sequence: Synthetic oligonucleotide
auuuuuaaaaagcucaag

SEQ ID NO: 67238 - RNA, 18 nt, Artificial Sequence
  Description of Artificial Sequence: Synthetic oligonucleotide
gagauauuuuuaaaaagc

SEQ ID NO: 67239 - RNA, 18 nt, Artificial Sequence
  Description of Artificial Sequence: Synthetic oligonucleotide
aaggugagauauuuuuaa

SEQ ID NO: 67240 - RNA, 18 nt, Artificial Sequence
  Description of Artificial Sequence: Synthetic oligonucleotide
agcugaaggugagauauu

SEQ ID NO: 67241 - RNA, 18 nt, Artificial Sequence
  Description of Artificial Sequence: Synthetic oligonucleotide
ggccaagcugaaggugag

SEQ ID NO: 67242 - RNA, 18 nt, Artificial Sequence
  Description of Artificial Sequence: Synthetic oligonucleotide
aggguggccaagcugaag

SEQ ID NO: 67243 - RNA, 18 nt, Artificial Sequence
  Description of Artificial Sequence: Synthetic oligonucleotide
ggguuaggguggccaagc

SEQ ID NO: 67244 - RNA, 18 nt, Artificial Sequence
  Description of Artificial Sequence: Synthetic oligonucleotide
agauuggguuaggguggc

SEQ ID NO: 67245 - RNA, 18 nt, Artificial Sequence
  Description of Artificial Sequence: Synthetic oligonucleotide
aauguagauuggguuagg

SEQ ID NO: 67246 - RNA, 18 nt, Artificial Sequence
  Description of Artificial Sequence: Synthetic oligonucleotide
aggugaauguagauuggg

SEQ ID NO: 67247 - RNA, 18 nt, Artificial Sequence
  Description of Artificial Sequence: Synthetic oligonucleotide
aucauaggugaauguaga

SEQ ID NO: 67248 - RNA, 18 nt, Artificial Sequence
  Description of Artificial Sequence: Synthetic oligonucleotide
cuaucaucauaggugaau

SEQ ID NO: 67249 - RNA, 18 nt, Artificial Sequence
  Description of Artificial Sequence: Synthetic oligonucleotide
acaggcuaucaucauagg

SEQ ID NO: 67250 - RNA, 18 nt, Artificial Sequence
  Description of Artificial Sequence: Synthetic oligonucleotide
uauccacaggcuaucauc

SEQ ID NO: 67251 - RNA, 18 nt, Artificial Sequence
  Description of Artificial Sequence: Synthetic oligonucleotide
caucuuauccacaggcua

SEQ ID NO: 67252 - RNA, 18 nt, Artificial Sequence
  Description of Artificial Sequence: Synthetic oligonucleotide
gccaucaucuuauccaca

SEQ ID NO: 67253 - RNA, 18 nt, Artificial Sequence
  Description of Artificial Sequence: Synthetic oligonucleotide
ugcaagccaucaucuuau

SEQ ID NO: 67254 - RNA, 18 nt, Artificial Sequence
  Description of Artificial Sequence: Synthetic oligonucleotide
ggaccugcaagccaucau

SEQ ID NO: 67255 - RNA, 18 nt, Artificial Sequence
  Description of Artificial Sequence: Synthetic oligonucleotide
auauuggaccugcaagcc

SEQ ID NO: 67256 - RNA, 18 nt, Artificial Sequence
  Description of Artificial Sequence: Synthetic oligonucleotide
uucacauauuggaccugc

SEQ ID NO: 67257 - RNA, 18 nt, Artificial Sequence
  Description of Artificial Sequence: Synthetic oligonucleotide
aucuauucacauauugga

SEQ ID NO: 67258 - RNA, 18 nt, Artificial Sequence
  Description of Artificial Sequence: Synthetic oligonucleotide
uucaaaucuauucacaua

SEQ ID NO: 67259 - RNA, 18 nt, Artificial Sequence
  Description of Artificial Sequence: Synthetic oligonucleotide
ucagcuucaaaucuauuc

SEQ ID NO: 67260 - RNA, 18 nt, Artificial Sequence
  Description of Artificial Sequence: Synthetic oligonucleotide
gguguucagcuucaaauc

SEQ ID NO: 67261 - RNA, 18 nt, Artificial Sequence
  Description of Artificial Sequence: Synthetic oligonucleotide
uucaugguguucagcuuc

SEQ ID NO: 67262 - RNA, 18 nt, Artificial Sequence
  Description of Artificial Sequence: Synthetic oligonucleotide
agcuuuucaugguguuca

SEQ ID NO: 67263 - RNA, 18 nt, Artificial Sequence
  Description of Artificial Sequence: Synthetic oligonucleotide
ucuccagcuuuucauggu

SEQ ID NO: 67264 - RNA, 18 nt, Artificial Sequence
  Description of Artificial Sequence: Synthetic oligonucleotide
auuucucuccagcuuuuc

SEQ ID NO: 67265 - RNA, 18 nt, Artificial Sequence
  Description of Artificial Sequence: Synthetic oligonucleotide
gagcgauuucucuccagc

SEQ ID NO: 67266 - RNA, 18 nt, Artificial Sequence
  Description of Artificial Sequence: Synthetic oligonucleotide
gccaugagcgauuucucu

SEQ ID NO: 67267 - RNA, 18 nt, Artificial Sequence
  Description of Artificial Sequence: Synthetic oligonucleotide
gcauggccaugagcgauu

SEQ ID NO: 67268 - RNA, 18 nt, Artificial Sequence
  Description of Artificial Sequence: Synthetic oligonucleotide
caaaggcauggccaugag

SEQ ID NO: 67269 - RNA, 18 nt, Artificial Sequence
  Description of Artificial Sequence: Synthetic oligonucleotide
uaggucaaaggcauggcc

SEQ ID NO: 67270 - RNA, 18 nt, Artificial Sequence
  Description of Artificial Sequence: Synthetic oligonucleotide
gggaauaggucaaaggca

SEQ ID NO: 67271 - RNA, 18 nt, Artificial Sequence
  Description of Artificial Sequence: Synthetic oligonucleotide
ugaacgggaauaggucaa

SEQ ID NO: 67272 - RNA, 18 nt, Artificial Sequence
  Description of Artificial Sequence: Synthetic oligonucleotide
aagacugaacgggaauag

SEQ ID NO: 67273 - RNA, 18 nt, Artificial Sequence
  Description of Artificial Sequence: Synthetic oligonucleotide
uuaagaagacugaacggg

SEQ ID NO: 67274 - RNA, 18 nt, Artificial Sequence
  Description of Artificial Sequence: Synthetic oligonucleotide
ccaauuuaagaagacuga

SEQ ID NO: 67275 - RNA, 18 nt, Artificial Sequence
  Description of Artificial Sequence: Synthetic oligonucleotide
ucaugccaauuuaagaag

SEQ ID NO: 67276 - RNA, 18 nt, Artificial Sequence
  Description of Artificial Sequence: Synthetic oligonucleotide
cuucuucaugccaauuua

SEQ ID NO: 67277 - RNA, 18 nt, Artificial Sequence
  Description of Artificial Sequence: Synthetic oligonucleotide
ucuugcuucuucaugcca

SEQ ID NO: 67278 - RNA, 18 nt, Artificial Sequence
  Description of Artificial Sequence: Synthetic oligonucleotide
augagucuugcuucuuca

SEQ ID NO: 67279 - RNA, 18 nt, Artificial Sequence
  Description of Artificial Sequence: Synthetic oligonucleotide
gacauaugagucuugcuu

SEQ ID NO: 67280 - RNA, 18 nt, Artificial Sequence
  Description of Artificial Sequence: Synthetic oligonucleotide
uggaugacauaugagucu

SEQ ID NO: 67281 - RNA, 18 nt, Artificial Sequence
  Description of Artificial Sequence: Synthetic oligonucleotide
aucuguggaugacauaug

SEQ ID NO: 67282 - RNA, 18 nt, Artificial Sequence
  Description of Artificial Sequence: Synthetic oligonucleotide
gugucaucuguggaugac

SEQ ID NO: 67283 - RNA, 18 nt, Artificial Sequence
  Description of Artificial Sequence: Synthetic oligonucleotide
gcuuugugucaucugugg

SEQ ID NO: 67284 - RNA, 18 nt, Artificial Sequence
  Description of Artificial Sequence: Synthetic oligonucleotide
ucccagcuuugugucauc

SEQ ID NO: 67285 - RNA, 18 nt, Artificial Sequence
  Description of Artificial Sequence: Synthetic oligonucleotide
guacuucccagcuuugug

SEQ ID NO: 67286 - RNA, 18 nt, Artificial Sequence
  Description of Artificial Sequence: Synthetic oligonucleotide
uagugguacuucccagcu

SEQ ID NO: 67287 - RNA, 18 nt, Artificial Sequence
  Description of Artificial Sequence: Synthetic oligonucleotide
uauuuuagugguacuucc

SEQ ID NO: 67288 - RNA, 18 nt, Artificial Sequence
  Description of Artificial Sequence: Synthetic oligonucleotide
uuuguuauuuuaguggua

SEQ ID NO: 67289 - RNA, 18 nt, Artificial Sequence
  Description of Artificial Sequence: Synthetic oligonucleotide
agucuuuuguuauuuuag

SEQ ID NO: 67290 - RNA, 18 nt, Artificial Sequence
  Description of Artificial Sequence: Synthetic oligonucleotide
gauucagucuuuuguuau

SEQ ID NO: 67291 - RNA, 18 nt, Artificial Sequence
  Description of Artificial Sequence: Synthetic oligonucleotide
aucuugauucagucuuuu

SEQ ID NO: 67292 - RNA, 18 nt, Artificial Sequence
  Description of Artificial Sequence: Synthetic oligonucleotide
uuugaaucuugauucagu

SEQ ID NO: 67293 - RNA, 18 nt, Artificial Sequence
  Description of Artificial Sequence: Synthetic oligonucleotide
agugauuugaaucuugau

SEQ ID NO: 67294 - RNA, 18 nt, Artificial Sequence
  Description of Artificial Sequence: Synthetic oligonucleotide
cuuucagugauuugaauc

SEQ ID NO: 67295 - RNA, 18 nt, Artificial Sequence
  Description of Artificial Sequence: Synthetic oligonucleotide
cuagucuuucagugauuu

SEQ ID NO: 67296 - RNA, 18 nt, Artificial Sequence
  Description of Artificial Sequence: Synthetic oligonucleotide
uugaccuagucuuucagu

SEQ ID NO: 67297 - RNA, 18 nt, Artificial Sequence
  Description of Artificial Sequence: Synthetic oligonucleotide
uguuuuugaccuagucuu

SEQ ID NO: 67298 - RNA, 18 nt, Artificial Sequence
  Description of Artificial Sequence: Synthetic oligonucleotide
caccuuguuuuugaccua

SEQ ID NO: 67299 - RNA, 18 nt, Artificial Sequence
  Description of Artificial Sequence: Synthetic oligonucleotide
uguuucaccuuguuuuug

SEQ ID NO: 67300 - RNA, 18 nt, Artificial Sequence
  Description of Artificial Sequence: Synthetic oligonucleotide
ucuguuguuucaccuugu

SEQ ID NO: 67301 - RNA, 18 nt, Artificial Sequence
  Description of Artificial Sequence: Synthetic oligonucleotide
auaucucuguuguuucac

SEQ ID NO: 67302 - RNA, 18 nt, Artificial Sequence
  Description of Artificial Sequence: Synthetic oligonucleotide
aguuuauaucucuguugu

SEQ ID NO: 67303 - RNA, 18 nt, Artificial Sequence
  Description of Artificial Sequence: Synthetic oligonucleotide
guagaaguuuauaucucu

SEQ ID NO: 67304 - RNA, 18 nt, Artificial Sequence
  Description of Artificial Sequence: Synthetic oligonucleotide
cacauguagaaguuuaua

SEQ ID NO: 67305 - RNA, 18 nt, Artificial Sequence
  Description of Artificial Sequence: Synthetic oligonucleotide
cggcccacauguagaagu

SEQ ID NO: 67306 - RNA, 18 nt, Artificial Sequence
  Description of Artificial Sequence: Synthetic oligonucleotide
gcccccggcccacaugua

SEQ ID NO: 67307 - RNA, 18 nt, Artificial Sequence
  Description of Artificial Sequence: Synthetic oligonucleotide
cgugagcccccggcccac

SEQ ID NO: 67308 - RNA, 18 nt, Artificial Sequence
  Description of Artificial Sequence: Synthetic oligonucleotide
acaggcgugagcccccgg

SEQ ID NO: 67309 - RNA, 18 nt, Artificial Sequence
  Description of Artificial Sequence: Synthetic oligonucleotide
ggauuacaggcgugagcc

SEQ ID NO: 67310 - RNA, 18 nt, Artificial Sequence
  Description of Artificial Sequence: Synthetic oligonucleotide
ugcugggauuacaggcgu

SEQ ID NO: 67311 - RNA, 18 nt, Artificial Sequence
  Description of Artificial Sequence: Synthetic oligonucleotide
caaagugcugggauuaca

SEQ ID NO: 67312 - RNA, 18 nt, Artificial Sequence
  Description of Artificial Sequence: Synthetic oligonucleotide
ccucccaaagugcuggga

SEQ ID NO: 67313 - RNA, 18 nt, Artificial Sequence
  Description of Artificial Sequence: Synthetic oligonucleotide
cucggccucccaaagugc

SEQ ID NO: 67314 - RNA, 18 nt, Artificial Sequence
  Description of Artificial Sequence: Synthetic oligonucleotide
ccugccucggccucccaa

SEQ ID NO: 67315 - RNA, 18 nt, Artificial Sequence
  Description of Artificial Sequence: Synthetic oligonucleotide
aucugccugccucggccu

SEQ ID NO: 67316 - RNA, 18 nt, Artificial Sequence
  Description of Artificial Sequence: Synthetic oligonucleotide
aggugaucugccugccuc

SEQ ID NO: 67317 - RNA, 18 nt, Artificial Sequence
  Description of Artificial Sequence: Synthetic oligonucleotide
cccucaggugaucugccu

SEQ ID NO: 67318 - RNA, 18 nt, Artificial Sequence
  Description of Artificial Sequence: Synthetic oligonucleotide
uccugcccucaggugauc

SEQ ID NO: 67319 - RNA, 18 nt, Artificial Sequence
  Description of Artificial Sequence: Synthetic oligonucleotide
caaacuccugcccucagg

SEQ ID NO: 67320 - RNA, 18 nt, Artificial Sequence
  Description of Artificial Sequence: Synthetic oligonucleotide
gcucucaaacuccugccc

SEQ ID NO: 67321 - RNA, 18 nt, Artificial Sequence
  Description of Artificial Sequence: Synthetic oligonucleotide
gcugggcauggugguggg

SEQ ID NO: 67322 - RNA, 18 nt, Artificial Sequence
  Description of Artificial Sequence: Synthetic oligonucleotide
aauuagcugggcauggug

SEQ ID NO: 67323 - RNA, 18 nt, Artificial Sequence
  Description of Artificial Sequence: Synthetic oligonucleotide
acaaaaauuagcugggca

SEQ ID NO: 67324 - RNA, 18 nt, Artificial Sequence
  Description of Artificial Sequence: Synthetic oligonucleotide
aaaauacaaaaauuagcu

SEQ ID NO: 67325 - RNA, 18 nt, Artificial Sequence
  Description of Artificial Sequence: Synthetic oligonucleotide
uaccaaaaauacaaaaau

SEQ ID NO: 67326 - RNA, 18 nt, Artificial Sequence
  Description of Artificial Sequence: Synthetic oligonucleotide
aucucuaccaaaaauaca

SEQ ID NO: 67327 - RNA, 18 nt, Artificial Sequence
  Description of Artificial Sequence: Synthetic oligonucleotide
accccaucucuaccaaaa

SEQ ID NO: 67328 - RNA, 18 nt, Artificial Sequence
  Description of Artificial Sequence: Synthetic oligonucleotide
gugaaaccccaucucuac

SEQ ID NO: 67329 - RNA, 18 nt, Artificial Sequence
  Description of Artificial Sequence: Synthetic oligonucleotide
acauggugaaaccccauc

SEQ ID NO: 67330 - RNA, 18 nt, Artificial Sequence
  Description of Artificial Sequence: Synthetic oligonucleotide
ggccaacauggugaaacc

SEQ ID NO: 67331 - RNA, 18 nt, Artificial Sequence
  Description of Artificial Sequence: Synthetic oligonucleotide
agccuggccaacauggug

SEQ ID NO: 67332 - RNA, 18 nt, Artificial Sequence
  Description of Artificial Sequence: Synthetic oligonucleotide
agaucagccuggccaaca

SEQ ID NO: 67333 - RNA, 18 nt, Artificial Sequence
  Description of Artificial Sequence: Synthetic oligonucleotide
guucaagaucagccuggc

SEQ ID NO: 67334 - RNA, 18 nt, Artificial Sequence
  Description of Artificial Sequence: Synthetic oligonucleotide
caggaguucaagaucagc

SEQ ID NO: 67335 - RNA, 18 nt, Artificial Sequence
  Description of Artificial Sequence: Synthetic oligonucleotide
gaggucaggaguucaaga

SEQ ID NO: 67336 - RNA, 18 nt, Artificial Sequence
  Description of Artificial Sequence: Synthetic oligonucleotide
caccugaggucaggaguu

SEQ ID NO: 67337 - RNA, 18 nt, Artificial Sequence
  Description of Artificial Sequence: Synthetic oligonucleotide
uggaucaccugaggucag

SEQ ID NO: 67338 - RNA, 18 nt, Artificial Sequence
  Description of Artificial Sequence: Synthetic oligonucleotide
gcagguggaucaccugag

SEQ ID NO: 67339 - RNA, 18 nt, Artificial Sequence
  Description of Artificial Sequence: Synthetic oligonucleotide
cugaggcagguggaucac

SEQ ID NO: 67340 - RNA, 18 nt, Artificial Sequence
  Description of Artificial Sequence: Synthetic oligonucleotide
ggaggcugaggcaggugg

SEQ ID NO: 67341 - RNA, 18 nt, Artificial Sequence
  Description of Artificial Sequence: Synthetic oligonucleotide
cuuugggaggcugaggca

SEQ ID NO: 67342 - RNA, 18 nt, Artificial Sequence
  Description of Artificial Sequence: Synthetic oligonucleotide
cagcacuuugggaggcug

SEQ ID NO: 67343 - RNA, 18 nt, Artificial Sequence
  Description of Artificial Sequence: Synthetic oligonucleotide
aaucccagcacuuuggga

SEQ ID NO: 67344 - RNA, 18 nt, Artificial Sequence
  Description of Artificial Sequence: Synthetic oligonucleotide
ccuguaaucccagcacuu

SEQ ID NO: 67345 - RNA, 18 nt, Artificial Sequence
  Description of Artificial Sequence: Synthetic oligonucleotide
ucacgccuguaaucccag

SEQ ID NO: 67346 - RNA, 18 nt, Artificial Sequence
  Description of Artificial Sequence: Synthetic oligonucleotide
guggcucacgccuguaau

SEQ ID NO: 67347 - RNA, 18 nt, Artificial Sequence
  Description of Artificial Sequence: Synthetic oligonucleotide
gugcaguggcucacgccu

SEQ ID NO: 67348 - RNA, 18 nt, Artificial Sequence
  Description of Artificial Sequence: Synthetic oligonucleotide
gcugggugcaguggcuca

SEQ ID NO: 67349 - RNA, 18 nt, Artificial Sequence
  Description of Artificial Sequence: Synthetic oligonucleotide
ugaaggcugggugcagug

SEQ ID NO: 67350 - RNA, 18 nt, Artificial Sequence
  Description of Artificial Sequence: Synthetic oligonucleotide
cugaaugaaggcugggug

SEQ ID NO: 67351 - RNA, 18 nt, Artificial Sequence
  Description of Artificial Sequence: Synthetic oligonucleotide
uuaaacugaaugaaggcu

SEQ ID NO: 67352 - RNA, 18 nt, Artificial Sequence
  Description of Artificial Sequence: Synthetic oligonucleotide
gauuuuuaaacugaauga

SEQ ID NO: 67353 - RNA, 18 nt, Artificial Sequence
  Description of Artificial Sequence: Synthetic oligonucleotide
cauuugauuuuuaaacug

SEQ ID NO: 67354 - RNA, 18 nt, Artificial Sequence
  Description of Artificial Sequence: Synthetic oligonucleotide
aggaucauuugauuuuua

SEQ ID NO: 67355 - RNA, 18 nt, Artificial Sequence
  Description of Artificial Sequence: Synthetic oligonucleotide
accuuaggaucauuugau

SEQ ID NO: 67356 - RNA, 18 nt, Artificial Sequence
  Description of Artificial Sequence: Synthetic oligonucleotide
gcaaaaccuuaggaucau

SEQ ID NO: 67357 - RNA, 18 nt, Artificial Sequence
  Description of Artificial Sequence: Synthetic oligonucleotide
cugcugcaaaaccuuagg

SEQ ID NO: 67358 - RNA, 18 nt, Artificial Sequence
  Description of Artificial Sequence: Synthetic oligonucleotide
ucuuucugcugcaaaacc

SEQ ID NO: 67359 - RNA, 18 nt, Artificial Sequence
  Description of Artificial Sequence: Synthetic oligonucleotide
uuuacucuuucugcugca

SEQ ID NO: 67360 - RNA, 18 nt, Artificial Sequence
  Description of Artificial Sequence: Synthetic oligonucleotide
gcaaauuuacucuuucug

SEQ ID NO: 67361 - RNA, 18 nt, Artificial Sequence
  Description of Artificial Sequence: Synthetic oligonucleotide
gugcugcaaauuuacucu

SEQ ID NO: 67362 - RNA, 18 nt, Artificial Sequence
  Description of Artificial Sequence: Synthetic oligonucleotide
uucuagugcugcaaauuu

SEQ ID NO: 67363 - RNA, 18 nt, Artificial Sequence
  Description of Artificial Sequence: Synthetic oligonucleotide
cuugguucuagugcugca

SEQ ID NO: 67364 - RNA, 18 nt, Artificial Sequence
  Description of Artificial Sequence: Synthetic oligonucleotide
uaccucuugguucuagug

SEQ ID NO: 67365 - RNA, 18 nt, Artificial Sequence
  Description of Artificial Sequence: Synthetic oligonucleotide
gcuuuuaccucuugguuc

SEQ ID NO: 67366 - RNA, 18 nt, Artificial Sequence
  Description of Artificial Sequence: Synthetic oligonucleotide
uuacagcuuuuaccucuu

SEQ ID NO: 67367 - RNA, 18 nt, Artificial Sequence
  Description of Artificial Sequence: Synthetic oligonucleotide
cccuguuacagcuuuuac

SEQ ID NO: 67368 - RNA, 18 nt, Artificial Sequence
  Description of Artificial Sequence: Synthetic oligonucleotide
aucugcccuguuacagcu

SEQ ID NO: 67369 - RNA, 18 nt, Artificial Sequence
  Description of Artificial Sequence: Synthetic oligonucleotide
cugaaaucugcccuguua

SEQ ID NO: 67370 - RNA, 18 nt, Artificial Sequence
  Description of Artificial Sequence: Synthetic oligonucleotide
cguugcugaaaucugccc

SEQ ID NO: 67371 - RNA, 18 nt, Artificial Sequence
  Description of Artificial Sequence: Synthetic oligonucleotide
ucuuacguugcugaaauc

SEQ ID NO: 67372 - RNA, 18 nt, Artificial Sequence
  Description of Artificial Sequence: Synthetic oligonucleotide
uuuuuucuuacguugcug

SEQ ID NO: 67373 - RNA, 18 nt, Artificial Sequence
  Description of Artificial Sequence: Synthetic oligonucleotide
gcuccuuuuuucuuacgu

SEQ ID NO: 67374 - RNA, 18 nt, Artificial Sequence
  Description of Artificial Sequence: Synthetic oligonucleotide
gaagagcuccuuuuuucu

SEQ ID NO: 67375 - RNA, 18 nt, Artificial Sequence
  Description of Artificial Sequence: Synthetic oligonucleotide
agugagaagagcuccuuu

SEQ ID NO: 67376 - RNA, 18 nt, Artificial Sequence
  Description of Artificial Sequence: Synthetic oligonucleotide
guuucagugagaagagcu

SEQ ID NO: 67377 - RNA, 18 nt, Artificial Sequence
  Description of Artificial Sequence: Synthetic oligonucleotide
acuugguuucagugagaa

SEQ ID NO: 67378 - RNA, 18 nt, Artificial Sequence
  Description of Artificial Sequence: Synthetic oligonucleotide
cuuacacuugguuucagu

SEQ ID NO: 67379 - RNA, 18 nt, Artificial Sequence
  Description of Artificial Sequence: Synthetic oligonucleotide
cuggucuuacacuugguu

SEQ ID NO: 67380 - RNA, 18 nt, Artificial Sequence
  Description of Artificial Sequence: Synthetic oligonucleotide
ccagccuggucuuacacu

SEQ ID NO: 67381 - RNA, 18 nt, Artificial Sequence
  Description of Artificial Sequence: Synthetic oligonucleotide
cuaguccagccuggucuu

SEQ ID NO: 67382 - RNA, 18 nt, Artificial Sequence
  Description of Artificial Sequence: Synthetic oligonucleotide
guccucuaguccagccug

SEQ ID NO: 67383 - RNA, 18 nt, Artificial Sequence
  Description of Artificial Sequence: Synthetic oligonucleotide
cccguguccucuagucca

SEQ ID NO: 67384 - RNA, 18 nt, Artificial Sequence
  Description of Artificial Sequence: Synthetic oligonucleotide
aaacucccguguccucua

SEQ ID NO: 67385 - RNA, 18 nt, Artificial Sequence
  Description of Artificial Sequence: Synthetic oligonucleotide
uucaaaaacucccguguc

SEQ ID NO: 67386 - RNA, 18 nt, Artificial Sequence
  Description of Artificial Sequence: Synthetic oligonucleotide
ucugcuucaaaaacuccc

SEQ ID NO: 67387 - RNA, 18 nt, Artificial Sequence
  Description of Artificial Sequence: Synthetic oligonucleotide
cagccucugcuucaaaaa

SEQ ID NO: 67388 - RNA, 18 nt, Artificial Sequence
  Description of Artificial Sequence: Synthetic oligonucleotide
gucaucagccucugcuuc

SEQ ID NO: 67389 - RNA, 18 nt, Artificial Sequence
  Description of Artificial Sequence: Synthetic oligonucleotide
agcuggucaucagccucu

SEQ ID NO: 67390 - RNA, 18 nt, Artificial Sequence
  Description of Artificial Sequence: Synthetic oligonucleotide
ccgacagcuggucaucag

SEQ ID NO: 67391 - RNA, 18 nt, Artificial Sequence
  Description of Artificial Sequence: Synthetic oligonucleotide
gucucccgacagcugguc

SEQ ID NO: 67392 - RNA, 18 nt, Artificial Sequence
  Description of Artificial Sequence: Synthetic oligonucleotide
ucacagucucccgacagc

SEQ ID NO: 67393 - RNA, 18 nt, Artificial Sequence
  Description of Artificial Sequence: Synthetic oligonucleotide
uuccuucacagucucccg

SEQ ID NO: 67394 - RNA, 18 nt, Artificial Sequence
  Description of Artificial Sequence: Synthetic oligonucleotide
aggaauuccuucacaguc

SEQ ID NO: 67395 - RNA, 18 nt, Artificial Sequence
  Description of Artificial Sequence: Synthetic oligonucleotide
agggcaggaauuccuuca

SEQ ID NO: 67396 - RNA, 18 nt, Artificial Sequence
  Description of Artificial Sequence: Synthetic oligonucleotide
cacccagggcaggaauuc

SEQ ID NO: 67397 - RNA, 18 nt, Artificial Sequence
  Description of Artificial Sequence: Synthetic oligonucleotide
ggucccacccagggcagg

SEQ ID NO: 67398 - RNA, 18 nt, Artificial Sequence
  Description of Artificial Sequence: Synthetic oligonucleotide
accaaggucccacccagg

SEQ ID NO: 67399 - RNA, 18 nt, Artificial Sequence
  Description of Artificial Sequence: Synthetic oligonucleotide
acaggaccaaggucccac

SEQ ID NO: 67400 - RNA, 18 nt, Artificial Sequence
  Description of Artificial Sequence: Synthetic oligonucleotide
acuggacaggaccaaggu

SEQ ID NO: 67401 - RNA, 18 nt, Artificial Sequence
  Description of Artificial Sequence: Synthetic oligonucleotide
ugagaacuggacaggacc

SEQ ID NO: 67402 - RNA, 18 nt, Artificial Sequence
  Description of Artificial Sequence: Synthetic oligonucleotide
caggcugagaacuggaca

SEQ ID NO: 67403 - RNA, 18 nt, Artificial Sequence
  Description of Artificial Sequence: Synthetic oligonucleotide
ucauacaggcugagaacu

SEQ ID NO: 67404 - RNA, 18 nt, Artificial Sequence
  Description of Artificial Sequence: Synthetic oligonucleotide
gugaaucauacaggcuga

SEQ ID NO: 67405 - RNA, 18 nt, Artificial Sequence
  Description of Artificial Sequence: Synthetic oligonucleotide
gcagagugaaucauacag

SEQ ID NO: 67406 - RNA, 18 nt, Artificial Sequence
  Description of Artificial Sequence: Synthetic oligonucleotide
agccagcagagugaauca

SEQ ID NO: 67407 - RNA, 18 nt, Artificial Sequence
  Description of Artificial Sequence: Synthetic oligonucleotide
ggaguagccagcagagug

SEQ ID NO: 67408 - RNA, 18 nt, Artificial Sequence
  Description of Artificial Sequence: Synthetic oligonucleotide
ccuuaggaguagccagca

SEQ ID NO: 67409 - RNA, 18 nt, Artificial Sequence
  Description of Artificial Sequence: Synthetic oligonucleotide
gggagccuuaggaguagc

SEQ ID NO: 67410 - RNA, 18 nt, Artificial Sequence
  Description of Artificial Sequence: Synthetic oligonucleotide
acacuaaaagcggguggg

SEQ ID NO: 67411 - RNA, 18 nt, Artificial Sequence
  Description of Artificial Sequence: Synthetic oligonucleotide
ggcacacuaaaagcgggu

SEQ ID NO: 67412 - RNA, 18 nt, Artificial Sequence
  Description of Artificial Sequence: Synthetic oligonucleotide
caaagggcacacuaaaag

SEQ ID NO: 67413 - RNA, 18 nt, Artificial Sequence
  Description of Artificial Sequence: Synthetic oligonucleotide
ugccucaaagggcacacu

SEQ ID NO: 67414 - RNA, 18 nt, Artificial Sequence
  Description of Artificial Sequence: Synthetic oligonucleotide
cgcacugccucaaagggc

SEQ ID NO: 67415 - RNA, 18 nt, Artificial Sequence
  Description of Artificial Sequence: Synthetic oligonucleotide
agaagcgcacugccucaa

SEQ ID NO: 67416 - RNA, 18 nt, Artificial Sequence
  Description of Artificial Sequence: Synthetic oligonucleotide
aagagagaagcgcacugc

SEQ ID NO: 67417 - RNA, 18 nt, Artificial Sequence
  Description of Artificial Sequence: Synthetic oligonucleotide
ccugugccuuggucuccu

SEQ ID NO: 67418 - RNA, 18 nt, Artificial Sequence
  Description of Artificial Sequence: Synthetic oligonucleotide
aauguccugugccuuggu

SEQ ID NO: 67419 - RNA, 18 nt, Artificial Sequence
  Description of Artificial Sequence: Synthetic oligonucleotide
cccagaauguccugugcc

SEQ ID NO: 67420 - RNA, 18 nt, Artificial Sequence
  Description of Artificial Sequence: Synthetic oligonucleotide
cugcucccagaauguccu

SEQ ID NO: 67421 - RNA, 18 nt, Artificial Sequence
  Description of Artificial Sequence: Synthetic oligonucleotide
ggucacugcucccagaau

SEQ ID NO: 67422 - RNA, 18 nt, Artificial Sequence
  Description of Artificial Sequence: Synthetic oligonucleotide
agaagggucacugcuccc

SEQ ID NO: 67423 - RNA, 18 nt, Artificial Sequence
  Description of Artificial Sequence: Synthetic oligonucleotide
ccagcagaagggucacug

SEQ ID NO: 67424 - RNA, 18 nt, Artificial Sequence
  Description of Artificial Sequence: Synthetic oligonucleotide
ucccuccagcagaagggu

SEQ ID NO: 67425 - RNA, 18 nt, Artificial Sequence
  Description of Artificial Sequence: Synthetic oligonucleotide
aucacucccuccagcaga

SEQ ID NO: 67426 - RNA, 18 nt, Artificial Sequence
  Description of Artificial Sequence: Synthetic oligonucleotide
cugccaucacucccucca

SEQ ID NO: 67427 - RNA, 18 nt, Artificial Sequence
  Description of Artificial Sequence: Synthetic oligonucleotide
ccgugcugccaucacucc

SEQ ID NO: 67428 - RNA, 18 nt, Artificial Sequence
  Description of Artificial Sequence: Synthetic oligonucleotide
uguccccgugcugccauc

SEQ ID NO: 67429 - RNA, 18 nt, Artificial Sequence
  Description of Artificial Sequence: Synthetic oligonucleotide
ccaguuguccccgugcug

SEQ ID NO: 67430 - RNA, 18 nt, Artificial Sequence
  Description of Artificial Sequence: Synthetic oligonucleotide
gggucccaguuguccccg

SEQ ID NO: 67431 - RNA, 18 nt, Artificial Sequence
  Description of Artificial Sequence: Synthetic oligonucleotide
caagugggucccaguugu

SEQ ID NO: 67432 - RNA, 18 nt, Artificial Sequence
  Description of Artificial Sequence: Synthetic oligonucleotide
agaggcaaguggguccca

SEQ ID NO: 67433 - RNA, 18 nt, Artificial Sequence
  Description of Artificial Sequence: Synthetic oligonucleotide
ggaugagaggcaaguggg

SEQ ID NO: 67434 - RNA, 18 nt, Artificial Sequence
  Description of Artificial Sequence: Synthetic oligonucleotide
aggagggaugagaggcaa

SEQ ID NO: 67435 - RNA, 18 nt, Artificial Sequence
  Description of Artificial Sequence: Synthetic oligonucleotide
gccccaggagggaugaga

SEQ ID NO: 67436 - RNA, 18 nt, Artificial Sequence
  Description of Artificial Sequence: Synthetic oligonucleotide
aagcugccccaggaggga

SEQ ID NO: 67437 - RNA, 18 nt, Artificial Sequence
  Description of Artificial Sequence: Synthetic oligonucleotide
ccagaaagcugccccagg

SEQ ID NO: 67438 - RNA, 18 nt, Artificial Sequence
  Description of Artificial Sequence: Synthetic oligonucleotide
ccuguccagaaagcugcc

SEQ ID NO: 67439 - RNA, 18 nt, Artificial Sequence
  Description of Artificial Sequence: Synthetic oligonucleotide
acggaccuguccagaaag

SEQ ID NO: 67440 - RNA, 18 nt, Artificial Sequence
  Description of Artificial Sequence: Synthetic oligonucleotide
aggagacggaccugucca

SEQ ID NO: 67441 - RNA, 18 nt, Artificial Sequence
  Description of Artificial Sequence: Synthetic oligonucleotide
caaggaggagacggaccu

SEQ ID NO: 67442 - RNA, 18 nt, Artificial Sequence
  Description of Artificial Sequence: Synthetic oligonucleotide
ggccccaaggaggagacg

SEQ ID NO: 67443 - RNA, 18 nt, Artificial Sequence
  Description of Artificial Sequence: Synthetic oligonucleotide
ugcagggccccaaggagg

SEQ ID NO: 67444 - RNA, 18 nt, Artificial Sequence
  Description of Artificial Sequence: Synthetic oligonucleotide
ggcucugcagggccccaa

SEQ ID NO: 67445 - RNA, 18 nt, Artificial Sequence
  Description of Artificial Sequence: Synthetic oligonucleotide
aaggaggcucugcagggc

SEQ ID NO: 67446 - RNA, 18 nt, Artificial Sequence
  Description of Artificial Sequence: Synthetic oligonucleotide
guuccaaggaggcucugc

SEQ ID NO: 67447 - RNA, 18 nt, Artificial Sequence
  Description of Artificial Sequence: Synthetic oligonucleotide
uccugugccuuggucucc

SEQ ID NO: 67448 - RNA, 18 nt, Artificial Sequence
  Description of Artificial Sequence: Synthetic oligonucleotide
gaauguccugugccuugg

SEQ ID NO: 67449 - RNA, 18 nt, Artificial Sequence
  Description of Artificial Sequence: Synthetic oligonucleotide
ucccagaauguccugugc

SEQ ID NO: 67450 - RNA, 18 nt, Artificial Sequence
  Description of Artificial Sequence: Synthetic oligonucleotide
acugcucccagaaugucc

SEQ ID NO: 67451 - RNA, 18 nt, Artificial Sequence
  Description of Artificial Sequence: Synthetic oligonucleotide
gggucacugcucccagaa

SEQ ID NO: 67452 - RNA, 18 nt, Artificial Sequence
  Description of Artificial Sequence: Synthetic oligonucleotide
cagaagggucacugcucc

SEQ ID NO: 67453 - RNA, 18 nt, Artificial Sequence
  Description of Artificial Sequence: Synthetic oligonucleotide
uccagcagaagggucacu

SEQ ID NO: 67454 - RNA, 18 nt, Artificial Sequence
  Description of Artificial Sequence: Synthetic oligonucleotide
cucccuccagcagaaggg

SEQ ID NO: 67455 - RNA, 18 nt, Artificial Sequence
  Description of Artificial Sequence: Synthetic oligonucleotide
caucacucccuccagcag

SEQ ID NO: 67456 - RNA, 18 nt, Artificial Sequence
  Description of Artificial Sequence: Synthetic oligonucleotide
gcugccaucacucccucc

SEQ ID NO: 67457 - RNA, 18 nt, Artificial Sequence
  Description of Artificial Sequence: Synthetic oligonucleotide
cccgugcugccaucacuc

SEQ ID NO: 67458 - RNA, 18 nt, Artificial Sequence
  Description of Artificial Sequence: Synthetic oligonucleotide
uuguccccgugcugccau

SEQ ID NO: 67459 - RNA, 18 nt, Artificial Sequence
  Description of Artificial Sequence: Synthetic oligonucleotide
cccaguuguccccgugcu

SEQ ID NO: 67460 - RNA, 18 nt, Artificial Sequence
  Description of Artificial Sequence: Synthetic oligonucleotide
ugggucccaguugucccc

SEQ ID NO: 67461 - RNA, 18 nt, Artificial Sequence
  Description of Artificial Sequence: Synthetic oligonucleotide
gcaagugggucccaguug

SEQ ID NO: 67462 - RNA, 18 nt, Artificial Sequence
  Description of Artificial Sequence: Synthetic oligonucleotide
gagaggcaaguggguccc

SEQ ID NO: 67463 - RNA, 18 nt, Artificial Sequence
  Description of Artificial Sequence: Synthetic oligonucleotide
gggaugagaggcaagugg

SEQ ID NO: 67464 - RNA, 18 nt, Artificial Sequence
  Description of Artificial Sequence: Synthetic oligonucleotide
caggagggaugagaggca

SEQ ID NO: 67465 - RNA, 18 nt, Artificial Sequence
  Description of Artificial Sequence: Synthetic oligonucleotide
ugccccaggagggaugag

SEQ ID NO: 67466 - RNA, 18 nt, Artificial Sequence
  Description of Artificial Sequence: Synthetic oligonucleotide
aaagcugccccaggaggg

SEQ ID NO: 67467 - RNA, 18 nt, Artificial Sequence
  Description of Artificial Sequence: Synthetic oligonucleotide
uccagaaagcugccccag

SEQ ID NO: 67468 - RNA, 18 nt, Artificial Sequence
  Description of Artificial Sequence: Synthetic oligonucleotide
accuguccagaaagcugc

SEQ ID NO: 67469 - RNA, 18 nt, Artificial Sequence
  Description of Artificial Sequence: Synthetic oligonucleotide
gacggaccuguccagaaa

SEQ ID NO: 67470 - RNA, 18 nt, Artificial Sequence
  Description of Artificial Sequence: Synthetic oligonucleotide
gaggagacggaccugucc

SEQ ID NO: 67471 - RNA, 18 nt, Artificial Sequence
  Description of Artificial Sequence: Synthetic oligonucleotide
ccaaggaggagacggacc

SEQ ID NO: 67472 - RNA, 18 nt, Artificial Sequence
  Description of Artificial Sequence: Synthetic oligonucleotide
gggccccaaggaggagac

SEQ ID NO: 67473 - RNA, 18 nt, Artificial Sequence
  Description of Artificial Sequence: Synthetic oligonucleotide
cugcagggccccaaggag

SEQ ID NO: 67474 - RNA, 18 nt, Artificial Sequence
  Description of Artificial Sequence: Synthetic oligonucleotide
aggcucugcagggcccca

SEQ ID NO: 67475 - RNA, 18 nt, Artificial Sequence
  Description of Artificial Sequence: Synthetic oligonucleotide
caaggaggcucugcaggg

SEQ ID NO: 67476 - RNA, 18 nt, Artificial Sequence
  Description of Artificial Sequence: Synthetic oligonucleotide
gguuccaaggaggcucug

SEQ ID NO: 67477 - RNA, 18 nt, Artificial Sequence
  Description of Artificial Sequence: Synthetic oligonucleotide
ucuacagaucccuugacu

SEQ ID NO: 67478 - RNA, 18 nt, Artificial Sequence
  Description of Artificial Sequence: Synthetic oligonucleotide
caguuucuacagaucccu

SEQ ID NO: 67479 - RNA, 18 nt, Artificial Sequence
  Description of Artificial Sequence: Synthetic oligonucleotide
aagaacaguuucuacaga

SEQ ID NO: 67480 - RNA, 18 nt, Artificial Sequence
  Description of Artificial Sequence: Synthetic oligonucleotide
cagaaaagaacaguuucu

SEQ ID NO: 67481 - RNA, 18 nt, Artificial Sequence
  Description of Artificial Sequence: Synthetic oligonucleotide
ugagucagaaaagaacag

SEQ ID NO: 67482 - RNA, 18 nt, Artificial Sequence
  Description of Artificial Sequence: Synthetic oligonucleotide
gggacugagucagaaaag

SEQ ID NO: 67483 - RNA, 18 nt, Artificial Sequence
  Description of Artificial Sequence: Synthetic oligonucleotide
cuucccucaggucuucua

SEQ ID NO: 67484 - RNA, 18 nt, Artificial Sequence
  Description of Artificial Sequence: Synthetic oligonucleotide
cccuucuucccucagguc

SEQ ID NO: 67485 - RNA, 18 nt, Artificial Sequence
  Description of Artificial Sequence: Synthetic oligonucleotide
aagagcccuucuucccuc

SEQ ID NO: 67486 - RNA, 18 nt, Artificial Sequence
  Description of Artificial Sequence: Synthetic oligonucleotide
ccuggaagagcccuucuu

SEQ ID NO: 67487 - RNA, 18 nt, Artificial Sequence
  Description of Artificial Sequence: Synthetic oligonucleotide
agcucccuggaagagccc

SEQ ID NO: 67488 - RNA, 18 nt, Artificial Sequence
  Description of Artificial Sequence: Synthetic oligonucleotide
ccuugagcucccuggaag

SEQ ID NO: 67489 - RNA, 18 nt, Artificial Sequence
  Description of Artificial Sequence: Synthetic oligonucleotide
ucugcccuugagcucccu

SEQ ID NO: 67490 - RNA, 18 nt, Artificial Sequence
  Description of Artificial Sequence: Synthetic oligonucleotide
gcucuucugcccuugagc

SEQ ID NO: 67491 - RNA, 18 nt, Artificial Sequence
  Description of Artificial Sequence: Synthetic oligonucleotide
gaucagcucuucugcccu

SEQ ID NO: 67492 - RNA, 18 nt, Artificial Sequence
  Description of Artificial Sequence: Synthetic oligonucleotide
uaguagaucagcucuucu

SEQ ID NO: 67493 - RNA, 18 nt, Artificial Sequence
  Description of Artificial Sequence: Synthetic oligonucleotide
acucuuaguagaucagcu

SEQ ID NO: 67494 - RNA, 18 nt, Artificial Sequence
  Description of Artificial Sequence: Synthetic oligonucleotide
ggagcacucuuaguagau

SEQ ID NO: 67495 - RNA, 18 nt, Artificial Sequence
  Description of Artificial Sequence: Synthetic oligonucleotide
ggcagggagcacucuuag

SEQ ID NO: 67496 - RNA, 18 nt, Artificial Sequence
  Description of Artificial Sequence: Synthetic oligonucleotide
uggcuggcagggagcacu

SEQ ID NO: 67497 - RNA, 18 nt, Artificial Sequence
  Description of Artificial Sequence: Synthetic oligonucleotide
cauuguggcuggcaggga

SEQ ID NO: 67498 - RNA, 18 nt, Artificial Sequence
  Description of Artificial Sequence: Synthetic oligonucleotide
ccaggcauuguggcuggc

SEQ ID NO: 67499 - RNA, 18 nt, Artificial Sequence
  Description of Artificial Sequence: Synthetic oligonucleotide
ucuucugcccuugagcuc

SEQ ID NO: 67500 - RNA, 18 nt, Artificial Sequence
  Description of Artificial Sequence: Synthetic oligonucleotide
ucagcucuucugcccuug

SEQ ID NO: 67501 - RNA, 18 nt, Artificial Sequence
  Description of Artificial Sequence: Synthetic oligonucleotide
guagaucagcucuucugc

SEQ ID NO: 67502 - RNA, 18 nt, Artificial Sequence
  Description of Artificial Sequence: Synthetic oligonucleotide
ucuuaguagaucagcucu

SEQ ID NO: 67503 - RNA, 18 nt, Artificial Sequence
  Description of Artificial Sequence: Synthetic oligonucleotide
agcacucuuaguagauca

SEQ ID NO: 67504 - RNA, 18 nt, Artificial Sequence
  Description of Artificial Sequence: Synthetic oligonucleotide
cagggagcacucuuagua

SEQ ID NO: 67505 - RNA, 18 nt, Artificial Sequence
  Description of Artificial Sequence: Synthetic oligonucleotide
gcuggcagggagcacucu

SEQ ID NO: 67506 - RNA, 18 nt, Artificial Sequence
  Description of Artificial Sequence: Synthetic oligonucleotide
uuguggcuggcagggagc

SEQ ID NO: 67507 - RNA, 18 nt, Artificial Sequence
  Description of Artificial Sequence: Synthetic oligonucleotide
aggcauuguggcuggcag

SEQ ID NO: 67508 - RNA, 18 nt, Artificial Sequence
  Description of Artificial Sequence: Synthetic oligonucleotide
uacccaggcauuguggcu

SEQ ID NO: 67509 - RNA, 18 nt, Artificial Sequence
  Description of Artificial Sequence: Synthetic oligonucleotide
gccaguacccaggcauug

SEQ ID NO: 67510 - RNA, 18 nt, Artificial Sequence
  Description of Artificial Sequence: Synthetic oligonucleotide
aggaugccaguacccagg

SEQ ID NO: 67511 - RNA, 18 nt, Artificial Sequence
  Description of Artificial Sequence: Synthetic oligonucleotide
aagacaggaugccaguac

SEQ ID NO: 67512 - RNA, 18 nt, Artificial Sequence
  Description of Artificial Sequence: Synthetic oligonucleotide
uaggaaagacaggaugcc

SEQ ID NO: 67513 - RNA, 18 nt, Artificial Sequence
  Description of Artificial Sequence: Synthetic oligonucleotide
cuaaguaggaaagacagg

SEQ ID NO: 67514 - RNA, 18 nt, Artificial Sequence
  Description of Artificial Sequence: Synthetic oligonucleotide
cuugucuaaguaggaaag

SEQ ID NO: 67515 - RNA, 18 nt, Artificial Sequence
  Description of Artificial Sequence: Synthetic oligonucleotide
ccucccuugucuaaguag

SEQ ID NO: 67516 - RNA, 18 nt, Artificial Sequence
  Description of Artificial Sequence: Synthetic oligonucleotide
ucaggccucccuugucua

SEQ ID NO: 67517 - RNA, 18 nt, Artificial Sequence
  Description of Artificial Sequence: Synthetic oligonucleotide
agaucucaggccucccuu

SEQ ID NO: 67518 - RNA, 18 nt, Artificial Sequence
  Description of Artificial Sequence: Synthetic oligonucleotide
gggccagaucucaggccu

SEQ ID NO: 67519 - RNA, 18 nt, Artificial Sequence
  Description of Artificial Sequence: Synthetic oligonucleotide
caccagggccagaucuca

SEQ ID NO: 67520 - RNA, 18 nt, Artificial Sequence
  Description of Artificial Sequence: Synthetic oligonucleotide
ccaaacaccagggccaga

SEQ ID NO: 67521 - RNA, 18 nt, Artificial Sequence
  Description of Artificial Sequence: Synthetic oligonucleotide
ugaggccaaacaccaggg

SEQ ID NO: 67522 - RNA, 18 nt, Artificial Sequence
  Description of Artificial Sequence: Synthetic oligonucleotide
gguccugaggccaaacac

SEQ ID NO: 67523 - RNA, 18 nt, Artificial Sequence
  Description of Artificial Sequence: Synthetic oligonucleotide
uccugcccuguggaggaa

SEQ ID NO: 67524 - RNA, 18 nt, Artificial Sequence
  Description of Artificial Sequence: Synthetic oligonucleotide
ugugguccugcccugugg

SEQ ID NO: 67525 - RNA, 18 nt, Artificial Sequence
  Description of Artificial Sequence: Synthetic oligonucleotide
ugagcugugguccugccc

SEQ ID NO: 67526 - RNA, 18 nt, Artificial Sequence
  Description of Artificial Sequence: Synthetic oligonucleotide
ccuugugagcuguggucc

SEQ ID NO: 67527 - RNA, 18 nt, Artificial Sequence
  Description of Artificial Sequence: Synthetic oligonucleotide
gggauccuugugagcugu

SEQ ID NO: 67528 - RNA, 18 nt, Artificial Sequence
  Description of Artificial Sequence: Synthetic oligonucleotide
gcauugggauccuuguga

SEQ ID NO: 67529 - RNA, 18 nt, Artificial Sequence
  Description of Artificial Sequence: Synthetic oligonucleotide
agauggcauugggauccu

SEQ ID NO: 67530 - RNA, 18 nt, Artificial Sequence
  Description of Artificial Sequence: Synthetic oligonucleotide
caggaagauggcauuggg

SEQ ID NO: 67531 - RNA, 18 nt, Artificial Sequence
  Description of Artificial Sequence: Synthetic oligonucleotide
aagcucaggaagauggca

SEQ ID NO: 67532 - RNA, 18 nt, Artificial Sequence
  Description of Artificial Sequence: Synthetic oligonucleotide
guuggaagcucaggaaga

SEQ ID NO: 67533 - RNA, 18 nt, Artificial Sequence
  Description of Artificial Sequence: Synthetic oligonucleotide
cagguguuggaagcucag

SEQ ID NO: 67534 - RNA, 18 nt, Artificial Sequence
  Description of Artificial Sequence: Synthetic oligonucleotide
cggagcagguguuggaag

SEQ ID NO: 67535 - RNA, 18 nt, Artificial Sequence
  Description of Artificial Sequence: Synthetic oligonucleotide
uuccucggagcagguguu

SEQ ID NO: 67536 - RNA, 18 nt, Artificial Sequence
  Description of Artificial Sequence: Synthetic oligonucleotide
caccuuuccucggagcag

SEQ ID NO: 67537 - RNA, 18 nt, Artificial Sequence
  Description of Artificial Sequence: Synthetic oligonucleotide
aaacgcaccuuuccucgg

SEQ ID NO: 67538 - RNA, 18 nt, Artificial Sequence
  Description of Artificial Sequence: Synthetic oligonucleotide
ucaggaaacgcaccuuuc

SEQ ID NO: 67539 - RNA, 18 nt, Artificial Sequence
  Description of Artificial Sequence: Synthetic oligonucleotide
aagcaucaggaaacgcac

SEQ ID NO: 67540 - RNA, 18 nt, Artificial Sequence
  Description of Artificial Sequence: Synthetic oligonucleotide
ccuacaagcaucaggaaa

SEQ ID NO: 67541 - RNA, 18 nt, Artificial Sequence
  Description of Artificial Sequence: Synthetic oligonucleotide
acccuccuacaagcauca

SEQ ID NO: 67542 - RNA, 18 nt, Artificial Sequence
  Description of Artificial Sequence: Synthetic oligonucleotide
gguggacccuccuacaag

SEQ ID NO: 67543 - RNA, 18 nt, Artificial Sequence
  Description of Artificial Sequence: Synthetic oligonucleotide
cagaggguggacccuccu

SEQ ID NO: 67544 - RNA, 18 nt, Artificial Sequence
  Description of Artificial Sequence: Synthetic oligonucleotide
ugacgcagaggguggacc

SEQ ID NO: 67545 - RNA, 18 nt, Artificial Sequence
  Description of Artificial Sequence: Synthetic oligonucleotide
ccgccugacgcagagggu

SEQ ID NO: 67546 - RNA, 18 nt, Artificial Sequence
  Description of Artificial Sequence: Synthetic oligonucleotide
gggcccgccugacgcaga

SEQ ID NO: 67547 - RNA, 18 nt, Artificial Sequence
  Description of Artificial Sequence: Synthetic oligonucleotide
acagcugugguggguggg

SEQ ID NO: 67548 - RNA, 18 nt, Artificial Sequence
  Description of Artificial Sequence: Synthetic oligonucleotide
gggacagcuguggugggu

SEQ ID NO: 67549 - RNA, 18 nt, Artificial Sequence
  Description of Artificial Sequence: Synthetic oligonucleotide
uagagagguucugcuggg

SEQ ID NO: 67550 - RNA, 18 nt, Artificial Sequence
  Description of Artificial Sequence: Synthetic oligonucleotide
aggacuagagagguucug

SEQ ID NO: 67551 - RNA, 18 nt, Artificial Sequence
  Description of Artificial Sequence: Synthetic oligonucleotide
gugugaggacuagagagg

SEQ ID NO: 67552 - RNA, 18 nt, Artificial Sequence
  Description of Artificial Sequence: Synthetic oligonucleotide
guucagugugaggacuag

SEQ ID NO: 67553 - RNA, 18 nt, Artificial Sequence
  Description of Artificial Sequence: Synthetic oligonucleotide
agcucguucagugugagg

SEQ ID NO: 67554 - RNA, 18 nt, Artificial Sequence
  Description of Artificial Sequence: Synthetic oligonucleotide
uugggagcucguucagug

SEQ ID NO: 67555 - RNA, 18 nt, Artificial Sequence
  Description of Artificial Sequence: Synthetic oligonucleotide
ccuguuugggagcucguu

SEQ ID NO: 67556 - RNA, 18 nt, Artificial Sequence
  Description of Artificial Sequence: Synthetic oligonucleotide
gaaguccuguuugggagc

SEQ ID NO: 67557 - RNA, 18 nt, Artificial Sequence
  Description of Artificial Sequence: Synthetic oligonucleotide
auccagaaguccuguuug

SEQ ID NO: 67558 - RNA, 18 nt, Artificial Sequence
  Description of Artificial Sequence: Synthetic oligonucleotide
caacaauccagaaguccu

SEQ ID NO: 67559 - RNA, 18 nt, Artificial Sequence
  Description of Artificial Sequence: Synthetic oligonucleotide
gucuccaacaauccagaa

SEQ ID NO: 67560 - RNA, 18 nt, Artificial Sequence
  Description of Artificial Sequence: Synthetic oligonucleotide
aguuugucuccaacaauc

SEQ ID NO: 67561 - RNA, 18 nt, Artificial Sequence
  Description of Artificial Sequence: Synthetic oligonucleotide
agugaaguuugucuccaa

SEQ ID NO: 67562 - RNA, 18 nt, Artificial Sequence
  Description of Artificial Sequence: Synthetic oligonucleotide
gaggcagugaaguuuguc

SEQ ID NO: 67563 - RNA, 18 nt, Artificial Sequence
  Description of Artificial Sequence: Synthetic oligonucleotide
uggcugaggcagugaagu

SEQ ID NO: 67564 - RNA, 18 nt, Artificial Sequence
  Description of Artificial Sequence: Synthetic oligonucleotide
aguucuggcugaggcagu

SEQ ID NO: 67565 - RNA, 18 nt, Artificial Sequence
  Description of Artificial Sequence: Synthetic oligonucleotide
ccaguaguucuggcugag

SEQ ID NO: 67566 - RNA, 18 nt, Artificial Sequence
  Description of Artificial Sequence: Synthetic oligonucleotide
cagagccaguaguucugg

SEQ ID NO: 67567 - RNA, 18 nt, Artificial Sequence
  Description of Artificial Sequence: Synthetic oligonucleotide
aagcccagagccaguagu

SEQ ID NO: 67568 - RNA, 18 nt, Artificial Sequence
  Description of Artificial Sequence: Synthetic oligonucleotide
uucagaagcccagagcca

SEQ ID NO: 67569 - RNA, 18 nt, Artificial Sequence
  Description of Artificial Sequence: Synthetic oligonucleotide
gccacuucagaagcccag

SEQ ID NO: 67570 - RNA, 18 nt, Artificial Sequence
  Description of Artificial Sequence: Synthetic oligonucleotide
cugcugccacuucagaag

SEQ ID NO: 67571 - RNA, 18 nt, Artificial Sequence
  Description of Artificial Sequence: Synthetic oligonucleotide
aaucccugcugccacuuc

SEQ ID NO: 67572 - RNA, 18 nt, Artificial Sequence
  Description of Artificial Sequence: Synthetic oligonucleotide
cucugaaucccugcugcc

SEQ ID NO: 67573 - RNA, 18 nt, Artificial Sequence
  Description of Artificial Sequence: Synthetic oligonucleotide
cuuggcucugaaucccug

SEQ ID NO: 67574 - RNA, 18 nt, Artificial Sequence
  Description of Artificial Sequence: Synthetic oligonucleotide
ggaaucuuggcucugaau

SEQ ID NO: 67575 - RNA, 18 nt, Artificial Sequence
  Description of Artificial Sequence: Synthetic oligonucleotide
gaccaggaaucuuggcuc

SEQ ID NO: 67576 - RNA, 18 nt, Artificial Sequence
  Description of Artificial Sequence: Synthetic oligonucleotide
cagcagaccaggaaucuu

SEQ ID NO: 67577 - RNA, 18 nt, Artificial Sequence
  Description of Artificial Sequence: Synthetic oligonucleotide
ugguucagcagaccagga

SEQ ID NO: 67578 - RNA, 18 nt, Artificial Sequence
  Description of Artificial Sequence: Synthetic oligonucleotide
agguuugguucagcagac

SEQ ID NO: 67579 - RNA, 18 nt, Artificial Sequence
  Description of Artificial Sequence: Synthetic oligonucleotide
ccuggagguuugguucag

SEQ ID NO: 67580 - RNA, 18 nt, Artificial Sequence
  Description of Artificial Sequence: Synthetic oligonucleotide
agggaccuggagguuugg

SEQ ID NO: 67581 - RNA, 18 nt, Artificial Sequence
  Description of Artificial Sequence: Synthetic oligonucleotide
gguccagggaccuggagg

SEQ ID NO: 67582 - RNA, 18 nt, Artificial Sequence
  Description of Artificial Sequence: Synthetic oligonucleotide
gauuugguccagggaccu

SEQ ID NO: 67583 - RNA, 18 nt, Artificial Sequence
  Description of Artificial Sequence: Synthetic oligonucleotide
gggauuugguccagggac

SEQ ID NO: 67584 - RNA, 18 nt, Artificial Sequence
  Description of Artificial Sequence: Synthetic oligonucleotide
ccuguucagguauccggg

SEQ ID NO: 67585 - RNA, 18 nt, Artificial Sequence
  Description of Artificial Sequence: Synthetic oligonucleotide
uguauccuguucagguau

SEQ ID NO: 67586 - RNA, 18 nt, Artificial Sequence
  Description of Artificial Sequence: Synthetic oligonucleotide
guucguguauccuguuca

SEQ ID NO: 67587 - RNA, 18 nt, Artificial Sequence
  Description of Artificial Sequence: Synthetic oligonucleotide
caagaguucguguauccu

SEQ ID NO: 67588 - RNA, 18 nt, Artificial Sequence
  Description of Artificial Sequence: Synthetic oligonucleotide
ccauucaagaguucgugu

SEQ ID NO: 67589 - RNA, 18 nt, Artificial Sequence
  Description of Artificial Sequence: Synthetic oligonucleotide
gaguuccauucaagaguu

SEQ ID NO: 67590 - RNA, 18 nt, Artificial Sequence
  Description of Artificial Sequence: Synthetic oligonucleotide
uccacgaguuccauucaa

SEQ ID NO: 67591 - RNA, 18 nt, Artificial Sequence
  Description of Artificial Sequence: Synthetic oligonucleotide
aagaguccacgaguucca

SEQ ID NO: 67592 - RNA, 18 nt, Artificial Sequence
  Description of Artificial Sequence: Synthetic oligonucleotide
caggaaagaguccacgag

SEQ ID NO: 67593 - RNA, 18 nt, Artificial Sequence
  Description of Artificial Sequence: Synthetic oligonucleotide
ggguccaggaaagagucc

SEQ ID NO: 67594 - RNA, 18 nt, Artificial Sequence
  Description of Artificial Sequence: Synthetic oligonucleotide
cgugaggguccaggaaag

SEQ ID NO: 67595 - RNA, 18 nt, Artificial Sequence
  Description of Artificial Sequence: Synthetic oligonucleotide
uccugcgugaggguccag

SEQ ID NO: 67596 - RNA, 18 nt, Artificial Sequence
  Description of Artificial Sequence: Synthetic oligonucleotide
uaggguccugcgugaggg

SEQ ID NO: 67597 - RNA, 18 nt, Artificial Sequence
  Description of Artificial Sequence: Synthetic oligonucleotide
gcuccuaggguccugcgu

SEQ ID NO: 67598 - RNA, 18 nt, Artificial Sequence
  Description of Artificial Sequence: Synthetic oligonucleotide
gggcuccuaggguccugc

SEQ ID NO: 67599 - RNA, 18 nt, Artificial Sequence
  Description of Artificial Sequence: Synthetic oligonucleotide
ccugaggaaauguccggg

SEQ ID NO: 67600 - RNA, 18 nt, Artificial Sequence
  Description of Artificial Sequence: Synthetic oligonucleotide
auguuccugaggaaaugu

SEQ ID NO: 67601 - RNA, 18 nt, Artificial Sequence
  Description of Artificial Sequence: Synthetic oligonucleotide
gucugauguuccugagga

SEQ ID NO: 67602 - RNA, 18 nt, Artificial Sequence
  Description of Artificial Sequence: Synthetic oligonucleotide
ccugugucugauguuccu

SEQ ID NO: 67603 - RNA, 18 nt, Artificial Sequence
  Description of Artificial Sequence: Synthetic oligonucleotide
gggagccugugucugaug

SEQ ID NO: 67604 - RNA, 18 nt, Artificial Sequence
  Description of Artificial Sequence: Synthetic oligonucleotide
uggcagggagccuguguc

SEQ ID NO: 67605 - RNA, 18 nt, Artificial Sequence
  Description of Artificial Sequence: Synthetic oligonucleotide
uuggguggcagggagccu

SEQ ID NO: 67606 - RNA, 18 nt, Artificial Sequence
  Description of Artificial Sequence: Synthetic oligonucleotide
ggagguuggguggcaggg

SEQ ID NO: 67607 - RNA, 18 nt, Artificial Sequence
  Description of Artificial Sequence: Synthetic oligonucleotide
aggcuggagguugggugg

SEQ ID NO: 67608 - RNA, 18 nt, Artificial Sequence
  Description of Artificial Sequence: Synthetic oligonucleotide
uauccaggcuggagguug

SEQ ID NO: 67609 - RNA, 18 nt, Artificial Sequence
  Description of Artificial Sequence: Synthetic oligonucleotide
gagaauauccaggcugga

SEQ ID NO: 67610 - RNA, 18 nt, Artificial Sequence
  Description of Artificial Sequence: Synthetic oligonucleotide
ggaaggagaauauccagg

SEQ ID NO: 67611 - RNA, 18 nt, Artificial Sequence
  Description of Artificial Sequence: Synthetic oligonucleotide
gggaaggagaauauccag

SEQ ID NO: 67612 - RNA, 18 nt, Artificial Sequence
  Description of Artificial Sequence: Synthetic oligonucleotide
guaggaggauggguuggg

SEQ ID NO: 67613 - RNA, 18 nt, Artificial Sequence
  Description of Artificial Sequence: Synthetic oligonucleotide
guccaguaggaggauggg

SEQ ID NO: 67614 - RNA, 18 nt, Artificial Sequence
  Description of Artificial Sequence: Synthetic oligonucleotide
auacuguccaguaggagg

SEQ ID NO: 67615 - RNA, 18 nt, Artificial Sequence
  Description of Artificial Sequence: Synthetic oligonucleotide
agcguauacuguccagua

SEQ ID NO: 67616 - RNA, 18 nt, Artificial Sequence
  Description of Artificial Sequence: Synthetic oligonucleotide
ggaagagcguauacuguc

SEQ ID NO: 67617 - RNA, 18 nt, Artificial Sequence
  Description of Artificial Sequence: Synthetic oligonucleotide
aagagggaagagcguaua

SEQ ID NO: 67618 - RNA, 18 nt, Artificial Sequence
  Description of Artificial Sequence: Synthetic oligonucleotide
gguggaagagggaagagc

SEQ ID NO: 67619 - RNA, 18 nt, Artificial Sequence
  Description of Artificial Sequence: Synthetic oligonucleotide
agguggguggaagaggga

SEQ ID NO: 67620 - RNA, 18 nt, Artificial Sequence
  Description of Artificial Sequence: Synthetic oligonucleotide
gggcaagguggguggaag

SEQ ID NO: 67621 - RNA, 18 nt, Artificial Sequence
  Description of Artificial Sequence: Synthetic oligonucleotide
gggugggcaaggugggug

SEQ ID NO: 67622 - RNA, 18 nt, Artificial Sequence
  Description of Artificial Sequence: Synthetic oligonucleotide
uggagcuggaccacaggg

SEQ ID NO: 67623 - RNA, 18 nt, Artificial Sequence
  Description of Artificial Sequence: Synthetic oligonucleotide
ggguggagcuggaccaca

SEQ ID NO: 67624 - RNA, 18 nt, Artificial Sequence
  Description of Artificial Sequence: Synthetic oligonucleotide
aagggucaggaagcaggg

SEQ ID NO: 67625 - RNA, 18 nt, Artificial Sequence
  Description of Artificial Sequence: Synthetic oligonucleotide
agcagaagggucaggaag

SEQ ID NO: 67626 - RNA, 18 nt, Artificial Sequence
  Description of Artificial Sequence: Synthetic oligonucleotide
guuggagcagaaggguca

SEQ ID NO: 67627 - RNA, 18 nt, Artificial Sequence
  Description of Artificial Sequence: Synthetic oligonucleotide
ugggcguuggagcagaag

SEQ ID NO: 67628 - RNA, 18 nt, Artificial Sequence
  Description of Artificial Sequence: Synthetic oligonucleotide
gggugggcguuggagcag

SEQ ID NO: 67629 - RNA, 18 nt, Artificial Sequence
  Description of Artificial Sequence: Synthetic oligonucleotide
agaagagggcugguaggg

SEQ ID NO: 67630 - RNA, 18 nt, Artificial Sequence
  Description of Artificial Sequence: Synthetic oligonucleotide
uguuuagaagagggcugg

SEQ ID NO: 67631 - RNA, 18 nt, Artificial Sequence
  Description of Artificial Sequence: Synthetic oligonucleotide
ggauguguuuagaagagg

SEQ ID NO: 67632 - RNA, 18 nt, Artificial Sequence
  Description of Artificial Sequence: Synthetic oligonucleotide
guguaggauguguuuaga

SEQ ID NO: 67633 - RNA, 18 nt, Artificial Sequence
  Description of Artificial Sequence: Synthetic oligonucleotide
aguggguguaggaugugu

SEQ ID NO: 67634 - RNA, 18 nt, Artificial Sequence
  Description of Artificial Sequence: Synthetic oligonucleotide
cugggaguggguguagga

SEQ ID NO: 67635 - RNA, 18 nt, Artificial Sequence
  Description of Artificial Sequence: Synthetic oligonucleotide
agauucugggagugggug

SEQ ID NO: 67636 - RNA, 18 nt, Artificial Sequence
  Description of Artificial Sequence: Synthetic oligonucleotide
gagacagauucugggagu

SEQ ID NO: 67637 - RNA, 18 nt, Artificial Sequence
  Description of Artificial Sequence: Synthetic oligonucleotide
uuccugagacagauucug

SEQ ID NO: 67638 - RNA, 18 nt, Artificial Sequence
  Description of Artificial Sequence: Synthetic oligonucleotide
uacccuuccugagacaga

SEQ ID NO: 67639 - RNA, 18 nt, Artificial Sequence
  Description of Artificial Sequence: Synthetic oligonucleotide
aaccuuacccuuccugag

SEQ ID NO: 67640 - RNA, 18 nt, Artificial Sequence
  Description of Artificial Sequence: Synthetic oligonucleotide
cugagaaccuuacccuuc

SEQ ID NO: 67641 - RNA, 18 nt, Artificial Sequence
  Description of Artificial Sequence: Synthetic oligonucleotide
agugucugagaaccuuac

SEQ ID NO: 67642 - RNA, 18 nt, Artificial Sequence
  Description of Artificial Sequence: Synthetic oligonucleotide
ucggcagugucugagaac

SEQ ID NO: 67643 - RNA, 18 nt, Artificial Sequence
  Description of Artificial Sequence: Synthetic oligonucleotide
ugaugucggcagugucug

SEQ ID NO: 67644 - RNA, 18 nt, Artificial Sequence
  Description of Artificial Sequence: Synthetic oligonucleotide
aaugcugaugucggcagu

SEQ ID NO: 67645 - RNA, 18 nt, Artificial Sequence
  Description of Artificial Sequence: Synthetic oligonucleotide
gagacaaugcugaugucg

SEQ ID NO: 67646 - RNA, 18 nt, Artificial Sequence
  Description of Artificial Sequence: Synthetic oligonucleotide
uacacgagacaaugcuga

SEQ ID NO: 67647 - RNA, 18 nt, Artificial Sequence
  Description of Artificial Sequence: Synthetic oligonucleotide
agcuguacacgagacaau

SEQ ID NO: 67648 - RNA, 18 nt, Artificial Sequence
  Description of Artificial Sequence: Synthetic oligonucleotide
aagggagcuguacacgag

SEQ ID NO: 67649 - RNA, 18 nt, Artificial Sequence
  Description of Artificial Sequence: Synthetic oligonucleotide
cagggaagggagcuguac

SEQ ID NO: 67650 - RNA, 18 nt, Artificial Sequence
  Description of Artificial Sequence: Synthetic oligonucleotide
cccugcagggaagggagc

SEQ ID NO: 67651 - RNA, 18 nt, Artificial Sequence
  Description of Artificial Sequence: Synthetic oligonucleotide
gggcgcccugcagggaag

SEQ ID NO: 67652 - RNA, 18 nt, Artificial Sequence
  Description of Artificial Sequence: Synthetic oligonucleotide
cuuguccaguugucuccc

SEQ ID NO: 67653 - RNA, 18 nt, Artificial Sequence
  Description of Artificial Sequence: Synthetic oligonucleotide
gaaaucuuguccaguugu

SEQ ID NO: 67654 - RNA, 18 nt, Artificial Sequence
  Description of Artificial Sequence: Synthetic oligonucleotide
aguaggaaaucuugucca

SEQ ID NO: 67655 - RNA, 18 nt, Artificial Sequence
  Description of Artificial Sequence: Synthetic oligonucleotide
gagaaaguaggaaaucuu

SEQ ID NO: 67656 - RNA, 18 nt, Artificial Sequence
  Description of Artificial Sequence: Synthetic oligonucleotide
uucaggagaaaguaggaa

SEQ ID NO: 67657 - RNA, 18 nt, Artificial Sequence
  Description of Artificial Sequence: Synthetic oligonucleotide
uggguuucaggagaaagu

SEQ ID NO: 67658 - RNA, 18 nt, Artificial Sequence
  Description of Artificial Sequence: Synthetic oligonucleotide
ggcuuuggguuucaggag

SEQ ID NO: 67659 - RNA, 18 nt, Artificial Sequence
  Description of Artificial Sequence: Synthetic oligonucleotide
accagggcuuuggguuuc

SEQ ID NO: 67660 - RNA, 18 nt, Artificial Sequence
  Description of Artificial Sequence: Synthetic oligonucleotide
cuuuuaccagggcuuugg

SEQ ID NO: 67661 - RNA, 18 nt, Artificial Sequence
  Description of Artificial Sequence: Synthetic oligonucleotide
uaucccuuuuaccagggc

SEQ ID NO: 67662 - RNA, 18 nt, Artificial Sequence
  Description of Artificial Sequence: Synthetic oligonucleotide
cuguguaucccuuuuacc

SEQ ID NO: 67663 - RNA, 18 nt, Artificial Sequence
  Description of Artificial Sequence: Synthetic oligonucleotide
caguccuguguaucccuu

SEQ ID NO: 67664 - RNA, 18 nt, Artificial Sequence
  Description of Artificial Sequence: Synthetic oligonucleotide
cuuuucaguccuguguau

SEQ ID NO: 67665 - RNA, 18 nt, Artificial Sequence
  Description of Artificial Sequence: Synthetic oligonucleotide
auucccuuuucaguccug

SEQ ID NO: 67666 - RNA, 18 nt, Artificial Sequence
  Description of Artificial Sequence: Synthetic oligonucleotide
aaaugauucccuuuucag

SEQ ID NO: 67667 - RNA, 18 nt, Artificial Sequence
  Description of Artificial Sequence: Synthetic oligonucleotide
gugaaaaaugauucccuu

SEQ ID NO: 67668 - RNA, 18 nt, Artificial Sequence
  Description of Artificial Sequence: Synthetic oligonucleotide
guacagugaaaaaugauu

SEQ ID NO: 67669 - RNA, 18 nt, Artificial Sequence
  Description of Artificial Sequence: Synthetic oligonucleotide
auaauguacagugaaaaa

SEQ ID NO: 67670 - RNA, 18 nt, Artificial Sequence
  Description of Artificial Sequence: Synthetic oligonucleotide
gguuuauaauguacagug

SEQ ID NO: 67671 - RNA, 18 nt, Artificial Sequence
  Description of Artificial Sequence: Synthetic oligonucleotide
cugaagguuuauaaugua

SEQ ID NO: 67672 - RNA, 18 nt, Artificial Sequence
  Description of Artificial Sequence: Synthetic oligonucleotide
agcuucugaagguuuaua

SEQ ID NO: 67673 - RNA, 18 nt, Artificial Sequence
  Description of Artificial Sequence: Synthetic oligonucleotide
aaaauagcuucugaaggu

SEQ ID NO: 67674 - RNA, 18 nt, Artificial Sequence
  Description of Artificial Sequence: Synthetic oligonucleotide
uuaaaaaaauagcuucug

SEQ ID NO: 67675 - RNA, 18 nt, Artificial Sequence
  Description of Artificial Sequence: Synthetic oligonucleotide
auagcuuaaaaaaauagc

SEQ ID NO: 67676 - RNA, 18 nt, Artificial Sequence
  Description of Artificial Sequence: Synthetic oligonucleotide
ugcugauagcuuaaaaaa

SEQ ID NO: 67677 - RNA, 18 nt, Artificial Sequence
  Description of Artificial Sequence: Synthetic oligonucleotide
aguauugcugauagcuua

SEQ ID NO: 67678 - RNA, 18 nt, Artificial Sequence
  Description of Artificial Sequence: Synthetic oligonucleotide
ugaugaguauugcugaua

SEQ ID NO: 67679 - RNA, 18 nt, Artificial Sequence
  Description of Artificial Sequence: Synthetic oligonucleotide
ugcucugaugaguauugc

SEQ ID NO: 67680 - RNA, 18 nt, Artificial Sequence
  Description of Artificial Sequence: Synthetic oligonucleotide
cuagcugcucugaugagu

SEQ ID NO: 67681 - RNA, 18 nt, Artificial Sequence
  Description of Artificial Sequence: Synthetic oligonucleotide
aagagcuagcugcucuga

SEQ ID NO: 67682 - RNA, 18 nt, Artificial Sequence
  Description of Artificial Sequence: Synthetic oligonucleotide
gaccaaagagcuagcugc

SEQ ID NO: 67683 - RNA, 18 nt, Artificial Sequence
  Description of Artificial Sequence: Synthetic oligonucleotide
aaauagaccaaagagcua

SEQ ID NO: 67684 - RNA, 18 nt, Artificial Sequence
  Description of Artificial Sequence: Synthetic oligonucleotide
gcagaaaauagaccaaag

SEQ ID NO: 67685 - RNA, 18 nt, Artificial Sequence
  Description of Artificial Sequence: Synthetic oligonucleotide
uuucugcagaaaauagac

SEQ ID NO: 67686 - RNA, 18 nt, Artificial Sequence
  Description of Artificial Sequence: Synthetic oligonucleotide
gcaaauuucugcagaaaa

SEQ ID NO: 67687 - RNA, 18 nt, Artificial Sequence
  Description of Artificial Sequence: Synthetic oligonucleotide
gaguugcaaauuucugca

SEQ ID NO: 67688 - RNA, 18 nt, Artificial Sequence
  Description of Artificial Sequence: Synthetic oligonucleotide
ucagugaguugcaaauuu

SEQ ID NO: 67689 - RNA, 18 nt, Artificial Sequence
  Description of Artificial Sequence: Synthetic oligonucleotide
gagaaucagugaguugca

SEQ ID NO: 67690 - RNA, 18 nt, Artificial Sequence
  Description of Artificial Sequence: Synthetic oligonucleotide
auguagagaaucagugag

SEQ ID NO: 67691 - RNA, 18 nt, Artificial Sequence
  Description of Artificial Sequence: Synthetic oligonucleotide
agagcauguagagaauca

SEQ ID NO: 67692 - RNA, 18 nt, Artificial Sequence
  Description of Artificial Sequence: Synthetic oligonucleotide
gaaaaagagcauguagag

SEQ ID NO: 67693 - RNA, 18 nt, Artificial Sequence
  Description of Artificial Sequence: Synthetic oligonucleotide
ucacagaaaaagagcaug

SEQ ID NO: 67694 - RNA, 18 nt, Artificial Sequence
  Description of Artificial Sequence: Synthetic oligonucleotide
aguuaucacagaaaaaga

SEQ ID NO: 67695 - RNA, 18 nt, Artificial Sequence
  Description of Artificial Sequence: Synthetic oligonucleotide
ugcagaguuaucacagaa

SEQ ID NO: 67696 - RNA, 18 nt, Artificial Sequence
  Description of Artificial Sequence: Synthetic oligonucleotide
gccuuugcagaguuauca

SEQ ID NO: 67697 - RNA, 18 nt, Artificial Sequence
  Description of Artificial Sequence: Synthetic oligonucleotide
cccaggccuuugcagagu

SEQ ID NO: 67698 - RNA, 18 nt, Artificial Sequence
  Description of Artificial Sequence: Synthetic oligonucleotide
gccagcccaggccuuugc

SEQ ID NO: 67699 - RNA, 18 nt, Artificial Sequence
  Description of Artificial Sequence: Synthetic oligonucleotide
gccaggccagcccaggcc

SEQ ID NO: 67700 - RNA, 18 nt, Artificial Sequence
  Description of Artificial Sequence: Synthetic oligonucleotide
caacugccaggccagccc

SEQ ID NO: 67701 - RNA, 18 nt, Artificial Sequence
  Description of Artificial Sequence: Synthetic oligonucleotide
cuguucaacugccaggcc

SEQ ID NO: 67702 - RNA, 18 nt, Artificial Sequence
  Description of Artificial Sequence: Synthetic oligonucleotide
ucccucuguucaacugcc

SEQ ID NO: 67703 - RNA, 18 nt, Artificial Sequence
  Description of Artificial Sequence: Synthetic oligonucleotide
gucucucccucuguucaa

SEQ ID NO: 67704 - RNA, 18 nt, Artificial Sequence
  Description of Artificial Sequence: Synthetic oligonucleotide
gguuagucucucccucug

SEQ ID NO: 67705 - RNA, 18 nt, Artificial Sequence
  Description of Artificial Sequence: Synthetic oligonucleotide
cucaagguuagucucucc

SEQ ID NO: 67706 - RNA, 18 nt, Artificial Sequence
  Description of Artificial Sequence: Synthetic oligonucleotide
ucugacucaagguuaguc

SEQ ID NO: 67707 - RNA, 18 nt, Artificial Sequence
  Description of Artificial Sequence: Synthetic oligonucleotide
uguuuucugacucaaggu

SEQ ID NO: 67708 - RNA, 18 nt, Artificial Sequence
  Description of Artificial Sequence: Synthetic oligonucleotide
uucucuguuuucugacuc

SEQ ID NO: 67709 - RNA, 18 nt, Artificial Sequence
  Description of Artificial Sequence: Synthetic oligonucleotide
acccuuucucuguuuucu

SEQ ID NO: 67710 - RNA, 18 nt, Artificial Sequence
  Description of Artificial Sequence: Synthetic oligonucleotide
aaauuacccuuucucugu

SEQ ID NO: 67711 - RNA, 18 nt, Artificial Sequence
  Description of Artificial Sequence: Synthetic oligonucleotide
aaaggaaauuacccuuuc

SEQ ID NO: 67712 - RNA, 18 nt, Artificial Sequence
  Description of Artificial Sequence: Synthetic oligonucleotide
gaagcaaaggaaauuacc

SEQ ID NO: 67713 - RNA, 18 nt, Artificial Sequence
  Description of Artificial Sequence: Synthetic oligonucleotide
aauuugaagcaaaggaaa

SEQ ID NO: 67714 - RNA, 18 nt, Artificial Sequence
  Description of Artificial Sequence: Synthetic oligonucleotide
ccuugaauuugaagcaaa

SEQ ID NO: 67715 - RNA, 18 nt, Artificial Sequence
  Description of Artificial Sequence: Synthetic oligonucleotide
gaaggccuugaauuugaa

SEQ ID NO: 67716 - RNA, 18 nt, Artificial Sequence
  Description of Artificial Sequence: Synthetic oligonucleotide
cguuggaaggccuugaau

SEQ ID NO: 67717 - RNA, 18 nt, Artificial Sequence
  Description of Artificial Sequence: Synthetic oligonucleotide
gggcguuggaaggccuug

SEQ ID NO: 67718 - RNA, 18 nt, Artificial Sequence
  Description of Artificial Sequence: Synthetic oligonucleotide
gagaaugauaguaaaggg

SEQ ID NO: 67719 - RNA, 18 nt, Artificial Sequence
  Description of Artificial Sequence: Synthetic oligonucleotide
ccacugagaaugauagua

SEQ ID NO: 67720 - RNA, 18 nt, Artificial Sequence
  Description of Artificial Sequence: Synthetic oligonucleotide
gagucccacugagaauga

SEQ ID NO: 67721 - RNA, 18 nt, Artificial Sequence
  Description of Artificial Sequence: Synthetic oligonucleotide
gaucagagucccacugag

SEQ ID NO: 67722 - RNA, 18 nt, Artificial Sequence
  Description of Artificial Sequence: Synthetic oligonucleotide
uaugggaucagaguccca

SEQ ID NO: 67723 - RNA, 18 nt, Artificial Sequence
  Description of Artificial Sequence: Synthetic oligonucleotide
aagaauaugggaucagag

SEQ ID NO: 67724 - RNA, 18 nt, Artificial Sequence
  Description of Artificial Sequence: Synthetic oligonucleotide
cuguuaagaauaugggau

SEQ ID NO: 67725 - RNA, 18 nt, Artificial Sequence
  Description of Artificial Sequence: Synthetic oligonucleotide
aagaucuguuaagaauau

SEQ ID NO: 67726 - RNA, 18 nt, Artificial Sequence
  Description of Artificial Sequence: Synthetic oligonucleotide
gaguaaagaucuguuaag

SEQ ID NO: 67727 - RNA, 18 nt, Artificial Sequence
  Description of Artificial Sequence: Synthetic oligonucleotide
cucaagaguaaagaucug

SEQ ID NO: 67728 - RNA, 18 nt, Artificial Sequence
  Description of Artificial Sequence: Synthetic oligonucleotide
cauuucucaagaguaaag

SEQ ID NO: 67729 - RNA, 18 nt, Artificial Sequence
  Description of Artificial Sequence: Synthetic oligonucleotide
uuauucauuucucaagag

SEQ ID NO: 67730 - RNA, 18 nt, Artificial Sequence
  Description of Artificial Sequence: Synthetic oligonucleotide
aaagcuuauucauuucuc

SEQ ID NO: 67731 - RNA, 18 nt, Artificial Sequence
  Description of Artificial Sequence: Synthetic oligonucleotide
gagagaaagcuuauucau

SEQ ID NO: 67732 - RNA, 18 nt, Artificial Sequence
  Description of Artificial Sequence: Synthetic oligonucleotide
uuucugagagaaagcuua

SEQ ID NO: 67733 - RNA, 18 nt, Artificial Sequence
  Description of Artificial Sequence: Synthetic oligonucleotide
cagcauuucugagagaaa

SEQ ID NO: 67734 - RNA, 18 nt, Artificial Sequence
  Description of Artificial Sequence: Synthetic oligonucleotide
agggacagcauuucugag

SEQ ID NO: 67735 - RNA, 18 nt, Artificial Sequence
  Description of Artificial Sequence: Synthetic oligonucleotide
uguauagggacagcauuu

SEQ ID NO: 67736 - RNA, 18 nt, Artificial Sequence
  Description of Artificial Sequence: Synthetic oligonucleotide
ucuaguguauagggacag

SEQ ID NO: 67737 - RNA, 18 nt, Artificial Sequence
  Description of Artificial Sequence: Synthetic oligonucleotide
uuuugucuaguguauagg

SEQ ID NO: 67738 - RNA, 18 nt, Artificial Sequence
  Description of Artificial Sequence: Synthetic oligonucleotide
cucaguuuugucuagugu

SEQ ID NO: 67739 - RNA, 18 nt, Artificial Sequence
  Description of Artificial Sequence: Synthetic oligonucleotide
acaggcucaguuuugucu

SEQ ID NO: 67740 - RNA, 18 nt, Artificial Sequence
  Description of Artificial Sequence: Synthetic oligonucleotide
cuuauacaggcucaguuu

SEQ ID NO: 67741 - RNA, 18 nt, Artificial Sequence
  Description of Artificial Sequence: Synthetic oligonucleotide
uauuccuuauacaggcuc

SEQ ID NO: 67742 - RNA, 18 nt, Artificial Sequence
  Description of Artificial Sequence: Synthetic oligonucleotide
ccauuuauuccuuauaca

SEQ ID NO: 67743 - RNA, 18 nt, Artificial Sequence
  Description of Artificial Sequence: Synthetic oligonucleotide
cgcucccauuuauuccuu

SEQ ID NO: 67744 - RNA, 18 nt, Artificial Sequence
  Description of Artificial Sequence: Synthetic oligonucleotide
uucggcgcucccauuuau

SEQ ID NO: 67745 - RNA, 18 nt, Artificial Sequence
  Description of Artificial Sequence: Synthetic oligonucleotide
agcuuuucggcgcuccca

SEQ ID NO: 67746 - RNA, 18 nt, Artificial Sequence
  Description of Artificial Sequence: Synthetic oligonucleotide
uagggagcuuuucggcgc

SEQ ID NO: 67747 - RNA, 18 nt, Artificial Sequence
  Description of Artificial Sequence: Synthetic oligonucleotide
cuuuuuagggagcuuuuc

SEQ ID NO: 67748 - RNA, 18 nt, Artificial Sequence
  Description of Artificial Sequence: Synthetic oligonucleotide
acgccugccugggccacu

SEQ ID NO: 67749 - RNA, 18 nt, Artificial Sequence
  Description of Artificial Sequence: Synthetic oligonucleotide
gucauacgccugccuggg

SEQ ID NO: 67750 - RNA, 18 nt, Artificial Sequence
  Description of Artificial Sequence: Synthetic oligonucleotide
agcaggucauacgccugc

SEQ ID NO: 67751 - RNA, 18 nt, Artificial Sequence
  Description of Artificial Sequence: Synthetic oligonucleotide
acagcagcaggucauacg

SEQ ID NO: 67752 - RNA, 18 nt, Artificial Sequence
  Description of Artificial Sequence: Synthetic oligonucleotide
ccuccacagcagcagguc

SEQ ID NO: 67753 - RNA, 18 nt, Artificial Sequence
  Description of Artificial Sequence: Synthetic oligonucleotide
cagccccuccacagcagc

SEQ ID NO: 67754 - RNA, 18 nt, Artificial Sequence
  Description of Artificial Sequence: Synthetic oligonucleotide
gggcacagccccuccaca

SEQ ID NO: 67755 - RNA, 18 nt, Artificial Sequence
  Description of Artificial Sequence: Synthetic oligonucleotide
aagacauguggcgguggg

SEQ ID NO: 67756 - RNA, 18 nt, Artificial Sequence
  Description of Artificial Sequence: Synthetic oligonucleotide
aggaagacauguggcggu

SEQ ID NO: 67757 - RNA, 18 nt, Artificial Sequence
  Description of Artificial Sequence: Synthetic oligonucleotide
uggguaggaagacaugug

SEQ ID NO: 67758 - RNA, 18 nt, Artificial Sequence
  Description of Artificial Sequence: Synthetic oligonucleotide
gcagauggguaggaagac

SEQ ID NO: 67759 - RNA, 18 nt, Artificial Sequence
  Description of Artificial Sequence: Synthetic oligonucleotide
agcaggcagcccucuggg

SEQ ID NO: 67760 - RNA, 18 nt, Artificial Sequence
  Description of Artificial Sequence: Synthetic oligonucleotide
ugcacagcaggcagcccu

SEQ ID NO: 67761 - RNA, 18 nt, Artificial Sequence
  Description of Artificial Sequence: Synthetic oligonucleotide
ccaagugcacagcaggca

SEQ ID NO: 67762 - RNA, 18 nt, Artificial Sequence
  Description of Artificial Sequence: Synthetic oligonucleotide
aggacccaagugcacagc

SEQ ID NO: 67763 - RNA, 18 nt, Artificial Sequence
  Description of Artificial Sequence: Synthetic oligonucleotide
gcuccaggacccaagugc

SEQ ID NO: 67764 - RNA, 18 nt, Artificial Sequence
  Description of Artificial Sequence: Synthetic oligonucleotide
gaagggcuccaggaccca

SEQ ID NO: 67765 - RNA, 18 nt, Artificial Sequence
  Description of Artificial Sequence: Synthetic oligonucleotide
guggagaagggcuccagg

SEQ ID NO: 67766 - RNA, 18 nt, Artificial Sequence
  Description of Artificial Sequence: Synthetic oligonucleotide
cccacacccugcuggcca

SEQ ID NO: 67767 - RNA, 18 nt, Artificial Sequence
  Description of Artificial Sequence: Synthetic oligonucleotide
auaaccccacacccugcu

SEQ ID NO: 67768 - RNA, 18 nt, Artificial Sequence
  Description of Artificial Sequence: Synthetic oligonucleotide
cucacauaaccccacacc

SEQ ID NO: 67769 - RNA, 18 nt, Artificial Sequence
  Description of Artificial Sequence: Synthetic oligonucleotide
cuacccucacauaacccc

SEQ ID NO: 67770 - RNA, 18 nt, Artificial Sequence
  Description of Artificial Sequence: Synthetic oligonucleotide
ccuuucuacccucacaua

SEQ ID NO: 67771 - RNA, 18 nt, Artificial Sequence
  Description of Artificial Sequence: Synthetic oligonucleotide
gcuguccuuucuacccuc

SEQ ID NO: 67772 - RNA, 18 nt, Artificial Sequence
  Description of Artificial Sequence: Synthetic oligonucleotide
ucuuugcuguccuuucua

SEQ ID NO: 67773 - RNA, 18 nt, Artificial Sequence
  Description of Artificial Sequence: Synthetic oligonucleotide
auuucucuuugcuguccu

SEQ ID NO: 67774 - RNA, 18 nt, Artificial Sequence
  Description of Artificial Sequence: Synthetic oligonucleotide
agcccauuucucuuugcu

SEQ ID NO: 67775 - RNA, 18 nt, Artificial Sequence
  Description of Artificial Sequence: Synthetic oligonucleotide
cugggagcccauuucucu

SEQ ID NO: 67776 - RNA, 18 nt, Artificial Sequence
  Description of Artificial Sequence: Synthetic oligonucleotide
cccagcugggagcccauu

SEQ ID NO: 67777 - RNA, 18 nt, Artificial Sequence
  Description of Artificial Sequence: Synthetic oligonucleotide
ccucccccagcugggagc

SEQ ID NO: 67778 - RNA, 18 nt, Artificial Sequence
  Description of Artificial Sequence: Synthetic oligonucleotide
cugccccucccccagcug

SEQ ID NO: 67779 - RNA, 18 nt, Artificial Sequence
  Description of Artificial Sequence: Synthetic oligonucleotide
uuugccugccccuccccc

SEQ ID NO: 67780 - RNA, 18 nt, Artificial Sequence
  Description of Artificial Sequence: Synthetic oligonucleotide
uccaguuugccugccccu

SEQ ID NO: 67781 - RNA, 18 nt, Artificial Sequence
  Description of Artificial Sequence: Synthetic oligonucleotide
uagguuccaguuugccug

SEQ ID NO: 67782 - RNA, 18 nt, Artificial Sequence
  Description of Artificial Sequence: Synthetic oligonucleotide
gccuguagguuccaguuu

SEQ ID NO: 67783 - RNA, 18 nt, Artificial Sequence
  Description of Artificial Sequence: Synthetic oligonucleotide
ucagugccuguagguucc

SEQ ID NO: 67784 - RNA, 18 nt, Artificial Sequence
  Description of Artificial Sequence: Synthetic oligonucleotide
aaaggucagugccuguag

SEQ ID NO: 67785 - RNA, 18 nt, Artificial Sequence
  Description of Artificial Sequence: Synthetic oligonucleotide
ucgacaaaggucagugcc

SEQ ID NO: 67786 - RNA, 18 nt, Artificial Sequence
  Description of Artificial Sequence: Synthetic oligonucleotide
ucuucucgacaaagguca

SEQ ID NO: 67787 - RNA, 18 nt, Artificial Sequence
  Description of Artificial Sequence: Synthetic oligonucleotide
uacacucuucucgacaaa

SEQ ID NO: 67788 - RNA, 18 nt, Artificial Sequence
  Description of Artificial Sequence: Synthetic oligonucleotide
aaggcuacacucuucucg

SEQ ID NO: 67789 - RNA, 18 nt, Artificial Sequence
  Description of Artificial Sequence: Synthetic oligonucleotide
cugggaaggcuacacucu

SEQ ID NO: 67790 - RNA, 18 nt, Artificial Sequence
  Description of Artificial Sequence: Synthetic oligonucleotide
ccauucugggaaggcuac

SEQ ID NO: 67791 - RNA, 18 nt, Artificial Sequence
  Description of Artificial Sequence: Synthetic oligonucleotide
uccucccauucugggaag

SEQ ID NO: 67792 - RNA, 18 nt, Artificial Sequence
  Description of Artificial Sequence: Synthetic oligonucleotide
ccugcuccucccauucug

SEQ ID NO: 67793 - RNA, 18 nt, Artificial Sequence
  Description of Artificial Sequence: Synthetic oligonucleotide
ucugcccugcuccuccca

SEQ ID NO: 67794 - RNA, 18 nt, Artificial Sequence
  Description of Artificial Sequence: Synthetic oligonucleotide
ccugcucugcccugcucc

SEQ ID NO: 67795 - RNA, 18 nt, Artificial Sequence
  Description of Artificial Sequence: Synthetic oligonucleotide
cuaccccugcucugcccu

SEQ ID NO: 67796 - RNA, 18 nt, Artificial Sequence
  Description of Artificial Sequence: Synthetic oligonucleotide
acccccuaccccugcucu

SEQ ID NO: 67797 - RNA, 18 nt, Artificial Sequence
  Description of Artificial Sequence: Synthetic oligonucleotide
accccacccccuaccccu

SEQ ID NO: 67798 - RNA, 18 nt, Artificial Sequence
  Description of Artificial Sequence: Synthetic oligonucleotide
ccagcaccccacccccua

SEQ ID NO: 67799 - RNA, 18 nt, Artificial Sequence
  Description of Artificial Sequence: Synthetic oligonucleotide
agaaaccagcaccccacc

SEQ ID NO: 67800 - RNA, 18 nt, Artificial Sequence
  Description of Artificial Sequence: Synthetic oligonucleotide
cccucagaaaccagcacc

SEQ ID NO: 67801 - RNA, 18 nt, Artificial Sequence
  Description of Artificial Sequence: Synthetic oligonucleotide
ucagucccucagaaacca

SEQ ID NO: 67802 - RNA, 18 nt, Artificial Sequence
  Description of Artificial Sequence: Synthetic oligonucleotide
agugaucagucccucaga

SEQ ID NO: 67803 - RNA, 18 nt, Artificial Sequence
  Description of Artificial Sequence: Synthetic oligonucleotide
aaguaagugaucaguccc

SEQ ID NO: 67804 - RNA, 18 nt, Artificial Sequence
  Description of Artificial Sequence: Synthetic oligonucleotide
ccaccaaguaagugauca

SEQ ID NO: 67805 - RNA, 18 nt, Artificial Sequence
  Description of Artificial Sequence: Synthetic oligonucleotide
guauuccaccaaguaagu

SEQ ID NO: 67806 - RNA, 18 nt, Artificial Sequence
  Description of Artificial Sequence: Synthetic oligonucleotide
gugcuguauuccaccaag

SEQ ID NO: 67807 - RNA, 18 nt, Artificial Sequence
  Description of Artificial Sequence: Synthetic oligonucleotide
gggcugugcuguauucca

SEQ ID NO: 67808 - RNA, 18 nt, Artificial Sequence
  Description of Artificial Sequence: Synthetic oligonucleotide
agccagggcugugcugua

SEQ ID NO: 67809 - RNA, 18 nt, Artificial Sequence
  Description of Artificial Sequence: Synthetic oligonucleotide
gggccagccagggcugug

SEQ ID NO: 67810 - RNA, 18 nt, Artificial Sequence
  Description of Artificial Sequence: Synthetic oligonucleotide
ccuuagggccagccaggg

SEQ ID NO: 67811 - RNA, 18 nt, Artificial Sequence
  Description of Artificial Sequence: Synthetic oligonucleotide
ccuuuccuuagggccagc

SEQ ID NO: 67812 - RNA, 18 nt, Artificial Sequence
  Description of Artificial Sequence: Synthetic oligonucleotide
uguccccuuuccuuaggg

SEQ ID NO: 67813 - RNA, 18 nt, Artificial Sequence
  Description of Artificial Sequence: Synthetic oligonucleotide
gcucauguccccuuuccu

SEQ ID NO: 67814 - RNA, 18 nt, Artificial Sequence
  Description of Artificial Sequence: Synthetic oligonucleotide
ccugggcucauguccccu

SEQ ID NO: 67815 - RNA, 18 nt, Artificial Sequence
  Description of Artificial Sequence: Synthetic oligonucleotide
uucucccugggcucaugu

SEQ ID NO: 67816 - RNA, 18 nt, Artificial Sequence
  Description of Artificial Sequence: Synthetic oligonucleotide
uuauuuucucccugggcu

SEQ ID NO: 67817 - RNA, 18 nt, Artificial Sequence
  Description of Artificial Sequence: Synthetic oligonucleotide
cucucuuauuuucucccu

SEQ ID NO: 67818 - RNA, 18 nt, Artificial Sequence
  Description of Artificial Sequence: Synthetic oligonucleotide
gcucccucucuuauuuuc

SEQ ID NO: 67819 - RNA, 18 nt, Artificial Sequence
  Description of Artificial Sequence: Synthetic oligonucleotide
gugcagcucccucucuua

SEQ ID NO: 67820 - RNA, 18 nt, Artificial Sequence
  Description of Artificial Sequence: Synthetic oligonucleotide
ccuaagugcagcucccuc

SEQ ID NO: 67821 - RNA, 18 nt, Artificial Sequence
  Description of Artificial Sequence: Synthetic oligonucleotide
uaagcccuaagugcagcu

SEQ ID NO: 67822 - RNA, 18 nt, Artificial Sequence
  Description of Artificial Sequence: Synthetic oligonucleotide
uuugcuaagcccuaagug

SEQ ID NO: 67823 - RNA, 18 nt, Artificial Sequence
  Description of Artificial Sequence: Synthetic oligonucleotide
cuguguuugcuaagcccu

SEQ ID NO: 67824 - RNA, 18 nt, Artificial Sequence
  Description of Artificial Sequence: Synthetic oligonucleotide
uacuacuguguuugcuaa

SEQ ID NO: 67825 - RNA, 18 nt, Artificial Sequence
  Description of Artificial Sequence: Synthetic oligonucleotide
caucuuacuacuguguuu

SEQ ID NO: 67826 - RNA, 18 nt, Artificial Sequence
  Description of Artificial Sequence: Synthetic oligonucleotide
guguccaucuuacuacug

SEQ ID NO: 67827 - RNA, 18 nt, Artificial Sequence
  Description of Artificial Sequence: Synthetic oligonucleotide
gggcuguguccaucuuac

SEQ ID NO: 67828 - RNA, 18 nt, Artificial Sequence
  Description of Artificial Sequence: Synthetic oligonucleotide
aaugaccagcuaagaaug

SEQ ID NO: 67829 - RNA, 18 nt, Artificial Sequence
  Description of Artificial Sequence: Synthetic oligonucleotide
cgaggaaugaccagcuaa

SEQ ID NO: 67830 - RNA, 18 nt, Artificial Sequence
  Description of Artificial Sequence: Synthetic oligonucleotide
gcuaacgaggaaugacca

SEQ ID NO: 67831 - RNA, 18 nt, Artificial Sequence
  Description of Artificial Sequence: Synthetic oligonucleotide
cuuaagcuaacgaggaau

SEQ ID NO: 67832 - RNA, 18 nt, Artificial Sequence
  Description of Artificial Sequence: Synthetic oligonucleotide
agaaccuuaagcuaacga

SEQ ID NO: 67833 - RNA, 18 nt, Artificial Sequence
  Description of Artificial Sequence: Synthetic oligonucleotide
gauucagaaccuuaagcu

SEQ ID NO: 67834 - RNA, 18 nt, Artificial Sequence
  Description of Artificial Sequence: Synthetic oligonucleotide
caccagauucagaaccuu

SEQ ID NO: 67835 - RNA, 18 nt, Artificial Sequence
  Description of Artificial Sequence: Synthetic oligonucleotide
cccagcaccagauucaga

SEQ ID NO: 67836 - RNA, 18 nt, Artificial Sequence
  Description of Artificial Sequence: Synthetic oligonucleotide
gcuuccccagcaccagau

SEQ ID NO: 67837 - RNA, 18 nt, Artificial Sequence
  Description of Artificial Sequence: Synthetic oligonucleotide
gcccagcuuccccagcac

SEQ ID NO: 67838 - RNA, 18 nt, Artificial Sequence
  Description of Artificial Sequence: Synthetic oligonucleotide
gccuggcccagcuucccc

SEQ ID NO: 67839 - RNA, 18 nt, Artificial Sequence
  Description of Artificial Sequence: Synthetic oligonucleotide
ggcuugccuggcccagcu

SEQ ID NO: 67840 - RNA, 18 nt, Artificial Sequence
  Description of Artificial Sequence: Synthetic oligonucleotide
gcccuggcuugccuggcc

SEQ ID NO: 67841 - RNA, 18 nt, Artificial Sequence
  Description of Artificial Sequence: Synthetic oligonucleotide
cuugcgcccuggcuugcc

SEQ ID NO: 67842 - RNA, 18 nt, Artificial Sequence
  Description of Artificial Sequence: Synthetic oligonucleotide
cucuccuugcgcccuggc

SEQ ID NO: 67843 - RNA, 18 nt, Artificial Sequence
  Description of Artificial Sequence: Synthetic oligonucleotide
uuacccucuccuugcgcc

SEQ ID NO: 67844 - RNA, 18 nt, Artificial Sequence
  Description of Artificial Sequence: Synthetic oligonucleotide
ucccauuacccucuccuu

SEQ ID NO: 67845 - RNA, 18 nt, Artificial Sequence
  Description of Artificial Sequence: Synthetic oligonucleotide
ccuccucccauuacccuc

SEQ ID NO: 67846 - RNA, 18 nt, Artificial Sequence
  Description of Artificial Sequence: Synthetic oligonucleotide
ugggcccuccucccauua

SEQ ID NO: 67847 - RNA, 18 nt, Artificial Sequence
  Description of Artificial Sequence: Synthetic oligonucleotide
augagugggcccuccucc

SEQ ID NO: 67848 - RNA, 18 nt, Artificial Sequence
  Description of Artificial Sequence: Synthetic oligonucleotide
ucaacaugagugggcccu

SEQ ID NO: 67849 - RNA, 18 nt, Artificial Sequence
  Description of Artificial Sequence: Synthetic oligonucleotide
gucugucaacaugagugg

SEQ ID NO: 67850 - RNA, 18 nt, Artificial Sequence
  Description of Artificial Sequence: Synthetic oligonucleotide
uguaggucugucaacaug

SEQ ID NO: 67851 - RNA, 18 nt, Artificial Sequence
  Description of Artificial Sequence: Synthetic oligonucleotide
uuuccuguaggucuguca

SEQ ID NO: 67852 - RNA, 18 nt, Artificial Sequence
  Description of Artificial Sequence: Synthetic oligonucleotide
ugggauuuccuguagguc

SEQ ID NO: 67853 - RNA, 18 nt, Artificial Sequence
  Description of Artificial Sequence: Synthetic oligonucleotide
aauauugggauuuccugu

SEQ ID NO: 67854 - RNA, 18 nt, Artificial Sequence
  Description of Artificial Sequence: Synthetic oligonucleotide
gauucaauauugggauuu

SEQ ID NO: 67855 - RNA, 18 nt, Artificial Sequence
  Description of Artificial Sequence: Synthetic oligonucleotide
caccugauucaauauugg

SEQ ID NO: 67856 - RNA, 18 nt, Artificial Sequence
  Description of Artificial Sequence: Synthetic oligonucleotide
gcuugcaccugauucaau

SEQ ID NO: 67857 - RNA, 18 nt, Artificial Sequence
  Description of Artificial Sequence: Synthetic oligonucleotide
aagaggcuugcaccugau

SEQ ID NO: 67858 - RNA, 18 nt, Artificial Sequence
  Description of Artificial Sequence: Synthetic oligonucleotide
gugcaaagaggcuugcac

SEQ ID NO: 67859 - RNA, 18 nt, Artificial Sequence
  Description of Artificial Sequence: Synthetic oligonucleotide
aaguugugcaaagaggcu

SEQ ID NO: 67860 - RNA, 18 nt, Artificial Sequence
  Description of Artificial Sequence: Synthetic oligonucleotide
uucacaaguugugcaaag

SEQ ID NO: 67861 - RNA, 18 nt, Artificial Sequence
  Description of Artificial Sequence: Synthetic oligonucleotide
ucuccuuuuugucaggac

SEQ ID NO: 67862 - RNA, 18 nt, Artificial Sequence
  Description of Artificial Sequence: Synthetic oligonucleotide
uggugucuccuuuuuguc

SEQ ID NO: 67863 - RNA, 18 nt, Artificial Sequence
  Description of Artificial Sequence: Synthetic oligonucleotide
gcauauggugucuccuuu

SEQ ID NO: 67864 - RNA, 18 nt, Artificial Sequence
  Description of Artificial Sequence: Synthetic oligonucleotide
agaaagcauauggugucu

SEQ ID NO: 67865 - RNA, 18 nt, Artificial Sequence
  Description of Artificial Sequence: Synthetic oligonucleotide
aagcaagaaagcauaugg

SEQ ID NO: 67866 - RNA, 18 nt, Artificial Sequence
  Description of Artificial Sequence: Synthetic oligonucleotide
aaagaaagcaagaaagca

SEQ ID NO: 67867 - RNA, 18 nt, Artificial Sequence
  Description of Artificial Sequence: Synthetic oligonucleotide
gaaagaaagaaagcaaga

SEQ ID NO: 67868 - RNA, 18 nt, Artificial Sequence
  Description of Artificial Sequence: Synthetic oligonucleotide
agaaagaaagaaagaaag

SEQ ID NO: 67869 - RNA, 18 nt, Artificial Sequence
  Description of Artificial Sequence: Synthetic oligonucleotide
aagaaagaaagaaagaaa

SEQ ID NO: 67870 - RNA, 18 nt, Artificial Sequence
  Description of Artificial Sequence: Synthetic oligonucleotide
aaagaaagaaagaaagaa

SEQ ID NO: 67871 - RNA, 18 nt, Artificial Sequence
  Description of Artificial Sequence: Synthetic oligonucleotide
aaaaaaaagaaagaaaga

SEQ ID NO: 67872 - RNA, 18 nt, Artificial Sequence
  Description of Artificial Sequence: Synthetic oligonucleotide
caaaaaaaaaaaagaaag

SEQ ID NO: 67873 - RNA, 18 nt, Artificial Sequence
  Description of Artificial Sequence: Synthetic oligonucleotide
cgucucaaaaaaaaaaaa

SEQ ID NO: 67874 - RNA, 18 nt, Artificial Sequence
  Description of Artificial Sequence: Synthetic oligonucleotide
aacuccgucucaaaaaaa

SEQ ID NO: 67875 - RNA, 18 nt, Artificial Sequence
  Description of Artificial Sequence: Synthetic oligonucleotide
agugaaacuccgucucaa

SEQ ID NO: 67876 - RNA, 18 nt, Artificial Sequence
  Description of Artificial Sequence: Synthetic oligonucleotide
auaagagugaaacuccgu

SEQ ID NO: 67877 - RNA, 18 nt, Artificial Sequence
  Description of Artificial Sequence: Synthetic oligonucleotide
gggcaauaagagugaaac

SEQ ID NO: 67878 - RNA, 18 nt, Artificial Sequence
  Description of Artificial Sequence: Synthetic oligonucleotide
agccugggcaauaagagu

SEQ ID NO: 67879 - RNA, 18 nt, Artificial Sequence
  Description of Artificial Sequence: Synthetic oligonucleotide
acuccagccugggcaaua

SEQ ID NO: 67880 - RNA, 18 nt, Artificial Sequence
  Description of Artificial Sequence: Synthetic oligonucleotide
auugcacuccagccuggg

SEQ ID NO: 67881 - RNA, 18 nt, Artificial Sequence
  Description of Artificial Sequence: Synthetic oligonucleotide
gcaccauugcacuccagc

SEQ ID NO: 67882 - RNA, 18 nt, Artificial Sequence
  Description of Artificial Sequence: Synthetic oligonucleotide
agaucgcaccauugcacu

SEQ ID NO: 67883 - RNA, 18 nt, Artificial Sequence
  Description of Artificial Sequence: Synthetic oligonucleotide
agccgagaucgcaccauu

SEQ ID NO: 67884 - RNA, 18 nt, Artificial Sequence
  Description of Artificial Sequence: Synthetic oligonucleotide
uggugagccgagaucgca

SEQ ID NO: 67885 - RNA, 18 nt, Artificial Sequence
  Description of Artificial Sequence: Synthetic oligonucleotide
gguuguggugagccgaga

SEQ ID NO: 67886 - RNA, 18 nt, Artificial Sequence
  Description of Artificial Sequence: Synthetic oligonucleotide
gcggagguuguggugagc

SEQ ID NO: 67887 - RNA, 18 nt, Artificial Sequence
  Description of Artificial Sequence: Synthetic oligonucleotide
gggaggcggagguugugg

SEQ ID NO: 67888 - RNA, 18 nt, Artificial Sequence
  Description of Artificial Sequence: Synthetic oligonucleotide
uaccugggaggcggaggu

SEQ ID NO: 67889 - RNA, 18 nt, Artificial Sequence
  Description of Artificial Sequence: Synthetic oligonucleotide
gcuuguaccugggaggcg

SEQ ID NO: 67890 - RNA, 18 nt, Artificial Sequence
  Description of Artificial Sequence: Synthetic oligonucleotide
gaaucgcuuguaccuggg

SEQ ID NO: 67891 - RNA, 18 nt, Artificial Sequence
  Description of Artificial Sequence: Synthetic oligonucleotide
caggagaaucgcuuguac

SEQ ID NO: 67892 - RNA, 18 nt, Artificial Sequence
  Description of Artificial Sequence: Synthetic oligonucleotide
ugagacaggagaaucgcu

SEQ ID NO: 67893 - RNA, 18 nt, Artificial Sequence
  Description of Artificial Sequence: Synthetic oligonucleotide
gaggcugagacaggagaa

SEQ ID NO: 67894 - RNA, 18 nt, Artificial Sequence
  Description of Artificial Sequence: Synthetic oligonucleotide
cuugggaggcugagacag

SEQ ID NO: 67895 - RNA, 18 nt, Artificial Sequence
  Description of Artificial Sequence: Synthetic oligonucleotide
agcuacuugggaggcuga

SEQ ID NO: 67896 - RNA, 18 nt, Artificial Sequence
  Description of Artificial Sequence: Synthetic oligonucleotide
auccaagcuacuugggag

SEQ ID NO: 67897 - RNA, 18 nt, Artificial Sequence
  Description of Artificial Sequence: Synthetic oligonucleotide
cuguaauccaagcuacuu

SEQ ID NO: 67898 - RNA, 18 nt, Artificial Sequence
  Description of Artificial Sequence: Synthetic oligonucleotide
caugccuguaauccaagc

SEQ ID NO: 67899 - RNA, 18 nt, Artificial Sequence
  Description of Artificial Sequence: Synthetic oligonucleotide
ugguucaugccuguaauc

SEQ ID NO: 67900 - RNA, 18 nt, Artificial Sequence
  Description of Artificial Sequence: Synthetic oligonucleotide
uguggugguucaugccug

SEQ ID NO: 67901 - RNA, 18 nt, Artificial Sequence
  Description of Artificial Sequence: Synthetic oligonucleotide
caggguguggugguucau

SEQ ID NO: 67902 - RNA, 18 nt, Artificial Sequence
  Description of Artificial Sequence: Synthetic oligonucleotide
acuagcaggguguggugg

SEQ ID NO: 67903 - RNA, 18 nt, Artificial Sequence
  Description of Artificial Sequence: Synthetic oligonucleotide
aaaaaacuagcagggugu

SEQ ID NO: 67904 - RNA, 18 nt, Artificial Sequence
  Description of Artificial Sequence: Synthetic oligonucleotide
auacaaaaaaacuagcag

SEQ ID NO: 67905 - RNA, 18 nt, Artificial Sequence
  Description of Artificial Sequence: Synthetic oligonucleotide
acgaaauacaaaaaaacu

SEQ ID NO: 67906 - RNA, 18 nt, Artificial Sequence
  Description of Artificial Sequence: Synthetic oligonucleotide
gcucuacgaaauacaaaa

SEQ ID NO: 67907 - RNA, 18 nt, Artificial Sequence
  Description of Artificial Sequence: Synthetic oligonucleotide
ccccggcucuacgaaaua

SEQ ID NO: 67908 - RNA, 18 nt, Artificial Sequence
  Description of Artificial Sequence: Synthetic oligonucleotide
ugaaaccccggcucuacg

SEQ ID NO: 67909 - RNA, 18 nt, Artificial Sequence
  Description of Artificial Sequence: Synthetic oligonucleotide
cauggugaaaccccggcu

SEQ ID NO: 67910 - RNA, 18 nt, Artificial Sequence
  Description of Artificial Sequence: Synthetic oligonucleotide
acuaacauggugaaaccc

SEQ ID NO: 67911 - RNA, 18 nt, Artificial Sequence
  Description of Artificial Sequence: Synthetic oligonucleotide
gccucacuaacaugguga

SEQ ID NO: 67912 - RNA, 18 nt, Artificial Sequence
  Description of Artificial Sequence: Synthetic oligonucleotide
caccagccucacuaacau

SEQ ID NO: 67913 - RNA, 18 nt, Artificial Sequence
  Description of Artificial Sequence: Synthetic oligonucleotide
uucgccaccagccucacu

SEQ ID NO: 67914 - RNA, 18 nt, Artificial Sequence
  Description of Artificial Sequence: Synthetic oligonucleotide
aggaguucgccaccagcc

SEQ ID NO: 67915 - RNA, 18 nt, Artificial Sequence
  Description of Artificial Sequence: Synthetic oligonucleotide
aggucaggaguucgccac

SEQ ID NO: 67916 - RNA, 18 nt, Artificial Sequence
  Description of Artificial Sequence: Synthetic oligonucleotide
accugaggucaggaguuc

SEQ ID NO: 67917 - RNA, 18 nt, Artificial Sequence
  Description of Artificial Sequence: Synthetic oligonucleotide
ggaucaccugaggucagg

SEQ ID NO: 67918 - RNA, 18 nt, Artificial Sequence
  Description of Artificial Sequence: Synthetic oligonucleotide
cggguggaucaccugagg

SEQ ID NO: 67919 - RNA, 18 nt, Artificial Sequence
  Description of Artificial Sequence: Synthetic oligonucleotide
caaggcggguggaucacc

SEQ ID NO: 67920 - RNA, 18 nt, Artificial Sequence
  Description of Artificial Sequence: Synthetic oligonucleotide
gaguccaaggcgggugga

SEQ ID NO: 67921 - RNA, 18 nt, Artificial Sequence
  Description of Artificial Sequence: Synthetic oligonucleotide
uuugggaguccaaggcgg

SEQ ID NO: 67922 - RNA, 18 nt, Artificial Sequence
  Description of Artificial Sequence: Synthetic oligonucleotide
agcacuuugggaguccaa

SEQ ID NO: 67923 - RNA, 18 nt, Artificial Sequence
  Description of Artificial Sequence: Synthetic oligonucleotide
aucccagcacuuugggag

SEQ ID NO: 67924 - RNA, 18 nt, Artificial Sequence
  Description of Artificial Sequence: Synthetic oligonucleotide
cuguaaucccagcacuuu

SEQ ID NO: 67925 - RNA, 18 nt, Artificial Sequence
  Description of Artificial Sequence: Synthetic oligonucleotide
caugccuguaaucccagc

SEQ ID NO: 67926 - RNA, 18 nt, Artificial Sequence
  Description of Artificial Sequence: Synthetic oligonucleotide
uggcucaugccuguaauc

SEQ ID NO: 67927 - RNA, 18 nt, Artificial Sequence
  Description of Artificial Sequence: Synthetic oligonucleotide
ugcaguggcucaugccug

SEQ ID NO: 67928 - RNA, 18 nt, Artificial Sequence
  Description of Artificial Sequence: Synthetic oligonucleotide
ccgggugcaguggcucau

SEQ ID NO: 67929 - RNA, 18 nt, Artificial Sequence
  Description of Artificial Sequence: Synthetic oligonucleotide
gugugccgggugcagugg

SEQ ID NO: 67930 - RNA, 18 nt, Artificial Sequence
  Description of Artificial Sequence: Synthetic oligonucleotide
auauggugugccgggugc

SEQ ID NO: 67931 - RNA, 18 nt, Artificial Sequence
  Description of Artificial Sequence: Synthetic oligonucleotide
aaagcauauggugugccg

SEQ ID NO: 67932 - RNA, 18 nt, Artificial Sequence
  Description of Artificial Sequence: Synthetic oligonucleotide
ugaugaaagcauauggug

SEQ ID NO: 67933 - RNA, 18 nt, Artificial Sequence
  Description of Artificial Sequence: Synthetic oligonucleotide
ucuugugaugaaagcaua

SEQ ID NO: 67934 - RNA, 18 nt, Artificial Sequence
  Description of Artificial Sequence: Synthetic oligonucleotide
cauuuucuugugaugaaa

SEQ ID NO: 67935 - RNA, 18 nt, Artificial Sequence
  Description of Artificial Sequence: Synthetic oligonucleotide
ucucacauuuucuuguga

SEQ ID NO: 67936 - RNA, 18 nt, Artificial Sequence
  Description of Artificial Sequence: Synthetic oligonucleotide
aauucucucacauuuucu

SEQ ID NO: 67937 - RNA, 18 nt, Artificial Sequence
  Description of Artificial Sequence: Synthetic oligonucleotide
cccugaauucucucacau

SEQ ID NO: 67938 - RNA, 18 nt, Artificial Sequence
  Description of Artificial Sequence: Synthetic oligonucleotide
caaagcccugaauucucu

SEQ ID NO: 67939 - RNA, 18 nt, Artificial Sequence
  Description of Artificial Sequence: Synthetic oligonucleotide
acugccaaagcccugaau

SEQ ID NO: 67940 - RNA, 18 nt, Artificial Sequence
  Description of Artificial Sequence: Synthetic oligonucleotide
cuggaacugccaaagccc

SEQ ID NO: 67941 - RNA, 18 nt, Artificial Sequence
  Description of Artificial Sequence: Synthetic oligonucleotide
ccagccuggaacugccaa

SEQ ID NO: 67942 - RNA, 18 nt, Artificial Sequence
  Description of Artificial Sequence: Synthetic oligonucleotide
gcugaccagccuggaacu

SEQ ID NO: 67943 - RNA, 18 nt, Artificial Sequence
  Description of Artificial Sequence: Synthetic oligonucleotide
gagaugcugaccagccug

SEQ ID NO: 67944 - RNA, 18 nt, Artificial Sequence
  Description of Artificial Sequence: Synthetic oligonucleotide
ggcuugagaugcugacca

SEQ ID NO: 67945 - RNA, 18 nt, Artificial Sequence
  Description of Artificial Sequence: Synthetic oligonucleotide
gggagggcuugagaugcu

SEQ ID NO: 67946 - RNA, 18 nt, Artificial Sequence
  Description of Artificial Sequence: Synthetic oligonucleotide
gggugaacagaugcuggg

SEQ ID NO: 67947 - RNA, 18 nt, Artificial Sequence
  Description of Artificial Sequence: Synthetic oligonucleotide
ggcagggugaacagaugc

SEQ ID NO: 67948 - RNA, 18 nt, Artificial Sequence
  Description of Artificial Sequence: Synthetic oligonucleotide
ugccuggcagggugaaca

SEQ ID NO: 67949 - RNA, 18 nt, Artificial Sequence
  Description of Artificial Sequence: Synthetic oligonucleotide
gagacugccuggcagggu

SEQ ID NO: 67950 - RNA, 18 nt, Artificial Sequence
  Description of Artificial Sequence: Synthetic oligonucleotide
aggaagagacugccuggc

SEQ ID NO: 67951 - RNA, 18 nt, Artificial Sequence
  Description of Artificial Sequence: Synthetic oligonucleotide
uuucuaggaagagacugc

SEQ ID NO: 67952 - RNA, 18 nt, Artificial Sequence
  Description of Artificial Sequence: Synthetic oligonucleotide
ccaaguuucuaggaagag

SEQ ID NO: 67953 - RNA, 18 nt, Artificial Sequence
  Description of Artificial Sequence: Synthetic oligonucleotide
uuuaaccaaguuucuagg

SEQ ID NO: 67954 - RNA, 18 nt, Artificial Sequence
  Description of Artificial Sequence: Synthetic oligonucleotide
gaacauuuaaccaaguuu

SEQ ID NO: 67955 - RNA, 18 nt, Artificial Sequence
  Description of Artificial Sequence: Synthetic oligonucleotide
agagugaacauuuaacca

SEQ ID NO: 67956 - RNA, 18 nt, Artificial Sequence
  Description of Artificial Sequence: Synthetic oligonucleotide
caagggugaagaaucuau

SEQ ID NO: 67957 - RNA, 18 nt, Artificial Sequence
  Description of Artificial Sequence: Synthetic oligonucleotide
cgggccaagggugaagaa

SEQ ID NO: 67958 - RNA, 18 nt, Artificial Sequence
  Description of Artificial Sequence: Synthetic oligonucleotide
aaaggcgggccaagggug

SEQ ID NO: 67959 - RNA, 18 nt, Artificial Sequence
  Description of Artificial Sequence: Synthetic oligonucleotide
gggcaaaggcgggccaag

SEQ ID NO: 67960 - RNA, 18 nt, Artificial Sequence
  Description of Artificial Sequence: Synthetic oligonucleotide
ugggcagaguaggguggg

SEQ ID NO: 67961 - RNA, 18 nt, Artificial Sequence
  Description of Artificial Sequence: Synthetic oligonucleotide
acuucugggcagaguagg

SEQ ID NO: 67962 - RNA, 18 nt, Artificial Sequence
  Description of Artificial Sequence: Synthetic oligonucleotide
cuugcacuucugggcaga

SEQ ID NO: 67963 - RNA, 18 nt, Artificial Sequence
  Description of Artificial Sequence: Synthetic oligonucleotide
aggcucuugcacuucugg

SEQ ID NO: 67964 - RNA, 18 nt, Artificial Sequence
  Description of Artificial Sequence: Synthetic oligonucleotide
ggcuuaggcucuugcacu

SEQ ID NO: 67965 - RNA, 18 nt, Artificial Sequence
  Description of Artificial Sequence: Synthetic oligonucleotide
gaggcggcuuaggcucuu

SEQ ID NO: 67966 - RNA, 18 nt, Artificial Sequence
  Description of Artificial Sequence: Synthetic oligonucleotide
ccauggaggcggcuuagg

SEQ ID NO: 67967 - RNA, 18 nt, Artificial Sequence
  Description of Artificial Sequence: Synthetic oligonucleotide
gggccauggaggcggcuu

SEQ ID NO: 67968 - RNA, 18 nt, Artificial Sequence
  Description of Artificial Sequence: Synthetic oligonucleotide
cccugaauccuuccuggg

SEQ ID NO: 67969 - RNA, 18 nt, Artificial Sequence
  Description of Artificial Sequence: Synthetic oligonucleotide
cucuccccugaauccuuc

SEQ ID NO: 67970 - RNA, 18 nt, Artificial Sequence
  Description of Artificial Sequence: Synthetic oligonucleotide
gggccucuccccugaauc

SEQ ID NO: 67971 - RNA, 18 nt, Artificial Sequence
  Description of Artificial Sequence: Synthetic oligonucleotide
cguggcucccuguuuggg

SEQ ID NO: 67972 - RNA, 18 nt, Artificial Sequence
  Description of Artificial Sequence: Synthetic oligonucleotide
gcuggcguggcucccugu

SEQ ID NO: 67973 - RNA, 18 nt, Artificial Sequence
  Description of Artificial Sequence: Synthetic oligonucleotide
gucuggcuggcguggcuc

SEQ ID NO: 67974 - RNA, 18 nt, Artificial Sequence
  Description of Artificial Sequence: Synthetic oligonucleotide
gggugucuggcuggcgug

SEQ ID NO: 67975 - RNA, 18 nt, Artificial Sequence
  Description of Artificial Sequence: Synthetic oligonucleotide
agcuccauucuggccggg

SEQ ID NO: 67976 - RNA, 18 nt, Artificial Sequence
  Description of Artificial Sequence: Synthetic oligonucleotide
cagucagcuccauucugg

SEQ ID NO: 67977 - RNA, 18 nt, Artificial Sequence
  Description of Artificial Sequence: Synthetic oligonucleotide
aagggugaagaaucuauc

SEQ ID NO: 67978 - RNA, 18 nt, Artificial Sequence
  Description of Artificial Sequence: Synthetic oligonucleotide
gggccaagggugaagaau

SEQ ID NO: 67979 - RNA, 18 nt, Artificial Sequence
  Description of Artificial Sequence: Synthetic oligonucleotide
aaggcgggccaaggguga

SEQ ID NO: 67980 - RNA, 18 nt, Artificial Sequence
  Description of Artificial Sequence: Synthetic oligonucleotide
gggcaaaggcgggccaag

SEQ ID NO: 67981 - RNA, 18 nt, Artificial Sequence
  Description of Artificial Sequence: Synthetic oligonucleotide
ugggcagaguaggguggg

SEQ ID NO: 67982 - RNA, 18 nt, Artificial Sequence
  Description of Artificial Sequence: Synthetic oligonucleotide
uucugggcagaguagggu

SEQ ID NO: 67983 - RNA, 18 nt, Artificial Sequence
  Description of Artificial Sequence: Synthetic oligonucleotide
ugcacuucugggcagagu

SEQ ID NO: 67984 - RNA, 18 nt, Artificial Sequence
  Description of Artificial Sequence: Synthetic oligonucleotide
gcucuugcacuucugggc

SEQ ID NO: 67985 - RNA, 18 nt, Artificial Sequence
  Description of Artificial Sequence: Synthetic oligonucleotide
cuuaggcucuugcacuuc

SEQ ID NO: 67986 - RNA, 18 nt, Artificial Sequence
  Description of Artificial Sequence: Synthetic oligonucleotide
ggcggcuuaggcucuugc

SEQ ID NO: 67987 - RNA, 18 nt, Artificial Sequence
  Description of Artificial Sequence: Synthetic oligonucleotide
auggaggcggcuuaggcu

SEQ ID NO: 67988 - RNA, 18 nt, Artificial Sequence
  Description of Artificial Sequence: Synthetic oligonucleotide
gggccauggaggcggcuu

SEQ ID NO: 67989 - RNA, 18 nt, Artificial Sequence
  Description of Artificial Sequence: Synthetic oligonucleotide
cccugaauccuuccuggg

SEQ ID NO: 67990 - RNA, 18 nt, Artificial Sequence
  Description of Artificial Sequence: Synthetic oligonucleotide
ucuccccugaauccuucc

SEQ ID NO: 67991 - RNA, 18 nt, Artificial Sequence
  Description of Artificial Sequence: Synthetic oligonucleotide
gggccucuccccugaauc

SEQ ID NO: 67992 - RNA, 18 nt, Artificial Sequence
  Description of Artificial Sequence: Synthetic oligonucleotide
cguggcucccuguuuggg

SEQ ID NO: 67993 - RNA, 18 nt, Artificial Sequence
  Description of Artificial Sequence: Synthetic oligonucleotide
cuggcguggcucccuguu

SEQ ID NO: 67994 - RNA, 18 nt, Artificial Sequence
  Description of Artificial Sequence: Synthetic oligonucleotide
ucuggcuggcguggcucc

SEQ ID NO: 67995 - RNA, 18 nt, Artificial Sequence
  Description of Artificial Sequence: Synthetic oligonucleotide
gggugucuggcuggcgug

SEQ ID NO: 67996 - RNA, 18 nt, Artificial Sequence
  Description of Artificial Sequence: Synthetic oligonucleotide
agcuccauucuggccggg

SEQ ID NO: 67997 - RNA, 18 nt, Artificial Sequence
  Description of Artificial Sequence: Synthetic oligonucleotide
ucagcuccauucuggccg

SEQ ID NO: 67998 - RNA, 18 nt, Artificial Sequence
  Description of Artificial Sequence: Synthetic oligonucleotide
uagccccucagguguguu

SEQ ID NO: 67999 - RNA, 18 nt, Artificial Sequence
  Description of Artificial Sequence: Synthetic oligonucleotide
ggcccuagccccucaggu

SEQ ID NO: 68000 - RNA, 18 nt, Artificial Sequence
  Description of Artificial Sequence: Synthetic oligonucleotide
cauauggcccuagccccu

SEQ ID NO: 68001 - RNA, 18 nt, Artificial Sequence
  Description of Artificial Sequence: Synthetic oligonucleotide
guuuccauauggcccuag

SEQ ID NO: 68002 - RNA, 18 nt, Artificial Sequence
  Description of Artificial Sequence: Synthetic oligonucleotide
gucauguuuccauauggc

SEQ ID NO: 68003 - RNA, 18 nt, Artificial Sequence
  Description of Artificial Sequence: Synthetic oligonucleotide
cuucugucauguuuccau

SEQ ID NO: 68004 - RNA, 18 nt, Artificial Sequence
  Description of Artificial Sequence: Synthetic oligonucleotide
cuccccuucugucauguu

SEQ ID NO: 68005 - RNA, 18 nt, Artificial Sequence
  Description of Artificial Sequence: Synthetic oligonucleotide
ucucucuccccuucuguc

SEQ ID NO: 68006 - RNA, 18 nt, Artificial Sequence
  Description of Artificial Sequence: Synthetic oligonucleotide
uccuuucucucuccccuu

SEQ ID NO: 68007 - RNA, 18 nt, Artificial Sequence
  Description of Artificial Sequence: Synthetic oligonucleotide
gugucuccuuucucucuc

SEQ ID NO: 68008 - RNA, 18 nt, Artificial Sequence
  Description of Artificial Sequence: Synthetic oligonucleotide
gcagcgugucuccuuucu

SEQ ID NO: 68009 - RNA, 18 nt, Artificial Sequence
  Description of Artificial Sequence: Synthetic oligonucleotide
ccccugcagcgugucucc

SEQ ID NO: 68010 - RNA, 18 nt, Artificial Sequence
  Description of Artificial Sequence: Synthetic oligonucleotide
ccugcccccugcagcgug

SEQ ID NO: 68011 - RNA, 18 nt, Artificial Sequence
  Description of Artificial Sequence: Synthetic oligonucleotide
agcuuccugcccccugca

SEQ ID NO: 68012 - RNA, 18 nt, Artificial Sequence
  Description of Artificial Sequence: Synthetic oligonucleotide
cccccagcuuccugcccc

SEQ ID NO: 68013 - RNA, 18 nt, Artificial Sequence
  Description of Artificial Sequence: Synthetic oligonucleotide
ggguucccccagcuuccu

SEQ ID NO: 68014 - RNA, 18 nt, Artificial Sequence
  Description of Artificial Sequence: Synthetic oligonucleotide
agaauggguucccccagc

SEQ ID NO: 68015 - RNA, 18 nt, Artificial Sequence
  Description of Artificial Sequence: Synthetic oligonucleotide
uugggagaauggguuccc

SEQ ID NO: 68016 - RNA, 18 nt, Artificial Sequence
  Description of Artificial Sequence: Synthetic oligonucleotide
uauuuuugggagaauggg

SEQ ID NO: 68017 - RNA, 18 nt, Artificial Sequence
  Description of Artificial Sequence: Synthetic oligonucleotide
ccccuuauuuuugggaga

SEQ ID NO: 68018 - RNA, 18 nt, Artificial Sequence
  Description of Artificial Sequence: Synthetic oligonucleotide
ucagaccccuuauuuuug

SEQ ID NO: 68019 - RNA, 18 nt, Artificial Sequence
  Description of Artificial Sequence: Synthetic oligonucleotide
accccucagaccccuuau

SEQ ID NO: 68020 - RNA, 18 nt, Artificial Sequence
  Description of Artificial Sequence: Synthetic oligonucleotide
aauccaccccucagaccc

SEQ ID NO: 68021 - RNA, 18 nt, Artificial Sequence
  Description of Artificial Sequence: Synthetic oligonucleotide
cagggaauccaccccuca

SEQ ID NO: 68022 - RNA, 18 nt, Artificial Sequence
  Description of Artificial Sequence: Synthetic oligonucleotide
aaacccagggaauccacc

SEQ ID NO: 68023 - RNA, 18 nt, Artificial Sequence
  Description of Artificial Sequence: Synthetic oligonucleotide
gggagaauggguuccccc

SEQ ID NO: 68024 - RNA, 18 nt, Artificial Sequence
  Description of Artificial Sequence: Synthetic oligonucleotide
uuuuugggagaauggguu

SEQ ID NO: 68025 - RNA, 18 nt, Artificial Sequence
  Description of Artificial Sequence: Synthetic oligonucleotide
ccuuauuuuugggagaau

SEQ ID NO: 68026 - RNA, 18 nt, Artificial Sequence
  Description of Artificial Sequence: Synthetic oligonucleotide
agaccccuuauuuuuggg

SEQ ID NO: 68027 - RNA, 18 nt, Artificial Sequence
  Description of Artificial Sequence: Synthetic oligonucleotide
cccucagaccccuuauuu

SEQ ID NO: 68028 - RNA, 18 nt, Artificial Sequence
  Description of Artificial Sequence: Synthetic oligonucleotide
uccaccccucagaccccu

SEQ ID NO: 68029 - RNA, 18 nt, Artificial Sequence
  Description of Artificial Sequence: Synthetic oligonucleotide
gggaauccaccccucaga

SEQ ID NO: 68030 - RNA, 18 nt, Artificial Sequence
  Description of Artificial Sequence: Synthetic oligonucleotide
acccagggaauccacccc

SEQ ID NO: 68031 - RNA, 18 nt, Artificial Sequence
  Description of Artificial Sequence: Synthetic oligonucleotide
cugaaacccagggaaucc

SEQ ID NO: 68032 - RNA, 18 nt, Artificial Sequence
  Description of Artificial Sequence: Synthetic oligonucleotide
cagaccugaaacccaggg

SEQ ID NO: 68033 - RNA, 18 nt, Artificial Sequence
  Description of Artificial Sequence: Synthetic oligonucleotide
ggacccagaccugaaacc

SEQ ID NO: 68034 - RNA, 18 nt, Artificial Sequence
  Description of Artificial Sequence: Synthetic oligonucleotide
auucaggacccagaccug

SEQ ID NO: 68035 - RNA, 18 nt, Artificial Sequence
  Description of Artificial Sequence: Synthetic oligonucleotide
uucccauucaggacccag

SEQ ID NO: 68036 - RNA, 18 nt, Artificial Sequence
  Description of Artificial Sequence: Synthetic oligonucleotide
aggaauucccauucagga

SEQ ID NO: 68037 - RNA, 18 nt, Artificial Sequence
  Description of Artificial Sequence: Synthetic oligonucleotide
auuccaggaauucccauu

SEQ ID NO: 68038 - RNA, 18 nt, Artificial Sequence
  Description of Artificial Sequence: Synthetic oligonucleotide
cugguauuccaggaauuc

SEQ ID NO: 68039 - RNA, 18 nt, Artificial Sequence
  Description of Artificial Sequence: Synthetic oligonucleotide
gucagcugguauuccagg

SEQ ID NO: 68040 - RNA, 18 nt, Artificial Sequence
  Description of Artificial Sequence: Synthetic oligonucleotide
ucauugucagcugguauu

SEQ ID NO: 68041 - RNA, 18 nt, Artificial Sequence
  Description of Artificial Sequence: Synthetic oligonucleotide
ggaaaucauugucagcug

SEQ ID NO: 68042 - RNA, 18 nt, Artificial Sequence
  Description of Artificial Sequence: Synthetic oligonucleotide
gaggaggaaaucauuguc

SEQ ID NO: 68043 - RNA, 18 nt, Artificial Sequence
  Description of Artificial Sequence: Synthetic oligonucleotide
aagaugaggaggaaauca

SEQ ID NO: 68044 - RNA, 18 nt, Artificial Sequence
  Description of Artificial Sequence: Synthetic oligonucleotide
guugaaagaugaggagga

SEQ ID NO: 68045 - RNA, 18 nt, Artificial Sequence
  Description of Artificial Sequence: Synthetic oligonucleotide
gugagguugaaagaugag

SEQ ID NO: 68046 - RNA, 18 nt, Artificial Sequence
  Description of Artificial Sequence: Synthetic oligonucleotide
augaccacgaggagcaau

SEQ ID NO: 68047 - RNA, 18 nt, Artificial Sequence
  Description of Artificial Sequence: Synthetic oligonucleotide
gaagcaugaccacgagga

SEQ ID NO: 68048 - RNA, 18 nt, Artificial Sequence
  Description of Artificial Sequence: Synthetic oligonucleotide
uaggagaagcaugaccac

SEQ ID NO: 68049 - RNA, 18 nt, Artificial Sequence
  Description of Artificial Sequence: Synthetic oligonucleotide
gcaguuaggagaagcaug

SEQ ID NO: 68050 - RNA, 18 nt, Artificial Sequence
  Description of Artificial Sequence: Synthetic oligonucleotide
gccuugcaguuaggagaa

SEQ ID NO: 68051 - RNA, 18 nt, Artificial Sequence
  Description of Artificial Sequence: Synthetic oligonucleotide
cguuagccuugcaguuag

SEQ ID NO: 68052 - RNA, 18 nt, Artificial Sequence
  Description of Artificial Sequence: Synthetic oligonucleotide
gacagcguuagccuugca

SEQ ID NO: 68053 - RNA, 18 nt, Artificial Sequence
  Description of Artificial Sequence: Synthetic oligonucleotide
ggcuggacagcguuagcc

SEQ ID NO: 68054 - RNA, 18 nt, Artificial Sequence
  Description of Artificial Sequence: Synthetic oligonucleotide
agccgggcuggacagcgu

SEQ ID NO: 68055 - RNA, 18 nt, Artificial Sequence
  Description of Artificial Sequence: Synthetic oligonucleotide
ggaggagccgggcuggac

SEQ ID NO: 68056 - RNA, 18 nt, Artificial Sequence
  Description of Artificial Sequence: Synthetic oligonucleotide
aagcaggaggagccgggc

SEQ ID NO: 68057 - RNA, 18 nt, Artificial Sequence
  Description of Artificial Sequence: Synthetic oligonucleotide
gucacaagcaggaggagc

SEQ ID NO: 68058 - RNA, 18 nt, Artificial Sequence
  Description of Artificial Sequence: Synthetic oligonucleotide
cggaggucacaagcagga

SEQ ID NO: 68059 - RNA, 18 nt, Artificial Sequence
  Description of Artificial Sequence: Synthetic oligonucleotide
ggacucggaggucacaag

SEQ ID NO: 68060 - RNA, 18 nt, Artificial Sequence
  Description of Artificial Sequence: Synthetic oligonucleotide
acugaggacucggagguc

SEQ ID NO: 68061 - RNA, 18 nt, Artificial Sequence
  Description of Artificial Sequence: Synthetic oligonucleotide
aguuuacugaggacucgg

SEQ ID NO: 68062 - RNA, 18 nt, Artificial Sequence
  Description of Artificial Sequence: Synthetic oligonucleotide
gaagcaguuuacugagga

SEQ ID NO: 68063 - RNA, 18 nt, Artificial Sequence
  Description of Artificial Sequence: Synthetic oligonucleotide
gucacgaagcaguuuacu

SEQ ID NO: 68064 - RNA, 18 nt, Artificial Sequence
  Description of Artificial Sequence: Synthetic oligonucleotide
ugggagucacgaagcagu

SEQ ID NO: 68065 - RNA, 18 nt, Artificial Sequence
  Description of Artificial Sequence: Synthetic oligonucleotide
ggacaugggagucacgaa

SEQ ID NO: 68066 - RNA, 18 nt, Artificial Sequence
  Description of Artificial Sequence: Synthetic oligonucleotide
gugaaggacaugggaguc

SEQ ID NO: 68067 - RNA, 18 nt, Artificial Sequence
  Description of Artificial Sequence: Synthetic oligonucleotide
cugcugugaaggacaugg

SEQ ID NO: 68068 - RNA, 18 nt, Artificial Sequence
  Description of Artificial Sequence: Synthetic oligonucleotide
caugaccacgaggagcaa

SEQ ID NO: 68069 - RNA, 18 nt, Artificial Sequence
  Description of Artificial Sequence: Synthetic oligonucleotide
agaagcaugaccacgagg

SEQ ID NO: 68070 - RNA, 18 nt, Artificial Sequence
  Description of Artificial Sequence: Synthetic oligonucleotide
uuaggagaagcaugacca

SEQ ID NO: 68071 - RNA, 18 nt, Artificial Sequence
  Description of Artificial Sequence: Synthetic oligonucleotide
ugcaguuaggagaagcau

SEQ ID NO: 68072 - RNA, 18 nt, Artificial Sequence
  Description of Artificial Sequence: Synthetic oligonucleotide
agccuugcaguuaggaga

SEQ ID NO: 68073 - RNA, 18 nt, Artificial Sequence
  Description of Artificial Sequence: Synthetic oligonucleotide
gcguuagccuugcaguua

SEQ ID NO: 68074 - RNA, 18 nt, Artificial Sequence
  Description of Artificial Sequence: Synthetic oligonucleotide
ggacagcguuagccuugc

SEQ ID NO: 68075 - RNA, 18 nt, Artificial Sequence
  Description of Artificial Sequence: Synthetic oligonucleotide
gggcuggacagcguuagc

SEQ ID NO: 68076 - RNA, 18 nt, Artificial Sequence
  Description of Artificial Sequence: Synthetic oligonucleotide
gagccgggcuggacagcg

SEQ ID NO: 68077 - RNA, 18 nt, Artificial Sequence
  Description of Artificial Sequence: Synthetic oligonucleotide
aggaggagccgggcugga

SEQ ID NO: 68078 - RNA, 18 nt, Artificial Sequence
  Description of Artificial Sequence: Synthetic oligonucleotide
caagcaggaggagccggg

SEQ ID NO: 68079 - RNA, 18 nt, Artificial Sequence
  Description of Artificial Sequence: Synthetic oligonucleotide
ggucacaagcaggaggag

SEQ ID NO: 68080 - RNA, 18 nt, Artificial Sequence
  Description of Artificial Sequence: Synthetic oligonucleotide
ucggaggucacaagcagg

SEQ ID NO: 68081 - RNA, 18 nt, Artificial Sequence
  Description of Artificial Sequence: Synthetic oligonucleotide
aggacucggaggucacaa

SEQ ID NO: 68082 - RNA, 18 nt, Artificial Sequence
  Description of Artificial Sequence: Synthetic oligonucleotide
uacugaggacucggaggu

SEQ ID NO: 68083 - RNA, 18 nt, Artificial Sequence
  Description of Artificial Sequence: Synthetic oligonucleotide
caguuuacugaggacucg

SEQ ID NO: 68084 - RNA, 18 nt, Artificial Sequence
  Description of Artificial Sequence: Synthetic oligonucleotide
cgaagcaguuuacugagg

SEQ ID NO: 68085 - RNA, 18 nt, Artificial Sequence
  Description of Artificial Sequence: Synthetic oligonucleotide
agucacgaagcaguuuac

SEQ ID NO: 68086 - RNA, 18 nt, Artificial Sequence
  Description of Artificial Sequence: Synthetic oligonucleotide
augggagucacgaagcag

SEQ ID NO: 68087 - RNA, 18 nt, Artificial Sequence
  Description of Artificial Sequence: Synthetic oligonucleotide
aggacaugggagucacga

SEQ ID NO: 68088 - RNA, 18 nt, Artificial Sequence
  Description of Artificial Sequence: Synthetic oligonucleotide
ugugaaggacaugggagu

SEQ ID NO: 68089 - RNA, 18 nt, Artificial Sequence
  Description of Artificial Sequence: Synthetic oligonucleotide
ucugcugugaaggacaug

SEQ ID NO: 68090 - RNA, 18 nt, Artificial Sequence
  Description of Artificial Sequence: Synthetic oligonucleotide
gggauaauguugggaguu

SEQ ID NO: 68091 - RNA, 18 nt, Artificial Sequence
  Description of Artificial Sequence: Synthetic oligonucleotide
uaccaguuacgcggauaa

SEQ ID NO: 68092 - RNA, 18 nt, Artificial Sequence
  Description of Artificial Sequence: Synthetic oligonucleotide
ugucuuaccaguuacgcg

SEQ ID NO: 68093 - RNA, 18 nt, Artificial Sequence
  Description of Artificial Sequence: Synthetic oligonucleotide
augggugucuuaccaguu

SEQ ID NO: 68094 - RNA, 18 nt, Artificial Sequence
  Description of Artificial Sequence: Synthetic oligonucleotide
ggaguaugggugucuuac

SEQ ID NO: 68095 - RNA, 18 nt, Artificial Sequence
  Description of Artificial Sequence: Synthetic oligonucleotide
uccugggaguaugggugu

SEQ ID NO: 68096 - RNA, 18 nt, Artificial Sequence
  Description of Artificial Sequence: Synthetic oligonucleotide
ugucuuccugggaguaug

SEQ ID NO: 68097 - RNA, 18 nt, Artificial Sequence
  Description of Artificial Sequence: Synthetic oligonucleotide
gauggugucuuccuggga

SEQ ID NO: 68098 - RNA, 18 nt, Artificial Sequence
  Description of Artificial Sequence: Synthetic oligonucleotide
gaagugauggugucuucc

SEQ ID NO: 68099 - RNA, 18 nt, Artificial Sequence
  Description of Artificial Sequence: Synthetic oligonucleotide
uagaggaagugauggugu

SEQ ID NO: 68100 - RNA, 18 nt, Artificial Sequence
  Description of Artificial Sequence: Synthetic oligonucleotide
ggaguuagaggaagugau

SEQ ID NO: 68101 - RNA, 18 nt, Artificial Sequence
  Description of Artificial Sequence: Synthetic oligonucleotide
gucaaggaguuagaggaa

SEQ ID NO: 68102 - RNA, 18 nt, Artificial Sequence
  Description of Artificial Sequence: Synthetic oligonucleotide
auugggucaaggaguuag

SEQ ID NO: 68103 - RNA, 18 nt, Artificial Sequence
  Description of Artificial Sequence: Synthetic oligonucleotide
uagucauugggucaagga

SEQ ID NO: 68104 - RNA, 18 nt, Artificial Sequence
  Description of Artificial Sequence: Synthetic oligonucleotide
aagaauagucauuggguc

SEQ ID NO: 68105 - RNA, 18 nt, Artificial Sequence
  Description of Artificial Sequence: Synthetic oligonucleotide
augggaagaauagucauu

SEQ ID NO: 68106 - RNA, 18 nt, Artificial Sequence
  Description of Artificial Sequence: Synthetic oligonucleotide
acaauaugggaagaauag

SEQ ID NO: 68107 - RNA, 18 nt, Artificial Sequence
  Description of Artificial Sequence: Synthetic oligonucleotide
gggacaauaugggaagaa

SEQ ID NO: 68108 - RNA, 18 nt, Artificial Sequence
  Description of Artificial Sequence: Synthetic oligonucleotide
gugugaucaguagguggg

SEQ ID NO: 68109 - RNA, 18 nt, Artificial Sequence
  Description of Artificial Sequence: Synthetic oligonucleotide
agagagugugaucaguag

SEQ ID NO: 68110 - RNA, 18 nt, Artificial Sequence
  Description of Artificial Sequence: Synthetic oligonucleotide
uugucagagagugugauc

SEQ ID NO: 68111 - RNA, 18 nt, Artificial Sequence
  Description of Artificial Sequence: Synthetic oligonucleotide
aauccuugucagagagug

SEQ ID NO: 68112 - RNA, 18 nt, Artificial Sequence
  Description of Artificial Sequence: Synthetic oligonucleotide
agaauaauccuugucaga

SEQ ID NO: 68113 - RNA, 18 nt, Artificial Sequence
  Description of Artificial Sequence: Synthetic oligonucleotide
ugugaagaauaauccuug

SEQ ID NO: 68114 - RNA, 18 nt, Artificial Sequence
  Description of Artificial Sequence: Synthetic oligonucleotide
uguauugugaagaauaau

SEQ ID NO: 68115 - RNA, 18 nt, Artificial Sequence
  Description of Artificial Sequence: Synthetic oligonucleotide
cgggcuguauugugaaga

SEQ ID NO: 68116 - RNA, 18 nt, Artificial Sequence
  Description of Artificial Sequence: Synthetic oligonucleotide
gugugaucaguagguggg

SEQ ID NO: 68117 - RNA, 18 nt, Artificial Sequence
  Description of Artificial Sequence: Synthetic oligonucleotide
gagagugugaucaguagg

SEQ ID NO: 68118 - RNA, 18 nt, Artificial Sequence
  Description of Artificial Sequence: Synthetic oligonucleotide
ugucagagagugugauca

SEQ ID NO: 68119 - RNA, 18 nt, Artificial Sequence
  Description of Artificial Sequence: Synthetic oligonucleotide
auccuugucagagagugu

SEQ ID NO: 68120 - RNA, 18 nt, Artificial Sequence
  Description of Artificial Sequence: Synthetic oligonucleotide
gaauaauccuugucagag

SEQ ID NO: 68121 - RNA, 18 nt, Artificial Sequence
  Description of Artificial Sequence: Synthetic oligonucleotide
gugaagaauaauccuugu

SEQ ID NO: 68122 - RNA, 18 nt, Artificial Sequence
  Description of Artificial Sequence: Synthetic oligonucleotide
guauugugaagaauaauc

SEQ ID NO: 68123 - RNA, 18 nt, Artificial Sequence
  Description of Artificial Sequence: Synthetic oligonucleotide
gggcuguauugugaagaa

SEQ ID NO: 68124 - RNA, 18 nt, Artificial Sequence
  Description of Artificial Sequence: Synthetic oligonucleotide
aaugcgggcuguauugug

SEQ ID NO: 68125 - RNA, 18 nt, Artificial Sequence
  Description of Artificial Sequence: Synthetic oligonucleotide
uuuuaaaugcgggcugua

SEQ ID NO: 68126 - RNA, 18 nt, Artificial Sequence
  Description of Artificial Sequence: Synthetic oligonucleotide
agagcuuuuaaaugcggg

SEQ ID NO: 68127 - RNA, 18 nt, Artificial Sequence
  Description of Artificial Sequence: Synthetic oligonucleotide
agacgagagcuuuuaaau

SEQ ID NO: 68128 - RNA, 18 nt, Artificial Sequence
  Description of Artificial Sequence: Synthetic oligonucleotide
ucucuagacgagagcuuu

SEQ ID NO: 68129 - RNA, 18 nt, Artificial Sequence
  Description of Artificial Sequence: Synthetic oligonucleotide
uacuaucucuagacgaga

SEQ ID NO: 68130 - RNA, 18 nt, Artificial Sequence
  Description of Artificial Sequence: Synthetic oligonucleotide
augaguacuaucucuaga

SEQ ID NO: 68131 - RNA, 18 nt, Artificial Sequence
  Description of Artificial Sequence: Synthetic oligonucleotide
ccuccaugaguacuaucu

SEQ ID NO: 68132 - RNA, 18 nt, Artificial Sequence
  Description of Artificial Sequence: Synthetic oligonucleotide
cuaguccuccaugaguac

SEQ ID NO: 68133 - RNA, 18 nt, Artificial Sequence
  Description of Artificial Sequence: Synthetic oligonucleotide
gcaggcuaguccuccaug

SEQ ID NO: 68134 - RNA, 18 nt, Artificial Sequence
  Description of Artificial Sequence: Synthetic oligonucleotide
aauaagcaggcuaguccu

SEQ ID NO: 68135 - RNA, 18 nt, Artificial Sequence
  Description of Artificial Sequence: Synthetic oligonucleotide
agccuaauaagcaggcua

SEQ ID NO: 68136 - RNA, 18 nt, Artificial Sequence
  Description of Artificial Sequence: Synthetic oligonucleotide
augguagccuaauaagca

SEQ ID NO: 68137 - RNA, 18 nt, Artificial Sequence
  Description of Artificial Sequence: Synthetic oligonucleotide
gagcuaugguagccuaau

SEQ ID NO: 68138 - RNA, 18 nt, Artificial Sequence
  Description of Artificial Sequence: Synthetic oligonucleotide
agagagagcuaugguagc

SEQ ID NO: 68139 - RNA, 18 nt, Artificial Sequence
  Description of Artificial Sequence: Synthetic oligonucleotide
gaaauagagagagcuaug

SEQ ID NO: 68140 - RNA, 18 nt, Artificial Sequence
  Description of Artificial Sequence: Synthetic oligonucleotide
gagcugaaauagagagag

SEQ ID NO: 68141 - RNA, 18 nt, Artificial Sequence
  Description of Artificial Sequence: Synthetic oligonucleotide
gaagggagcugaaauaga

SEQ ID NO: 68142 - RNA, 18 nt, Artificial Sequence
  Description of Artificial Sequence: Synthetic oligonucleotide
gaaccucugggcacuggc

SEQ ID NO: 68143 - RNA, 18 nt, Artificial Sequence
  Description of Artificial Sequence: Synthetic oligonucleotide
agggugaaccucugggca

SEQ ID NO: 68144 - RNA, 18 nt, Artificial Sequence
  Description of Artificial Sequence: Synthetic oligonucleotide
ggcaaagggugaaccucu

SEQ ID NO: 68145 - RNA, 18 nt, Artificial Sequence
  Description of Artificial Sequence: Synthetic oligonucleotide
guguaggcaaagggugaa

SEQ ID NO: 68146 - RNA, 18 nt, Artificial Sequence
  Description of Artificial Sequence: Synthetic oligonucleotide
gacagguguaggcaaagg

SEQ ID NO: 68147 - RNA, 18 nt, Artificial Sequence
  Description of Artificial Sequence: Synthetic oligonucleotide
agcaggacagguguaggc

SEQ ID NO: 68148 - RNA, 18 nt, Artificial Sequence
  Description of Artificial Sequence: Synthetic oligonucleotide
caggcagcaggacaggug

SEQ ID NO: 68149 - RNA, 18 nt, Artificial Sequence
  Description of Artificial Sequence: Synthetic oligonucleotide
cacagcaggcagcaggac

SEQ ID NO: 68150 - RNA, 18 nt, Artificial Sequence
  Description of Artificial Sequence: Synthetic oligonucleotide
aaguccacagcaggcagc

SEQ ID NO: 68151 - RNA, 18 nt, Artificial Sequence
  Description of Artificial Sequence: Synthetic oligonucleotide
agcuaaaguccacagcag

SEQ ID NO: 68152 - RNA, 18 nt, Artificial Sequence
  Description of Artificial Sequence: Synthetic oligonucleotide
ucccaagcuaaaguccac

SEQ ID NO: 68153 - RNA, 18 nt, Artificial Sequence
  Description of Artificial Sequence: Synthetic oligonucleotide
cauucucccaagcuaaag

SEQ ID NO: 68154 - RNA, 18 nt, Artificial Sequence
  Description of Artificial Sequence: Synthetic oligonucleotide
uuuuccauucucccaagc

SEQ ID NO: 68155 - RNA, 18 nt, Artificial Sequence
  Description of Artificial Sequence: Synthetic oligonucleotide
cuggguuuuccauucucc

SEQ ID NO: 68156 - RNA, 18 nt, Artificial Sequence
  Description of Artificial Sequence: Synthetic oligonucleotide
gaaccucugggcacuggc

SEQ ID NO: 68157 - RNA, 18 nt, Artificial Sequence
  Description of Artificial Sequence: Synthetic oligonucleotide
agggugaaccucugggca

SEQ ID NO: 68158 - RNA, 18 nt, Artificial Sequence
  Description of Artificial Sequence: Synthetic oligonucleotide
ggcaaagggugaaccucu

SEQ ID NO: 68159 - RNA, 18 nt, Artificial Sequence
  Description of Artificial Sequence: Synthetic oligonucleotide
guguaggcaaagggugaa

SEQ ID NO: 68160 - RNA, 18 nt, Artificial Sequence
  Description of Artificial Sequence: Synthetic oligonucleotide
gacagguguaggcaaagg

SEQ ID NO: 68161 - RNA, 18 nt, Artificial Sequence
  Description of Artificial Sequence: Synthetic oligonucleotide
agcaggacagguguaggc

SEQ ID NO: 68162 - RNA, 18 nt, Artificial Sequence
  Description of Artificial Sequence: Synthetic oligonucleotide
caggcagcaggacaggug

SEQ ID NO: 68163 - RNA, 18 nt, Artificial Sequence
  Description of Artificial Sequence: Synthetic oligonucleotide
cacagcaggcagcaggac

SEQ ID NO: 68164 - RNA, 18 nt, Artificial Sequence
  Description of Artificial Sequence: Synthetic oligonucleotide
aaguccacagcaggcagc

SEQ ID NO: 68165 - RNA, 18 nt, Artificial Sequence
  Description of Artificial Sequence: Synthetic oligonucleotide
agcuaaaguccacagcag

SEQ ID NO: 68166 - RNA, 18 nt, Artificial Sequence
  Description of Artificial Sequence: Synthetic oligonucleotide
ucccaagcuaaaguccac

SEQ ID NO: 68167 - RNA, 18 nt, Artificial Sequence
  Description of Artificial Sequence: Synthetic oligonucleotide
cauucucccaagcuaaag

SEQ ID NO: 68168 - RNA, 18 nt, Artificial Sequence
  Description of Artificial Sequence: Synthetic oligonucleotide
uuuuccauucucccaagc

SEQ ID NO: 68169 - RNA, 18 nt, Artificial Sequence
  Description of Artificial Sequence: Synthetic oligonucleotide
cuggguuuuccauucucc

SEQ ID NO: 68170 - RNA, 18 nt, Artificial Sequence
  Description of Artificial Sequence: Synthetic oligonucleotide
aagguuagggauggcuuu

SEQ ID NO: 68171 - RNA, 18 nt, Artificial Sequence
  Description of Artificial Sequence: Synthetic oligonucleotide
aagccaagguuagggaug

SEQ ID NO: 68172 - RNA, 18 nt, Artificial Sequence
  Description of Artificial Sequence: Synthetic oligonucleotide
uagggaagccaagguuag

SEQ ID NO: 68173 - RNA, 18 nt, Artificial Sequence
  Description of Artificial Sequence: Synthetic oligonucleotide
ggacuuagggaagccaag

SEQ ID NO: 68174 - RNA, 18 nt, Artificial Sequence
  Description of Artificial Sequence: Synthetic oligonucleotide
agacaggacuuagggaag

SEQ ID NO: 68175 - RNA, 18 nt, Artificial Sequence
  Description of Artificial Sequence: Synthetic oligonucleotide
acugaagacaggacuuag

SEQ ID NO: 68176 - RNA, 18 nt, Artificial Sequence
  Description of Artificial Sequence: Synthetic oligonucleotide
gggaaacugaagacagga

SEQ ID NO: 68177 - RNA, 18 nt, Artificial Sequence
  Description of Artificial Sequence: Synthetic oligonucleotide
gcagugggaaacugaaga

SEQ ID NO: 68178 - RNA, 18 nt, Artificial Sequence
  Description of Artificial Sequence: Synthetic oligonucleotide
gggaagcagugggaaacu

SEQ ID NO: 68179 - RNA, 18 nt, Artificial Sequence
  Description of Artificial Sequence: Synthetic oligonucleotide
uccaugggaagcaguggg

SEQ ID NO: 68180 - RNA, 18 nt, Artificial Sequence
  Description of Artificial Sequence: Synthetic oligonucleotide
gagaauccaugggaagca

SEQ ID NO: 68181 - RNA, 18 nt, Artificial Sequence
  Description of Artificial Sequence: Synthetic oligonucleotide
uguuggagaauccauggg

SEQ ID NO: 68182 - RNA, 18 nt, Artificial Sequence
  Description of Artificial Sequence: Synthetic oligonucleotide
aagaauguuggagaaucc

SEQ ID NO: 68183 - RNA, 18 nt, Artificial Sequence
  Description of Artificial Sequence: Synthetic oligonucleotide
agcucaagaauguuggag

SEQ ID NO: 68184 - RNA, 18 nt, Artificial Sequence
  Description of Artificial Sequence: Synthetic oligonucleotide
uaaaaagcucaagaaugu

SEQ ID NO: 68185 - RNA, 18 nt, Artificial Sequence
  Description of Artificial Sequence: Synthetic oligonucleotide
auuuuuaaaaagcucaag

SEQ ID NO: 68186 - RNA, 18 nt, Artificial Sequence
  Description of Artificial Sequence: Synthetic oligonucleotide
gagauauuuuuaaaaagc

SEQ ID NO: 68187 - RNA, 18 nt, Artificial Sequence
  Description of Artificial Sequence: Synthetic oligonucleotide
aaggugagauauuuuuaa

SEQ ID NO: 68188 - RNA, 18 nt, Artificial Sequence
  Description of Artificial Sequence: Synthetic oligonucleotide
agcugaaggugagauauu

SEQ ID NO: 68189 - RNA, 18 nt, Artificial Sequence
  Description of Artificial Sequence: Synthetic oligonucleotide
ggccaagcugaaggugag

SEQ ID NO: 68190 - RNA, 18 nt, Artificial Sequence
  Description of Artificial Sequence: Synthetic oligonucleotide
aggguggccaagcugaag

SEQ ID NO: 68191 - RNA, 18 nt, Artificial Sequence
  Description of Artificial Sequence: Synthetic oligonucleotide
ggguuaggguggccaagc

SEQ ID NO: 68192 - RNA, 18 nt, Artificial Sequence
  Description of Artificial Sequence: Synthetic oligonucleotide
agauuggguuaggguggc

SEQ ID NO: 68193 - RNA, 18 nt, Artificial Sequence
  Description of Artificial Sequence: Synthetic oligonucleotide
aauguagauuggguuagg

SEQ ID NO: 68194 - RNA, 18 nt, Artificial Sequence
  Description of Artificial Sequence: Synthetic oligonucleotide
aggugaauguagauuggg

SEQ ID NO: 68195 - RNA, 18 nt, Artificial Sequence
  Description of Artificial Sequence: Synthetic oligonucleotide
aucauaggugaauguaga

SEQ ID NO: 68196 - RNA, 18 nt, Artificial Sequence
  Description of Artificial Sequence: Synthetic oligonucleotide
cuaucaucauaggugaau

SEQ ID NO: 68197 - RNA, 18 nt, Artificial Sequence
  Description of Artificial Sequence: Synthetic oligonucleotide
acaggcuaucaucauagg

SEQ ID NO: 68198 - RNA, 18 nt, Artificial Sequence
  Description of Artificial Sequence: Synthetic oligonucleotide
uauccacaggcuaucauc

SEQ ID NO: 68199 - RNA, 18 nt, Artificial Sequence
  Description of Artificial Sequence: Synthetic oligonucleotide
caucuuauccacaggcua

SEQ ID NO: 68200 - RNA, 18 nt, Artificial Sequence
  Description of Artificial Sequence: Synthetic oligonucleotide
gccaucaucuuauccaca

SEQ ID NO: 68201 - RNA, 18 nt, Artificial Sequence
  Description of Artificial Sequence: Synthetic oligonucleotide
ugcaagccaucaucuuau

SEQ ID NO: 68202 - RNA, 18 nt, Artificial Sequence
  Description of Artificial Sequence: Synthetic oligonucleotide
ggaccugcaagccaucau

SEQ ID NO: 68203 - RNA, 18 nt, Artificial Sequence
  Description of Artificial Sequence: Synthetic oligonucleotide
auauuggaccugcaagcc

SEQ ID NO: 68204 - RNA, 18 nt, Artificial Sequence
  Description of Artificial Sequence: Synthetic oligonucleotide
uucacauauuggaccugc

SEQ ID NO: 68205 - RNA, 18 nt, Artificial Sequence
  Description of Artificial Sequence: Synthetic oligonucleotide
aucuauucacauauugga

SEQ ID NO: 68206 - RNA, 18 nt, Artificial Sequence
  Description of Artificial Sequence: Synthetic oligonucleotide
uucaaaucuauucacaua

SEQ ID NO: 68207 - RNA, 18 nt, Artificial Sequence
  Description of Artificial Sequence: Synthetic oligonucleotide
ucagcuucaaaucuauuc

SEQ ID NO: 68208 - RNA, 18 nt, Artificial Sequence
  Description of Artificial Sequence: Synthetic oligonucleotide
gguguucagcuucaaauc

SEQ ID NO: 68209 - RNA, 18 nt, Artificial Sequence
  Description of Artificial Sequence: Synthetic oligonucleotide
uucaugguguucagcuuc

SEQ ID NO: 68210 - RNA, 18 nt, Artificial Sequence
  Description of Artificial Sequence: Synthetic oligonucleotide
agcuuuucaugguguuca

SEQ ID NO: 68211 - RNA, 18 nt, Artificial Sequence
  Description of Artificial Sequence: Synthetic oligonucleotide
ucuccagcuuuucauggu

SEQ ID NO: 68212 - RNA, 18 nt, Artificial Sequence
  Description of Artificial Sequence: Synthetic oligonucleotide
auuucucuccagcuuuuc

SEQ ID NO: 68213 - RNA, 18 nt, Artificial Sequence
  Description of Artificial Sequence: Synthetic oligonucleotide
gagcgauuucucuccagc

SEQ ID NO: 68214 - RNA, 18 nt, Artificial Sequence
  Description of Artificial Sequence: Synthetic oligonucleotide
gccaugagcgauuucucu

SEQ ID NO: 68215 - RNA, 18 nt, Artificial Sequence
  Description of Artificial Sequence: Synthetic oligonucleotide
gcauggccaugagcgauu

SEQ ID NO: 68216 - RNA, 18 nt, Artificial Sequence
  Description of Artificial Sequence: Synthetic oligonucleotide
caaaggcauggccaugag

SEQ ID NO: 68217 - RNA, 18 nt, Artificial Sequence
  Description of Artificial Sequence: Synthetic oligonucleotide
uaggucaaaggcauggcc

SEQ ID NO: 68218 - RNA, 18 nt, Artificial Sequence
  Description of Artificial Sequence: Synthetic oligonucleotide
gggaauaggucaaaggca

SEQ ID NO: 68219 - RNA, 18 nt, Artificial Sequence
  Description of Artificial Sequence: Synthetic oligonucleotide
ugaacgggaauaggucaa

SEQ ID NO: 68220 - RNA, 18 nt, Artificial Sequence
  Description of Artificial Sequence: Synthetic oligonucleotide
aagacugaacgggaauag

SEQ ID NO: 68221 - RNA, 18 nt, Artificial Sequence
  Description of Artificial Sequence: Synthetic oligonucleotide
uuaagaagacugaacggg

SEQ ID NO: 68222 - RNA, 18 nt, Artificial Sequence
  Description of Artificial Sequence: Synthetic oligonucleotide
ccaauuuaagaagacuga

SEQ ID NO: 68223 - RNA, 18 nt, Artificial Sequence
  Description of Artificial Sequence: Synthetic oligonucleotide
ucaugccaauuuaagaag

SEQ ID NO: 68224 - RNA, 18 nt, Artificial Sequence
  Description of Artificial Sequence: Synthetic oligonucleotide
cuucuucaugccaauuua

SEQ ID NO: 68225 - RNA, 18 nt, Artificial Sequence
  Description of Artificial Sequence: Synthetic oligonucleotide
ucuugcuucuucaugcca

SEQ ID NO: 68226 - RNA, 18 nt, Artificial Sequence
  Description of Artificial Sequence: Synthetic oligonucleotide
augagucuugcuucuuca

SEQ ID NO: 68227 - RNA, 18 nt, Artificial Sequence
  Description of Artificial Sequence: Synthetic oligonucleotide
gacauaugagucuugcuu

SEQ ID NO: 68228 - RNA, 18 nt, Artificial Sequence
  Description of Artificial Sequence: Synthetic oligonucleotide
uggaugacauaugagucu

SEQ ID NO: 68229 - RNA, 18 nt, Artificial Sequence
  Description of Artificial Sequence: Synthetic oligonucleotide
aucuguggaugacauaug

SEQ ID NO: 68230 - RNA, 18 nt, Artificial Sequence
  Description of Artificial Sequence: Synthetic oligonucleotide
gugucaucuguggaugac

SEQ ID NO: 68231 - RNA, 18 nt, Artificial Sequence
  Description of Artificial Sequence: Synthetic oligonucleotide
gcuuugugucaucugugg

SEQ ID NO: 68232 - RNA, 18 nt, Artificial Sequence
  Description of Artificial Sequence: Synthetic oligonucleotide
ucccagcuuugugucauc

SEQ ID NO: 68233 - RNA, 18 nt, Artificial Sequence
  Description of Artificial Sequence: Synthetic oligonucleotide
guacuucccagcuuugug

SEQ ID NO: 68234 - RNA, 18 nt, Artificial Sequence
  Description of Artificial Sequence: Synthetic oligonucleotide
uagugguacuucccagcu

SEQ ID NO: 68235 - RNA, 18 nt, Artificial Sequence
  Description of Artificial Sequence: Synthetic oligonucleotide
uauuuuagugguacuucc

SEQ ID NO: 68236 - RNA, 18 nt, Artificial Sequence
  Description of Artificial Sequence: Synthetic oligonucleotide
uuuguuauuuuaguggua

SEQ ID NO: 68237 - RNA, 18 nt, Artificial Sequence
  Description of Artificial Sequence: Synthetic oligonucleotide
agucuuuuguuauuuuag

SEQ ID NO: 68238 - RNA, 18 nt, Artificial Sequence
  Description of Artificial Sequence: Synthetic oligonucleotide
gauucagucuuuuguuau

SEQ ID NO: 68239 - RNA, 18 nt, Artificial Sequence
  Description of Artificial Sequence: Synthetic oligonucleotide
aucuugauucagucuuuu

SEQ ID NO: 68240 - RNA, 18 nt, Artificial Sequence
  Description of Artificial Sequence: Synthetic oligonucleotide
uuugaaucuugauucagu

SEQ ID NO: 68241 - RNA, 18 nt, Artificial Sequence
  Description of Artificial Sequence: Synthetic oligonucleotide
agugauuugaaucuugau

SEQ ID NO: 68242 - RNA, 18 nt, Artificial Sequence
  Description of Artificial Sequence: Synthetic oligonucleotide
cuuucagugauuugaauc

SEQ ID NO: 68243 - RNA, 18 nt, Artificial Sequence
  Description of Artificial Sequence: Synthetic oligonucleotide
cuagucuuucagugauuu

SEQ ID NO: 68244 - RNA, 18 nt, Artificial Sequence
  Description of Artificial Sequence: Synthetic oligonucleotide
uugaccuagucuuucagu

SEQ ID NO: 68245 - RNA, 18 nt, Artificial Sequence
  Description of Artificial Sequence: Synthetic oligonucleotide
uguuuuugaccuagucuu

SEQ ID NO: 68246 - RNA, 18 nt, Artificial Sequence
  Description of Artificial Sequence: Synthetic oligonucleotide
caccuuguuuuugaccua

SEQ ID NO: 68247 - RNA, 18 nt, Artificial Sequence
  Description of Artificial Sequence: Synthetic oligonucleotide
uguuucaccuuguuuuug

SEQ ID NO: 68248 - RNA, 18 nt, Artificial Sequence
  Description of Artificial Sequence: Synthetic oligonucleotide
ucuguuguuucaccuugu

SEQ ID NO: 68249 - RNA, 18 nt, Artificial Sequence
  Description of Artificial Sequence: Synthetic oligonucleotide
auaucucuguuguuucac

SEQ ID NO: 68250 - RNA, 18 nt, Artificial Sequence
  Description of Artificial Sequence: Synthetic oligonucleotide
aguuuauaucucuguugu

SEQ ID NO: 68251 - RNA, 18 nt, Artificial Sequence
  Description of Artificial Sequence: Synthetic oligonucleotide
guagaaguuuauaucucu

SEQ ID NO: 68252 - RNA, 18 nt, Artificial Sequence
  Description of Artificial Sequence: Synthetic oligonucleotide
cacauguagaaguuuaua

SEQ ID NO: 68253 - RNA, 18 nt, Artificial Sequence
  Description of Artificial Sequence: Synthetic oligonucleotide
cggcccacauguagaagu

SEQ ID NO: 68254 - RNA, 18 nt, Artificial Sequence
  Description of Artificial Sequence: Synthetic oligonucleotide
gcccccggcccacaugua

SEQ ID NO: 68255 - RNA, 18 nt, Artificial Sequence
  Description of Artificial Sequence: Synthetic oligonucleotide
cgugagcccccggcccac

SEQ ID NO: 68256 - RNA, 18 nt, Artificial Sequence
  Description of Artificial Sequence: Synthetic oligonucleotide
acaggcgugagcccccgg

SEQ ID NO: 68257 - RNA, 18 nt, Artificial Sequence
  Description of Artificial Sequence: Synthetic oligonucleotide
ggauuacaggcgugagcc

SEQ ID NO: 68258 - RNA, 18 nt, Artificial Sequence
  Description of Artificial Sequence: Synthetic oligonucleotide
ugcugggauuacaggcgu

SEQ ID NO: 68259 - RNA, 18 nt, Artificial Sequence
  Description of Artificial Sequence: Synthetic oligonucleotide
caaagugcugggauuaca

SEQ ID NO: 68260 - RNA, 18 nt, Artificial Sequence
  Description of Artificial Sequence: Synthetic oligonucleotide
ccucccaaagugcuggga

SEQ ID NO: 68261 - RNA, 18 nt, Artificial Sequence
  Description of Artificial Sequence: Synthetic oligonucleotide
cucggccucccaaagugc

SEQ ID NO: 68262 - RNA, 18 nt, Artificial Sequence
  Description of Artificial Sequence: Synthetic oligonucleotide
ccugccucggccucccaa

SEQ ID NO: 68263 - RNA, 18 nt, Artificial Sequence
  Description of Artificial Sequence: Synthetic oligonucleotide
aucugccugccucggccu

SEQ ID NO: 68264 - RNA, 18 nt, Artificial Sequence
  Description of Artificial Sequence: Synthetic oligonucleotide
aggugaucugccugccuc

SEQ ID NO: 68265 - RNA, 18 nt, Artificial Sequence
  Description of Artificial Sequence: Synthetic oligonucleotide
cccucaggugaucugccu

SEQ ID NO: 68266 - RNA, 18 nt, Artificial Sequence
  Description of Artificial Sequence: Synthetic oligonucleotide
uccugcccucaggugauc

SEQ ID NO: 68267 - RNA, 18 nt, Artificial Sequence
  Description of Artificial Sequence: Synthetic oligonucleotide
caaacuccugcccucagg

SEQ ID NO: 68268 - RNA, 18 nt, Artificial Sequence
  Description of Artificial Sequence: Synthetic oligonucleotide
gcucucaaacuccugccc

SEQ ID NO: 68269 - RNA, 18 nt, Artificial Sequence
  Description of Artificial Sequence: Synthetic oligonucleotide
gcugggcauggugguggg

SEQ ID NO: 68270 - RNA, 18 nt, Artificial Sequence
  Description of Artificial Sequence: Synthetic oligonucleotide
aauuagcugggcauggug

SEQ ID NO: 68271 - RNA, 18 nt, Artificial Sequence
  Description of Artificial Sequence: Synthetic oligonucleotide
acaaaaauuagcugggca

SEQ ID NO: 68272 - RNA, 18 nt, Artificial Sequence
  Description of Artificial Sequence: Synthetic oligonucleotide
aaaauacaaaaauuagcu

SEQ ID NO: 68273 - RNA, 18 nt, Artificial Sequence
  Description of Artificial Sequence: Synthetic oligonucleotide
uaccaaaaauacaaaaau

SEQ ID NO: 68274 - RNA, 18 nt, Artificial Sequence
  Description of Artificial Sequence: Synthetic oligonucleotide
aucucuaccaaaaauaca

SEQ ID NO: 68275 - RNA, 18 nt, Artificial Sequence
  Description of Artificial Sequence: Synthetic oligonucleotide
accccaucucuaccaaaa

SEQ ID NO: 68276 - RNA, 18 nt, Artificial Sequence
  Description of Artificial Sequence: Synthetic oligonucleotide
gugaaaccccaucucuac

SEQ ID NO: 68277 - RNA, 18 nt, Artificial Sequence
  Description of Artificial Sequence: Synthetic oligonucleotide
acauggugaaaccccauc

SEQ ID NO: 68278 - RNA, 18 nt, Artificial Sequence
  Description of Artificial Sequence: Synthetic oligonucleotide
ggccaacauggugaaacc

SEQ ID NO: 68279 - RNA, 18 nt, Artificial Sequence
  Description of Artificial Sequence: Synthetic oligonucleotide
agccuggccaacauggug

SEQ ID NO: 68280 - RNA, 18 nt, Artificial Sequence
  Description of Artificial Sequence: Synthetic oligonucleotide
agaucagccuggccaaca

SEQ ID NO: 68281 - RNA, 18 nt, Artificial Sequence
  Description of Artificial Sequence: Synthetic oligonucleotide
guucaagaucagccuggc

SEQ ID NO: 68282 - RNA, 18 nt, Artificial Sequence
  Description of Artificial Sequence: Synthetic oligonucleotide
caggaguucaagaucagc

SEQ ID NO: 68283 - RNA, 18 nt, Artificial Sequence
  Description of Artificial Sequence: Synthetic oligonucleotide
gaggucaggaguucaaga

SEQ ID NO: 68284 - RNA, 18 nt, Artificial Sequence
  Description of Artificial Sequence: Synthetic oligonucleotide
caccugaggucaggaguu

SEQ ID NO: 68285 - RNA, 18 nt, Artificial Sequence
  Description of Artificial Sequence: Synthetic oligonucleotide
uggaucaccugaggucag

SEQ ID NO: 68286 - RNA, 18 nt, Artificial Sequence
  Description of Artificial Sequence: Synthetic oligonucleotide
gcagguggaucaccugag

SEQ ID NO: 68287 - RNA, 18 nt, Artificial Sequence
  Description of Artificial Sequence: Synthetic oligonucleotide
cugaggcagguggaucac

SEQ ID NO: 68288 - RNA, 18 nt, Artificial Sequence
  Description of Artificial Sequence: Synthetic oligonucleotide
ggaggcugaggcaggugg

SEQ ID NO: 68289 - RNA, 18 nt, Artificial Sequence
  Description of Artificial Sequence: Synthetic oligonucleotide
cuuugggaggcugaggca

SEQ ID NO: 68290 - RNA, 18 nt, Artificial Sequence
  Description of Artificial Sequence: Synthetic oligonucleotide
cagcacuuugggaggcug

SEQ ID NO: 68291 - RNA, 18 nt, Artificial Sequence
  Description of Artificial Sequence: Synthetic oligonucleotide
aaucccagcacuuuggga

SEQ ID NO: 68292 - RNA, 18 nt, Artificial Sequence
  Description of Artificial Sequence: Synthetic oligonucleotide
ccuguaaucccagcacuu

SEQ ID NO: 68293 - RNA, 18 nt, Artificial Sequence
  Description of Artificial Sequence: Synthetic oligonucleotide
ucacgccuguaaucccag

SEQ ID NO: 68294 - RNA, 18 nt, Artificial Sequence
  Description of Artificial Sequence: Synthetic oligonucleotide
guggcucacgccuguaau

SEQ ID NO: 68295 - RNA, 18 nt, Artificial Sequence
  Description of Artificial Sequence: Synthetic oligonucleotide
gugcaguggcucacgccu

SEQ ID NO: 68296 - RNA, 18 nt, Artificial Sequence
  Description of Artificial Sequence: Synthetic oligonucleotide
gcugggugcaguggcuca

SEQ ID NO: 68297 - RNA, 18 nt, Artificial Sequence
  Description of Artificial Sequence: Synthetic oligonucleotide
ugaaggcugggugcagug

SEQ ID NO: 68298 - RNA, 18 nt, Artificial Sequence
  Description of Artificial Sequence: Synthetic oligonucleotide
cugaaugaaggcugggug

SEQ ID NO: 68299 - RNA, 18 nt, Artificial Sequence
  Description of Artificial Sequence: Synthetic oligonucleotide
uuaaacugaaugaaggcu

SEQ ID NO: 68300 - RNA, 18 nt, Artificial Sequence
  Description of Artificial Sequence: Synthetic oligonucleotide
gauuuuuaaacugaauga

SEQ ID NO: 68301 - RNA, 18 nt, Artificial Sequence
  Description of Artificial Sequence: Synthetic oligonucleotide
cauuugauuuuuaaacug

SEQ ID NO: 68302 - RNA, 18 nt, Artificial Sequence
  Description of Artificial Sequence: Synthetic oligonucleotide
aggaucauuugauuuuua

SEQ ID NO: 68303 - RNA, 18 nt, Artificial Sequence
  Description of Artificial Sequence: Synthetic oligonucleotide
accuuaggaucauuugau

SEQ ID NO: 68304 - RNA, 18 nt, Artificial Sequence
  Description of Artificial Sequence: Synthetic oligonucleotide
gcaaaaccuuaggaucau

SEQ ID NO: 68305 - RNA, 18 nt, Artificial Sequence
  Description of Artificial Sequence: Synthetic oligonucleotide
cugcugcaaaaccuuagg

SEQ ID NO: 68306 - RNA, 18 nt, Artificial Sequence
  Description of Artificial Sequence: Synthetic oligonucleotide
ucuuucugcugcaaaacc

SEQ ID NO: 68307 - RNA, 18 nt, Artificial Sequence
  Description of Artificial Sequence: Synthetic oligonucleotide
uuuacucuuucugcugca

SEQ ID NO: 68308 - RNA, 18 nt, Artificial Sequence
  Description of Artificial Sequence: Synthetic oligonucleotide
gcaaauuuacucuuucug

SEQ ID NO: 68309 - RNA, 18 nt, Artificial Sequence
  Description of Artificial Sequence: Synthetic oligonucleotide
gugcugcaaauuuacucu

SEQ ID NO: 68310 - RNA, 18 nt, Artificial Sequence
  Description of Artificial Sequence: Synthetic oligonucleotide
uucuagugcugcaaauuu

SEQ ID NO: 68311 - RNA, 18 nt, Artificial Sequence
  Description of Artificial Sequence: Synthetic oligonucleotide
cuugguucuagugcugca

SEQ ID NO: 68312 - RNA, 18 nt, Artificial Sequence
  Description of Artificial Sequence: Synthetic oligonucleotide
uaccucuugguucuagug

SEQ ID NO: 68313 - RNA, 18 nt, Artificial Sequence
  Description of Artificial Sequence: Synthetic oligonucleotide
gcuuuuaccucuugguuc

SEQ ID NO: 68314 - RNA, 18 nt, Artificial Sequence
  Description of Artificial Sequence: Synthetic oligonucleotide
uuacagcuuuuaccucuu

SEQ ID NO: 68315 - RNA, 18 nt, Artificial Sequence
  Description of Artificial Sequence: Synthetic oligonucleotide
cccuguuacagcuuuuac

SEQ ID NO: 68316 - RNA, 18 nt, Artificial Sequence
  Description of Artificial Sequence: Synthetic oligonucleotide
aucugcccuguuacagcu

SEQ ID NO: 68317 - RNA, 18 nt, Artificial Sequence
  Description of Artificial Sequence: Synthetic oligonucleotide
cugaaaucugcccuguua

SEQ ID NO: 68318 - RNA, 18 nt, Artificial Sequence
  Description of Artificial Sequence: Synthetic oligonucleotide
cguugcugaaaucugccc

SEQ ID NO: 68319 - RNA, 18 nt, Artificial Sequence
  Description of Artificial Sequence: Synthetic oligonucleotide
ucuuacguugcugaaauc

SEQ ID NO: 68320 - RNA, 18 nt, Artificial Sequence
  Description of Artificial Sequence: Synthetic oligonucleotide
uuuuuucuuacguugcug

SEQ ID NO: 68321 - RNA, 18 nt, Artificial Sequence
  Description of Artificial Sequence: Synthetic oligonucleotide
gcuccuuuuuucuuacgu

SEQ ID NO: 68322 - RNA, 18 nt, Artificial Sequence
  Description of Artificial Sequence: Synthetic oligonucleotide
gaagagcuccuuuuuucu

SEQ ID NO: 68323 - RNA, 18 nt, Artificial Sequence
  Description of Artificial Sequence: Synthetic oligonucleotide
agugagaagagcuccuuu

SEQ ID NO: 68324 - RNA, 18 nt, Artificial Sequence
  Description of Artificial Sequence: Synthetic oligonucleotide
guuucagugagaagagcu

SEQ ID NO: 68325 - RNA, 18 nt, Artificial Sequence
  Description of Artificial Sequence: Synthetic oligonucleotide
acuugguuucagugagaa

SEQ ID NO: 68326 - RNA, 18 nt, Artificial Sequence
  Description of Artificial Sequence: Synthetic oligonucleotide
cuuacacuugguuucagu

SEQ ID NO: 68327 - RNA, 18 nt, Artificial Sequence
  Description of Artificial Sequence: Synthetic oligonucleotide
cuggucuuacacuugguu

SEQ ID NO: 68328 - RNA, 18 nt, Artificial Sequence
  Description of Artificial Sequence: Synthetic oligonucleotide
ccagccuggucuuacacu

SEQ ID NO: 68329 - RNA, 18 nt, Artificial Sequence
  Description of Artificial Sequence: Synthetic oligonucleotide
cuaguccagccuggucuu

SEQ ID NO: 68330 - RNA, 18 nt, Artificial Sequence
  Description of Artificial Sequence: Synthetic oligonucleotide
guccucuaguccagccug

SEQ ID NO: 68331 - RNA, 18 nt, Artificial Sequence
  Description of Artificial Sequence: Synthetic oligonucleotide
cccguguccucuagucca

SEQ ID NO: 68332 - RNA, 18 nt, Artificial Sequence
  Description of Artificial Sequence: Synthetic oligonucleotide
aaacucccguguccucua

SEQ ID NO: 68333 - RNA, 18 nt, Artificial Sequence
  Description of Artificial Sequence: Synthetic oligonucleotide
uucaaaaacucccguguc

SEQ ID NO: 68334 - RNA, 18 nt, Artificial Sequence
  Description of Artificial Sequence: Synthetic oligonucleotide
ucugcuucaaaaacuccc

SEQ ID NO: 68335 - RNA, 18 nt, Artificial Sequence
  Description of Artificial Sequence: Synthetic oligonucleotide
cagccucugcuucaaaaa

SEQ ID NO: 68336 - RNA, 18 nt, Artificial Sequence
  Description of Artificial Sequence: Synthetic oligonucleotide
gucaucagccucugcuuc

SEQ ID NO: 68337 - RNA, 18 nt, Artificial Sequence
  Description of Artificial Sequence: Synthetic oligonucleotide
agcuggucaucagccucu

SEQ ID NO: 68338 - RNA, 18 nt, Artificial Sequence
  Description of Artificial Sequence: Synthetic oligonucleotide
ccgacagcuggucaucag

SEQ ID NO: 68339 - RNA, 18 nt, Artificial Sequence
  Description of Artificial Sequence: Synthetic oligonucleotide
gucucccgacagcugguc

SEQ ID NO: 68340 - RNA, 18 nt, Artificial Sequence
  Description of Artificial Sequence: Synthetic oligonucleotide
ucacagucucccgacagc

SEQ ID NO: 68341 - RNA, 18 nt, Artificial Sequence
  Description of Artificial Sequence: Synthetic oligonucleotide
uuccuucacagucucccg

SEQ ID NO: 68342 - RNA, 18 nt, Artificial Sequence
  Description of Artificial Sequence: Synthetic oligonucleotide
aggaauuccuucacaguc

SEQ ID NO: 68343 - RNA, 18 nt, Artificial Sequence
  Description of Artificial Sequence: Synthetic oligonucleotide
agggcaggaauuccuuca

SEQ ID NO: 68344 - RNA, 18 nt, Artificial Sequence
  Description of Artificial Sequence: Synthetic oligonucleotide
cacccagggcaggaauuc

SEQ ID NO: 68345 - RNA, 18 nt, Artificial Sequence
  Description of Artificial Sequence: Synthetic oligonucleotide
ggucccacccagggcagg

SEQ ID NO: 68346 - RNA, 18 nt, Artificial Sequence
  Description of Artificial Sequence: Synthetic oligonucleotide
accaaggucccacccagg

SEQ ID NO: 68347 - RNA, 18 nt, Artificial Sequence
  Description of Artificial Sequence: Synthetic oligonucleotide
acaggaccaaggucccac

SEQ ID NO: 68348 - RNA, 18 nt, Artificial Sequence
  Description of Artificial Sequence: Synthetic oligonucleotide
acuggacaggaccaaggu

SEQ ID NO: 68349 - RNA, 18 nt, Artificial Sequence
  Description of Artificial Sequence: Synthetic oligonucleotide
ugagaacuggacaggacc

SEQ ID NO: 68350 - RNA, 18 nt, Artificial Sequence
  Description of Artificial Sequence: Synthetic oligonucleotide
caggcugagaacuggaca

SEQ ID NO: 68351 - RNA, 18 nt, Artificial Sequence
  Description of Artificial Sequence: Synthetic oligonucleotide
ucauacaggcugagaacu

SEQ ID NO: 68352 - RNA, 18 nt, Artificial Sequence
  Description of Artificial Sequence: Synthetic oligonucleotide
gugaaucauacaggcuga

SEQ ID NO: 68353 - RNA, 18 nt, Artificial Sequence
  Description of Artificial Sequence: Synthetic oligonucleotide
gcagagugaaucauacag

SEQ ID NO: 68354 - RNA, 18 nt, Artificial Sequence
  Description of Artificial Sequence: Synthetic oligonucleotide
agccagcagagugaauca

SEQ ID NO: 68355 - RNA, 18 nt, Artificial Sequence
  Description of Artificial Sequence: Synthetic oligonucleotide
ggaguagccagcagagug

SEQ ID NO: 68356 - RNA, 18 nt, Artificial Sequence
  Description of Artificial Sequence: Synthetic oligonucleotide
ccuuaggaguagccagca

SEQ ID NO: 68357 - RNA, 18 nt, Artificial Sequence
  Description of Artificial Sequence: Synthetic oligonucleotide
gggagccuuaggaguagc

SEQ ID NO: 68358 - RNA, 18 nt, Artificial Sequence
  Description of Artificial Sequence: Synthetic oligonucleotide
acacuaaaagcggguggg

SEQ ID NO: 68359 - RNA, 18 nt, Artificial Sequence
  Description of Artificial Sequence: Synthetic oligonucleotide
ggcacacuaaaagcgggu

SEQ ID NO: 68360 - RNA, 18 nt, Artificial Sequence
  Description of Artificial Sequence: Synthetic oligonucleotide
caaagggcacacuaaaag

SEQ ID NO: 68361 - RNA, 18 nt, Artificial Sequence
  Description of Artificial Sequence: Synthetic oligonucleotide
ugccucaaagggcacacu

SEQ ID NO: 68362 - RNA, 18 nt, Artificial Sequence
  Description of Artificial Sequence: Synthetic oligonucleotide
cgcacugccucaaagggc

SEQ ID NO: 68363 - RNA, 18 nt, Artificial Sequence
  Description of Artificial Sequence: Synthetic oligonucleotide
agaagcgcacugccucaa

SEQ ID NO: 68364 - RNA, 18 nt, Artificial Sequence
  Description of Artificial Sequence: Synthetic oligonucleotide
aagagagaagcgcacugc

SEQ ID NO: 68365 - RNA, 18 nt, Artificial Sequence
  Description of Artificial Sequence: Synthetic oligonucleotide
ccugugccuuggucuccu

SEQ ID NO: 68366 - RNA, 18 nt, Artificial Sequence
  Description of Artificial Sequence: Synthetic oligonucleotide
aauguccugugccuuggu

SEQ ID NO: 68367 - RNA, 18 nt, Artificial Sequence
  Description of Artificial Sequence: Synthetic oligonucleotide
cccagaauguccugugcc

SEQ ID NO: 68368 - RNA, 18 nt, Artificial Sequence
  Description of Artificial Sequence: Synthetic oligonucleotide
cugcucccagaauguccu

SEQ ID NO: 68369 - RNA, 18 nt, Artificial Sequence
  Description of Artificial Sequence: Synthetic oligonucleotide
ggucacugcucccagaau

SEQ ID NO: 68370 - RNA, 18 nt, Artificial Sequence
  Description of Artificial Sequence: Synthetic oligonucleotide
agaagggucacugcuccc

SEQ ID NO: 68371 - RNA, 18 nt, Artificial Sequence
  Description of Artificial Sequence: Synthetic oligonucleotide
ccagcagaagggucacug

SEQ ID NO: 68372 - RNA, 18 nt, Artificial Sequence
  Description of Artificial Sequence: Synthetic oligonucleotide
ucccuccagcagaagggu

SEQ ID NO: 68373 - RNA, 18 nt, Artificial Sequence
  Description of Artificial Sequence: Synthetic oligonucleotide
aucacucccuccagcaga

SEQ ID NO: 68374 - RNA, 18 nt, Artificial Sequence
  Description of Artificial Sequence: Synthetic oligonucleotide
cugccaucacucccucca

SEQ ID NO: 68375 - RNA, 18 nt, Artificial Sequence
  Description of Artificial Sequence: Synthetic oligonucleotide
ccgugcugccaucacucc

SEQ ID NO: 68376 - RNA, 18 nt, Artificial Sequence
  Description of Artificial Sequence: Synthetic oligonucleotide
uguccccgugcugccauc

SEQ ID NO: 68377 - RNA, 18 nt, Artificial Sequence
  Description of Artificial Sequence: Synthetic oligonucleotide
ccaguuguccccgugcug

SEQ ID NO: 68378 - RNA, 18 nt, Artificial Sequence
  Description of Artificial Sequence: Synthetic oligonucleotide
gggucccaguuguccccg

SEQ ID NO: 68379 - RNA, 18 nt, Artificial Sequence
  Description of Artificial Sequence: Synthetic oligonucleotide
caagugggucccaguugu

SEQ ID NO: 68380 - RNA, 18 nt, Artificial Sequence
  Description of Artificial Sequence: Synthetic oligonucleotide
agaggcaaguggguccca

SEQ ID NO: 68381 - RNA, 18 nt, Artificial Sequence
  Description of Artificial Sequence: Synthetic oligonucleotide
ggaugagaggcaaguggg

SEQ ID NO: 68382 - RNA, 18 nt, Artificial Sequence
  Description of Artificial Sequence: Synthetic oligonucleotide
aggagggaugagaggcaa

SEQ ID NO: 68383 - RNA, 18 nt, Artificial Sequence
  Description of Artificial Sequence: Synthetic oligonucleotide
gccccaggagggaugaga

SEQ ID NO: 68384 - RNA, 18 nt, Artificial Sequence
  Description of Artificial Sequence: Synthetic oligonucleotide
aagcugccccaggaggga

SEQ ID NO: 68385 - RNA, 18 nt, Artificial Sequence
  Description of Artificial Sequence: Synthetic oligonucleotide
ccagaaagcugccccagg

SEQ ID NO: 68386 - RNA, 18 nt, Artificial Sequence
  Description of Artificial Sequence: Synthetic oligonucleotide
ccuguccagaaagcugcc

SEQ ID NO: 68387 - RNA, 18 nt, Artificial Sequence
  Description of Artificial Sequence: Synthetic oligonucleotide
acggaccuguccagaaag

SEQ ID NO: 68388 - RNA, 18 nt, Artificial Sequence
  Description of Artificial Sequence: Synthetic oligonucleotide
aggagacggaccugucca

SEQ ID NO: 68389 - RNA, 18 nt, Artificial Sequence
  Description of Artificial Sequence: Synthetic oligonucleotide
caaggaggagacggaccu

SEQ ID NO: 68390 - RNA, 18 nt, Artificial Sequence
  Description of Artificial Sequence: Synthetic oligonucleotide
ggccccaaggaggagacg

SEQ ID NO: 68391 - RNA, 18 nt, Artificial Sequence
  Description of Artificial Sequence: Synthetic oligonucleotide
ugcagggccccaaggagg

SEQ ID NO: 68392 - RNA, 18 nt, Artificial Sequence
  Description of Artificial Sequence: Synthetic oligonucleotide
ggcucugcagggccccaa

SEQ ID NO: 68393 - RNA, 18 nt, Artificial Sequence
  Description of Artificial Sequence: Synthetic oligonucleotide
aaggaggcucugcagggc

SEQ ID NO: 68394 - RNA, 18 nt, Artificial Sequence
  Description of Artificial Sequence: Synthetic oligonucleotide
guuccaaggaggcucugc

SEQ ID NO: 68395 - RNA, 18 nt, Artificial Sequence
  Description of Artificial Sequence: Synthetic oligonucleotide
uccugugccuuggucucc

SEQ ID NO: 68396 - RNA, 18 nt, Artificial Sequence
  Description of Artificial Sequence: Synthetic oligonucleotide
gaauguccugugccuugg

SEQ ID NO: 68397 - RNA, 18 nt, Artificial Sequence
  Description of Artificial Sequence: Synthetic oligonucleotide
ucccagaauguccugugc

SEQ ID NO: 68398 - RNA, 18 nt, Artificial Sequence
  Description of Artificial Sequence: Synthetic oligonucleotide
acugcucccagaaugucc

SEQ ID NO: 68399 - RNA, 18 nt, Artificial Sequence
  Description of Artificial Sequence: Synthetic oligonucleotide
gggucacugcucccagaa

SEQ ID NO: 68400 - RNA, 18 nt, Artificial Sequence
  Description of Artificial Sequence: Synthetic oligonucleotide
cagaagggucacugcucc

SEQ ID NO: 68401 - RNA, 18 nt, Artificial Sequence
  Description of Artificial Sequence: Synthetic oligonucleotide
uccagcagaagggucacu

SEQ ID NO: 68402 - RNA, 18 nt, Artificial Sequence
  Description of Artificial Sequence: Synthetic oligonucleotide
cucccuccagcagaaggg

SEQ ID NO: 68403 - RNA, 18 nt, Artificial Sequence
  Description of Artificial Sequence: Synthetic oligonucleotide
caucacucccuccagcag

SEQ ID NO: 68404 - RNA, 18 nt, Artificial Sequence
  Description of Artificial Sequence: Synthetic oligonucleotide
gcugccaucacucccucc

SEQ ID NO: 68405 - RNA, 18 nt, Artificial Sequence
  Description of Artificial Sequence: Synthetic oligonucleotide
cccgugcugccaucacuc

SEQ ID NO: 68406 - RNA, 18 nt, Artificial Sequence
  Description of Artificial Sequence: Synthetic oligonucleotide
uuguccccgugcugccau

SEQ ID NO: 68407 - RNA, 18 nt, Artificial Sequence
  Description of Artificial Sequence: Synthetic oligonucleotide
cccaguuguccccgugcu

SEQ ID NO: 68408 - RNA, 18 nt, Artificial Sequence
  Description of Artificial Sequence: Synthetic oligonucleotide
ugggucccaguugucccc

SEQ ID NO: 68409 - RNA, 18 nt, Artificial Sequence
  Description of Artificial Sequence: Synthetic oligonucleotide
gcaagugggucccaguug

SEQ ID NO: 68410 - RNA, 18 nt, Artificial Sequence
  Description of Artificial Sequence: Synthetic oligonucleotide
gagaggcaaguggguccc

SEQ ID NO: 68411 - RNA, 18 nt, Artificial Sequence
  Description of Artificial Sequence: Synthetic oligonucleotide
gggaugagaggcaagugg

SEQ ID NO: 68412 - RNA, 18 nt, Artificial Sequence
  Description of Artificial Sequence: Synthetic oligonucleotide
caggagggaugagaggca

SEQ ID NO: 68413 - RNA, 18 nt, Artificial Sequence
  Description of Artificial Sequence: Synthetic oligonucleotide
ugccccaggagggaugag

SEQ ID NO: 68414 - RNA, 18 nt, Artificial Sequence
  Description of Artificial Sequence: Synthetic oligonucleotide
aaagcugccccaggaggg

SEQ ID NO: 68415 - RNA, 18 nt, Artificial Sequence
  Description of Artificial Sequence: Synthetic oligonucleotide
uccagaaagcugccccag

SEQ ID NO: 68416 - RNA, 18 nt, Artificial Sequence
  Description of Artificial Sequence: Synthetic oligonucleotide
accuguccagaaagcugc

SEQ ID NO: 68417 - RNA, 18 nt, Artificial Sequence
  Description of Artificial Sequence: Synthetic oligonucleotide
gacggaccuguccagaaa

SEQ ID NO: 68418 - RNA, 18 nt, Artificial Sequence
  Description of Artificial Sequence: Synthetic oligonucleotide
gaggagacggaccugucc

SEQ ID NO: 68419 - RNA, 18 nt, Artificial Sequence
  Description of Artificial Sequence: Synthetic oligonucleotide
ccaaggaggagacggacc

SEQ ID NO: 68420 - RNA, 18 nt, Artificial Sequence
  Description of Artificial Sequence: Synthetic oligonucleotide
gggccccaaggaggagac

SEQ ID NO: 68421 - RNA, 18 nt, Artificial Sequence
  Description of Artificial Sequence: Synthetic oligonucleotide
cugcagggccccaaggag

SEQ ID NO: 68422 - RNA, 18 nt, Artificial Sequence
  Description of Artificial Sequence: Synthetic oligonucleotide
aggcucugcagggcccca

SEQ ID NO: 68423 - RNA, 18 nt, Artificial Sequence
  Description of Artificial Sequence: Synthetic oligonucleotide
caaggaggcucugcaggg

SEQ ID NO: 68424 - RNA, 18 nt, Artificial Sequence
  Description of Artificial Sequence: Synthetic oligonucleotide
gguuccaaggaggcucug

SEQ ID NO: 68425 - RNA, 18 nt, Artificial Sequence
  Description of Artificial Sequence: Synthetic oligonucleotide
ucuacagaucccuugacu

SEQ ID NO: 68426 - RNA, 18 nt, Artificial Sequence
  Description of Artificial Sequence: Synthetic oligonucleotide
caguuucuacagaucccu

SEQ ID NO: 68427 - RNA, 18 nt, Artificial Sequence
  Description of Artificial Sequence: Synthetic oligonucleotide
aagaacaguuucuacaga

SEQ ID NO: 68428 - RNA, 18 nt, Artificial Sequence
  Description of Artificial Sequence: Synthetic oligonucleotide
cagaaaagaacaguuucu

SEQ ID NO: 68429 - RNA, 18 nt, Artificial Sequence
  Description of Artificial Sequence: Synthetic oligonucleotide
ugagucagaaaagaacag

SEQ ID NO: 68430 - RNA, 18 nt, Artificial Sequence
  Description of Artificial Sequence: Synthetic oligonucleotide
gggacugagucagaaaag

SEQ ID NO: 68431 - RNA, 18 nt, Artificial Sequence
  Description of Artificial Sequence: Synthetic oligonucleotide
cuucccucaggucuucua

SEQ ID NO: 68432 - RNA, 18 nt, Artificial Sequence
  Description of Artificial Sequence: Synthetic oligonucleotide
cccuucuucccucagguc

SEQ ID NO: 68433 - RNA, 18 nt, Artificial Sequence
  Description of Artificial Sequence: Synthetic oligonucleotide
aagagcccuucuucccuc

SEQ ID NO: 68434 - RNA, 18 nt, Artificial Sequence
  Description of Artificial Sequence: Synthetic oligonucleotide
ccuggaagagcccuucuu

SEQ ID NO: 68435 - RNA, 18 nt, Artificial Sequence
  Description of Artificial Sequence: Synthetic oligonucleotide
agcucccuggaagagccc

SEQ ID NO: 68436 - RNA, 18 nt, Artificial Sequence
  Description of Artificial Sequence: Synthetic oligonucleotide
ccuugagcucccuggaag

SEQ ID NO: 68437 - RNA, 18 nt, Artificial Sequence
  Description of Artificial Sequence: Synthetic oligonucleotide
ucugcccuugagcucccu

SEQ ID NO: 68438 - RNA, 18 nt, Artificial Sequence
  Description of Artificial Sequence: Synthetic oligonucleotide
gcucuucugcccuugagc

SEQ ID NO: 68439 - RNA, 18 nt, Artificial Sequence
  Description of Artificial Sequence: Synthetic oligonucleotide
gaucagcucuucugcccu

SEQ ID NO: 68440 - RNA, 18 nt, Artificial Sequence
  Description of Artificial Sequence: Synthetic oligonucleotide
uaguagaucagcucuucu

SEQ ID NO: 68441 - RNA, 18 nt, Artificial Sequence
  Description of Artificial Sequence: Synthetic oligonucleotide
acucuuaguagaucagcu

SEQ ID NO: 68442 - RNA, 18 nt, Artificial Sequence
  Description of Artificial Sequence: Synthetic oligonucleotide
ggagcacucuuaguagau

SEQ ID NO: 68443 - RNA, 18 nt, Artificial Sequence
  Description of Artificial Sequence: Synthetic oligonucleotide
ggcagggagcacucuuag

SEQ ID NO: 68444 - RNA, 18 nt, Artificial Sequence
  Description of Artificial Sequence: Synthetic oligonucleotide
uggcuggcagggagcacu

SEQ ID NO: 68445 - RNA, 18 nt, Artificial Sequence
  Description of Artificial Sequence: Synthetic oligonucleotide
cauuguggcuggcaggga

SEQ ID NO: 68446 - RNA, 18 nt, Artificial Sequence
  Description of Artificial Sequence: Synthetic oligonucleotide
ccaggcauuguggcuggc

SEQ ID NO: 68447 - RNA, 18 nt, Artificial Sequence
  Description of Artificial Sequence: Synthetic oligonucleotide
aguacccaggcauugugg

SEQ ID NO: 68448 - RNA, 18 nt, Artificial Sequence
  Description of Artificial Sequence: Synthetic oligonucleotide
gaucagcucuucugcccu

SEQ ID NO: 68449 - RNA, 18 nt, Artificial Sequence
  Description of Artificial Sequence: Synthetic oligonucleotide
uaguagaucagcucuucu

SEQ ID NO: 68450 - RNA, 18 nt, Artificial Sequence
  Description of Artificial Sequence: Synthetic oligonucleotide
acucuuaguagaucagcu

SEQ ID NO: 68451 - RNA, 18 nt, Artificial Sequence
  Description of Artificial Sequence: Synthetic oligonucleotide
ggagcacucuuaguagau

SEQ ID NO: 68452 - RNA, 18 nt, Artificial Sequence
  Description of Artificial Sequence: Synthetic oligonucleotide
ggcagggagcacucuuag

SEQ ID NO: 68453 - RNA, 18 nt, Artificial Sequence
  Description of Artificial Sequence: Synthetic oligonucleotide
uggcuggcagggagcacu

SEQ ID NO: 68454 - RNA, 18 nt, Artificial Sequence
  Description of Artificial Sequence: Synthetic oligonucleotide
cauuguggcuggcaggga

SEQ ID NO: 68455 - RNA, 18 nt, Artificial Sequence
  Description of Artificial Sequence: Synthetic oligonucleotide
ccaggcauuguggcuggc

SEQ ID NO: 68456 - RNA, 18 nt, Artificial Sequence
  Description of Artificial Sequence: Synthetic oligonucleotide
aguacccaggcauugugg

SEQ ID NO: 68457 - RNA, 18 nt, Artificial Sequence
  Description of Artificial Sequence: Synthetic oligonucleotide
augccaguacccaggcau

SEQ ID NO: 68458 - RNA, 18 nt, Artificial Sequence
  Description of Artificial Sequence: Synthetic oligonucleotide
acaggaugccaguaccca

SEQ ID NO: 68459 - RNA, 18 nt, Artificial Sequence
  Description of Artificial Sequence: Synthetic oligonucleotide
gaaagacaggaugccagu

SEQ ID NO: 68460 - RNA, 18 nt, Artificial Sequence
  Description of Artificial Sequence: Synthetic oligonucleotide
aguaggaaagacaggaug

SEQ ID NO: 68461 - RNA, 18 nt, Artificial Sequence
  Description of Artificial Sequence: Synthetic oligonucleotide
gucuaaguaggaaagaca

SEQ ID NO: 68462 - RNA, 18 nt, Artificial Sequence
  Description of Artificial Sequence: Synthetic oligonucleotide
cccuugucuaaguaggaa

SEQ ID NO: 68463 - RNA, 18 nt, Artificial Sequence
  Description of Artificial Sequence: Synthetic oligonucleotide
ggccucccuugucuaagu

SEQ ID NO: 68464 - RNA, 18 nt, Artificial Sequence
  Description of Artificial Sequence: Synthetic oligonucleotide
ucucaggccucccuuguc

SEQ ID NO: 68465 - RNA, 18 nt, Artificial Sequence
  Description of Artificial Sequence: Synthetic oligonucleotide
ccagaucucaggccuccc

SEQ ID NO: 68466 - RNA, 18 nt, Artificial Sequence
  Description of Artificial Sequence: Synthetic oligonucleotide
cagggccagaucucaggc

SEQ ID NO: 68467 - RNA, 18 nt, Artificial Sequence
  Description of Artificial Sequence: Synthetic oligonucleotide
aacaccagggccagaucu

SEQ ID NO: 68468 - RNA, 18 nt, Artificial Sequence
  Description of Artificial Sequence: Synthetic oligonucleotide
ggccaaacaccagggcca

SEQ ID NO: 68469 - RNA, 18 nt, Artificial Sequence
  Description of Artificial Sequence: Synthetic oligonucleotide
ccugaggccaaacaccag

SEQ ID NO: 68470 - RNA, 18 nt, Artificial Sequence
  Description of Artificial Sequence: Synthetic oligonucleotide
augguccugaggccaaac

SEQ ID NO: 68471 - RNA, 18 nt, Artificial Sequence
  Description of Artificial Sequence: Synthetic oligonucleotide
agaggaugguccugaggc

SEQ ID NO: 68472 - RNA, 18 nt, Artificial Sequence
  Description of Artificial Sequence: Synthetic oligonucleotide
agggcagaggaugguccu

SEQ ID NO: 68473 - RNA, 18 nt, Artificial Sequence
  Description of Artificial Sequence: Synthetic oligonucleotide
agcugagggcagaggaug

SEQ ID NO: 68474 - RNA, 18 nt, Artificial Sequence
  Description of Artificial Sequence: Synthetic oligonucleotide
auccuugugagcuguggu

SEQ ID NO: 68475 - RNA, 18 nt, Artificial Sequence
  Description of Artificial Sequence: Synthetic oligonucleotide
uugggauccuugugagcu

SEQ ID NO: 68476 - RNA, 18 nt, Artificial Sequence
  Description of Artificial Sequence: Synthetic oligonucleotide
uggcauugggauccuugu

SEQ ID NO: 68477 - RNA, 18 nt, Artificial Sequence
  Description of Artificial Sequence: Synthetic oligonucleotide
gaagauggcauugggauc

SEQ ID NO: 68478 - RNA, 18 nt, Artificial Sequence
  Description of Artificial Sequence: Synthetic oligonucleotide
cucaggaagauggcauug

SEQ ID NO: 68479 - RNA, 18 nt, Artificial Sequence
  Description of Artificial Sequence: Synthetic oligonucleotide
ggaagcucaggaagaugg

SEQ ID NO: 68480 - RNA, 18 nt, Artificial Sequence
  Description of Artificial Sequence: Synthetic oligonucleotide
guguuggaagcucaggaa

SEQ ID NO: 68481 - RNA, 18 nt, Artificial Sequence
  Description of Artificial Sequence: Synthetic oligonucleotide
agcagguguuggaagcuc

SEQ ID NO: 68482 - RNA, 18 nt, Artificial Sequence
  Description of Artificial Sequence: Synthetic oligonucleotide
cucggagcagguguugga

SEQ ID NO: 68483 - RNA, 18 nt, Artificial Sequence
  Description of Artificial Sequence: Synthetic oligonucleotide
cuuuccucggagcaggug

SEQ ID NO: 68484 - RNA, 18 nt, Artificial Sequence
  Description of Artificial Sequence: Synthetic oligonucleotide
cgcaccuuuccucggagc

SEQ ID NO: 68485 - RNA, 18 nt, Artificial Sequence
  Description of Artificial Sequence: Synthetic oligonucleotide
ggaaacgcaccuuuccuc

SEQ ID NO: 68486 - RNA, 18 nt, Artificial Sequence
  Description of Artificial Sequence: Synthetic oligonucleotide
caucaggaaacgcaccuu

SEQ ID NO: 68487 - RNA, 18 nt, Artificial Sequence
  Description of Artificial Sequence: Synthetic oligonucleotide
acaagcaucaggaaacgc

SEQ ID NO: 68488 - RNA, 18 nt, Artificial Sequence
  Description of Artificial Sequence: Synthetic oligonucleotide
cuccuacaagcaucagga

SEQ ID NO: 68489 - RNA, 18 nt, Artificial Sequence
  Description of Artificial Sequence: Synthetic oligonucleotide
ggacccuccuacaagcau

SEQ ID NO: 68490 - RNA, 18 nt, Artificial Sequence
  Description of Artificial Sequence: Synthetic oligonucleotide
aggguggacccuccuaca

SEQ ID NO: 68491 - RNA, 18 nt, Artificial Sequence
  Description of Artificial Sequence: Synthetic oligonucleotide
cgcagaggguggacccuc

SEQ ID NO: 68492 - RNA, 18 nt, Artificial Sequence
  Description of Artificial Sequence: Synthetic oligonucleotide
ccugacgcagagggugga

SEQ ID NO: 68493 - RNA, 18 nt, Artificial Sequence
  Description of Artificial Sequence: Synthetic oligonucleotide
gcccgccugacgcagagg

SEQ ID NO: 68494 - RNA, 18 nt, Artificial Sequence
  Description of Artificial Sequence: Synthetic oligonucleotide
gggcccgccugacgcaga

SEQ ID NO: 68495 - RNA, 18 nt, Artificial Sequence
  Description of Artificial Sequence: Synthetic oligonucleotide
acagcugugguggguggg

SEQ ID NO: 68496 - RNA, 18 nt, Artificial Sequence
  Description of Artificial Sequence: Synthetic oligonucleotide
gggacagcuguggugggu

SEQ ID NO: 68497 - RNA, 18 nt, Artificial Sequence
  Description of Artificial Sequence: Synthetic oligonucleotide
uagagagguucugcuggg

SEQ ID NO: 68498 - RNA, 18 nt, Artificial Sequence
  Description of Artificial Sequence: Synthetic oligonucleotide
aggacuagagagguucug

SEQ ID NO: 68499 - RNA, 18 nt, Artificial Sequence
  Description of Artificial Sequence: Synthetic oligonucleotide
gugugaggacuagagagg

SEQ ID NO: 68500 - RNA, 18 nt, Artificial Sequence
  Description of Artificial Sequence: Synthetic oligonucleotide
guucagugugaggacuag

SEQ ID NO: 68501 - RNA, 18 nt, Artificial Sequence
  Description of Artificial Sequence: Synthetic oligonucleotide
agcucguucagugugagg

SEQ ID NO: 68502 - RNA, 18 nt, Artificial Sequence
  Description of Artificial Sequence: Synthetic oligonucleotide
uugggagcucguucagug

SEQ ID NO: 68503 - RNA, 18 nt, Artificial Sequence
  Description of Artificial Sequence: Synthetic oligonucleotide
ccuguuugggagcucguu

SEQ ID NO: 68504 - RNA, 18 nt, Artificial Sequence
  Description of Artificial Sequence: Synthetic oligonucleotide
gaaguccuguuugggagc

SEQ ID NO: 68505 - RNA, 18 nt, Artificial Sequence
  Description of Artificial Sequence: Synthetic oligonucleotide
auccagaaguccuguuug

SEQ ID NO: 68506 - RNA, 18 nt, Artificial Sequence
  Description of Artificial Sequence: Synthetic oligonucleotide
caacaauccagaaguccu

SEQ ID NO: 68507 - RNA, 18 nt, Artificial Sequence
  Description of Artificial Sequence: Synthetic oligonucleotide
gucuccaacaauccagaa

SEQ ID NO: 68508 - RNA, 18 nt, Artificial Sequence
  Description of Artificial Sequence: Synthetic oligonucleotide
aguuugucuccaacaauc

SEQ ID NO: 68509 - RNA, 18 nt, Artificial Sequence
  Description of Artificial Sequence: Synthetic oligonucleotide
agugaaguuugucuccaa

SEQ ID NO: 68510 - RNA, 18 nt, Artificial Sequence
  Description of Artificial Sequence: Synthetic oligonucleotide
gaggcagugaaguuuguc

SEQ ID NO: 68511 - RNA, 18 nt, Artificial Sequence
  Description of Artificial Sequence: Synthetic oligonucleotide
uggcugaggcagugaagu

SEQ ID NO: 68512 - RNA, 18 nt, Artificial Sequence
  Description of Artificial Sequence: Synthetic oligonucleotide
aguucuggcugaggcagu

SEQ ID NO: 68513 - RNA, 18 nt, Artificial Sequence
  Description of Artificial Sequence: Synthetic oligonucleotide
ccaguaguucuggcugag

SEQ ID NO: 68514 - RNA, 18 nt, Artificial Sequence
  Description of Artificial Sequence: Synthetic oligonucleotide
cagagccaguaguucugg

SEQ ID NO: 68515 - RNA, 18 nt, Artificial Sequence
  Description of Artificial Sequence: Synthetic oligonucleotide
aagcccagagccaguagu

SEQ ID NO: 68516 - RNA, 18 nt, Artificial Sequence
  Description of Artificial Sequence: Synthetic oligonucleotide
uucagaagcccagagcca

SEQ ID NO: 68517 - RNA, 18 nt, Artificial Sequence
  Description of Artificial Sequence: Synthetic oligonucleotide
gccacuucagaagcccag

SEQ ID NO: 68518 - RNA, 18 nt, Artificial Sequence
  Description of Artificial Sequence: Synthetic oligonucleotide
cugcugccacuucagaag

SEQ ID NO: 68519 - RNA, 18 nt, Artificial Sequence
  Description of Artificial Sequence: Synthetic oligonucleotide
aaucccugcugccacuuc

SEQ ID NO: 68520 - RNA, 18 nt, Artificial Sequence
  Description of Artificial Sequence: Synthetic oligonucleotide
cucugaaucccugcugcc

SEQ ID NO: 68521 - RNA, 18 nt, Artificial Sequence
  Description of Artificial Sequence: Synthetic oligonucleotide
cuuggcucugaaucccug

SEQ ID NO: 68522 - RNA, 18 nt, Artificial Sequence
  Description of Artificial Sequence: Synthetic oligonucleotide
ggaaucuuggcucugaau

SEQ ID NO: 68523 - RNA, 18 nt, Artificial Sequence
  Description of Artificial Sequence: Synthetic oligonucleotide
gaccaggaaucuuggcuc

SEQ ID NO: 68524 - RNA, 18 nt, Artificial Sequence
  Description of Artificial Sequence: Synthetic oligonucleotide
cagcagaccaggaaucuu

SEQ ID NO: 68525 - RNA, 18 nt, Artificial Sequence
  Description of Artificial Sequence: Synthetic oligonucleotide
ugguucagcagaccagga

SEQ ID NO: 68526 - RNA, 18 nt, Artificial Sequence
  Description of Artificial Sequence: Synthetic oligonucleotide
agguuugguucagcagac

SEQ ID NO: 68527 - RNA, 18 nt, Artificial Sequence
  Description of Artificial Sequence: Synthetic oligonucleotide
ccuggagguuugguucag

SEQ ID NO: 68528 - RNA, 18 nt, Artificial Sequence
  Description of Artificial Sequence: Synthetic oligonucleotide
agggaccuggagguuugg

SEQ ID NO: 68529 - RNA, 18 nt, Artificial Sequence
  Description of Artificial Sequence: Synthetic oligonucleotide
gguccagggaccuggagg

SEQ ID NO: 68530 - RNA, 18 nt, Artificial Sequence
  Description of Artificial Sequence: Synthetic oligonucleotide
gauuugguccagggaccu

SEQ ID NO: 68531 - RNA, 18 nt, Artificial Sequence
  Description of Artificial Sequence: Synthetic oligonucleotide
gggauuugguccagggac

SEQ ID NO: 68532 - RNA, 18 nt, Artificial Sequence
  Description of Artificial Sequence: Synthetic oligonucleotide
ccuguucagguauccggg

SEQ ID NO: 68533 - RNA, 18 nt, Artificial Sequence
  Description of Artificial Sequence: Synthetic oligonucleotide
uguauccuguucagguau

SEQ ID NO: 68534 - RNA, 18 nt, Artificial Sequence
  Description of Artificial Sequence: Synthetic oligonucleotide
guucguguauccuguuca

SEQ ID NO: 68535 - RNA, 18 nt, Artificial Sequence
  Description of Artificial Sequence: Synthetic oligonucleotide
caagaguucguguauccu

SEQ ID NO: 68536 - RNA, 18 nt, Artificial Sequence
  Description of Artificial Sequence: Synthetic oligonucleotide
ccauucaagaguucgugu

SEQ ID NO: 68537 - RNA, 18 nt, Artificial Sequence
  Description of Artificial Sequence: Synthetic oligonucleotide
gaguuccauucaagaguu

SEQ ID NO: 68538 - RNA, 18 nt, Artificial Sequence
  Description of Artificial Sequence: Synthetic oligonucleotide
uccacgaguuccauucaa

SEQ ID NO: 68539 - RNA, 18 nt, Artificial Sequence
  Description of Artificial Sequence: Synthetic oligonucleotide
aagaguccacgaguucca

SEQ ID NO: 68540 - RNA, 18 nt, Artificial Sequence
  Description of Artificial Sequence: Synthetic oligonucleotide
caggaaagaguccacgag

SEQ ID NO: 68541 - RNA, 18 nt, Artificial Sequence
  Description of Artificial Sequence: Synthetic oligonucleotide
ggguccaggaaagagucc

SEQ ID NO: 68542 - RNA, 18 nt, Artificial Sequence
  Description of Artificial Sequence: Synthetic oligonucleotide
cgugaggguccaggaaag

SEQ ID NO: 68543 - RNA, 18 nt, Artificial Sequence
  Description of Artificial Sequence: Synthetic oligonucleotide
uccugcgugaggguccag

SEQ ID NO: 68544 - RNA, 18 nt, Artificial Sequence
  Description of Artificial Sequence: Synthetic oligonucleotide
uaggguccugcgugaggg

SEQ ID NO: 68545 - RNA, 18 nt, Artificial Sequence
  Description of Artificial Sequence: Synthetic oligonucleotide
gcuccuaggguccugcgu

SEQ ID NO: 68546 - RNA, 18 nt, Artificial Sequence
  Description of Artificial Sequence: Synthetic oligonucleotide
gggcuccuaggguccugc

SEQ ID NO: 68547 - RNA, 18 nt, Artificial Sequence
  Description of Artificial Sequence: Synthetic oligonucleotide
ccugaggaaauguccggg

SEQ ID NO: 68548 - RNA, 18 nt, Artificial Sequence
  Description of Artificial Sequence: Synthetic oligonucleotide
auguuccugaggaaaugu

SEQ ID NO: 68549 - RNA, 18 nt, Artificial Sequence
  Description of Artificial Sequence: Synthetic oligonucleotide
gucugauguuccugagga

SEQ ID NO: 68550 - RNA, 18 nt, Artificial Sequence
  Description of Artificial Sequence: Synthetic oligonucleotide
ccugugucugauguuccu

SEQ ID NO: 68551 - RNA, 18 nt, Artificial Sequence
  Description of Artificial Sequence: Synthetic oligonucleotide
gggagccugugucugaug

SEQ ID NO: 68552 - RNA, 18 nt, Artificial Sequence
  Description of Artificial Sequence: Synthetic oligonucleotide
uggcagggagccuguguc

SEQ ID NO: 68553 - RNA, 18 nt, Artificial Sequence
  Description of Artificial Sequence: Synthetic oligonucleotide
uuggguggcagggagccu

SEQ ID NO: 68554 - RNA, 18 nt, Artificial Sequence
  Description of Artificial Sequence: Synthetic oligonucleotide
ggagguuggguggcaggg

SEQ ID NO: 68555 - RNA, 18 nt, Artificial Sequence
  Description of Artificial Sequence: Synthetic oligonucleotide
aggcuggagguugggugg

SEQ ID NO: 68556 - RNA, 18 nt, Artificial Sequence
  Description of Artificial Sequence: Synthetic oligonucleotide
uauccaggcuggagguug

SEQ ID NO: 68557 - RNA, 18 nt, Artificial Sequence
  Description of Artificial Sequence: Synthetic oligonucleotide
gagaauauccaggcugga

SEQ ID NO: 68558 - RNA, 18 nt, Artificial Sequence
  Description of Artificial Sequence: Synthetic oligonucleotide
ggaaggagaauauccagg

SEQ ID NO: 68559 - RNA, 18 nt, Artificial Sequence
  Description of Artificial Sequence: Synthetic oligonucleotide
gggaaggagaauauccag

SEQ ID NO: 68560 - RNA, 18 nt, Artificial Sequence
  Description of Artificial Sequence: Synthetic oligonucleotide
guaggaggauggguuggg

SEQ ID NO: 68561 - RNA, 18 nt, Artificial Sequence
  Description of Artificial Sequence: Synthetic oligonucleotide
guccaguaggaggauggg

SEQ ID NO: 68562 - RNA, 18 nt, Artificial Sequence
  Description of Artificial Sequence: Synthetic oligonucleotide
auacuguccaguaggagg

SEQ ID NO: 68563 - RNA, 18 nt, Artificial Sequence
  Description of Artificial Sequence: Synthetic oligonucleotide
agcguauacuguccagua

SEQ ID NO: 68564 - RNA, 18 nt, Artificial Sequence
  Description of Artificial Sequence: Synthetic oligonucleotide
ggaagagcguauacuguc

SEQ ID NO: 68565 - RNA, 18 nt, Artificial Sequence
  Description of Artificial Sequence: Synthetic oligonucleotide
aagagggaagagcguaua

SEQ ID NO: 68566 - RNA, 18 nt, Artificial Sequence
  Description of Artificial Sequence: Synthetic oligonucleotide
gguggaagagggaagagc

SEQ ID NO: 68567 - RNA, 18 nt, Artificial Sequence
  Description of Artificial Sequence: Synthetic oligonucleotide
agguggguggaagaggga

SEQ ID NO: 68568 - RNA, 18 nt, Artificial Sequence
  Description of Artificial Sequence: Synthetic oligonucleotide
gggcaagguggguggaag

SEQ ID NO: 68569 - RNA, 18 nt, Artificial Sequence
  Description of Artificial Sequence: Synthetic oligonucleotide
gggugggcaaggugggug

SEQ ID NO: 68570 - RNA, 18 nt, Artificial Sequence
  Description of Artificial Sequence: Synthetic oligonucleotide
uggagcuggaccacaggg

SEQ ID NO: 68571 - RNA, 18 nt, Artificial Sequence
  Description of Artificial Sequence: Synthetic oligonucleotide
ggguggagcuggaccaca

SEQ ID NO: 68572 - RNA, 18 nt, Artificial Sequence
  Description of Artificial Sequence: Synthetic oligonucleotide
aagggucaggaagcaggg

SEQ ID NO: 68573 - RNA, 18 nt, Artificial Sequence
  Description of Artificial Sequence: Synthetic oligonucleotide
agcagaagggucaggaag

SEQ ID NO: 68574 - RNA, 18 nt, Artificial Sequence
  Description of Artificial Sequence: Synthetic oligonucleotide
guuggagcagaaggguca

SEQ ID NO: 68575 - RNA, 18 nt, Artificial Sequence
  Description of Artificial Sequence: Synthetic oligonucleotide
ugggcguuggagcagaag

SEQ ID NO: 68576 - RNA, 18 nt, Artificial Sequence
  Description of Artificial Sequence: Synthetic oligonucleotide
gggugggcguuggagcag

SEQ ID NO: 68577 - RNA, 18 nt, Artificial Sequence
  Description of Artificial Sequence: Synthetic oligonucleotide
agaagagggcugguaggg

SEQ ID NO: 68578 - RNA, 18 nt, Artificial Sequence
  Description of Artificial Sequence: Synthetic oligonucleotide
uguuuagaagagggcugg

SEQ ID NO: 68579 - RNA, 18 nt, Artificial Sequence
  Description of Artificial Sequence: Synthetic oligonucleotide
ggauguguuuagaagagg

SEQ ID NO: 68580 - RNA, 18 nt, Artificial Sequence
  Description of Artificial Sequence: Synthetic oligonucleotide
guguaggauguguuuaga

SEQ ID NO: 68581 - RNA, 18 nt, Artificial Sequence
  Description of Artificial Sequence: Synthetic oligonucleotide
aguggguguaggaugugu

SEQ ID NO: 68582 - RNA, 18 nt, Artificial Sequence
  Description of Artificial Sequence: Synthetic oligonucleotide
cugggaguggguguagga

SEQ ID NO: 68583 - RNA, 18 nt, Artificial Sequence
  Description of Artificial Sequence: Synthetic oligonucleotide
agauucugggagugggug

SEQ ID NO: 68584 - RNA, 18 nt, Artificial Sequence
  Description of Artificial Sequence: Synthetic oligonucleotide
gagacagauucugggagu

SEQ ID NO: 68585 - RNA, 18 nt, Artificial Sequence
  Description of Artificial Sequence: Synthetic oligonucleotide
uuccugagacagauucug

SEQ ID NO: 68586 - RNA, 18 nt, Artificial Sequence
  Description of Artificial Sequence: Synthetic oligonucleotide
uacccuuccugagacaga

SEQ ID NO: 68587 - RNA, 18 nt, Artificial Sequence
  Description of Artificial Sequence: Synthetic oligonucleotide
aaccuuacccuuccugag

SEQ ID NO: 68588 - RNA, 18 nt, Artificial Sequence
  Description of Artificial Sequence: Synthetic oligonucleotide
cugagaaccuuacccuuc

SEQ ID NO: 68589 - RNA, 18 nt, Artificial Sequence
  Description of Artificial Sequence: Synthetic oligonucleotide
agugucugagaaccuuac

SEQ ID NO: 68590 - RNA, 18 nt, Artificial Sequence
  Description of Artificial Sequence: Synthetic oligonucleotide
ucggcagugucugagaac

SEQ ID NO: 68591 - RNA, 18 nt, Artificial Sequence
  Description of Artificial Sequence: Synthetic oligonucleotide
ugaugucggcagugucug

SEQ ID NO: 68592 - RNA, 18 nt, Artificial Sequence
  Description of Artificial Sequence: Synthetic oligonucleotide
aaugcugaugucggcagu

SEQ ID NO: 68593 - RNA, 18 nt, Artificial Sequence
  Description of Artificial Sequence: Synthetic oligonucleotide
gagacaaugcugaugucg

SEQ ID NO: 68594 - RNA, 18 nt, Artificial Sequence
  Description of Artificial Sequence: Synthetic oligonucleotide
uacacgagacaaugcuga

SEQ ID NO: 68595 - RNA, 18 nt, Artificial Sequence
  Description of Artificial Sequence: Synthetic oligonucleotide
agcuguacacgagacaau

SEQ ID NO: 68596 - RNA, 18 nt, Artificial Sequence
  Description of Artificial Sequence: Synthetic oligonucleotide
aagggagcuguacacgag

SEQ ID NO: 68597 - RNA, 18 nt, Artificial Sequence
  Description of Artificial Sequence: Synthetic oligonucleotide
cagggaagggagcuguac

SEQ ID NO: 68598 - RNA, 18 nt, Artificial Sequence
  Description of Artificial Sequence: Synthetic oligonucleotide
cccugcagggaagggagc

SEQ ID NO: 68599 - RNA, 18 nt, Artificial Sequence
  Description of Artificial Sequence: Synthetic oligonucleotide
gggcgcccugcagggaag

SEQ ID NO: 68600 - RNA, 18 nt, Artificial Sequence
  Description of Artificial Sequence: Synthetic oligonucleotide
cuuguccaguugucuccc

SEQ ID NO: 68601 - RNA, 18 nt, Artificial Sequence
  Description of Artificial Sequence: Synthetic oligonucleotide
gaaaucuuguccaguugu

SEQ ID NO: 68602 - RNA, 18 nt, Artificial Sequence
  Description of Artificial Sequence: Synthetic oligonucleotide
aguaggaaaucuugucca

SEQ ID NO: 68603 - RNA, 18 nt, Artificial Sequence
  Description of Artificial Sequence: Synthetic oligonucleotide
gagaaaguaggaaaucuu

SEQ ID NO: 68604 - RNA, 18 nt, Artificial Sequence
  Description of Artificial Sequence: Synthetic oligonucleotide
uucaggagaaaguaggaa

SEQ ID NO: 68605 - RNA, 18 nt, Artificial Sequence
  Description of Artificial Sequence: Synthetic oligonucleotide
uggguuucaggagaaagu

SEQ ID NO: 68606 - RNA, 18 nt, Artificial Sequence
  Description of Artificial Sequence: Synthetic oligonucleotide
ggcuuuggguuucaggag

SEQ ID NO: 68607 - RNA, 18 nt, Artificial Sequence
  Description of Artificial Sequence: Synthetic oligonucleotide
accagggcuuuggguuuc

SEQ ID NO: 68608 - RNA, 18 nt, Artificial Sequence
  Description of Artificial Sequence: Synthetic oligonucleotide
cuuuuaccagggcuuugg

SEQ ID NO: 68609 - RNA, 18 nt, Artificial Sequence
  Description of Artificial Sequence: Synthetic oligonucleotide
uaucccuuuuaccagggc

SEQ ID NO: 68610 - RNA, 18 nt, Artificial Sequence
  Description of Artificial Sequence: Synthetic oligonucleotide
cuguguaucccuuuuacc

SEQ ID NO: 68611 - RNA, 18 nt, Artificial Sequence
  Description of Artificial Sequence: Synthetic oligonucleotide
caguccuguguaucccuu

SEQ ID NO: 68612 - RNA, 18 nt, Artificial Sequence
  Description of Artificial Sequence: Synthetic oligonucleotide
cuuuucaguccuguguau

SEQ ID NO: 68613 - RNA, 18 nt, Artificial Sequence
  Description of Artificial Sequence: Synthetic oligonucleotide
auucccuuuucaguccug

SEQ ID NO: 68614 - RNA, 18 nt, Artificial Sequence
  Description of Artificial Sequence: Synthetic oligonucleotide
aaaugauucccuuuucag

SEQ ID NO: 68615 - RNA, 18 nt, Artificial Sequence
  Description of Artificial Sequence: Synthetic oligonucleotide
gugaaaaaugauucccuu

SEQ ID NO: 68616 - RNA, 18 nt, Artificial Sequence
  Description of Artificial Sequence: Synthetic oligonucleotide
guacagugaaaaaugauu

SEQ ID NO: 68617 - RNA, 18 nt, Artificial Sequence
  Description of Artificial Sequence: Synthetic oligonucleotide
auaauguacagugaaaaa

SEQ ID NO: 68618 - RNA, 18 nt, Artificial Sequence
  Description of Artificial Sequence: Synthetic oligonucleotide
gguuuauaauguacagug

SEQ ID NO: 68619 - RNA, 18 nt, Artificial Sequence
  Description of Artificial Sequence: Synthetic oligonucleotide
cugaagguuuauaaugua

SEQ ID NO: 68620 - RNA, 18 nt, Artificial Sequence
  Description of Artificial Sequence: Synthetic oligonucleotide
agcuucugaagguuuaua

SEQ ID NO: 68621 - RNA, 18 nt, Artificial Sequence
  Description of Artificial Sequence: Synthetic oligonucleotide
aaaauagcuucugaaggu

SEQ ID NO: 68622 - RNA, 18 nt, Artificial Sequence
  Description of Artificial Sequence: Synthetic oligonucleotide
uuaaaaaaauagcuucug

SEQ ID NO: 68623 - RNA, 18 nt, Artificial Sequence
  Description of Artificial Sequence: Synthetic oligonucleotide
auagcuuaaaaaaauagc

SEQ ID NO: 68624 - RNA, 18 nt, Artificial Sequence
  Description of Artificial Sequence: Synthetic oligonucleotide
ugcugauagcuuaaaaaa

SEQ ID NO: 68625 - RNA, 18 nt, Artificial Sequence
  Description of Artificial Sequence: Synthetic oligonucleotide
aguauugcugauagcuua

SEQ ID NO: 68626 - RNA, 18 nt, Artificial Sequence
  Description of Artificial Sequence: Synthetic oligonucleotide
ugaugaguauugcugaua

SEQ ID NO: 68627 - RNA, 18 nt, Artificial Sequence
  Description of Artificial Sequence: Synthetic oligonucleotide
ugcucugaugaguauugc

SEQ ID NO: 68628 - RNA, 18 nt, Artificial Sequence
  Description of Artificial Sequence: Synthetic oligonucleotide
cuagcugcucugaugagu

SEQ ID NO: 68629 - RNA, 18 nt, Artificial Sequence
  Description of Artificial Sequence: Synthetic oligonucleotide
aagagcuagcugcucuga

SEQ ID NO: 68630 - RNA, 18 nt, Artificial Sequence
  Description of Artificial Sequence: Synthetic oligonucleotide
gaccaaagagcuagcugc

SEQ ID NO: 68631 - RNA, 18 nt, Artificial Sequence
  Description of Artificial Sequence: Synthetic oligonucleotide
aaauagaccaaagagcua

SEQ ID NO: 68632 - RNA, 18 nt, Artificial Sequence
  Description of Artificial Sequence: Synthetic oligonucleotide
gcagaaaauagaccaaag

SEQ ID NO: 68633 - RNA, 18 nt, Artificial Sequence
  Description of Artificial Sequence: Synthetic oligonucleotide
uuucugcagaaaauagac

SEQ ID NO: 68634 - RNA, 18 nt, Artificial Sequence
  Description of Artificial Sequence: Synthetic oligonucleotide
gcaaauuucugcagaaaa

SEQ ID NO: 68635 - RNA, 18 nt, Artificial Sequence
  Description of Artificial Sequence: Synthetic oligonucleotide
gaguugcaaauuucugca

SEQ ID NO: 68636 - RNA, 18 nt, Artificial Sequence
  Description of Artificial Sequence: Synthetic oligonucleotide
ucagugaguugcaaauuu

SEQ ID NO: 68637 - RNA, 18 nt, Artificial Sequence
  Description of Artificial Sequence: Synthetic oligonucleotide
gagaaucagugaguugca

SEQ ID NO: 68638 - RNA, 18 nt, Artificial Sequence
  Description of Artificial Sequence: Synthetic oligonucleotide
auguagagaaucagugag

SEQ ID NO: 68639 - RNA, 18 nt, Artificial Sequence
  Description of Artificial Sequence: Synthetic oligonucleotide
agagcauguagagaauca

SEQ ID NO: 68640 - RNA, 18 nt, Artificial Sequence
  Description of Artificial Sequence: Synthetic oligonucleotide
gaaaaagagcauguagag

SEQ ID NO: 68641 - RNA, 18 nt, Artificial Sequence
  Description of Artificial Sequence: Synthetic oligonucleotide
ucacagaaaaagagcaug

SEQ ID NO: 68642 - RNA, 18 nt, Artificial Sequence
  Description of Artificial Sequence: Synthetic oligonucleotide
aguuaucacagaaaaaga

SEQ ID NO: 68643 - RNA, 18 nt, Artificial Sequence
  Description of Artificial Sequence: Synthetic oligonucleotide
ugcagaguuaucacagaa

SEQ ID NO: 68644 - RNA, 18 nt, Artificial Sequence
  Description of Artificial Sequence: Synthetic oligonucleotide
gccuuugcagaguuauca

SEQ ID NO: 68645 - RNA, 18 nt, Artificial Sequence
  Description of Artificial Sequence: Synthetic oligonucleotide
cccaggccuuugcagagu

SEQ ID NO: 68646 - RNA, 18 nt, Artificial Sequence
  Description of Artificial Sequence: Synthetic oligonucleotide
gccagcccaggccuuugc

SEQ ID NO: 68647 - RNA, 18 nt, Artificial Sequence
  Description of Artificial Sequence: Synthetic oligonucleotide
gccaggccagcccaggcc

SEQ ID NO: 68648 - RNA, 18 nt, Artificial Sequence
  Description of Artificial Sequence: Synthetic oligonucleotide
caacugccaggccagccc

SEQ ID NO: 68649 - RNA, 18 nt, Artificial Sequence
  Description of Artificial Sequence: Synthetic oligonucleotide
cuguucaacugccaggcc

SEQ ID NO: 68650 - RNA, 18 nt, Artificial Sequence
  Description of Artificial Sequence: Synthetic oligonucleotide
ucccucuguucaacugcc

SEQ ID NO: 68651 - RNA, 18 nt, Artificial Sequence
  Description of Artificial Sequence: Synthetic oligonucleotide
gucucucccucuguucaa

SEQ ID NO: 68652 - RNA, 18 nt, Artificial Sequence
  Description of Artificial Sequence: Synthetic oligonucleotide
gguuagucucucccucug

SEQ ID NO: 68653 - RNA, 18 nt, Artificial Sequence
  Description of Artificial Sequence: Synthetic oligonucleotide
cucaagguuagucucucc

SEQ ID NO: 68654 - RNA, 18 nt, Artificial Sequence
  Description of Artificial Sequence: Synthetic oligonucleotide
ucugacucaagguuaguc

SEQ ID NO: 68655 - RNA, 18 nt, Artificial Sequence
  Description of Artificial Sequence: Synthetic oligonucleotide
uguuuucugacucaaggu

SEQ ID NO: 68656 - RNA, 18 nt, Artificial Sequence
  Description of Artificial Sequence: Synthetic oligonucleotide
uucucuguuuucugacuc

SEQ ID NO: 68657 - RNA, 18 nt, Artificial Sequence
  Description of Artificial Sequence: Synthetic oligonucleotide
acccuuucucuguuuucu

SEQ ID NO: 68658 - RNA, 18 nt, Artificial Sequence
  Description of Artificial Sequence: Synthetic oligonucleotide
aaauuacccuuucucugu

SEQ ID NO: 68659 - RNA, 18 nt, Artificial Sequence
  Description of Artificial Sequence: Synthetic oligonucleotide
aaaggaaauuacccuuuc

SEQ ID NO: 68660 - RNA, 18 nt, Artificial Sequence
  Description of Artificial Sequence: Synthetic oligonucleotide
gaagcaaaggaaauuacc

SEQ ID NO: 68661 - RNA, 18 nt, Artificial Sequence
  Description of Artificial Sequence: Synthetic oligonucleotide
aauuugaagcaaaggaaa

SEQ ID NO: 68662 - RNA, 18 nt, Artificial Sequence
  Description of Artificial Sequence: Synthetic oligonucleotide
ccuugaauuugaagcaaa

SEQ ID NO: 68663 - RNA, 18 nt, Artificial Sequence
  Description of Artificial Sequence: Synthetic oligonucleotide
gaaggccuugaauuugaa

SEQ ID NO: 68664 - RNA, 18 nt, Artificial Sequence
  Description of Artificial Sequence: Synthetic oligonucleotide
cguuggaaggccuugaau

SEQ ID NO: 68665 - RNA, 18 nt, Artificial Sequence
  Description of Artificial Sequence: Synthetic oligonucleotide
gggcguuggaaggccuug

SEQ ID NO: 68666 - RNA, 18 nt, Artificial Sequence
  Description of Artificial Sequence: Synthetic oligonucleotide
gagaaugauaguaaaggg

SEQ ID NO: 68667 - RNA, 18 nt, Artificial Sequence
  Description of Artificial Sequence: Synthetic oligonucleotide
ccacugagaaugauagua

SEQ ID NO: 68668 - RNA, 18 nt, Artificial Sequence
  Description of Artificial Sequence: Synthetic oligonucleotide
gagucccacugagaauga

SEQ ID NO: 68669 - RNA, 18 nt, Artificial Sequence
  Description of Artificial Sequence: Synthetic oligonucleotide
gaucagagucccacugag

SEQ ID NO: 68670 - RNA, 18 nt, Artificial Sequence
  Description of Artificial Sequence: Synthetic oligonucleotide
uaugggaucagaguccca

SEQ ID NO: 68671 - RNA, 18 nt, Artificial Sequence
  Description of Artificial Sequence: Synthetic oligonucleotide
aagaauaugggaucagag

SEQ ID NO: 68672 - RNA, 18 nt, Artificial Sequence
  Description of Artificial Sequence: Synthetic oligonucleotide
cuguuaagaauaugggau

SEQ ID NO: 68673 - RNA, 18 nt, Artificial Sequence
  Description of Artificial Sequence: Synthetic oligonucleotide
aagaucuguuaagaauau

SEQ ID NO: 68674 - RNA, 18 nt, Artificial Sequence
  Description of Artificial Sequence: Synthetic oligonucleotide
gaguaaagaucuguuaag

SEQ ID NO: 68675 - RNA, 18 nt, Artificial Sequence
  Description of Artificial Sequence: Synthetic oligonucleotide
cucaagaguaaagaucug

SEQ ID NO: 68676 - RNA, 18 nt, Artificial Sequence
  Description of Artificial Sequence: Synthetic oligonucleotide
cauuucucaagaguaaag

SEQ ID NO: 68677 - RNA, 18 nt, Artificial Sequence
  Description of Artificial Sequence: Synthetic oligonucleotide
uuauucauuucucaagag

SEQ ID NO: 68678 - RNA, 18 nt, Artificial Sequence
  Description of Artificial Sequence: Synthetic oligonucleotide
aaagcuuauucauuucuc

SEQ ID NO: 68679 - RNA, 18 nt, Artificial Sequence
  Description of Artificial Sequence: Synthetic oligonucleotide
gagagaaagcuuauucau

SEQ ID NO: 68680 - RNA, 18 nt, Artificial Sequence
  Description of Artificial Sequence: Synthetic oligonucleotide
uuucugagagaaagcuua

SEQ ID NO: 68681 - RNA, 18 nt, Artificial Sequence
  Description of Artificial Sequence: Synthetic oligonucleotide
cagcauuucugagagaaa

SEQ ID NO: 68682 - RNA, 18 nt, Artificial Sequence
  Description of Artificial Sequence: Synthetic oligonucleotide
agggacagcauuucugag

SEQ ID NO: 68683 - RNA, 18 nt, Artificial Sequence
  Description of Artificial Sequence: Synthetic oligonucleotide
uguauagggacagcauuu

SEQ ID NO: 68684 - RNA, 18 nt, Artificial Sequence
  Description of Artificial Sequence: Synthetic oligonucleotide
ucuaguguauagggacag

SEQ ID NO: 68685 - RNA, 18 nt, Artificial Sequence
  Description of Artificial Sequence: Synthetic oligonucleotide
uuuugucuaguguauagg

SEQ ID NO: 68686 - RNA, 18 nt, Artificial Sequence
  Description of Artificial Sequence: Synthetic oligonucleotide
cucaguuuugucuagugu

SEQ ID NO: 68687 - RNA, 18 nt, Artificial Sequence
  Description of Artificial Sequence: Synthetic oligonucleotide
acaggcucaguuuugucu

SEQ ID NO: 68688 - RNA, 18 nt, Artificial Sequence
  Description of Artificial Sequence: Synthetic oligonucleotide
cuuauacaggcucaguuu

SEQ ID NO: 68689 - RNA, 18 nt, Artificial Sequence
  Description of Artificial Sequence: Synthetic oligonucleotide
uauuccuuauacaggcuc

SEQ ID NO: 68690 - RNA, 18 nt, Artificial Sequence
  Description of Artificial Sequence: Synthetic oligonucleotide
ccauuuauuccuuauaca

SEQ ID NO: 68691 - RNA, 18 nt, Artificial Sequence
  Description of Artificial Sequence: Synthetic oligonucleotide
cgcucccauuuauuccuu

SEQ ID NO: 68692 - RNA, 18 nt, Artificial Sequence
  Description of Artificial Sequence: Synthetic oligonucleotide
uucggcgcucccauuuau

SEQ ID NO: 68693 - RNA, 18 nt, Artificial Sequence
  Description of Artificial Sequence: Synthetic oligonucleotide
agcuuuucggcgcuccca

SEQ ID NO: 68694 - RNA, 18 nt, Artificial Sequence
  Description of Artificial Sequence: Synthetic oligonucleotide
uagggagcuuuucggcgc

SEQ ID NO: 68695 - RNA, 18 nt, Artificial Sequence
  Description of Artificial Sequence: Synthetic oligonucleotide
cuuuuuagggagcuuuuc

SEQ ID NO: 68696 - RNA, 18 nt, Artificial Sequence
  Description of Artificial Sequence: Synthetic oligonucleotide
cuggacaugggcaaccug

SEQ ID NO: 68697 - RNA, 18 nt, Artificial Sequence
  Description of Artificial Sequence: Synthetic oligonucleotide
uuuuccuggacaugggca

SEQ ID NO: 68698 - RNA, 18 nt, Artificial Sequence
  Description of Artificial Sequence: Synthetic oligonucleotide
ccaucuuuuccuggacau

SEQ ID NO: 68699 - RNA, 18 nt, Artificial Sequence
  Description of Artificial Sequence: Synthetic oligonucleotide
gggauccaucuuuuccug

SEQ ID NO: 68700 - RNA, 18 nt, Artificial Sequence
  Description of Artificial Sequence: Synthetic oligonucleotide
gagaagauuuggauaggg

SEQ ID NO: 68701 - RNA, 18 nt, Artificial Sequence
  Description of Artificial Sequence: Synthetic oligonucleotide
cggagaagauuuggauag

SEQ ID NO: 68702 - RNA, 18 nt, Artificial Sequence
  Description of Artificial Sequence: Synthetic oligonucleotide
caccacggagaagauuug

SEQ ID NO: 68703 - RNA, 18 nt, Artificial Sequence
  Description of Artificial Sequence: Synthetic oligonucleotide
acacacaccacggagaag

SEQ ID NO: 68704 - RNA, 18 nt, Artificial Sequence
  Description of Artificial Sequence: Synthetic oligonucleotide
cacccacacacaccacgg

SEQ ID NO: 68705 - RNA, 18 nt, Artificial Sequence
  Description of Artificial Sequence: Synthetic oligonucleotide
uccuccacccacacacac

SEQ ID NO: 68706 - RNA, 18 nt, Artificial Sequence
  Description of Artificial Sequence: Synthetic oligonucleotide
uccacuccuccacccaca

SEQ ID NO: 68707 - RNA, 18 nt, Artificial Sequence
  Description of Artificial Sequence: Synthetic oligonucleotide
caggguccacuccuccac

SEQ ID NO: 68708 - RNA, 18 nt, Artificial Sequence
  Description of Artificial Sequence: Synthetic oligonucleotide
uggaccaggguccacucc

SEQ ID NO: 68709 - RNA, 18 nt, Artificial Sequence
  Description of Artificial Sequence: Synthetic oligonucleotide
cugccuggaccagggucc

SEQ ID NO: 68710 - RNA, 18 nt, Artificial Sequence
  Description of Artificial Sequence: Synthetic oligonucleotide
agccccugccuggaccag

SEQ ID NO: 68711 - RNA, 18 nt, Artificial Sequence
  Description of Artificial Sequence: Synthetic oligonucleotide
ccuggagccccugccugg

SEQ ID NO: 68712 - RNA, 18 nt, Artificial Sequence
  Description of Artificial Sequence: Synthetic oligonucleotide
ucuucccuggagccccug

SEQ ID NO: 68713 - RNA, 18 nt, Artificial Sequence
  Description of Artificial Sequence: Synthetic oligonucleotide
ccuucucuucccuggagc

SEQ ID NO: 68714 - RNA, 18 nt, Artificial Sequence
  Description of Artificial Sequence: Synthetic oligonucleotide
ugacgccuucucuucccu

SEQ ID NO: 68715 - RNA, 18 nt, Artificial Sequence
  Description of Artificial Sequence: Synthetic oligonucleotide
ggaagugacgccuucucu

SEQ ID NO: 68716 - RNA, 18 nt, Artificial Sequence
  Description of Artificial Sequence: Synthetic oligonucleotide
cccccggaagugacgccu

SEQ ID NO: 68717 - RNA, 18 nt, Artificial Sequence
  Description of Artificial Sequence: Synthetic oligonucleotide
gaaggcccccggaaguga

SEQ ID NO: 68718 - RNA, 18 nt, Artificial Sequence
  Description of Artificial Sequence: Synthetic oligonucleotide
cuggugaaggcccccgga

SEQ ID NO: 68719 - RNA, 18 nt, Artificial Sequence
  Description of Artificial Sequence: Synthetic oligonucleotide
agacacuggugaaggccc

SEQ ID NO: 68720 - RNA, 18 nt, Artificial Sequence
  Description of Artificial Sequence: Synthetic oligonucleotide
ccaccagacacuggugaa

SEQ ID NO: 68721 - RNA, 18 nt, Artificial Sequence
  Description of Artificial Sequence: Synthetic oligonucleotide
gggagccaccagacacug

SEQ ID NO: 68722 - RNA, 18 nt, Artificial Sequence
  Description of Artificial Sequence: Synthetic oligonucleotide
gagaagggagccaccaga

SEQ ID NO: 68723 - RNA, 18 nt, Artificial Sequence
  Description of Artificial Sequence: Synthetic oligonucleotide
aaucagagaagggagcca

SEQ ID NO: 68724 - RNA, 18 nt, Artificial Sequence
  Description of Artificial Sequence: Synthetic oligonucleotide
ugcccaaucagagaaggg

SEQ ID NO: 68725 - RNA, 18 nt, Artificial Sequence
  Description of Artificial Sequence: Synthetic oligonucleotide
acuucugcccaaucagag

SEQ ID NO: 68726 - RNA, 18 nt, Artificial Sequence
  Description of Artificial Sequence: Synthetic oligonucleotide
gggccacuucugcccaau

SEQ ID NO: 68727 - RNA, 18 nt, Artificial Sequence
  Description of Artificial Sequence: Synthetic oligonucleotide
ugccugggccacuucugc

SEQ ID NO: 68728 - RNA, 18 nt, Artificial Sequence
  Description of Artificial Sequence: Synthetic oligonucleotide
acgccugccugggccacu

SEQ ID NO: 68729 - RNA, 18 nt, Artificial Sequence
  Description of Artificial Sequence: Synthetic oligonucleotide
gucauacgccugccuggg

SEQ ID NO: 68730 - RNA, 18 nt, Artificial Sequence
  Description of Artificial Sequence: Synthetic oligonucleotide
agcaggucauacgccugc

SEQ ID NO: 68731 - RNA, 18 nt, Artificial Sequence
  Description of Artificial Sequence: Synthetic oligonucleotide
acagcagcaggucauacg

SEQ ID NO: 68732 - RNA, 18 nt, Artificial Sequence
  Description of Artificial Sequence: Synthetic oligonucleotide
ccuccacagcagcagguc

SEQ ID NO: 68733 - RNA, 18 nt, Artificial Sequence
  Description of Artificial Sequence: Synthetic oligonucleotide
cagccccuccacagcagc

SEQ ID NO: 68734 - RNA, 18 nt, Artificial Sequence
  Description of Artificial Sequence: Synthetic oligonucleotide
gggcacagccccuccaca

SEQ ID NO: 68735 - RNA, 18 nt, Artificial Sequence
  Description of Artificial Sequence: Synthetic oligonucleotide
aagacauguggcgguggg

SEQ ID NO: 68736 - RNA, 18 nt, Artificial Sequence
  Description of Artificial Sequence: Synthetic oligonucleotide
aggaagacauguggcggu

SEQ ID NO: 68737 - RNA, 18 nt, Artificial Sequence
  Description of Artificial Sequence: Synthetic oligonucleotide
uggguaggaagacaugug

SEQ ID NO: 68738 - RNA, 18 nt, Artificial Sequence
  Description of Artificial Sequence: Synthetic oligonucleotide
gcagauggguaggaagac

SEQ ID NO: 68739 - RNA, 18 nt, Artificial Sequence
  Description of Artificial Sequence: Synthetic oligonucleotide
agcaggcagcccucuggg

SEQ ID NO: 68740 - RNA, 18 nt, Artificial Sequence
  Description of Artificial Sequence: Synthetic oligonucleotide
ugcacagcaggcagcccu

SEQ ID NO: 68741 - RNA, 18 nt, Artificial Sequence
  Description of Artificial Sequence: Synthetic oligonucleotide
ccaagugcacagcaggca

SEQ ID NO: 68742 - RNA, 18 nt, Artificial Sequence
  Description of Artificial Sequence: Synthetic oligonucleotide
aggacccaagugcacagc

SEQ ID NO: 68743 - RNA, 18 nt, Artificial Sequence
  Description of Artificial Sequence: Synthetic oligonucleotide
gcuccaggacccaagugc

SEQ ID NO: 68744 - RNA, 18 nt, Artificial Sequence
  Description of Artificial Sequence: Synthetic oligonucleotide
gaagggcuccaggaccca

SEQ ID NO: 68745 - RNA, 18 nt, Artificial Sequence
  Description of Artificial Sequence: Synthetic oligonucleotide
guggagaagggcuccagg

SEQ ID NO: 68746 - RNA, 18 nt, Artificial Sequence
  Description of Artificial Sequence: Synthetic oligonucleotide
cccacacccugcuggcca

SEQ ID NO: 68747 - RNA, 18 nt, Artificial Sequence
  Description of Artificial Sequence: Synthetic oligonucleotide
auaaccccacacccugcu

SEQ ID NO: 68748 - RNA, 18 nt, Artificial Sequence
  Description of Artificial Sequence: Synthetic oligonucleotide
cucacauaaccccacacc

SEQ ID NO: 68749 - RNA, 18 nt, Artificial Sequence
  Description of Artificial Sequence: Synthetic oligonucleotide
cuacccucacauaacccc

SEQ ID NO: 68750 - RNA, 18 nt, Artificial Sequence
  Description of Artificial Sequence: Synthetic oligonucleotide
ccuuucuacccucacaua

SEQ ID NO: 68751 - RNA, 18 nt, Artificial Sequence
  Description of Artificial Sequence: Synthetic oligonucleotide
gcuguccuuucuacccuc

SEQ ID NO: 68752 - RNA, 18 nt, Artificial Sequence
  Description of Artificial Sequence: Synthetic oligonucleotide
ucuuugcuguccuuucua

SEQ ID NO: 68753 - RNA, 18 nt, Artificial Sequence
  Description of Artificial Sequence: Synthetic oligonucleotide
auuucucuuugcuguccu

SEQ ID NO: 68754 - RNA, 18 nt, Artificial Sequence
  Description of Artificial Sequence: Synthetic oligonucleotide
agcccauuucucuuugcu

SEQ ID NO: 68755 - RNA, 18 nt, Artificial Sequence
  Description of Artificial Sequence: Synthetic oligonucleotide
cugggagcccauuucucu

SEQ ID NO: 68756 - RNA, 18 nt, Artificial Sequence
  Description of Artificial Sequence: Synthetic oligonucleotide
cccagcugggagcccauu

SEQ ID NO: 68757 - RNA, 18 nt, Artificial Sequence
  Description of Artificial Sequence: Synthetic oligonucleotide
ccucccccagcugggagc

SEQ ID NO: 68758 - RNA, 18 nt, Artificial Sequence
  Description of Artificial Sequence: Synthetic oligonucleotide
cugccccucccccagcug

SEQ ID NO: 68759 - RNA, 18 nt, Artificial Sequence
  Description of Artificial Sequence: Synthetic oligonucleotide
uuugccugccccuccccc

SEQ ID NO: 68760 - RNA, 18 nt, Artificial Sequence
  Description of Artificial Sequence: Synthetic oligonucleotide
uccaguuugccugccccu

SEQ ID NO: 68761 - RNA, 18 nt, Artificial Sequence
  Description of Artificial Sequence: Synthetic oligonucleotide
uagguuccaguuugccug

SEQ ID NO: 68762 - RNA, 18 nt, Artificial Sequence
  Description of Artificial Sequence: Synthetic oligonucleotide
gccuguagguuccaguuu

SEQ ID NO: 68763 - RNA, 18 nt, Artificial Sequence
  Description of Artificial Sequence: Synthetic oligonucleotide
ucagugccuguagguucc

SEQ ID NO: 68764 - RNA, 18 nt, Artificial Sequence
  Description of Artificial Sequence: Synthetic oligonucleotide
aaaggucagugccuguag

SEQ ID NO: 68765 - RNA, 18 nt, Artificial Sequence
  Description of Artificial Sequence: Synthetic oligonucleotide
ucgacaaaggucagugcc

SEQ ID NO: 68766 - RNA, 18 nt, Artificial Sequence
  Description of Artificial Sequence: Synthetic oligonucleotide
ucuucucgacaaagguca

SEQ ID NO: 68767 - RNA, 18 nt, Artificial Sequence
  Description of Artificial Sequence: Synthetic oligonucleotide
uacacucuucucgacaaa

SEQ ID NO: 68768 - RNA, 18 nt, Artificial Sequence
  Description of Artificial Sequence: Synthetic oligonucleotide
aaggcuacacucuucucg

SEQ ID NO: 68769 - RNA, 18 nt, Artificial Sequence
  Description of Artificial Sequence: Synthetic oligonucleotide
cugggaaggcuacacucu

SEQ ID NO: 68770 - RNA, 18 nt, Artificial Sequence
  Description of Artificial Sequence: Synthetic oligonucleotide
ccauucugggaaggcuac

SEQ ID NO: 68771 - RNA, 18 nt, Artificial Sequence
  Description of Artificial Sequence: Synthetic oligonucleotide
uccucccauucugggaag

SEQ ID NO: 68772 - RNA, 18 nt, Artificial Sequence
  Description of Artificial Sequence: Synthetic oligonucleotide
ccugcuccucccauucug

SEQ ID NO: 68773 - RNA, 18 nt, Artificial Sequence
  Description of Artificial Sequence: Synthetic oligonucleotide
ucugcccugcuccuccca

SEQ ID NO: 68774 - RNA, 18 nt, Artificial Sequence
  Description of Artificial Sequence: Synthetic oligonucleotide
ccugcucugcccugcucc

SEQ ID NO: 68775 - RNA, 18 nt, Artificial Sequence
  Description of Artificial Sequence: Synthetic oligonucleotide
cuaccccugcucugcccu

SEQ ID NO: 68776 - RNA, 18 nt, Artificial Sequence
  Description of Artificial Sequence: Synthetic oligonucleotide
acccccuaccccugcucu

SEQ ID NO: 68777 - RNA, 18 nt, Artificial Sequence
  Description of Artificial Sequence: Synthetic oligonucleotide
accccacccccuaccccu

SEQ ID NO: 68778 - RNA, 18 nt, Artificial Sequence
  Description of Artificial Sequence: Synthetic oligonucleotide
ccagcaccccacccccua

SEQ ID NO: 68779 - RNA, 18 nt, Artificial Sequence
  Description of Artificial Sequence: Synthetic oligonucleotide
agaaaccagcaccccacc

SEQ ID NO: 68780 - RNA, 18 nt, Artificial Sequence
  Description of Artificial Sequence: Synthetic oligonucleotide
cccucagaaaccagcacc

SEQ ID NO: 68781 - RNA, 18 nt, Artificial Sequence
  Description of Artificial Sequence: Synthetic oligonucleotide
ucagucccucagaaacca

SEQ ID NO: 68782 - RNA, 18 nt, Artificial Sequence
  Description of Artificial Sequence: Synthetic oligonucleotide
agugaucagucccucaga

SEQ ID NO: 68783 - RNA, 18 nt, Artificial Sequence
  Description of Artificial Sequence: Synthetic oligonucleotide
aaguaagugaucaguccc

SEQ ID NO: 68784 - RNA, 18 nt, Artificial Sequence
  Description of Artificial Sequence: Synthetic oligonucleotide
ccaccaaguaagugauca

SEQ ID NO: 68785 - RNA, 18 nt, Artificial Sequence
  Description of Artificial Sequence: Synthetic oligonucleotide
guauuccaccaaguaagu

SEQ ID NO: 68786 - RNA, 18 nt, Artificial Sequence
  Description of Artificial Sequence: Synthetic oligonucleotide
gugcuguauuccaccaag

SEQ ID NO: 68787 - RNA, 18 nt, Artificial Sequence
  Description of Artificial Sequence: Synthetic oligonucleotide
gggcugugcuguauucca

SEQ ID NO: 68788 - RNA, 18 nt, Artificial Sequence
  Description of Artificial Sequence: Synthetic oligonucleotide
agccagggcugugcugua

SEQ ID NO: 68789 - RNA, 18 nt, Artificial Sequence
  Description of Artificial Sequence: Synthetic oligonucleotide
gggccagccagggcugug

SEQ ID NO: 68790 - RNA, 18 nt, Artificial Sequence
  Description of Artificial Sequence: Synthetic oligonucleotide
ccuuagggccagccaggg

SEQ ID NO: 68791 - RNA, 18 nt, Artificial Sequence
  Description of Artificial Sequence: Synthetic oligonucleotide
ccuuuccuuagggccagc

SEQ ID NO: 68792 - RNA, 18 nt, Artificial Sequence
  Description of Artificial Sequence: Synthetic oligonucleotide
uguccccuuuccuuaggg

SEQ ID NO: 68793 - RNA, 18 nt, Artificial Sequence
  Description of Artificial Sequence: Synthetic oligonucleotide
gcucauguccccuuuccu

SEQ ID NO: 68794 - RNA, 18 nt, Artificial Sequence
  Description of Artificial Sequence: Synthetic oligonucleotide
ccugggcucauguccccu

SEQ ID NO: 68795 - RNA, 18 nt, Artificial Sequence
  Description of Artificial Sequence: Synthetic oligonucleotide
uucucccugggcucaugu

SEQ ID NO: 68796 - RNA, 18 nt, Artificial Sequence
  Description of Artificial Sequence: Synthetic oligonucleotide
uuauuuucucccugggcu

SEQ ID NO: 68797 - RNA, 18 nt, Artificial Sequence
  Description of Artificial Sequence: Synthetic oligonucleotide
cucucuuauuuucucccu

SEQ ID NO: 68798 - RNA, 18 nt, Artificial Sequence
  Description of Artificial Sequence: Synthetic oligonucleotide
gcucccucucuuauuuuc

SEQ ID NO: 68799 - RNA, 18 nt, Artificial Sequence
  Description of Artificial Sequence: Synthetic oligonucleotide
gugcagcucccucucuua

SEQ ID NO: 68800 - RNA, 18 nt, Artificial Sequence
  Description of Artificial Sequence: Synthetic oligonucleotide
ccuaagugcagcucccuc

SEQ ID NO: 68801 - RNA, 18 nt, Artificial Sequence
  Description of Artificial Sequence: Synthetic oligonucleotide
uaagcccuaagugcagcu

SEQ ID NO: 68802 - RNA, 18 nt, Artificial Sequence
  Description of Artificial Sequence: Synthetic oligonucleotide
uuugcuaagcccuaagug

SEQ ID NO: 68803 - RNA, 18 nt, Artificial Sequence
  Description of Artificial Sequence: Synthetic oligonucleotide
cuguguuugcuaagcccu

SEQ ID NO: 68804 - RNA, 18 nt, Artificial Sequence
  Description of Artificial Sequence: Synthetic oligonucleotide
uacuacuguguuugcuaa

SEQ ID NO: 68805 - RNA, 18 nt, Artificial Sequence
  Description of Artificial Sequence: Synthetic oligonucleotide
caucuuacuacuguguuu

SEQ ID NO: 68806 - RNA, 18 nt, Artificial Sequence
  Description of Artificial Sequence: Synthetic oligonucleotide
guguccaucuuacuacug

SEQ ID NO: 68807 - RNA, 18 nt, Artificial Sequence
  Description of Artificial Sequence: Synthetic oligonucleotide
gggcuguguccaucuuac

SEQ ID NO: 68808 - RNA, 18 nt, Artificial Sequence
  Description of Artificial Sequence: Synthetic oligonucleotide
aaugaccagcuaagaaug

SEQ ID NO: 68809 - RNA, 18 nt, Artificial Sequence
  Description of Artificial Sequence: Synthetic oligonucleotide
cgaggaaugaccagcuaa

SEQ ID NO: 68810 - RNA, 18 nt, Artificial Sequence
  Description of Artificial Sequence: Synthetic oligonucleotide
gcuaacgaggaaugacca

SEQ ID NO: 68811 - RNA, 18 nt, Artificial Sequence
  Description of Artificial Sequence: Synthetic oligonucleotide
cuuaagcuaacgaggaau

SEQ ID NO: 68812 - RNA, 18 nt, Artificial Sequence
  Description of Artificial Sequence: Synthetic oligonucleotide
agaaccuuaagcuaacga

SEQ ID NO: 68813 - RNA, 18 nt, Artificial Sequence
  Description of Artificial Sequence: Synthetic oligonucleotide
gauucagaaccuuaagcu

SEQ ID NO: 68814 - RNA, 18 nt, Artificial Sequence
  Description of Artificial Sequence: Synthetic oligonucleotide
caccagauucagaaccuu

SEQ ID NO: 68815 - RNA, 18 nt, Artificial Sequence
  Description of Artificial Sequence: Synthetic oligonucleotide
cccagcaccagauucaga

SEQ ID NO: 68816 - RNA, 18 nt, Artificial Sequence
  Description of Artificial Sequence: Synthetic oligonucleotide
gcuuccccagcaccagau

SEQ ID NO: 68817 - RNA, 18 nt, Artificial Sequence
  Description of Artificial Sequence: Synthetic oligonucleotide
gcccagcuuccccagcac

SEQ ID NO: 68818 - RNA, 18 nt, Artificial Sequence
  Description of Artificial Sequence: Synthetic oligonucleotide
gccuggcccagcuucccc

SEQ ID NO: 68819 - RNA, 18 nt, Artificial Sequence
  Description of Artificial Sequence: Synthetic oligonucleotide
ggcuugccuggcccagcu

SEQ ID NO: 68820 - RNA, 18 nt, Artificial Sequence
  Description of Artificial Sequence: Synthetic oligonucleotide
gcccuggcuugccuggcc

SEQ ID NO: 68821 - RNA, 18 nt, Artificial Sequence
  Description of Artificial Sequence: Synthetic oligonucleotide
cuugcgcccuggcuugcc

SEQ ID NO: 68822 - RNA, 18 nt, Artificial Sequence
  Description of Artificial Sequence: Synthetic oligonucleotide
cucuccuugcgcccuggc

SEQ ID NO: 68823 - RNA, 18 nt, Artificial Sequence
  Description of Artificial Sequence: Synthetic oligonucleotide
uuacccucuccuugcgcc

SEQ ID NO: 68824 - RNA, 18 nt, Artificial Sequence
  Description of Artificial Sequence: Synthetic oligonucleotide
ucccauuacccucuccuu

SEQ ID NO: 68825 - RNA, 18 nt, Artificial Sequence
  Description of Artificial Sequence: Synthetic oligonucleotide
ccuccucccauuacccuc

SEQ ID NO: 68826 - RNA, 18 nt, Artificial Sequence
  Description of Artificial Sequence: Synthetic oligonucleotide
ugggcccuccucccauua

SEQ ID NO: 68827 - RNA, 18 nt, Artificial Sequence
  Description of Artificial Sequence: Synthetic oligonucleotide
augagugggcccuccucc

SEQ ID NO: 68828 - RNA, 18 nt, Artificial Sequence
  Description of Artificial Sequence: Synthetic oligonucleotide
ucaacaugagugggcccu

SEQ ID NO: 68829 - RNA, 18 nt, Artificial Sequence
  Description of Artificial Sequence: Synthetic oligonucleotide
gucugucaacaugagugg

SEQ ID NO: 68830 - RNA, 18 nt, Artificial Sequence
  Description of Artificial Sequence: Synthetic oligonucleotide
uguaggucugucaacaug

SEQ ID NO: 68831 - RNA, 18 nt, Artificial Sequence
  Description of Artificial Sequence: Synthetic oligonucleotide
uuuccuguaggucuguca

SEQ ID NO: 68832 - RNA, 18 nt, Artificial Sequence
  Description of Artificial Sequence: Synthetic oligonucleotide
ugggauuuccuguagguc

SEQ ID NO: 68833 - RNA, 18 nt, Artificial Sequence
  Description of Artificial Sequence: Synthetic oligonucleotide
aauauugggauuuccugu

SEQ ID NO: 68834 - RNA, 18 nt, Artificial Sequence
  Description of Artificial Sequence: Synthetic oligonucleotide
gauucaauauugggauuu

SEQ ID NO: 68835 - RNA, 18 nt, Artificial Sequence
  Description of Artificial Sequence: Synthetic oligonucleotide
caccugauucaauauugg

SEQ ID NO: 68836 - RNA, 18 nt, Artificial Sequence
  Description of Artificial Sequence: Synthetic oligonucleotide
gcuugcaccugauucaau

SEQ ID NO: 68837 - RNA, 18 nt, Artificial Sequence
  Description of Artificial Sequence: Synthetic oligonucleotide
aagaggcuugcaccugau

SEQ ID NO: 68838 - RNA, 18 nt, Artificial Sequence
  Description of Artificial Sequence: Synthetic oligonucleotide
gugcaaagaggcuugcac

SEQ ID NO: 68839 - RNA, 18 nt, Artificial Sequence
  Description of Artificial Sequence: Synthetic oligonucleotide
aaguugugcaaagaggcu

SEQ ID NO: 68840 - RNA, 18 nt, Artificial Sequence
  Description of Artificial Sequence: Synthetic oligonucleotide
uucacaaguugugcaaag

SEQ ID NO: 68841 - RNA, 18 nt, Artificial Sequence
  Description of Artificial Sequence: Synthetic oligonucleotide
ucuccuuuuugucaggac

SEQ ID NO: 68842 - RNA, 18 nt, Artificial Sequence
  Description of Artificial Sequence: Synthetic oligonucleotide
uggugucuccuuuuuguc

SEQ ID NO: 68843 - RNA, 18 nt, Artificial Sequence
  Description of Artificial Sequence: Synthetic oligonucleotide
gcauauggugucuccuuu

SEQ ID NO: 68844 - RNA, 18 nt, Artificial Sequence
  Description of Artificial Sequence: Synthetic oligonucleotide
agaaagcauauggugucu

SEQ ID NO: 68845 - RNA, 18 nt, Artificial Sequence
  Description of Artificial Sequence: Synthetic oligonucleotide
aagcaagaaagcauaugg

SEQ ID NO: 68846 - RNA, 18 nt, Artificial Sequence
  Description of Artificial Sequence: Synthetic oligonucleotide
aaagaaagcaagaaagca

SEQ ID NO: 68847 - RNA, 18 nt, Artificial Sequence
  Description of Artificial Sequence: Synthetic oligonucleotide
gaaagaaagaaagcaaga

SEQ ID NO: 68848 - RNA, 18 nt, Artificial Sequence
  Description of Artificial Sequence: Synthetic oligonucleotide
agaaagaaagaaagaaag

SEQ ID NO: 68849 - RNA, 18 nt, Artificial Sequence
  Description of Artificial Sequence: Synthetic oligonucleotide
aagaaagaaagaaagaaa

SEQ ID NO: 68850 - RNA, 18 nt, Artificial Sequence
  Description of Artificial Sequence: Synthetic oligonucleotide
aaagaaagaaagaaagaa

SEQ ID NO: 68851 - RNA, 18 nt, Artificial Sequence
  Description of Artificial Sequence: Synthetic oligonucleotide
aaaaaaaagaaagaaaga

SEQ ID NO: 68852 - RNA, 18 nt, Artificial Sequence
  Description of Artificial Sequence: Synthetic oligonucleotide
caaaaaaaaaaaagaaag

SEQ ID NO: 68853 - RNA, 18 nt, Artificial Sequence
  Description of Artificial Sequence: Synthetic oligonucleotide
cgucucaaaaaaaaaaaa

SEQ ID NO: 68854 - RNA, 18 nt, Artificial Sequence
  Description of Artificial Sequence: Synthetic oligonucleotide
aacuccgucucaaaaaaa

SEQ ID NO: 68855 - RNA, 18 nt, Artificial Sequence
  Description of Artificial Sequence: Synthetic oligonucleotide
agugaaacuccgucucaa

SEQ ID NO: 68856 - RNA, 18 nt, Artificial Sequence
  Description of Artificial Sequence: Synthetic oligonucleotide
auaagagugaaacuccgu

SEQ ID NO: 68857 - RNA, 18 nt, Artificial Sequence
  Description of Artificial Sequence: Synthetic oligonucleotide
gggcaauaagagugaaac

SEQ ID NO: 68858 - RNA, 18 nt, Artificial Sequence
  Description of Artificial Sequence: Synthetic oligonucleotide
agccugggcaauaagagu

SEQ ID NO: 68859 - RNA, 18 nt, Artificial Sequence
  Description of Artificial Sequence: Synthetic oligonucleotide
acuccagccugggcaaua

SEQ ID NO: 68860 - RNA, 18 nt, Artificial Sequence
  Description of Artificial Sequence: Synthetic oligonucleotide
auugcacuccagccuggg

SEQ ID NO: 68861 - RNA, 18 nt, Artificial Sequence
  Description of Artificial Sequence: Synthetic oligonucleotide
gcaccauugcacuccagc

SEQ ID NO: 68862 - RNA, 18 nt, Artificial Sequence
  Description of Artificial Sequence: Synthetic oligonucleotide
agaucgcaccauugcacu

SEQ ID NO: 68863 - RNA, 18 nt, Artificial Sequence
  Description of Artificial Sequence: Synthetic oligonucleotide
agccgagaucgcaccauu

SEQ ID NO: 68864 - RNA, 18 nt, Artificial Sequence
  Description of Artificial Sequence: Synthetic oligonucleotide
uggugagccgagaucgca

SEQ ID NO: 68865 - RNA, 18 nt, Artificial Sequence
  Description of Artificial Sequence: Synthetic oligonucleotide
gguuguggugagccgaga

SEQ ID NO: 68866 - RNA, 18 nt, Artificial Sequence
  Description of Artificial Sequence: Synthetic oligonucleotide
gcggagguuguggugagc

SEQ ID NO: 68867 - RNA, 18 nt, Artificial Sequence
  Description of Artificial Sequence: Synthetic oligonucleotide
gggaggcggagguugugg

SEQ ID NO: 68868 - RNA, 18 nt, Artificial Sequence
  Description of Artificial Sequence: Synthetic oligonucleotide
uaccugggaggcggaggu

SEQ ID NO: 68869 - RNA, 18 nt, Artificial Sequence
  Description of Artificial Sequence: Synthetic oligonucleotide
gcuuguaccugggaggcg

SEQ ID NO: 68870 - RNA, 18 nt, Artificial Sequence
  Description of Artificial Sequence: Synthetic oligonucleotide
gaaucgcuuguaccuggg

SEQ ID NO: 68871 - RNA, 18 nt, Artificial Sequence
  Description of Artificial Sequence: Synthetic oligonucleotide
caggagaaucgcuuguac

SEQ ID NO: 68872 - RNA, 18 nt, Artificial Sequence
  Description of Artificial Sequence: Synthetic oligonucleotide
ugagacaggagaaucgcu

SEQ ID NO: 68873 - RNA, 18 nt, Artificial Sequence
  Description of Artificial Sequence: Synthetic oligonucleotide
gaggcugagacaggagaa

SEQ ID NO: 68874 - RNA, 18 nt, Artificial Sequence
  Description of Artificial Sequence: Synthetic oligonucleotide
cuugggaggcugagacag

SEQ ID NO: 68875 - RNA, 18 nt, Artificial Sequence
  Description of Artificial Sequence: Synthetic oligonucleotide
agcuacuugggaggcuga

SEQ ID NO: 68876 - RNA, 18 nt, Artificial Sequence
  Description of Artificial Sequence: Synthetic oligonucleotide
auccaagcuacuugggag

SEQ ID NO: 68877 - RNA, 18 nt, Artificial Sequence
  Description of Artificial Sequence: Synthetic oligonucleotide
cuguaauccaagcuacuu

SEQ ID NO: 68878 - RNA, 18 nt, Artificial Sequence
  Description of Artificial Sequence: Synthetic oligonucleotide
caugccuguaauccaagc

SEQ ID NO: 68879 - RNA, 18 nt, Artificial Sequence
  Description of Artificial Sequence: Synthetic oligonucleotide
ugguucaugccuguaauc

SEQ ID NO: 68880 - RNA, 18 nt, Artificial Sequence
  Description of Artificial Sequence: Synthetic oligonucleotide
uguggugguucaugccug

SEQ ID NO: 68881 - RNA, 18 nt, Artificial Sequence
  Description of Artificial Sequence: Synthetic oligonucleotide
caggguguggugguucau

SEQ ID NO: 68882 - RNA, 18 nt, Artificial Sequence
  Description of Artificial Sequence: Synthetic oligonucleotide
acuagcaggguguggugg

SEQ ID NO: 68883 - RNA, 18 nt, Artificial Sequence
  Description of Artificial Sequence: Synthetic oligonucleotide
aaaaaacuagcagggugu

SEQ ID NO: 68884 - RNA, 18 nt, Artificial Sequence
  Description of Artificial Sequence: Synthetic oligonucleotide
auacaaaaaaacuagcag

SEQ ID NO: 68885 - RNA, 18 nt, Artificial Sequence
  Description of Artificial Sequence: Synthetic oligonucleotide
acgaaauacaaaaaaacu

SEQ ID NO: 68886 - RNA, 18 nt, Artificial Sequence
  Description of Artificial Sequence: Synthetic oligonucleotide
gcucuacgaaauacaaaa

SEQ ID NO: 68887 - RNA, 18 nt, Artificial Sequence
  Description of Artificial Sequence: Synthetic oligonucleotide
ccccggcucuacgaaaua

SEQ ID NO: 68888 - RNA, 18 nt, Artificial Sequence
  Description of Artificial Sequence: Synthetic oligonucleotide
ugaaaccccggcucuacg

SEQ ID NO: 68889 - RNA, 18 nt, Artificial Sequence
  Description of Artificial Sequence: Synthetic oligonucleotide
cauggugaaaccccggcu

SEQ ID NO: 68890 - RNA, 18 nt, Artificial Sequence
  Description of Artificial Sequence: Synthetic oligonucleotide
acuaacauggugaaaccc

SEQ ID NO: 68891 - RNA, 18 nt, Artificial Sequence
  Description of Artificial Sequence: Synthetic oligonucleotide
gccucacuaacaugguga

SEQ ID NO: 68892 - RNA, 18 nt, Artificial Sequence
  Description of Artificial Sequence: Synthetic oligonucleotide
caccagccucacuaacau

SEQ ID NO: 68893 - RNA, 18 nt, Artificial Sequence
  Description of Artificial Sequence: Synthetic oligonucleotide
uucgccaccagccucacu

SEQ ID NO: 68894 - RNA, 18 nt, Artificial Sequence
  Description of Artificial Sequence: Synthetic oligonucleotide
aggaguucgccaccagcc

SEQ ID NO: 68895 - RNA, 18 nt, Artificial Sequence
  Description of Artificial Sequence: Synthetic oligonucleotide
aggucaggaguucgccac

SEQ ID NO: 68896 - RNA, 18 nt, Artificial Sequence
  Description of Artificial Sequence: Synthetic oligonucleotide
accugaggucaggaguuc

SEQ ID NO: 68897 - RNA, 18 nt, Artificial Sequence
  Description of Artificial Sequence: Synthetic oligonucleotide
ggaucaccugaggucagg

SEQ ID NO: 68898 - RNA, 18 nt, Artificial Sequence
  Description of Artificial Sequence: Synthetic oligonucleotide
cggguggaucaccugagg

SEQ ID NO: 68899 - RNA, 18 nt, Artificial Sequence
  Description of Artificial Sequence: Synthetic oligonucleotide
caaggcggguggaucacc

SEQ ID NO: 68900 - RNA, 18 nt, Artificial Sequence
  Description of Artificial Sequence: Synthetic oligonucleotide
gaguccaaggcgggugga

SEQ ID NO: 68901 - RNA, 18 nt, Artificial Sequence
  Description of Artificial Sequence: Synthetic oligonucleotide
uuugggaguccaaggcgg

SEQ ID NO: 68902 - RNA, 18 nt, Artificial Sequence
  Description of Artificial Sequence: Synthetic oligonucleotide
agcacuuugggaguccaa

SEQ ID NO: 68903 - RNA, 18 nt, Artificial Sequence
  Description of Artificial Sequence: Synthetic oligonucleotide
aucccagcacuuugggag

SEQ ID NO: 68904 - RNA, 18 nt, Artificial Sequence
  Description of Artificial Sequence: Synthetic oligonucleotide
cuguaaucccagcacuuu

SEQ ID NO: 68905 - RNA, 18 nt, Artificial Sequence
  Description of Artificial Sequence: Synthetic oligonucleotide
caugccuguaaucccagc

SEQ ID NO: 68906 - RNA, 18 nt, Artificial Sequence
  Description of Artificial Sequence: Synthetic oligonucleotide
uggcucaugccuguaauc

SEQ ID NO: 68907 - RNA, 18 nt, Artificial Sequence
  Description of Artificial Sequence: Synthetic oligonucleotide
ugcaguggcucaugccug

SEQ ID NO: 68908 - RNA, 18 nt, Artificial Sequence
  Description of Artificial Sequence: Synthetic oligonucleotide
ccgggugcaguggcucau

SEQ ID NO: 68909 - RNA, 18 nt, Artificial Sequence
  Description of Artificial Sequence: Synthetic oligonucleotide
gugugccgggugcagugg

SEQ ID NO: 68910 - RNA, 18 nt, Artificial Sequence
  Description of Artificial Sequence: Synthetic oligonucleotide
auauggugugccgggugc

SEQ ID NO: 68911 - RNA, 18 nt, Artificial Sequence
  Description of Artificial Sequence: Synthetic oligonucleotide
aaagcauauggugugccg

SEQ ID NO: 68912 - RNA, 18 nt, Artificial Sequence
  Description of Artificial Sequence: Synthetic oligonucleotide
ugaugaaagcauauggug

SEQ ID NO: 68913 - RNA, 18 nt, Artificial Sequence
  Description of Artificial Sequence: Synthetic oligonucleotide
ucuugugaugaaagcaua

SEQ ID NO: 68914 - RNA, 18 nt, Artificial Sequence
  Description of Artificial Sequence: Synthetic oligonucleotide
cauuuucuugugaugaaa

SEQ ID NO: 68915 - RNA, 18 nt, Artificial Sequence
  Description of Artificial Sequence: Synthetic oligonucleotide
ucucacauuuucuuguga

SEQ ID NO: 68916 - RNA, 18 nt, Artificial Sequence
  Description of Artificial Sequence: Synthetic oligonucleotide
aauucucucacauuuucu

SEQ ID NO: 68917 - RNA, 18 nt, Artificial Sequence
  Description of Artificial Sequence: Synthetic oligonucleotide
cccugaauucucucacau

SEQ ID NO: 68918 - RNA, 18 nt, Artificial Sequence
  Description of Artificial Sequence: Synthetic oligonucleotide
caaagcccugaauucucu

SEQ ID NO: 68919 - RNA, 18 nt, Artificial Sequence
  Description of Artificial Sequence: Synthetic oligonucleotide
acugccaaagcccugaau

SEQ ID NO: 68920 - RNA, 18 nt, Artificial Sequence
  Description of Artificial Sequence: Synthetic oligonucleotide
cuggaacugccaaagccc

SEQ ID NO: 68921 - RNA, 18 nt, Artificial Sequence
  Description of Artificial Sequence: Synthetic oligonucleotide
ccagccuggaacugccaa

SEQ ID NO: 68922 - RNA, 18 nt, Artificial Sequence
  Description of Artificial Sequence: Synthetic oligonucleotide
gcugaccagccuggaacu

SEQ ID NO: 68923 - RNA, 18 nt, Artificial Sequence
  Description of Artificial Sequence: Synthetic oligonucleotide
gagaugcugaccagccug

SEQ ID NO: 68924 - RNA, 18 nt, Artificial Sequence
  Description of Artificial Sequence: Synthetic oligonucleotide
ggcuugagaugcugacca

SEQ ID NO: 68925 - RNA, 18 nt, Artificial Sequence
  Description of Artificial Sequence: Synthetic oligonucleotide
gggagggcuugagaugcu

SEQ ID NO: 68926 - RNA, 18 nt, Artificial Sequence
  Description of Artificial Sequence: Synthetic oligonucleotide
gggugaacagaugcuggg

SEQ ID NO: 68927 - RNA, 18 nt, Artificial Sequence
  Description of Artificial Sequence: Synthetic oligonucleotide
ggcagggugaacagaugc

SEQ ID NO: 68928 - RNA, 18 nt, Artificial Sequence
  Description of Artificial Sequence: Synthetic oligonucleotide
ugccuggcagggugaaca

SEQ ID NO: 68929 - RNA, 18 nt, Artificial Sequence
  Description of Artificial Sequence: Synthetic oligonucleotide
gagacugccuggcagggu

SEQ ID NO: 68930 - RNA, 18 nt, Artificial Sequence
  Description of Artificial Sequence: Synthetic oligonucleotide
aggaagagacugccuggc

SEQ ID NO: 68931 - RNA, 18 nt, Artificial Sequence
  Description of Artificial Sequence: Synthetic oligonucleotide
uuucuaggaagagacugc

SEQ ID NO: 68932 - RNA, 18 nt, Artificial Sequence
  Description of Artificial Sequence: Synthetic oligonucleotide
ccaaguuucuaggaagag

SEQ ID NO: 68933 - RNA, 18 nt, Artificial Sequence
  Description of Artificial Sequence: Synthetic oligonucleotide
uuuaaccaaguuucuagg

SEQ ID NO: 68934 - RNA, 18 nt, Artificial Sequence
  Description of Artificial Sequence: Synthetic oligonucleotide
gaacauuuaaccaaguuu

SEQ ID NO: 68935 - RNA, 18 nt, Artificial Sequence
  Description of Artificial Sequence: Synthetic oligonucleotide
agagugaacauuuaacca

SEQ ID NO: 68936 - RNA, 18 nt, Artificial Sequence
  Description of Artificial Sequence: Synthetic oligonucleotide
caagggugaagaaucuau

SEQ ID NO: 68937 - RNA, 18 nt, Artificial Sequence
  Description of Artificial Sequence: Synthetic oligonucleotide
cgggccaagggugaagaa

SEQ ID NO: 68938 - RNA, 18 nt, Artificial Sequence
  Description of Artificial Sequence: Synthetic oligonucleotide
aaaggcgggccaagggug

SEQ ID NO: 68939 - RNA, 18 nt, Artificial Sequence
  Description of Artificial Sequence: Synthetic oligonucleotide
gggcaaaggcgggccaag

SEQ ID NO: 68940 - RNA, 18 nt, Artificial Sequence
  Description of Artificial Sequence: Synthetic oligonucleotide
ugggcagaguaggguggg

SEQ ID NO: 68941 - RNA, 18 nt, Artificial Sequence
  Description of Artificial Sequence: Synthetic oligonucleotide
acuucugggcagaguagg

SEQ ID NO: 68942 - RNA, 18 nt, Artificial Sequence
  Description of Artificial Sequence: Synthetic oligonucleotide
cuugcacuucugggcaga

SEQ ID NO: 68943 - RNA, 18 nt, Artificial Sequence
  Description of Artificial Sequence: Synthetic oligonucleotide
aggcucuugcacuucugg

SEQ ID NO: 68944 - RNA, 18 nt, Artificial Sequence
  Description of Artificial Sequence: Synthetic oligonucleotide
ggcuuaggcucuugcacu

SEQ ID NO: 68945 - RNA, 18 nt, Artificial Sequence
  Description of Artificial Sequence: Synthetic oligonucleotide
gaggcggcuuaggcucuu

SEQ ID NO: 68946 - RNA, 18 nt, Artificial Sequence
  Description of Artificial Sequence: Synthetic oligonucleotide
ccauggaggcggcuuagg

SEQ ID NO: 68947 - RNA, 18 nt, Artificial Sequence
  Description of Artificial Sequence: Synthetic oligonucleotide
gggccauggaggcggcuu

SEQ ID NO: 68948 - RNA, 18 nt, Artificial Sequence
  Description of Artificial Sequence: Synthetic oligonucleotide
cccugaauccuuccuggg

SEQ ID NO: 68949 - RNA, 18 nt, Artificial Sequence
  Description of Artificial Sequence: Synthetic oligonucleotide
cucuccccugaauccuuc

SEQ ID NO: 68950 - RNA, 18 nt, Artificial Sequence
  Description of Artificial Sequence: Synthetic oligonucleotide
gggccucuccccugaauc

SEQ ID NO: 68951 - RNA, 18 nt, Artificial Sequence
  Description of Artificial Sequence: Synthetic oligonucleotide
cguggcucccuguuuggg

SEQ ID NO: 68952 - RNA, 18 nt, Artificial Sequence
  Description of Artificial Sequence: Synthetic oligonucleotide
gcuggcguggcucccugu

SEQ ID NO: 68953 - RNA, 18 nt, Artificial Sequence
  Description of Artificial Sequence: Synthetic oligonucleotide
gucuggcuggcguggcuc

SEQ ID NO: 68954 - RNA, 18 nt, Artificial Sequence
  Description of Artificial Sequence: Synthetic oligonucleotide
gggugucuggcuggcgug

SEQ ID NO: 68955 - RNA, 18 nt, Artificial Sequence
  Description of Artificial Sequence: Synthetic oligonucleotide
agcuccauucuggccggg

SEQ ID NO: 68956 - RNA, 18 nt, Artificial Sequence
  Description of Artificial Sequence: Synthetic oligonucleotide
cagucagcuccauucugg

SEQ ID NO: 68957 - RNA, 18 nt, Artificial Sequence
  Description of Artificial Sequence: Synthetic oligonucleotide
aagggugaagaaucuauc

SEQ ID NO: 68958 - RNA, 18 nt, Artificial Sequence
  Description of Artificial Sequence: Synthetic oligonucleotide
gggccaagggugaagaau

SEQ ID NO: 68959 - RNA, 18 nt, Artificial Sequence
  Description of Artificial Sequence: Synthetic oligonucleotide
aaggcgggccaaggguga

SEQ ID NO: 68960 - RNA, 18 nt, Artificial Sequence
  Description of Artificial Sequence: Synthetic oligonucleotide
gggcaaaggcgggccaag

SEQ ID NO: 68961 - RNA, 18 nt, Artificial Sequence
  Description of Artificial Sequence: Synthetic oligonucleotide
ugggcagaguaggguggg

SEQ ID NO: 68962 - RNA, 18 nt, Artificial Sequence
  Description of Artificial Sequence: Synthetic oligonucleotide
uucugggcagaguagggu

SEQ ID NO: 68963 - RNA, 18 nt, Artificial Sequence
  Description of Artificial Sequence: Synthetic oligonucleotide
ugcacuucugggcagagu

SEQ ID NO: 68964 - RNA, 18 nt, Artificial Sequence
  Description of Artificial Sequence: Synthetic oligonucleotide
gcucuugcacuucugggc

SEQ ID NO: 68965 - RNA, 18 nt, Artificial Sequence
  Description of Artificial Sequence: Synthetic oligonucleotide
cuuaggcucuugcacuuc

SEQ ID NO: 68966 - RNA, 18 nt, Artificial Sequence
  Description of Artificial Sequence: Synthetic oligonucleotide
ggcggcuuaggcucuugc

SEQ ID NO: 68967 - RNA, 18 nt, Artificial Sequence
  Description of Artificial Sequence: Synthetic oligonucleotide
auggaggcggcuuaggcu

SEQ ID NO: 68968 - RNA, 18 nt, Artificial Sequence
  Description of Artificial Sequence: Synthetic oligonucleotide
gggccauggaggcggcuu

SEQ ID NO: 68969 - RNA, 18 nt, Artificial Sequence
  Description of Artificial Sequence: Synthetic oligonucleotide
cccugaauccuuccuggg

SEQ ID NO: 68970 - RNA, 18 nt, Artificial Sequence
  Description of Artificial Sequence: Synthetic oligonucleotide
ucuccccugaauccuucc

SEQ ID NO: 68971 - RNA, 18 nt, Artificial Sequence
  Description of Artificial Sequence: Synthetic oligonucleotide
gggccucuccccugaauc

SEQ ID NO: 68972 - RNA, 18 nt, Artificial Sequence
  Description of Artificial Sequence: Synthetic oligonucleotide
cguggcucccuguuuggg

SEQ ID NO: 68973 - RNA, 18 nt, Artificial Sequence
  Description of Artificial Sequence: Synthetic oligonucleotide
cuggcguggcucccuguu

SEQ ID NO: 68974 - RNA, 18 nt, Artificial Sequence
  Description of Artificial Sequence: Synthetic oligonucleotide
ucuggcuggcguggcucc

SEQ ID NO: 68975 - RNA, 18 nt, Artificial Sequence
  Description of Artificial Sequence: Synthetic oligonucleotide
gggugucuggcuggcgug

SEQ ID NO: 68976 - RNA, 18 nt, Artificial Sequence
  Description of Artificial Sequence: Synthetic oligonucleotide
agcuccauucuggccggg

SEQ ID NO: 68977 - RNA, 18 nt, Artificial Sequence
  Description of Artificial Sequence: Synthetic oligonucleotide
ucagcuccauucuggccg

SEQ ID NO: 68978 - RNA, 18 nt, Artificial Sequence
  Description of Artificial Sequence: Synthetic oligonucleotide
uagccccucagguguguu

SEQ ID NO: 68979 - RNA, 18 nt, Artificial Sequence
  Description of Artificial Sequence: Synthetic oligonucleotide
ggcccuagccccucaggu

SEQ ID NO: 68980 - RNA, 18 nt, Artificial Sequence
  Description of Artificial Sequence: Synthetic oligonucleotide
cauauggcccuagccccu

SEQ ID NO: 68981 - RNA, 18 nt, Artificial Sequence
  Description of Artificial Sequence: Synthetic oligonucleotide
guuuccauauggcccuag

SEQ ID NO: 68982 - RNA, 18 nt, Artificial Sequence
  Description of Artificial Sequence: Synthetic oligonucleotide
gucauguuuccauauggc

SEQ ID NO: 68983 - RNA, 18 nt, Artificial Sequence
  Description of Artificial Sequence: Synthetic oligonucleotide
cuucugucauguuuccau

SEQ ID NO: 68984 - RNA, 18 nt, Artificial Sequence
  Description of Artificial Sequence: Synthetic oligonucleotide
cuccccuucugucauguu

SEQ ID NO: 68985 - RNA, 18 nt, Artificial Sequence
  Description of Artificial Sequence: Synthetic oligonucleotide
ucucucuccccuucuguc

SEQ ID NO: 68986 - RNA, 18 nt, Artificial Sequence
  Description of Artificial Sequence: Synthetic oligonucleotide
uccuuucucucuccccuu

SEQ ID NO: 68987 - RNA, 18 nt, Artificial Sequence
  Description of Artificial Sequence: Synthetic oligonucleotide
gugucuccuuucucucuc

SEQ ID NO: 68988 - RNA, 18 nt, Artificial Sequence
  Description of Artificial Sequence: Synthetic oligonucleotide
gcagcgugucuccuuucu

SEQ ID NO: 68989 - RNA, 18 nt, Artificial Sequence
  Description of Artificial Sequence: Synthetic oligonucleotide
ccccugcagcgugucucc

SEQ ID NO: 68990 - RNA, 18 nt, Artificial Sequence
  Description of Artificial Sequence: Synthetic oligonucleotide
ccugcccccugcagcgug

SEQ ID NO: 68991 - RNA, 18 nt, Artificial Sequence
  Description of Artificial Sequence: Synthetic oligonucleotide
agcuuccugcccccugca

SEQ ID NO: 68992 - RNA, 18 nt, Artificial Sequence
  Description of Artificial Sequence: Synthetic oligonucleotide
cccccagcuuccugcccc

SEQ ID NO: 68993 - RNA, 18 nt, Artificial Sequence
  Description of Artificial Sequence: Synthetic oligonucleotide
ggguucccccagcuuccu

SEQ ID NO: 68994 - RNA, 18 nt, Artificial Sequence
  Description of Artificial Sequence: Synthetic oligonucleotide
agaauggguucccccagc

SEQ ID NO: 68995 - RNA, 18 nt, Artificial Sequence
  Description of Artificial Sequence: Synthetic oligonucleotide
uugggagaauggguuccc

SEQ ID NO: 68996 - RNA, 18 nt, Artificial Sequence
  Description of Artificial Sequence: Synthetic oligonucleotide
uauuuuugggagaauggg

SEQ ID NO: 68997 - RNA, 18 nt, Artificial Sequence
  Description of Artificial Sequence: Synthetic oligonucleotide
ccccuuauuuuugggaga

SEQ ID NO: 68998 - RNA, 18 nt, Artificial Sequence
  Description of Artificial Sequence: Synthetic oligonucleotide
ucagaccccuuauuuuug

SEQ ID NO: 68999 - RNA, 18 nt, Artificial Sequence
  Description of Artificial Sequence: Synthetic oligonucleotide
accccucagaccccuuau

SEQ ID NO: 69000 - RNA, 18 nt, Artificial Sequence
  Description of Artificial Sequence: Synthetic oligonucleotide
aauccaccccucagaccc

SEQ ID NO: 69001 - RNA, 18 nt, Artificial Sequence
  Description of Artificial Sequence: Synthetic oligonucleotide
cagggaauccaccccuca

SEQ ID NO: 69002 - RNA, 18 nt, Artificial Sequence
  Description of Artificial Sequence: Synthetic oligonucleotide
aaacccagggaauccacc

SEQ ID NO: 69003 - RNA, 18 nt, Artificial Sequence
  Description of Artificial Sequence: Synthetic oligonucleotide
gggagaauggguuccccc

SEQ ID NO: 69004 - RNA, 18 nt, Artificial Sequence
  Description of Artificial Sequence: Synthetic oligonucleotide
uuuuugggagaauggguu

SEQ ID NO: 69005 - RNA, 18 nt, Artificial Sequence
  Description of Artificial Sequence: Synthetic oligonucleotide
ccuuauuuuugggagaau

SEQ ID NO: 69006 - RNA, 18 nt, Artificial Sequence
  Description of Artificial Sequence: Synthetic oligonucleotide
agaccccuuauuuuuggg

SEQ ID NO: 69007 - RNA, 18 nt, Artificial Sequence
  Description of Artificial Sequence: Synthetic oligonucleotide
cccucagaccccuuauuu

SEQ ID NO: 69008 - RNA, 18 nt, Artificial Sequence
  Description of Artificial Sequence: Synthetic oligonucleotide
uccaccccucagaccccu

SEQ ID NO: 69009 - RNA, 18 nt, Artificial Sequence
  Description of Artificial Sequence: Synthetic oligonucleotide
gggaauccaccccucaga

SEQ ID NO: 69010 - RNA, 18 nt, Artificial Sequence
  Description of Artificial Sequence: Synthetic oligonucleotide
acccagggaauccacccc

SEQ ID NO: 69011 - RNA, 18 nt, Artificial Sequence
  Description of Artificial Sequence: Synthetic oligonucleotide
cugaaacccagggaaucc

SEQ ID NO: 69012 - RNA, 18 nt, Artificial Sequence
  Description of Artificial Sequence: Synthetic oligonucleotide
cagaccugaaacccaggg

SEQ ID NO: 69013 - RNA, 18 nt, Artificial Sequence
  Description of Artificial Sequence: Synthetic oligonucleotide
ggacccagaccugaaacc

SEQ ID NO: 69014 - RNA, 18 nt, Artificial Sequence
  Description of Artificial Sequence: Synthetic oligonucleotide
auucaggacccagaccug

SEQ ID NO: 69015 - RNA, 18 nt, Artificial Sequence
  Description of Artificial Sequence: Synthetic oligonucleotide
uucccauucaggacccag

SEQ ID NO: 69016 - RNA, 18 nt, Artificial Sequence
  Description of Artificial Sequence: Synthetic oligonucleotide
aggaauucccauucagga

SEQ ID NO: 69017 - RNA, 18 nt, Artificial Sequence
  Description of Artificial Sequence: Synthetic oligonucleotide
auuccaggaauucccauu

SEQ ID NO: 69018 - RNA, 18 nt, Artificial Sequence
  Description of Artificial Sequence: Synthetic oligonucleotide
cugguauuccaggaauuc

SEQ ID NO: 69019 - RNA, 18 nt, Artificial Sequence
  Description of Artificial Sequence: Synthetic oligonucleotide
gucagcugguauuccagg

SEQ ID NO: 69020 - RNA, 18 nt, Artificial Sequence
  Description of Artificial Sequence: Synthetic oligonucleotide
ucauugucagcugguauu

SEQ ID NO: 69021 - RNA, 18 nt, Artificial Sequence
  Description of Artificial Sequence: Synthetic oligonucleotide
ggaaaucauugucagcug

SEQ ID NO: 69022 - RNA, 18 nt, Artificial Sequence
  Description of Artificial Sequence: Synthetic oligonucleotide
gaggaggaaaucauuguc

SEQ ID NO: 69023 - RNA, 18 nt, Artificial Sequence
  Description of Artificial Sequence: Synthetic oligonucleotide
aagaugaggaggaaauca

SEQ ID NO: 69024 - RNA, 18 nt, Artificial Sequence
  Description of Artificial Sequence: Synthetic oligonucleotide
guugaaagaugaggagga

SEQ ID NO: 69025 - RNA, 18 nt, Artificial Sequence
  Description of Artificial Sequence: Synthetic oligonucleotide
gugagguugaaagaugag

SEQ ID NO: 69026 - RNA, 18 nt, Artificial Sequence
  Description of Artificial Sequence: Synthetic oligonucleotide
augaccacgaggagcaau

SEQ ID NO: 69027 - RNA, 18 nt, Artificial Sequence
  Description of Artificial Sequence: Synthetic oligonucleotide
gaagcaugaccacgagga

SEQ ID NO: 69028 - RNA, 18 nt, Artificial Sequence
  Description of Artificial Sequence: Synthetic oligonucleotide
uaggagaagcaugaccac

SEQ ID NO: 69029 - RNA, 18 nt, Artificial Sequence
  Description of Artificial Sequence: Synthetic oligonucleotide
gcaguuaggagaagcaug

SEQ ID NO: 69030 - RNA, 18 nt, Artificial Sequence
  Description of Artificial Sequence: Synthetic oligonucleotide
gccuugcaguuaggagaa

SEQ ID NO: 69031 - RNA, 18 nt, Artificial Sequence
  Description of Artificial Sequence: Synthetic oligonucleotide
cguuagccuugcaguuag

SEQ ID NO: 69032 - RNA, 18 nt, Artificial Sequence
  Description of Artificial Sequence: Synthetic oligonucleotide
gacagcguuagccuugca

SEQ ID NO: 69033 - RNA, 18 nt, Artificial Sequence
  Description of Artificial Sequence: Synthetic oligonucleotide
ggcuggacagcguuagcc

SEQ ID NO: 69034 - RNA, 18 nt, Artificial Sequence
  Description of Artificial Sequence: Synthetic oligonucleotide
agccgggcuggacagcgu

SEQ ID NO: 69035 - RNA, 18 nt, Artificial Sequence
  Description of Artificial Sequence: Synthetic oligonucleotide
ggaggagccgggcuggac

SEQ ID NO: 69036 - RNA, 18 nt, Artificial Sequence
  Description of Artificial Sequence: Synthetic oligonucleotide
aagcaggaggagccgggc

SEQ ID NO: 69037 - RNA, 18 nt, Artificial Sequence
  Description of Artificial Sequence: Synthetic oligonucleotide
gucacaagcaggaggagc

SEQ ID NO: 69038 - RNA, 18 nt, Artificial Sequence
  Description of Artificial Sequence: Synthetic oligonucleotide
cggaggucacaagcagga

SEQ ID NO: 69039 - RNA, 18 nt, Artificial Sequence
  Description of Artificial Sequence: Synthetic oligonucleotide
ggacucggaggucacaag

SEQ ID NO: 69040 - RNA, 18 nt, Artificial Sequence
  Description of Artificial Sequence: Synthetic oligonucleotide
acugaggacucggagguc

SEQ ID NO: 69041 - RNA, 18 nt, Artificial Sequence
  Description of Artificial Sequence: Synthetic oligonucleotide
aguuuacugaggacucgg

SEQ ID NO: 69042 - RNA, 18 nt, Artificial Sequence
  Description of Artificial Sequence: Synthetic oligonucleotide
gaagcaguuuacugagga

SEQ ID NO: 69043 - RNA, 18 nt, Artificial Sequence
  Description of Artificial Sequence: Synthetic oligonucleotide
gucacgaagcaguuuacu

SEQ ID NO: 69044 - RNA, 18 nt, Artificial Sequence
  Description of Artificial Sequence: Synthetic oligonucleotide
ugggagucacgaagcagu

SEQ ID NO: 69045 - RNA, 18 nt, Artificial Sequence
  Description of Artificial Sequence: Synthetic oligonucleotide
ggacaugggagucacgaa

SEQ ID NO: 69046 - RNA, 18 nt, Artificial Sequence
  Description of Artificial Sequence: Synthetic oligonucleotide
gugaaggacaugggaguc

SEQ ID NO: 69047 - RNA, 18 nt, Artificial Sequence
  Description of Artificial Sequence: Synthetic oligonucleotide
cugcugugaaggacaugg

SEQ ID NO: 69048 - RNA, 18 nt, Artificial Sequence
  Description of Artificial Sequence: Synthetic oligonucleotide
caugaccacgaggagcaa

SEQ ID NO: 69049 - RNA, 18 nt, Artificial Sequence
  Description of Artificial Sequence: Synthetic oligonucleotide
agaagcaugaccacgagg

SEQ ID NO: 69050 - RNA, 18 nt, Artificial Sequence
  Description of Artificial Sequence: Synthetic oligonucleotide
uuaggagaagcaugacca

SEQ ID NO: 69051 - RNA, 18 nt, Artificial Sequence
  Description of Artificial Sequence: Synthetic oligonucleotide
ugcaguuaggagaagcau

SEQ ID NO: 69052 - RNA, 18 nt, Artificial Sequence
  Description of Artificial Sequence: Synthetic oligonucleotide
agccuugcaguuaggaga

SEQ ID NO: 69053 - RNA, 18 nt, Artificial Sequence
  Description of Artificial Sequence: Synthetic oligonucleotide
gcguuagccuugcaguua

SEQ ID NO: 69054 - RNA, 18 nt, Artificial Sequence
  Description of Artificial Sequence: Synthetic oligonucleotide
ggacagcguuagccuugc

SEQ ID NO: 69055 - RNA, 18 nt, Artificial Sequence
  Description of Artificial Sequence: Synthetic oligonucleotide
gggcuggacagcguuagc

SEQ ID NO: 69056 - RNA, 18 nt, Artificial Sequence
  Description of Artificial Sequence: Synthetic oligonucleotide
gagccgggcuggacagcg

SEQ ID NO: 69057 - RNA, 18 nt, Artificial Sequence
  Description of Artificial Sequence: Synthetic oligonucleotide
aggaggagccgggcugga

SEQ ID NO: 69058 - RNA, 18 nt, Artificial Sequence
  Description of Artificial Sequence: Synthetic oligonucleotide
caagcaggaggagccggg

SEQ ID NO: 69059 - RNA, 18 nt, Artificial Sequence
  Description of Artificial Sequence: Synthetic oligonucleotide
ggucacaagcaggaggag

SEQ ID NO: 69060 - RNA, 18 nt, Artificial Sequence
  Description of Artificial Sequence: Synthetic oligonucleotide
ucggaggucacaagcagg

SEQ ID NO: 69061 - RNA, 18 nt, Artificial Sequence
  Description of Artificial Sequence: Synthetic oligonucleotide
aggacucggaggucacaa

SEQ ID NO: 69062 - RNA, 18 nt, Artificial Sequence
  Description of Artificial Sequence: Synthetic oligonucleotide
uacugaggacucggaggu

SEQ ID NO: 69063 - RNA, 18 nt, Artificial Sequence
  Description of Artificial Sequence: Synthetic oligonucleotide
caguuuacugaggacucg

SEQ ID NO: 69064 - RNA, 18 nt, Artificial Sequence
  Description of Artificial Sequence: Synthetic oligonucleotide
cgaagcaguuuacugagg

SEQ ID NO: 69065 - RNA, 18 nt, Artificial Sequence
  Description of Artificial Sequence: Synthetic oligonucleotide
agucacgaagcaguuuac

SEQ ID NO: 69066 - RNA, 18 nt, Artificial Sequence
  Description of Artificial Sequence: Synthetic oligonucleotide
augggagucacgaagcag

SEQ ID NO: 69067 - RNA, 18 nt, Artificial Sequence
  Description of Artificial Sequence: Synthetic oligonucleotide
aggacaugggagucacga

SEQ ID NO: 69068 - RNA, 18 nt, Artificial Sequence
  Description of Artificial Sequence: Synthetic oligonucleotide
ugugaaggacaugggagu

SEQ ID NO: 69069 - RNA, 18 nt, Artificial Sequence
  Description of Artificial Sequence: Synthetic oligonucleotide
ucugcugugaaggacaug

SEQ ID NO: 69070 - RNA, 18 nt, Artificial Sequence
  Description of Artificial Sequence: Synthetic oligonucleotide
gggauaauguugggaguu

SEQ ID NO: 69071 - RNA, 18 nt, Artificial Sequence
  Description of Artificial Sequence: Synthetic oligonucleotide
uaccaguuacgcggauaa

SEQ ID NO: 69072 - RNA, 18 nt, Artificial Sequence
  Description of Artificial Sequence: Synthetic oligonucleotide
ugucuuaccaguuacgcg

SEQ ID NO: 69073 - RNA, 18 nt, Artificial Sequence
  Description of Artificial Sequence: Synthetic oligonucleotide
augggugucuuaccaguu

SEQ ID NO: 69074 - RNA, 18 nt, Artificial Sequence
  Description of Artificial Sequence: Synthetic oligonucleotide
ggaguaugggugucuuac

SEQ ID NO: 69075 - RNA, 18 nt, Artificial Sequence
  Description of Artificial Sequence: Synthetic oligonucleotide
uccugggaguaugggugu

SEQ ID NO: 69076 - RNA, 18 nt, Artificial Sequence
  Description of Artificial Sequence: Synthetic oligonucleotide
ugucuuccugggaguaug

SEQ ID NO: 69077 - RNA, 18 nt, Artificial Sequence
  Description of Artificial Sequence: Synthetic oligonucleotide
gauggugucuuccuggga

SEQ ID NO: 69078 - RNA, 18 nt, Artificial Sequence
  Description of Artificial Sequence: Synthetic oligonucleotide
gaagugauggugucuucc

SEQ ID NO: 69079 - RNA, 18 nt, Artificial Sequence
  Description of Artificial Sequence: Synthetic oligonucleotide
uagaggaagugauggugu

SEQ ID NO: 69080 - RNA, 18 nt, Artificial Sequence
  Description of Artificial Sequence: Synthetic oligonucleotide
ggaguuagaggaagugau

SEQ ID NO: 69081 - RNA, 18 nt, Artificial Sequence
  Description of Artificial Sequence: Synthetic oligonucleotide
gucaaggaguuagaggaa

SEQ ID NO: 69082 - RNA, 18 nt, Artificial Sequence
  Description of Artificial Sequence: Synthetic oligonucleotide
auugggucaaggaguuag

SEQ ID NO: 69083 - RNA, 18 nt, Artificial Sequence
  Description of Artificial Sequence: Synthetic oligonucleotide
uagucauugggucaagga

SEQ ID NO: 69084 - RNA, 18 nt, Artificial Sequence
  Description of Artificial Sequence: Synthetic oligonucleotide
aagaauagucauuggguc

SEQ ID NO: 69085 - RNA, 18 nt, Artificial Sequence
  Description of Artificial Sequence: Synthetic oligonucleotide
augggaagaauagucauu

SEQ ID NO: 69086 - RNA, 18 nt, Artificial Sequence
  Description of Artificial Sequence: Synthetic oligonucleotide
acaauaugggaagaauag

SEQ ID NO: 69087 - RNA, 18 nt, Artificial Sequence
  Description of Artificial Sequence: Synthetic oligonucleotide
gggacaauaugggaagaa

SEQ ID NO: 69088 - RNA, 18 nt, Artificial Sequence
  Description of Artificial Sequence: Synthetic oligonucleotide
gugugaucaguagguggg

SEQ ID NO: 69089 - RNA, 18 nt, Artificial Sequence
  Description of Artificial Sequence: Synthetic oligonucleotide
agagagugugaucaguag

SEQ ID NO: 69090 - RNA, 18 nt, Artificial Sequence
  Description of Artificial Sequence: Synthetic oligonucleotide
uugucagagagugugauc

SEQ ID NO: 69091 - RNA, 18 nt, Artificial Sequence
  Description of Artificial Sequence: Synthetic oligonucleotide
aauccuugucagagagug

SEQ ID NO: 69092 - RNA, 18 nt, Artificial Sequence
  Description of Artificial Sequence: Synthetic oligonucleotide
agaauaauccuugucaga

SEQ ID NO: 69093 - RNA, 18 nt, Artificial Sequence
  Description of Artificial Sequence: Synthetic oligonucleotide
ugugaagaauaauccuug

SEQ ID NO: 69094 - RNA, 18 nt, Artificial Sequence
  Description of Artificial Sequence: Synthetic oligonucleotide
uguauugugaagaauaau

SEQ ID NO: 69095 - RNA, 18 nt, Artificial Sequence
  Description of Artificial Sequence: Synthetic oligonucleotide
cgggcuguauugugaaga

SEQ ID NO: 69096 - RNA, 18 nt, Artificial Sequence
  Description of Artificial Sequence: Synthetic oligonucleotide
gugugaucaguagguggg

SEQ ID NO: 69097 - RNA, 18 nt, Artificial Sequence
  Description of Artificial Sequence: Synthetic oligonucleotide
gagagugugaucaguagg

SEQ ID NO: 69098 - RNA, 18 nt, Artificial Sequence
  Description of Artificial Sequence: Synthetic oligonucleotide
ugucagagagugugauca

SEQ ID NO: 69099 - RNA, 18 nt, Artificial Sequence
  Description of Artificial Sequence: Synthetic oligonucleotide
auccuugucagagagugu

SEQ ID NO: 69100 - RNA, 18 nt, Artificial Sequence
  Description of Artificial Sequence: Synthetic oligonucleotide
gaauaauccuugucagag

SEQ ID NO: 69101 - RNA, 18 nt, Artificial Sequence
  Description of Artificial Sequence: Synthetic oligonucleotide
gugaagaauaauccuugu

SEQ ID NO: 69102 - RNA, 18 nt, Artificial Sequence
  Description of Artificial Sequence: Synthetic oligonucleotide
guauugugaagaauaauc

SEQ ID NO: 69103 - RNA, 18 nt, Artificial Sequence
  Description of Artificial Sequence: Synthetic oligonucleotide
gggcuguauugugaagaa

SEQ ID NO: 69104 - RNA, 18 nt, Artificial Sequence
  Description of Artificial Sequence: Synthetic oligonucleotide
aaugcgggcuguauugug

SEQ ID NO: 69105 - RNA, 18 nt, Artificial Sequence
  Description of Artificial Sequence: Synthetic oligonucleotide
uuuuaaaugcgggcugua

SEQ ID NO: 69106 - RNA, 18 nt, Artificial Sequence
  Description of Artificial Sequence: Synthetic oligonucleotide
agagcuuuuaaaugcggg

SEQ ID NO: 69107 - RNA, 18 nt, Artificial Sequence
  Description of Artificial Sequence: Synthetic oligonucleotide
agacgagagcuuuuaaau

SEQ ID NO: 69108 - RNA, 18 nt, Artificial Sequence
  Description of Artificial Sequence: Synthetic oligonucleotide
ucucuagacgagagcuuu

SEQ ID NO: 69109 - RNA, 18 nt, Artificial Sequence
  Description of Artificial Sequence: Synthetic oligonucleotide
uacuaucucuagacgaga

SEQ ID NO: 69110 - RNA, 18 nt, Artificial Sequence
  Description of Artificial Sequence: Synthetic oligonucleotide
augaguacuaucucuaga

SEQ ID NO: 69111 - RNA, 18 nt, Artificial Sequence
  Description of Artificial Sequence: Synthetic oligonucleotide
ccuccaugaguacuaucu

SEQ ID NO: 69112 - RNA, 18 nt, Artificial Sequence
  Description of Artificial Sequence: Synthetic oligonucleotide
cuaguccuccaugaguac

SEQ ID NO: 69113 - RNA, 18 nt, Artificial Sequence
  Description of Artificial Sequence: Synthetic oligonucleotide
gcaggcuaguccuccaug

SEQ ID NO: 69114 - RNA, 18 nt, Artificial Sequence
  Description of Artificial Sequence: Synthetic oligonucleotide
aauaagcaggcuaguccu

SEQ ID NO: 69115 - RNA, 18 nt, Artificial Sequence
  Description of Artificial Sequence: Synthetic oligonucleotide
agccuaauaagcaggcua

SEQ ID NO: 69116 - RNA, 18 nt, Artificial Sequence
  Description of Artificial Sequence: Synthetic oligonucleotide
augguagccuaauaagca

SEQ ID NO: 69117 - RNA, 18 nt, Artificial Sequence
  Description of Artificial Sequence: Synthetic oligonucleotide
gagcuaugguagccuaau

SEQ ID NO: 69118 - RNA, 18 nt, Artificial Sequence
  Description of Artificial Sequence: Synthetic oligonucleotide
agagagagcuaugguagc

SEQ ID NO: 69119 - RNA, 18 nt, Artificial Sequence
  Description of Artificial Sequence: Synthetic oligonucleotide
gaaauagagagagcuaug

SEQ ID NO: 69120 - RNA, 18 nt, Artificial Sequence
  Description of Artificial Sequence: Synthetic oligonucleotide
gagcugaaauagagagag

SEQ ID NO: 69121 - RNA, 18 nt, Artificial Sequence
  Description of Artificial Sequence: Synthetic oligonucleotide
gaagggagcugaaauaga

SEQ ID NO: 69122 - RNA, 18 nt, Artificial Sequence
  Description of Artificial Sequence: Synthetic oligonucleotide
gaaccucugggcacuggc

SEQ ID NO: 69123 - RNA, 18 nt, Artificial Sequence
  Description of Artificial Sequence: Synthetic oligonucleotide
agggugaaccucugggca

SEQ ID NO: 69124 - RNA, 18 nt, Artificial Sequence
  Description of Artificial Sequence: Synthetic oligonucleotide
ggcaaagggugaaccucu

SEQ ID NO: 69125 - RNA, 18 nt, Artificial Sequence
  Description of Artificial Sequence: Synthetic oligonucleotide
guguaggcaaagggugaa

SEQ ID NO: 69126 - RNA, 18 nt, Artificial Sequence
  Description of Artificial Sequence: Synthetic oligonucleotide
gacagguguaggcaaagg

SEQ ID NO: 69127 - RNA, 18 nt, Artificial Sequence
  Description of Artificial Sequence: Synthetic oligonucleotide
agcaggacagguguaggc

SEQ ID NO: 69128 - RNA, 18 nt, Artificial Sequence
  Description of Artificial Sequence: Synthetic oligonucleotide
caggcagcaggacaggug

SEQ ID NO: 69129 - RNA, 18 nt, Artificial Sequence
  Description of Artificial Sequence: Synthetic oligonucleotide
cacagcaggcagcaggac

SEQ ID NO: 69130 - RNA, 18 nt, Artificial Sequence
  Description of Artificial Sequence: Synthetic oligonucleotide
aaguccacagcaggcagc

SEQ ID NO: 69131 - RNA, 18 nt, Artificial Sequence
  Description of Artificial Sequence: Synthetic oligonucleotide
agcuaaaguccacagcag

SEQ ID NO: 69132 - RNA, 18 nt, Artificial Sequence
  Description of Artificial Sequence: Synthetic oligonucleotide
ucccaagcuaaaguccac

SEQ ID NO: 69133 - RNA, 18 nt, Artificial Sequence
  Description of Artificial Sequence: Synthetic oligonucleotide
cauucucccaagcuaaag

SEQ ID NO: 69134 - RNA, 18 nt, Artificial Sequence
  Description of Artificial Sequence: Synthetic oligonucleotide
uuuuccauucucccaagc

SEQ ID NO: 69135 - RNA, 18 nt, Artificial Sequence
  Description of Artificial Sequence: Synthetic oligonucleotide
cuggguuuuccauucucc

SEQ ID NO: 69136 - RNA, 18 nt, Artificial Sequence
  Description of Artificial Sequence: Synthetic oligonucleotide
gaaccucugggcacuggc

SEQ ID NO: 69137 - RNA, 18 nt, Artificial Sequence
  Description of Artificial Sequence: Synthetic oligonucleotide
agggugaaccucugggca

SEQ ID NO: 69138 - RNA, 18 nt, Artificial Sequence
  Description of Artificial Sequence: Synthetic oligonucleotide
ggcaaagggugaaccucu

SEQ ID NO: 69139 - RNA, 18 nt, Artificial Sequence
  Description of Artificial Sequence: Synthetic oligonucleotide
guguaggcaaagggugaa

SEQ ID NO: 69140 - RNA, 18 nt, Artificial Sequence
  Description of Artificial Sequence: Synthetic oligonucleotide
gacagguguaggcaaagg

SEQ ID NO: 69141 - RNA, 18 nt, Artificial Sequence
  Description of Artificial Sequence: Synthetic oligonucleotide
agcaggacagguguaggc

SEQ ID NO: 69142 - RNA, 18 nt, Artificial Sequence
  Description of Artificial Sequence: Synthetic oligonucleotide
caggcagcaggacaggug

SEQ ID NO: 69143 - RNA, 18 nt, Artificial Sequence
  Description of Artificial Sequence: Synthetic oligonucleotide
cacagcaggcagcaggac

SEQ ID NO: 69144 - RNA, 18 nt, Artificial Sequence
  Description of Artificial Sequence: Synthetic oligonucleotide
aaguccacagcaggcagc

SEQ ID NO: 69145 - RNA, 18 nt, Artificial Sequence
  Description of Artificial Sequence: Synthetic oligonucleotide
agcuaaaguccacagcag

SEQ ID NO: 69146 - RNA, 18 nt, Artificial Sequence
  Description of Artificial Sequence: Synthetic oligonucleotide
ucccaagcuaaaguccac

SEQ ID NO: 69147 - RNA, 18 nt, Artificial Sequence
  Description of Artificial Sequence: Synthetic oligonucleotide
cauucucccaagcuaaag

SEQ ID NO: 69148 - RNA, 18 nt, Artificial Sequence
  Description of Artificial Sequence: Synthetic oligonucleotide
uuuuccauucucccaagc

SEQ ID NO: 69149 - RNA, 18 nt, Artificial Sequence
  Description of Artificial Sequence: Synthetic oligonucleotide
cuggguuuuccauucucc

SEQ ID NO: 69150 - RNA, 18 nt, Artificial Sequence
  Description of Artificial Sequence: Synthetic oligonucleotide
aagguuagggauggcuuu

SEQ ID NO: 69151 - RNA, 18 nt, Artificial Sequence
  Description of Artificial Sequence: Synthetic oligonucleotide
aagccaagguuagggaug

SEQ ID NO: 69152 - RNA, 18 nt, Artificial Sequence
  Description of Artificial Sequence: Synthetic oligonucleotide
uagggaagccaagguuag

SEQ ID NO: 69153 - RNA, 18 nt, Artificial Sequence
  Description of Artificial Sequence: Synthetic oligonucleotide
ggacuuagggaagccaag

SEQ ID NO: 69154 - RNA, 18 nt, Artificial Sequence
  Description of Artificial Sequence: Synthetic oligonucleotide
agacaggacuuagggaag

SEQ ID NO: 69155 - RNA, 18 nt, Artificial Sequence
  Description of Artificial Sequence: Synthetic oligonucleotide
acugaagacaggacuuag

SEQ ID NO: 69156 - RNA, 18 nt, Artificial Sequence
  Description of Artificial Sequence: Synthetic oligonucleotide
gggaaacugaagacagga

SEQ ID NO: 69157 - RNA, 18 nt, Artificial Sequence
  Description of Artificial Sequence: Synthetic oligonucleotide
gcagugggaaacugaaga

SEQ ID NO: 69158 - RNA, 18 nt, Artificial Sequence
  Description of Artificial Sequence: Synthetic oligonucleotide
gggaagcagugggaaacu

SEQ ID NO: 69159 - RNA, 18 nt, Artificial Sequence
  Description of Artificial Sequence: Synthetic oligonucleotide
uccaugggaagcaguggg

SEQ ID NO: 69160 - RNA, 18 nt, Artificial Sequence
  Description of Artificial Sequence: Synthetic oligonucleotide
gagaauccaugggaagca

SEQ ID NO: 69161 - RNA, 18 nt, Artificial Sequence
  Description of Artificial Sequence: Synthetic oligonucleotide
uguuggagaauccauggg

SEQ ID NO: 69162 - RNA, 18 nt, Artificial Sequence
  Description of Artificial Sequence: Synthetic oligonucleotide
aagaauguuggagaaucc

SEQ ID NO: 69163 - RNA, 18 nt, Artificial Sequence
  Description of Artificial Sequence: Synthetic oligonucleotide
agcucaagaauguuggag

SEQ ID NO: 69164 - RNA, 18 nt, Artificial Sequence
  Description of Artificial Sequence: Synthetic oligonucleotide
uaaaaagcucaagaaugu

SEQ ID NO: 69165 - RNA, 18 nt, Artificial Sequence
  Description of Artificial Sequence: Synthetic oligonucleotide
auuuuuaaaaagcucaag

SEQ ID NO: 69166 - RNA, 18 nt, Artificial Sequence
  Description of Artificial Sequence: Synthetic oligonucleotide
gagauauuuuuaaaaagc

SEQ ID NO: 69167 - RNA, 18 nt, Artificial Sequence
  Description of Artificial Sequence: Synthetic oligonucleotide
aaggugagauauuuuuaa

SEQ ID NO: 69168 - RNA, 18 nt, Artificial Sequence
  Description of Artificial Sequence: Synthetic oligonucleotide
agcugaaggugagauauu

SEQ ID NO: 69169 - RNA, 18 nt, Artificial Sequence
  Description of Artificial Sequence: Synthetic oligonucleotide
ggccaagcugaaggugag

SEQ ID NO: 69170 - RNA, 18 nt, Artificial Sequence
  Description of Artificial Sequence: Synthetic oligonucleotide
aggguggccaagcugaag

SEQ ID NO: 69171 - RNA, 18 nt, Artificial Sequence
  Description of Artificial Sequence: Synthetic oligonucleotide
ggguuaggguggccaagc

SEQ ID NO: 69172 - RNA, 18 nt, Artificial Sequence
  Description of Artificial Sequence: Synthetic oligonucleotide
agauuggguuaggguggc

SEQ ID NO: 69173 - RNA, 18 nt, Artificial Sequence
  Description of Artificial Sequence: Synthetic oligonucleotide
aauguagauuggguuagg

SEQ ID NO: 69174 - RNA, 18 nt, Artificial Sequence
  Description of Artificial Sequence: Synthetic oligonucleotide
aggugaauguagauuggg

SEQ ID NO: 69175 - RNA, 18 nt, Artificial Sequence
  Description of Artificial Sequence: Synthetic oligonucleotide
aucauaggugaauguaga

SEQ ID NO: 69176 - RNA, 18 nt, Artificial Sequence
  Description of Artificial Sequence: Synthetic oligonucleotide
cuaucaucauaggugaau

SEQ ID NO: 69177 - RNA, 18 nt, Artificial Sequence
  Description of Artificial Sequence: Synthetic oligonucleotide
acaggcuaucaucauagg

SEQ ID NO: 69178 - RNA, 18 nt, Artificial Sequence
  Description of Artificial Sequence: Synthetic oligonucleotide
uauccacaggcuaucauc

SEQ ID NO: 69179 - RNA, 18 nt, Artificial Sequence
  Description of Artificial Sequence: Synthetic oligonucleotide
caucuuauccacaggcua

SEQ ID NO: 69180 - RNA, 18 nt, Artificial Sequence
  Description of Artificial Sequence: Synthetic oligonucleotide
gccaucaucuuauccaca

SEQ ID NO: 69181 - RNA, 18 nt, Artificial Sequence
  Description of Artificial Sequence: Synthetic oligonucleotide
ugcaagccaucaucuuau

SEQ ID NO: 69182 - RNA, 18 nt, Artificial Sequence
  Description of Artificial Sequence: Synthetic oligonucleotide
ggaccugcaagccaucau

SEQ ID NO: 69183 - RNA, 18 nt, Artificial Sequence
  Description of Artificial Sequence: Synthetic oligonucleotide
auauuggaccugcaagcc

SEQ ID NO: 69184 - RNA, 18 nt, Artificial Sequence
  Description of Artificial Sequence: Synthetic oligonucleotide
uucacauauuggaccugc

SEQ ID NO: 69185 - RNA, 18 nt, Artificial Sequence
  Description of Artificial Sequence: Synthetic oligonucleotide
aucuauucacauauugga

SEQ ID NO: 69186 - RNA, 18 nt, Artificial Sequence
  Description of Artificial Sequence: Synthetic oligonucleotide
uucaaaucuauucacaua

SEQ ID NO: 69187 - RNA, 18 nt, Artificial Sequence
  Description of Artificial Sequence: Synthetic oligonucleotide
ucagcuucaaaucuauuc

SEQ ID NO: 69188 - RNA, 18 nt, Artificial Sequence
  Description of Artificial Sequence: Synthetic oligonucleotide
gguguucagcuucaaauc

SEQ ID NO: 69189 - RNA, 18 nt, Artificial Sequence
  Description of Artificial Sequence: Synthetic oligonucleotide
uucaugguguucagcuuc

SEQ ID NO: 69190 - RNA, 18 nt, Artificial Sequence
  Description of Artificial Sequence: Synthetic oligonucleotide
agcuuuucaugguguuca

SEQ ID NO: 69191 - RNA, 18 nt, Artificial Sequence
  Description of Artificial Sequence: Synthetic oligonucleotide
ucuccagcuuuucauggu

SEQ ID NO: 69192 - RNA, 18 nt, Artificial Sequence
  Description of Artificial Sequence: Synthetic oligonucleotide
auuucucuccagcuuuuc

SEQ ID NO: 69193 - RNA, 18 nt, Artificial Sequence
  Description of Artificial Sequence: Synthetic oligonucleotide
gagcgauuucucuccagc

SEQ ID NO: 69194 - RNA, 18 nt, Artificial Sequence
  Description of Artificial Sequence: Synthetic oligonucleotide
gccaugagcgauuucucu

SEQ ID NO: 69195 - RNA, 18 nt, Artificial Sequence
  Description of Artificial Sequence: Synthetic oligonucleotide
gcauggccaugagcgauu

SEQ ID NO: 69196 - RNA, 18 nt, Artificial Sequence
  Description of Artificial Sequence: Synthetic oligonucleotide
caaaggcauggccaugag

SEQ ID NO: 69197 - RNA, 18 nt, Artificial Sequence
  Description of Artificial Sequence: Synthetic oligonucleotide
uaggucaaaggcauggcc

SEQ ID NO: 69198 - RNA, 18 nt, Artificial Sequence
  Description of Artificial Sequence: Synthetic oligonucleotide
gggaauaggucaaaggca

SEQ ID NO: 69199 - RNA, 18 nt, Artificial Sequence
  Description of Artificial Sequence: Synthetic oligonucleotide
ugaacgggaauaggucaa

SEQ ID NO: 69200 - RNA, 18 nt, Artificial Sequence
  Description of Artificial Sequence: Synthetic oligonucleotide
aagacugaacgggaauag

SEQ ID NO: 69201 - RNA, 18 nt, Artificial Sequence
  Description of Artificial Sequence: Synthetic oligonucleotide
uuaagaagacugaacggg

SEQ ID NO: 69202 - RNA, 18 nt, Artificial Sequence
  Description of Artificial Sequence: Synthetic oligonucleotide
ccaauuuaagaagacuga

SEQ ID NO: 69203 - RNA, 18 nt, Artificial Sequence
  Description of Artificial Sequence: Synthetic oligonucleotide
ucaugccaauuuaagaag

SEQ ID NO: 69204 - RNA, 18 nt, Artificial Sequence
  Description of Artificial Sequence: Synthetic oligonucleotide
cuucuucaugccaauuua

SEQ ID NO: 69205 - RNA, 18 nt, Artificial Sequence
  Description of Artificial Sequence: Synthetic oligonucleotide
ucuugcuucuucaugcca

SEQ ID NO: 69206 - RNA, 18 nt, Artificial Sequence
  Description of Artificial Sequence: Synthetic oligonucleotide
augagucuugcuucuuca

SEQ ID NO: 69207 - RNA, 18 nt, Artificial Sequence
  Description of Artificial Sequence: Synthetic oligonucleotide
gacauaugagucuugcuu

SEQ ID NO: 69208 - RNA, 18 nt, Artificial Sequence
  Description of Artificial Sequence: Synthetic oligonucleotide
uggaugacauaugagucu

SEQ ID NO: 69209 - RNA, 18 nt, Artificial Sequence
  Description of Artificial Sequence: Synthetic oligonucleotide
aucuguggaugacauaug

SEQ ID NO: 69210 - RNA, 18 nt, Artificial Sequence
  Description of Artificial Sequence: Synthetic oligonucleotide
gugucaucuguggaugac

SEQ ID NO: 69211 - RNA, 18 nt, Artificial Sequence
  Description of Artificial Sequence: Synthetic oligonucleotide
gcuuugugucaucugugg

SEQ ID NO: 69212 - RNA, 18 nt, Artificial Sequence
  Description of Artificial Sequence: Synthetic oligonucleotide
ucccagcuuugugucauc

SEQ ID NO: 69213 - RNA, 18 nt, Artificial Sequence
  Description of Artificial Sequence: Synthetic oligonucleotide
guacuucccagcuuugug

SEQ ID NO: 69214 - RNA, 18 nt, Artificial Sequence
  Description of Artificial Sequence: Synthetic oligonucleotide
uagugguacuucccagcu

SEQ ID NO: 69215 - RNA, 18 nt, Artificial Sequence
  Description of Artificial Sequence: Synthetic oligonucleotide
uauuuuagugguacuucc

SEQ ID NO: 69216 - RNA, 18 nt, Artificial Sequence
  Description of Artificial Sequence: Synthetic oligonucleotide
uuuguuauuuuaguggua

SEQ ID NO: 69217 - RNA, 18 nt, Artificial Sequence
  Description of Artificial Sequence: Synthetic oligonucleotide
agucuuuuguuauuuuag

SEQ ID NO: 69218 - RNA, 18 nt, Artificial Sequence
  Description of Artificial Sequence: Synthetic oligonucleotide
gauucagucuuuuguuau

SEQ ID NO: 69219 - RNA, 18 nt, Artificial Sequence
  Description of Artificial Sequence: Synthetic oligonucleotide
aucuugauucagucuuuu

SEQ ID NO: 69220 - RNA, 18 nt, Artificial Sequence
  Description of Artificial Sequence: Synthetic oligonucleotide
uuugaaucuugauucagu

SEQ ID NO: 69221 - RNA, 18 nt, Artificial Sequence
  Description of Artificial Sequence: Synthetic oligonucleotide
agugauuugaaucuugau

SEQ ID NO: 69222 - RNA, 18 nt, Artificial Sequence
  Description of Artificial Sequence: Synthetic oligonucleotide
cuuucagugauuugaauc

SEQ ID NO: 69223 - RNA, 18 nt, Artificial Sequence
  Description of Artificial Sequence: Synthetic oligonucleotide
cuagucuuucagugauuu

SEQ ID NO: 69224 - RNA, 18 nt, Artificial Sequence
  Description of Artificial Sequence: Synthetic oligonucleotide
uugaccuagucuuucagu

SEQ ID NO: 69225 - RNA, 18 nt, Artificial Sequence
  Description of Artificial Sequence: Synthetic oligonucleotide
uguuuuugaccuagucuu

SEQ ID NO: 69226 - RNA, 18 nt, Artificial Sequence
  Description of Artificial Sequence: Synthetic oligonucleotide
caccuuguuuuugaccua

SEQ ID NO: 69227 - RNA, 18 nt, Artificial Sequence
  Description of Artificial Sequence: Synthetic oligonucleotide
uguuucaccuuguuuuug

SEQ ID NO: 69228 - RNA, 18 nt, Artificial Sequence
  Description of Artificial Sequence: Synthetic oligonucleotide
ucuguuguuucaccuugu

SEQ ID NO: 69229 - RNA, 18 nt, Artificial Sequence
  Description of Artificial Sequence: Synthetic oligonucleotide
auaucucuguuguuucac

SEQ ID NO: 69230 - RNA, 18 nt, Artificial Sequence
  Description of Artificial Sequence: Synthetic oligonucleotide
aguuuauaucucuguugu

SEQ ID NO: 69231 - RNA, 18 nt, Artificial Sequence
  Description of Artificial Sequence: Synthetic oligonucleotide
guagaaguuuauaucucu

SEQ ID NO: 69232 - RNA, 18 nt, Artificial Sequence
  Description of Artificial Sequence: Synthetic oligonucleotide
cacauguagaaguuuaua

SEQ ID NO: 69233 - RNA, 18 nt, Artificial Sequence
  Description of Artificial Sequence: Synthetic oligonucleotide
cggcccacauguagaagu

SEQ ID NO: 69234 - RNA, 18 nt, Artificial Sequence
  Description of Artificial Sequence: Synthetic oligonucleotide
gcccccggcccacaugua

SEQ ID NO: 69235 - RNA, 18 nt, Artificial Sequence
  Description of Artificial Sequence: Synthetic oligonucleotide
cgugagcccccggcccac

SEQ ID NO: 69236 - RNA, 18 nt, Artificial Sequence
  Description of Artificial Sequence: Synthetic oligonucleotide
acaggcgugagcccccgg

SEQ ID NO: 69237 - RNA, 18 nt, Artificial Sequence
  Description of Artificial Sequence: Synthetic oligonucleotide
ggauuacaggcgugagcc

SEQ ID NO: 69238 - RNA, 18 nt, Artificial Sequence
  Description of Artificial Sequence: Synthetic oligonucleotide
ugcugggauuacaggcgu

SEQ ID NO: 69239 - RNA, 18 nt, Artificial Sequence
  Description of Artificial Sequence: Synthetic oligonucleotide
caaagugcugggauuaca

SEQ ID NO: 69240 - RNA, 18 nt, Artificial Sequence
  Description of Artificial Sequence: Synthetic oligonucleotide
ccucccaaagugcuggga

SEQ ID NO: 69241 - RNA, 18 nt, Artificial Sequence
  Description of Artificial Sequence: Synthetic oligonucleotide
cucggccucccaaagugc

SEQ ID NO: 69242 - RNA, 18 nt, Artificial Sequence
  Description of Artificial Sequence: Synthetic oligonucleotide
ccugccucggccucccaa

SEQ ID NO: 69243 - RNA, 18 nt, Artificial Sequence
  Description of Artificial Sequence: Synthetic oligonucleotide
aucugccugccucggccu

SEQ ID NO: 69244 - RNA, 18 nt, Artificial Sequence
  Description of Artificial Sequence: Synthetic oligonucleotide
aggugaucugccugccuc

SEQ ID NO: 69245 - RNA, 18 nt, Artificial Sequence
  Description of Artificial Sequence: Synthetic oligonucleotide
cccucaggugaucugccu

SEQ ID NO: 69246 - RNA, 18 nt, Artificial Sequence
  Description of Artificial Sequence: Synthetic oligonucleotide
uccugcccucaggugauc

SEQ ID NO: 69247 - RNA, 18 nt, Artificial Sequence
  Description of Artificial Sequence: Synthetic oligonucleotide
caaacuccugcccucagg

SEQ ID NO: 69248 - RNA, 18 nt, Artificial Sequence
  Description of Artificial Sequence: Synthetic oligonucleotide
gcucucaaacuccugccc

SEQ ID NO: 69249 - RNA, 18 nt, Artificial Sequence
  Description of Artificial Sequence: Synthetic oligonucleotide
gcugggcauggugguggg

SEQ ID NO: 69250 - RNA, 18 nt, Artificial Sequence
  Description of Artificial Sequence: Synthetic oligonucleotide
aauuagcugggcauggug

SEQ ID NO: 69251 - RNA, 18 nt, Artificial Sequence
  Description of Artificial Sequence: Synthetic oligonucleotide
acaaaaauuagcugggca

SEQ ID NO: 69252 - RNA, 18 nt, Artificial Sequence
  Description of Artificial Sequence: Synthetic oligonucleotide
aaaauacaaaaauuagcu

SEQ ID NO: 69253 - RNA, 18 nt, Artificial Sequence
  Description of Artificial Sequence: Synthetic oligonucleotide
uaccaaaaauacaaaaau

SEQ ID NO: 69254 - RNA, 18 nt, Artificial Sequence
  Description of Artificial Sequence: Synthetic oligonucleotide
aucucuaccaaaaauaca

SEQ ID NO: 69255 - RNA, 18 nt, Artificial Sequence
  Description of Artificial Sequence: Synthetic oligonucleotide
accccaucucuaccaaaa

SEQ ID NO: 69256 - RNA, 18 nt, Artificial Sequence
  Description of Artificial Sequence: Synthetic oligonucleotide
gugaaaccccaucucuac

SEQ ID NO: 69257 - RNA, 18 nt, Artificial Sequence
  Description of Artificial Sequence: Synthetic oligonucleotide
acauggugaaaccccauc

SEQ ID NO: 69258 - RNA, 18 nt, Artificial Sequence
  Description of Artificial Sequence: Synthetic oligonucleotide
ggccaacauggugaaacc

SEQ ID NO: 69259 - RNA, 18 nt, Artificial Sequence
  Description of Artificial Sequence: Synthetic oligonucleotide
agccuggccaacauggug

SEQ ID NO: 69260 - RNA, 18 nt, Artificial Sequence
  Description of Artificial Sequence: Synthetic oligonucleotide
agaucagccuggccaaca

SEQ ID NO: 69261 - RNA, 18 nt, Artificial Sequence
  Description of Artificial Sequence: Synthetic oligonucleotide
guucaagaucagccuggc

SEQ ID NO: 69262 - RNA, 18 nt, Artificial Sequence
  Description of Artificial Sequence: Synthetic oligonucleotide
caggaguucaagaucagc

SEQ ID NO: 69263 - RNA, 18 nt, Artificial Sequence
  Description of Artificial Sequence: Synthetic oligonucleotide
gaggucaggaguucaaga

SEQ ID NO: 69264 - RNA, 18 nt, Artificial Sequence
  Description of Artificial Sequence: Synthetic oligonucleotide
caccugaggucaggaguu

SEQ ID NO: 69265 - RNA, 18 nt, Artificial Sequence
  Description of Artificial Sequence: Synthetic oligonucleotide
uggaucaccugaggucag

SEQ ID NO: 69266 - RNA, 18 nt, Artificial Sequence
  Description of Artificial Sequence: Synthetic oligonucleotide
gcagguggaucaccugag

SEQ ID NO: 69267 - RNA, 18 nt, Artificial Sequence
  Description of Artificial Sequence: Synthetic oligonucleotide
cugaggcagguggaucac

SEQ ID NO: 69268 - RNA, 18 nt, Artificial Sequence
  Description of Artificial Sequence: Synthetic oligonucleotide
ggaggcugaggcaggugg

SEQ ID NO: 69269 - RNA, 18 nt, Artificial Sequence
  Description of Artificial Sequence: Synthetic oligonucleotide
cuuugggaggcugaggca

SEQ ID NO: 69270 - RNA, 18 nt, Artificial Sequence
  Description of Artificial Sequence: Synthetic oligonucleotide
cagcacuuugggaggcug

SEQ ID NO: 69271 - RNA, 18 nt, Artificial Sequence
  Description of Artificial Sequence: Synthetic oligonucleotide
aaucccagcacuuuggga

SEQ ID NO: 69272 - RNA, 18 nt, Artificial Sequence
  Description of Artificial Sequence: Synthetic oligonucleotide
ccuguaaucccagcacuu

SEQ ID NO: 69273 - RNA, 18 nt, Artificial Sequence
  Description of Artificial Sequence: Synthetic oligonucleotide
ucacgccuguaaucccag

SEQ ID NO: 69274 - RNA, 18 nt, Artificial Sequence
  Description of Artificial Sequence: Synthetic oligonucleotide
guggcucacgccuguaau

SEQ ID NO: 69275 - RNA, 18 nt, Artificial Sequence
  Description of Artificial Sequence: Synthetic oligonucleotide
gugcaguggcucacgccu

SEQ ID NO: 69276 - RNA, 18 nt, Artificial Sequence
  Description of Artificial Sequence: Synthetic oligonucleotide
gcugggugcaguggcuca

SEQ ID NO: 69277 - RNA, 18 nt, Artificial Sequence
  Description of Artificial Sequence: Synthetic oligonucleotide
ugaaggcugggugcagug

SEQ ID NO: 69278 - RNA, 18 nt, Artificial Sequence
  Description of Artificial Sequence: Synthetic oligonucleotide
cugaaugaaggcugggug

SEQ ID NO: 69279 - RNA, 18 nt, Artificial Sequence
  Description of Artificial Sequence: Synthetic oligonucleotide
uuaaacugaaugaaggcu

SEQ ID NO: 69280 - RNA, 18 nt, Artificial Sequence
  Description of Artificial Sequence: Synthetic oligonucleotide
gauuuuuaaacugaauga

SEQ ID NO: 69281 - RNA, 18 nt, Artificial Sequence
  Description of Artificial Sequence: Synthetic oligonucleotide
cauuugauuuuuaaacug

SEQ ID NO: 69282 - RNA, 18 nt, Artificial Sequence
  Description of Artificial Sequence: Synthetic oligonucleotide
aggaucauuugauuuuua

SEQ ID NO: 69283 - RNA, 18 nt, Artificial Sequence
  Description of Artificial Sequence: Synthetic oligonucleotide
accuuaggaucauuugau

SEQ ID NO: 69284 - RNA, 18 nt, Artificial Sequence
  Description of Artificial Sequence: Synthetic oligonucleotide
gcaaaaccuuaggaucau

SEQ ID NO: 69285 - RNA, 18 nt, Artificial Sequence
  Description of Artificial Sequence: Synthetic oligonucleotide
cugcugcaaaaccuuagg

SEQ ID NO: 69286 - RNA, 18 nt, Artificial Sequence
  Description of Artificial Sequence: Synthetic oligonucleotide
ucuuucugcugcaaaacc

SEQ ID NO: 69287 - RNA, 18 nt, Artificial Sequence
  Description of Artificial Sequence: Synthetic oligonucleotide
uuuacucuuucugcugca

SEQ ID NO: 69288 - RNA, 18 nt, Artificial Sequence
  Description of Artificial Sequence: Synthetic oligonucleotide
gcaaauuuacucuuucug

SEQ ID NO: 69289 - RNA, 18 nt, Artificial Sequence
  Description of Artificial Sequence: Synthetic oligonucleotide
gugcugcaaauuuacucu

SEQ ID NO: 69290 - RNA, 18 nt, Artificial Sequence
  Description of Artificial Sequence: Synthetic oligonucleotide
uucuagugcugcaaauuu

SEQ ID NO: 69291 - RNA, 18 nt, Artificial Sequence
  Description of Artificial Sequence: Synthetic oligonucleotide
cuugguucuagugcugca

SEQ ID NO: 69292 - RNA, 18 nt, Artificial Sequence
  Description of Artificial Sequence: Synthetic oligonucleotide
uaccucuugguucuagug

SEQ ID NO: 69293 - RNA, 18 nt, Artificial Sequence
  Description of Artificial Sequence: Synthetic oligonucleotide
gcuuuuaccucuugguuc

SEQ ID NO: 69294 - RNA, 18 nt, Artificial Sequence
  Description of Artificial Sequence: Synthetic oligonucleotide
uuacagcuuuuaccucuu

SEQ ID NO: 69295 - RNA, 18 nt, Artificial Sequence
  Description of Artificial Sequence: Synthetic oligonucleotide
cccuguuacagcuuuuac

SEQ ID NO: 69296 - RNA, 18 nt, Artificial Sequence
  Description of Artificial Sequence: Synthetic oligonucleotide
aucugcccuguuacagcu

SEQ ID NO: 69297 - RNA, 18 nt, Artificial Sequence
  Description of Artificial Sequence: Synthetic oligonucleotide
cugaaaucugcccuguua

SEQ ID NO: 69298 - RNA, 18 nt, Artificial Sequence
  Description of Artificial Sequence: Synthetic oligonucleotide
cguugcugaaaucugccc

SEQ ID NO: 69299 - RNA, 18 nt, Artificial Sequence
  Description of Artificial Sequence: Synthetic oligonucleotide
ucuuacguugcugaaauc

SEQ ID NO: 69300 - RNA, 18 nt, Artificial Sequence
  Description of Artificial Sequence: Synthetic oligonucleotide
uuuuuucuuacguugcug

SEQ ID NO: 69301 - RNA, 18 nt, Artificial Sequence
  Description of Artificial Sequence: Synthetic oligonucleotide
gcuccuuuuuucuuacgu

SEQ ID NO: 69302 - RNA, 18 nt, Artificial Sequence
  Description of Artificial Sequence: Synthetic oligonucleotide
gaagagcuccuuuuuucu

SEQ ID NO: 69303 - RNA, 18 nt, Artificial Sequence
  Description of Artificial Sequence: Synthetic oligonucleotide
agugagaagagcuccuuu

SEQ ID NO: 69304 - RNA, 18 nt, Artificial Sequence
  Description of Artificial Sequence: Synthetic oligonucleotide
guuucagugagaagagcu

SEQ ID NO: 69305 - RNA, 18 nt, Artificial Sequence
  Description of Artificial Sequence: Synthetic oligonucleotide
acuugguuucagugagaa

SEQ ID NO: 69306 - RNA, 18 nt, Artificial Sequence
  Description of Artificial Sequence: Synthetic oligonucleotide
cuuacacuugguuucagu

SEQ ID NO: 69307 - RNA, 18 nt, Artificial Sequence
  Description of Artificial Sequence: Synthetic oligonucleotide
cuggucuuacacuugguu

SEQ ID NO: 69308 - RNA, 18 nt, Artificial Sequence
  Description of Artificial Sequence: Synthetic oligonucleotide
ccagccuggucuuacacu

SEQ ID NO: 69309 - RNA, 18 nt, Artificial Sequence
  Description of Artificial Sequence: Synthetic oligonucleotide
cuaguccagccuggucuu

SEQ ID NO: 69310 - RNA, 18 nt, Artificial Sequence
  Description of Artificial Sequence: Synthetic oligonucleotide
guccucuaguccagccug

SEQ ID NO: 69311 - RNA, 18 nt, Artificial Sequence
  Description of Artificial Sequence: Synthetic oligonucleotide
cccguguccucuagucca

SEQ ID NO: 69312 - RNA, 18 nt, Artificial Sequence
  Description of Artificial Sequence: Synthetic oligonucleotide
aaacucccguguccucua

SEQ ID NO: 69313 - RNA, 18 nt, Artificial Sequence
  Description of Artificial Sequence: Synthetic oligonucleotide
uucaaaaacucccguguc

SEQ ID NO: 69314 - RNA, 18 nt, Artificial Sequence
  Description of Artificial Sequence: Synthetic oligonucleotide
ucugcuucaaaaacuccc

SEQ ID NO: 69315 - RNA, 18 nt, Artificial Sequence
  Description of Artificial Sequence: Synthetic oligonucleotide
cagccucugcuucaaaaa

SEQ ID NO: 69316 - RNA, 18 nt, Artificial Sequence
  Description of Artificial Sequence: Synthetic oligonucleotide
gucaucagccucugcuuc

SEQ ID NO: 69317 - RNA, 18 nt, Artificial Sequence
  Description of Artificial Sequence: Synthetic oligonucleotide
agcuggucaucagccucu

SEQ ID NO: 69318 - RNA, 18 nt, Artificial Sequence
  Description of Artificial Sequence: Synthetic oligonucleotide
ccgacagcuggucaucag

SEQ ID NO: 69319 - RNA, 18 nt, Artificial Sequence
  Description of Artificial Sequence: Synthetic oligonucleotide
gucucccgacagcugguc

SEQ ID NO: 69320 - RNA, 18 nt, Artificial Sequence
  Description of Artificial Sequence: Synthetic oligonucleotide
ucacagucucccgacagc

SEQ ID NO: 69321 - RNA, 18 nt, Artificial Sequence
  Description of Artificial Sequence: Synthetic oligonucleotide
uuccuucacagucucccg

SEQ ID NO: 69322 - RNA, 18 nt, Artificial Sequence
  Description of Artificial Sequence: Synthetic oligonucleotide
aggaauuccuucacaguc

SEQ ID NO: 69323 - RNA, 18 nt, Artificial Sequence
  Description of Artificial Sequence: Synthetic oligonucleotide
agggcaggaauuccuuca

SEQ ID NO: 69324 - RNA, 18 nt, Artificial Sequence
  Description of Artificial Sequence: Synthetic oligonucleotide
cacccagggcaggaauuc

SEQ ID NO: 69325 - RNA, 18 nt, Artificial Sequence
  Description of Artificial Sequence: Synthetic oligonucleotide
ggucccacccagggcagg

SEQ ID NO: 69326 - RNA, 18 nt, Artificial Sequence
  Description of Artificial Sequence: Synthetic oligonucleotide
accaaggucccacccagg

SEQ ID NO: 69327 - RNA, 18 nt, Artificial Sequence
  Description of Artificial Sequence: Synthetic oligonucleotide
acaggaccaaggucccac

SEQ ID NO: 69328 - RNA, 18 nt, Artificial Sequence
  Description of Artificial Sequence: Synthetic oligonucleotide
acuggacaggaccaaggu

SEQ ID NO: 69329 - RNA, 18 nt, Artificial Sequence
  Description of Artificial Sequence: Synthetic oligonucleotide
ugagaacuggacaggacc

SEQ ID NO: 69330 - RNA, 18 nt, Artificial Sequence
  Description of Artificial Sequence: Synthetic oligonucleotide
caggcugagaacuggaca

SEQ ID NO: 69331 - RNA, 18 nt, Artificial Sequence
  Description of Artificial Sequence: Synthetic oligonucleotide
ucauacaggcugagaacu

SEQ ID NO: 69332 - RNA, 18 nt, Artificial Sequence
  Description of Artificial Sequence: Synthetic oligonucleotide
gugaaucauacaggcuga

SEQ ID NO: 69333 - RNA, 18 nt, Artificial Sequence
  Description of Artificial Sequence: Synthetic oligonucleotide
gcagagugaaucauacag

SEQ ID NO: 69334 - RNA, 18 nt, Artificial Sequence
  Description of Artificial Sequence: Synthetic oligonucleotide
agccagcagagugaauca

SEQ ID NO: 69335 - RNA, 18 nt, Artificial Sequence
  Description of Artificial Sequence: Synthetic oligonucleotide
ggaguagccagcagagug

SEQ ID NO: 69336 - RNA, 18 nt, Artificial Sequence
  Description of Artificial Sequence: Synthetic oligonucleotide
ccuuaggaguagccagca

SEQ ID NO: 69337 - RNA, 18 nt, Artificial Sequence
  Description of Artificial Sequence: Synthetic oligonucleotide
gggagccuuaggaguagc

SEQ ID NO: 69338 - RNA, 18 nt, Artificial Sequence
  Description of Artificial Sequence: Synthetic oligonucleotide
acacuaaaagcggguggg

SEQ ID NO: 69339 - RNA, 18 nt, Artificial Sequence
  Description of Artificial Sequence: Synthetic oligonucleotide
ggcacacuaaaagcgggu

SEQ ID NO: 69340 - RNA, 18 nt, Artificial Sequence
  Description of Artificial Sequence: Synthetic oligonucleotide
caaagggcacacuaaaag

SEQ ID NO: 69341 - RNA, 18 nt, Artificial Sequence
  Description of Artificial Sequence: Synthetic oligonucleotide
ugccucaaagggcacacu

SEQ ID NO: 69342 - RNA, 18 nt, Artificial Sequence
  Description of Artificial Sequence: Synthetic oligonucleotide
cgcacugccucaaagggc

SEQ ID NO: 69343 - RNA, 18 nt, Artificial Sequence
  Description of Artificial Sequence: Synthetic oligonucleotide
agaagcgcacugccucaa

SEQ ID NO: 69344 - RNA, 18 nt, Artificial Sequence
  Description of Artificial Sequence: Synthetic oligonucleotide
aagagagaagcgcacugc

SEQ ID NO: 69345 - RNA, 18 nt, Artificial Sequence
  Description of Artificial Sequence: Synthetic oligonucleotide
ccugugccuuggucuccu

SEQ ID NO: 69346 - RNA, 18 nt, Artificial Sequence
  Description of Artificial Sequence: Synthetic oligonucleotide
aauguccugugccuuggu

SEQ ID NO: 69347 - RNA, 18 nt, Artificial Sequence
  Description of Artificial Sequence: Synthetic oligonucleotide
cccagaauguccugugcc

SEQ ID NO: 69348 - RNA, 18 nt, Artificial Sequence
  Description of Artificial Sequence: Synthetic oligonucleotide
cugcucccagaauguccu

SEQ ID NO: 69349 - RNA, 18 nt, Artificial Sequence
  Description of Artificial Sequence: Synthetic oligonucleotide
ggucacugcucccagaau

SEQ ID NO: 69350 - RNA, 18 nt, Artificial Sequence
  Description of Artificial Sequence: Synthetic oligonucleotide
agaagggucacugcuccc

SEQ ID NO: 69351 - RNA, 18 nt, Artificial Sequence
  Description of Artificial Sequence: Synthetic oligonucleotide
ccagcagaagggucacug

SEQ ID NO: 69352 - RNA, 18 nt, Artificial Sequence
  Description of Artificial Sequence: Synthetic oligonucleotide
ucccuccagcagaagggu

SEQ ID NO: 69353 - RNA, 18 nt, Artificial Sequence
  Description of Artificial Sequence: Synthetic oligonucleotide
aucacucccuccagcaga

SEQ ID NO: 69354 - RNA, 18 nt, Artificial Sequence
  Description of Artificial Sequence: Synthetic oligonucleotide
cugccaucacucccucca

SEQ ID NO: 69355 - RNA, 18 nt, Artificial Sequence
  Description of Artificial Sequence: Synthetic oligonucleotide
ccgugcugccaucacucc

SEQ ID NO: 69356 - RNA, 18 nt, Artificial Sequence
  Description of Artificial Sequence: Synthetic oligonucleotide
uguccccgugcugccauc

SEQ ID NO: 69357 - RNA, 18 nt, Artificial Sequence
  Description of Artificial Sequence: Synthetic oligonucleotide
ccaguuguccccgugcug

SEQ ID NO: 69358 - RNA, 18 nt, Artificial Sequence
  Description of Artificial Sequence: Synthetic oligonucleotide
gggucccaguuguccccg

SEQ ID NO: 69359 - RNA, 18 nt, Artificial Sequence
  Description of Artificial Sequence: Synthetic oligonucleotide
caagugggucccaguugu

SEQ ID NO: 69360 - RNA, 18 nt, Artificial Sequence
  Description of Artificial Sequence: Synthetic oligonucleotide
agaggcaaguggguccca

SEQ ID NO: 69361 - RNA, 18 nt, Artificial Sequence
  Description of Artificial Sequence: Synthetic oligonucleotide
ggaugagaggcaaguggg

SEQ ID NO: 69362 - RNA, 18 nt, Artificial Sequence
  Description of Artificial Sequence: Synthetic oligonucleotide
aggagggaugagaggcaa

SEQ ID NO: 69363 - RNA, 18 nt, Artificial Sequence
  Description of Artificial Sequence: Synthetic oligonucleotide
gccccaggagggaugaga

SEQ ID NO: 69364 - RNA, 18 nt, Artificial Sequence
  Description of Artificial Sequence: Synthetic oligonucleotide
aagcugccccaggaggga

SEQ ID NO: 69365 - RNA, 18 nt, Artificial Sequence
  Description of Artificial Sequence: Synthetic oligonucleotide
ccagaaagcugccccagg

SEQ ID NO: 69366 - RNA, 18 nt, Artificial Sequence
  Description of Artificial Sequence: Synthetic oligonucleotide
ccuguccagaaagcugcc

SEQ ID NO: 69367 - RNA, 18 nt, Artificial Sequence
  Description of Artificial Sequence: Synthetic oligonucleotide
acggaccuguccagaaag

SEQ ID NO: 69368 - RNA, 18 nt, Artificial Sequence
  Description of Artificial Sequence: Synthetic oligonucleotide
aggagacggaccugucca

SEQ ID NO: 69369 - RNA, 18 nt, Artificial Sequence
  Description of Artificial Sequence: Synthetic oligonucleotide
caaggaggagacggaccu

SEQ ID NO: 69370 - RNA, 18 nt, Artificial Sequence
  Description of Artificial Sequence: Synthetic oligonucleotide
ggccccaaggaggagacg

SEQ ID NO: 69371 - RNA, 18 nt, Artificial Sequence
  Description of Artificial Sequence: Synthetic oligonucleotide
ugcagggccccaaggagg

SEQ ID NO: 69372 - RNA, 18 nt, Artificial Sequence
  Description of Artificial Sequence: Synthetic oligonucleotide
ggcucugcagggccccaa

SEQ ID NO: 69373 - RNA, 18 nt, Artificial Sequence
  Description of Artificial Sequence: Synthetic oligonucleotide
aaggaggcucugcagggc

SEQ ID NO: 69374 - RNA, 18 nt, Artificial Sequence
  Description of Artificial Sequence: Synthetic oligonucleotide
guuccaaggaggcucugc

SEQ ID NO: 69375 - RNA, 18 nt, Artificial Sequence
  Description of Artificial Sequence: Synthetic oligonucleotide
uccugugccuuggucucc

SEQ ID NO: 69376 - RNA, 18 nt, Artificial Sequence
  Description of Artificial Sequence: Synthetic oligonucleotide
gaauguccugugccuugg

SEQ ID NO: 69377 - RNA, 18 nt, Artificial Sequence
  Description of Artificial Sequence: Synthetic oligonucleotide
ucccagaauguccugugc

SEQ ID NO: 69378 - RNA, 18 nt, Artificial Sequence
  Description of Artificial Sequence: Synthetic oligonucleotide
acugcucccagaaugucc

SEQ ID NO: 69379 - RNA, 18 nt, Artificial Sequence
  Description of Artificial Sequence: Synthetic oligonucleotide
gggucacugcucccagaa

SEQ ID NO: 69380 - RNA, 18 nt, Artificial Sequence
  Description of Artificial Sequence: Synthetic oligonucleotide
cagaagggucacugcucc

SEQ ID NO: 69381 - RNA, 18 nt, Artificial Sequence
  Description of Artificial Sequence: Synthetic oligonucleotide
uccagcagaagggucacu

SEQ ID NO: 69382 - RNA, 18 nt, Artificial Sequence
  Description of Artificial Sequence: Synthetic oligonucleotide
cucccuccagcagaaggg

SEQ ID NO: 69383 - RNA, 18 nt, Artificial Sequence
  Description of Artificial Sequence: Synthetic oligonucleotide
caucacucccuccagcag

SEQ ID NO: 69384 - RNA, 18 nt, Artificial Sequence
  Description of Artificial Sequence: Synthetic oligonucleotide
gcugccaucacucccucc

SEQ ID NO: 69385 - RNA, 18 nt, Artificial Sequence
  Description of Artificial Sequence: Synthetic oligonucleotide
cccgugcugccaucacuc

SEQ ID NO: 69386 - RNA, 18 nt, Artificial Sequence
  Description of Artificial Sequence: Synthetic oligonucleotide
uuguccccgugcugccau

SEQ ID NO: 69387 - RNA, 18 nt, Artificial Sequence
  Description of Artificial Sequence: Synthetic oligonucleotide
cccaguuguccccgugcu

SEQ ID NO: 69388 - RNA, 18 nt, Artificial Sequence
  Description of Artificial Sequence: Synthetic oligonucleotide
ugggucccaguugucccc

SEQ ID NO: 69389 - RNA, 18 nt, Artificial Sequence
  Description of Artificial Sequence: Synthetic oligonucleotide
gcaagugggucccaguug

SEQ ID NO: 69390 - RNA, 18 nt, Artificial Sequence
  Description of Artificial Sequence: Synthetic oligonucleotide
gagaggcaaguggguccc

SEQ ID NO: 69391 - RNA, 18 nt, Artificial Sequence
  Description of Artificial Sequence: Synthetic oligonucleotide
gggaugagaggcaagugg

SEQ ID NO: 69392 - RNA, 18 nt, Artificial Sequence
  Description of Artificial Sequence: Synthetic oligonucleotide
caggagggaugagaggca

SEQ ID NO: 69393 - RNA, 18 nt, Artificial Sequence
  Description of Artificial Sequence: Synthetic oligonucleotide
ugccccaggagggaugag

SEQ ID NO: 69394 - RNA, 18 nt, Artificial Sequence
  Description of Artificial Sequence: Synthetic oligonucleotide
aaagcugccccaggaggg

SEQ ID NO: 69395 - RNA, 18 nt, Artificial Sequence
  Description of Artificial Sequence: Synthetic oligonucleotide
uccagaaagcugccccag

SEQ ID NO: 69396 - RNA, 18 nt, Artificial Sequence
  Description of Artificial Sequence: Synthetic oligonucleotide
accuguccagaaagcugc

SEQ ID NO: 69397 - RNA, 18 nt, Artificial Sequence
  Description of Artificial Sequence: Synthetic oligonucleotide
gacggaccuguccagaaa

SEQ ID NO: 69398 - RNA, 18 nt, Artificial Sequence
  Description of Artificial Sequence: Synthetic oligonucleotide
gaggagacggaccugucc

SEQ ID NO: 69399 - RNA, 18 nt, Artificial Sequence
  Description of Artificial Sequence: Synthetic oligonucleotide
ccaaggaggagacggacc

SEQ ID NO: 69400 - RNA, 18 nt, Artificial Sequence
  Description of Artificial Sequence: Synthetic oligonucleotide
gggccccaaggaggagac

SEQ ID NO: 69401 - RNA, 18 nt, Artificial Sequence
  Description of Artificial Sequence: Synthetic oligonucleotide
cugcagggccccaaggag

SEQ ID NO: 69402 - RNA, 18 nt, Artificial Sequence
  Description of Artificial Sequence: Synthetic oligonucleotide
aggcucugcagggcccca

SEQ ID NO: 69403 - RNA, 18 nt, Artificial Sequence
  Description of Artificial Sequence: Synthetic oligonucleotide
caaggaggcucugcaggg

SEQ ID NO: 69404 - RNA, 18 nt, Artificial Sequence
  Description of Artificial Sequence: Synthetic oligonucleotide
gguuccaaggaggcucug

SEQ ID NO: 69405 - RNA, 18 nt, Artificial Sequence
  Description of Artificial Sequence: Synthetic oligonucleotide
ucuacagaucccuugacu

SEQ ID NO: 69406 - RNA, 18 nt, Artificial Sequence
  Description of Artificial Sequence: Synthetic oligonucleotide
caguuucuacagaucccu

SEQ ID NO: 69407 - RNA, 18 nt, Artificial Sequence
  Description of Artificial Sequence: Synthetic oligonucleotide
aagaacaguuucuacaga

SEQ ID NO: 69408 - RNA, 18 nt, Artificial Sequence
  Description of Artificial Sequence: Synthetic oligonucleotide
cagaaaagaacaguuucu

SEQ ID NO: 69409 - RNA, 18 nt, Artificial Sequence
  Description of Artificial Sequence: Synthetic oligonucleotide
ugagucagaaaagaacag

SEQ ID NO: 69410 - RNA, 18 nt, Artificial Sequence
  Description of Artificial Sequence: Synthetic oligonucleotide
gggacugagucagaaaag

SEQ ID NO: 69411 - RNA, 18 nt, Artificial Sequence
  Description of Artificial Sequence: Synthetic oligonucleotide
cuucccucaggucuucua

SEQ ID NO: 69412 - RNA, 18 nt, Artificial Sequence
  Description of Artificial Sequence: Synthetic oligonucleotide
cccuucuucccucagguc

SEQ ID NO: 69413 - RNA, 18 nt, Artificial Sequence
  Description of Artificial Sequence: Synthetic oligonucleotide
aagagcccuucuucccuc

SEQ ID NO: 69414 - RNA, 18 nt, Artificial Sequence
  Description of Artificial Sequence: Synthetic oligonucleotide
ccuggaagagcccuucuu

SEQ ID NO: 69415 - RNA, 18 nt, Artificial Sequence
  Description of Artificial Sequence: Synthetic oligonucleotide
agcucccuggaagagccc

SEQ ID NO: 69416 - RNA, 18 nt, Artificial Sequence
  Description of Artificial Sequence: Synthetic oligonucleotide
ccuugagcucccuggaag

SEQ ID NO: 69417 - RNA, 18 nt, Artificial Sequence
  Description of Artificial Sequence: Synthetic oligonucleotide
ucugcccuugagcucccu

SEQ ID NO: 69418 - RNA, 18 nt, Artificial Sequence
  Description of Artificial Sequence: Synthetic oligonucleotide
gcucuucugcccuugagc

SEQ ID NO: 69419 - RNA, 18 nt, Artificial Sequence
  Description of Artificial Sequence: Synthetic oligonucleotide
gaucagcucuucugcccu

SEQ ID NO: 69420 - RNA, 18 nt, Artificial Sequence
  Description of Artificial Sequence: Synthetic oligonucleotide
uaguagaucagcucuucu

SEQ ID NO: 69421 - RNA, 18 nt, Artificial Sequence
  Description of Artificial Sequence: Synthetic oligonucleotide
acucuuaguagaucagcu

SEQ ID NO: 69422 - RNA, 18 nt, Artificial Sequence
  Description of Artificial Sequence: Synthetic oligonucleotide
ggagcacucuuaguagau

SEQ ID NO: 69423 - RNA, 18 nt, Artificial Sequence
  Description of Artificial Sequence: Synthetic oligonucleotide
ggcagggagcacucuuag

SEQ ID NO: 69424 - RNA, 18 nt, Artificial Sequence
  Description of Artificial Sequence: Synthetic oligonucleotide
uggcuggcagggagcacu

SEQ ID NO: 69425 - RNA, 18 nt, Artificial Sequence
  Description of Artificial Sequence: Synthetic oligonucleotide
cauuguggcuggcaggga

SEQ ID NO: 69426 - RNA, 18 nt, Artificial Sequence
  Description of Artificial Sequence: Synthetic oligonucleotide
ccaggcauuguggcuggc

SEQ ID NO: 69427 - RNA, 18 nt, Artificial Sequence
  Description of Artificial Sequence: Synthetic oligonucleotide
aguacccaggcauugugg

SEQ ID NO: 69428 - RNA, 18 nt, Artificial Sequence
  Description of Artificial Sequence: Synthetic oligonucleotide
gaucagcucuucugcccu

SEQ ID NO: 69429 - RNA, 18 nt, Artificial Sequence
  Description of Artificial Sequence: Synthetic oligonucleotide
uaguagaucagcucuucu

SEQ ID NO: 69430 - RNA, 18 nt, Artificial Sequence
  Description of Artificial Sequence: Synthetic oligonucleotide
acucuuaguagaucagcu

SEQ ID NO: 69431 - RNA, 18 nt, Artificial Sequence
  Description of Artificial Sequence: Synthetic oligonucleotide
ggagcacucuuaguagau

SEQ ID NO: 69432 - RNA, 18 nt, Artificial Sequence
  Description of Artificial Sequence: Synthetic oligonucleotide
ggcagggagcacucuuag

SEQ ID NO: 69433 - RNA, 18 nt, Artificial Sequence
  Description of Artificial Sequence: Synthetic oligonucleotide
uggcuggcagggagcacu

SEQ ID NO: 69434 - RNA, 18 nt, Artificial Sequence
  Description of Artificial Sequence: Synthetic oligonucleotide
cauuguggcuggcaggga

SEQ ID NO: 69435 - RNA, 18 nt, Artificial Sequence
  Description of Artificial Sequence: Synthetic oligonucleotide
ccaggcauuguggcuggc

SEQ ID NO: 69436 - RNA, 18 nt, Artificial Sequence
  Description of Artificial Sequence: Synthetic oligonucleotide
aguacccaggcauugugg

SEQ ID NO: 69437 - RNA, 18 nt, Artificial Sequence
  Description of Artificial Sequence: Synthetic oligonucleotide
augccaguacccaggcau

SEQ ID NO: 69438 - RNA, 18 nt, Artificial Sequence
  Description of Artificial Sequence: Synthetic oligonucleotide
acaggaugccaguaccca

SEQ ID NO: 69439 - RNA, 18 nt, Artificial Sequence
  Description of Artificial Sequence: Synthetic oligonucleotide
gaaagacaggaugccagu

SEQ ID NO: 69440 - RNA, 18 nt, Artificial Sequence
  Description of Artificial Sequence: Synthetic oligonucleotide
aguaggaaagacaggaug

SEQ ID NO: 69441 - RNA, 18 nt, Artificial Sequence
  Description of Artificial Sequence: Synthetic oligonucleotide
gucuaaguaggaaagaca

SEQ ID NO: 69442 - RNA, 18 nt, Artificial Sequence
  Description of Artificial Sequence: Synthetic oligonucleotide
cccuugucuaaguaggaa

SEQ ID NO: 69443 - RNA, 18 nt, Artificial Sequence
  Description of Artificial Sequence: Synthetic oligonucleotide
ggccucccuugucuaagu

SEQ ID NO: 69444 - RNA, 18 nt, Artificial Sequence
  Description of Artificial Sequence: Synthetic oligonucleotide
ucucaggccucccuuguc

SEQ ID NO: 69445 - RNA, 18 nt, Artificial Sequence
  Description of Artificial Sequence: Synthetic oligonucleotide
ccagaucucaggccuccc

SEQ ID NO: 69446 - RNA, 18 nt, Artificial Sequence
  Description of Artificial Sequence: Synthetic oligonucleotide
cagggccagaucucaggc

SEQ ID NO: 69447 - RNA, 18 nt, Artificial Sequence
  Description of Artificial Sequence: Synthetic oligonucleotide
aacaccagggccagaucu

SEQ ID NO: 69448 - RNA, 18 nt, Artificial Sequence
  Description of Artificial Sequence: Synthetic oligonucleotide
ggccaaacaccagggcca

SEQ ID NO: 69449 - RNA, 18 nt, Artificial Sequence
  Description of Artificial Sequence: Synthetic oligonucleotide
ccugaggccaaacaccag

SEQ ID NO: 69450 - RNA, 18 nt, Artificial Sequence
  Description of Artificial Sequence: Synthetic oligonucleotide
augguccugaggccaaac

SEQ ID NO: 69451 - RNA, 18 nt, Artificial Sequence
  Description of Artificial Sequence: Synthetic oligonucleotide
agaggaugguccugaggc

SEQ ID NO: 69452 - RNA, 18 nt, Artificial Sequence
  Description of Artificial Sequence: Synthetic oligonucleotide
agggcagaggaugguccu

SEQ ID NO: 69453 - RNA, 18 nt, Artificial Sequence
  Description of Artificial Sequence: Synthetic oligonucleotide
ugugagcugugguccugc

SEQ ID NO: 69454 - RNA, 18 nt, Artificial Sequence
  Description of Artificial Sequence: Synthetic oligonucleotide
auccuugugagcuguggu

SEQ ID NO: 69455 - RNA, 18 nt, Artificial Sequence
  Description of Artificial Sequence: Synthetic oligonucleotide
uugggauccuugugagcu

SEQ ID NO: 69456 - RNA, 18 nt, Artificial Sequence
  Description of Artificial Sequence: Synthetic oligonucleotide
uggcauugggauccuugu

SEQ ID NO: 69457 - RNA, 18 nt, Artificial Sequence
  Description of Artificial Sequence: Synthetic oligonucleotide
gaagauggcauugggauc

SEQ ID NO: 69458 - RNA, 18 nt, Artificial Sequence
  Description of Artificial Sequence: Synthetic oligonucleotide
cucaggaagauggcauug

SEQ ID NO: 69459 - RNA, 18 nt, Artificial Sequence
  Description of Artificial Sequence: Synthetic oligonucleotide
ggaagcucaggaagaugg

SEQ ID NO: 69460 - RNA, 18 nt, Artificial Sequence
  Description of Artificial Sequence: Synthetic oligonucleotide
guguuggaagcucaggaa

SEQ ID NO: 69461 - RNA, 18 nt, Artificial Sequence
  Description of Artificial Sequence: Synthetic oligonucleotide
agcagguguuggaagcuc

SEQ ID NO: 69462 - RNA, 18 nt, Artificial Sequence
  Description of Artificial Sequence: Synthetic oligonucleotide
cucggagcagguguugga

SEQ ID NO: 69463 - RNA, 18 nt, Artificial Sequence
  Description of Artificial Sequence: Synthetic oligonucleotide
cuuuccucggagcaggug

SEQ ID NO: 69464 - RNA, 18 nt, Artificial Sequence
  Description of Artificial Sequence: Synthetic oligonucleotide
cgcaccuuuccucggagc

SEQ ID NO: 69465 - RNA, 18 nt, Artificial Sequence
  Description of Artificial Sequence: Synthetic oligonucleotide
ggaaacgcaccuuuccuc

SEQ ID NO: 69466 - RNA, 18 nt, Artificial Sequence
  Description of Artificial Sequence: Synthetic oligonucleotide
caucaggaaacgcaccuu

SEQ ID NO: 69467 - RNA, 18 nt, Artificial Sequence
  Description of Artificial Sequence: Synthetic oligonucleotide
acaagcaucaggaaacgc

SEQ ID NO: 69468 - RNA, 18 nt, Artificial Sequence
  Description of Artificial Sequence: Synthetic oligonucleotide
cuccuacaagcaucagga

SEQ ID NO: 69469 - RNA, 18 nt, Artificial Sequence
  Description of Artificial Sequence: Synthetic oligonucleotide
ggacccuccuacaagcau

SEQ ID NO: 69470 - RNA, 18 nt, Artificial Sequence
  Description of Artificial Sequence: Synthetic oligonucleotide
aggguggacccuccuaca

SEQ ID NO: 69471 - RNA, 18 nt, Artificial Sequence
  Description of Artificial Sequence: Synthetic oligonucleotide
cgcagaggguggacccuc

SEQ ID NO: 69472 - RNA, 18 nt, Artificial Sequence
  Description of Artificial Sequence: Synthetic oligonucleotide
ccugacgcagagggugga

SEQ ID NO: 69473 - RNA, 18 nt, Artificial Sequence
  Description of Artificial Sequence: Synthetic oligonucleotide
gcccgccugacgcagagg

SEQ ID NO: 69474 - RNA, 18 nt, Artificial Sequence
  Description of Artificial Sequence: Synthetic oligonucleotide
gggcccgccugacgcaga

SEQ ID NO: 69475 - RNA, 18 nt, Artificial Sequence
  Description of Artificial Sequence: Synthetic oligonucleotide
acagcugugguggguggg

SEQ ID NO: 69476 - RNA, 18 nt, Artificial Sequence
  Description of Artificial Sequence: Synthetic oligonucleotide
gggacagcuguggugggu

SEQ ID NO: 69477 - RNA, 18 nt, Artificial Sequence
  Description of Artificial Sequence: Synthetic oligonucleotide
uagagagguucugcuggg

SEQ ID NO: 69478 - RNA, 18 nt, Artificial Sequence
  Description of Artificial Sequence: Synthetic oligonucleotide
aggacuagagagguucug

SEQ ID NO: 69479 - RNA, 18 nt, Artificial Sequence
  Description of Artificial Sequence: Synthetic oligonucleotide
gugugaggacuagagagg

SEQ ID NO: 69480 - RNA, 18 nt, Artificial Sequence
  Description of Artificial Sequence: Synthetic oligonucleotide
guucagugugaggacuag

SEQ ID NO: 69481 - RNA, 18 nt, Artificial Sequence
  Description of Artificial Sequence: Synthetic oligonucleotide
agcucguucagugugagg

SEQ ID NO: 69482 - RNA, 18 nt, Artificial Sequence
  Description of Artificial Sequence: Synthetic oligonucleotide
uugggagcucguucagug

SEQ ID NO: 69483 - RNA, 18 nt, Artificial Sequence
  Description of Artificial Sequence: Synthetic oligonucleotide
ccuguuugggagcucguu

SEQ ID NO: 69484 - RNA, 18 nt, Artificial Sequence
  Description of Artificial Sequence: Synthetic oligonucleotide
gaaguccuguuugggagc

SEQ ID NO: 69485 - RNA, 18 nt, Artificial Sequence
  Description of Artificial Sequence: Synthetic oligonucleotide
auccagaaguccuguuug

SEQ ID NO: 69486 - RNA, 18 nt, Artificial Sequence
  Description of Artificial Sequence: Synthetic oligonucleotide
caacaauccagaaguccu

SEQ ID NO: 69487 - RNA, 18 nt, Artificial Sequence
  Description of Artificial Sequence: Synthetic oligonucleotide
gucuccaacaauccagaa

SEQ ID NO: 69488 - RNA, 18 nt, Artificial Sequence
  Description of Artificial Sequence: Synthetic oligonucleotide
aguuugucuccaacaauc

SEQ ID NO: 69489 - RNA, 18 nt, Artificial Sequence
  Description of Artificial Sequence: Synthetic oligonucleotide
agugaaguuugucuccaa

SEQ ID NO: 69490 - RNA, 18 nt, Artificial Sequence
  Description of Artificial Sequence: Synthetic oligonucleotide
gaggcagugaaguuuguc

SEQ ID NO: 69491 - RNA, 18 nt, Artificial Sequence
  Description of Artificial Sequence: Synthetic oligonucleotide
uggcugaggcagugaagu

SEQ ID NO: 69492 - RNA, 18 nt, Artificial Sequence
  Description of Artificial Sequence: Synthetic oligonucleotide
aguucuggcugaggcagu

SEQ ID NO: 69493 - RNA, 18 nt, Artificial Sequence
  Description of Artificial Sequence: Synthetic oligonucleotide
ccaguaguucuggcugag

SEQ ID NO: 69494 - RNA, 18 nt, Artificial Sequence
  Description of Artificial Sequence: Synthetic oligonucleotide
cagagccaguaguucugg

SEQ ID NO: 69495 - RNA, 18 nt, Artificial Sequence
  Description of Artificial Sequence: Synthetic oligonucleotide
aagcccagagccaguagu

SEQ ID NO: 69496 - RNA, 18 nt, Artificial Sequence
  Description of Artificial Sequence: Synthetic oligonucleotide
uucagaagcccagagcca

SEQ ID NO: 69497 - RNA, 18 nt, Artificial Sequence
  Description of Artificial Sequence: Synthetic oligonucleotide
gccacuucagaagcccag

SEQ ID NO: 69498 - RNA, 18 nt, Artificial Sequence
  Description of Artificial Sequence: Synthetic oligonucleotide
cugcugccacuucagaag

SEQ ID NO: 69499 - RNA, 18 nt, Artificial Sequence
  Description of Artificial Sequence: Synthetic oligonucleotide
aaucccugcugccacuuc

SEQ ID NO: 69500 - RNA, 18 nt, Artificial Sequence
  Description of Artificial Sequence: Synthetic oligonucleotide
cucugaaucccugcugcc

SEQ ID NO: 69501 - RNA, 18 nt, Artificial Sequence
  Description of Artificial Sequence: Synthetic oligonucleotide
cuuggcucugaaucccug

SEQ ID NO: 69502 - RNA, 18 nt, Artificial Sequence
  Description of Artificial Sequence: Synthetic oligonucleotide
ggaaucuuggcucugaau

SEQ ID NO: 69503 - RNA, 18 nt, Artificial Sequence
  Description of Artificial Sequence: Synthetic oligonucleotide
gaccaggaaucuuggcuc

SEQ ID NO: 69504 - RNA, 18 nt, Artificial Sequence
  Description of Artificial Sequence: Synthetic oligonucleotide
cagcagaccaggaaucuu

SEQ ID NO: 69505 - RNA, 18 nt, Artificial Sequence
  Description of Artificial Sequence: Synthetic oligonucleotide
ugguucagcagaccagga

SEQ ID NO: 69506 - RNA, 18 nt, Artificial Sequence
  Description of Artificial Sequence: Synthetic oligonucleotide
agguuugguucagcagac

SEQ ID NO: 69507 - RNA, 18 nt, Artificial Sequence
  Description of Artificial Sequence: Synthetic oligonucleotide
ccuggagguuugguucag

SEQ ID NO: 69508 - RNA, 18 nt, Artificial Sequence
  Description of Artificial Sequence: Synthetic oligonucleotide
agggaccuggagguuugg

SEQ ID NO: 69509 - RNA, 18 nt, Artificial Sequence
  Description of Artificial Sequence: Synthetic oligonucleotide
gguccagggaccuggagg

SEQ ID NO: 69510 - RNA, 18 nt, Artificial Sequence
  Description of Artificial Sequence: Synthetic oligonucleotide
gauuugguccagggaccu

SEQ ID NO: 69511 - RNA, 18 nt, Artificial Sequence
  Description of Artificial Sequence: Synthetic oligonucleotide
gggauuugguccagggac

SEQ ID NO: 69512 - RNA, 18 nt, Artificial Sequence
  Description of Artificial Sequence: Synthetic oligonucleotide
ccuguucagguauccggg

SEQ ID NO: 69513 - RNA, 18 nt, Artificial Sequence
  Description of Artificial Sequence: Synthetic oligonucleotide
uguauccuguucagguau

SEQ ID NO: 69514 - RNA, 18 nt, Artificial Sequence
  Description of Artificial Sequence: Synthetic oligonucleotide
guucguguauccuguuca

SEQ ID NO: 69515 - RNA, 18 nt, Artificial Sequence
  Description of Artificial Sequence: Synthetic oligonucleotide
caagaguucguguauccu

SEQ ID NO: 69516 - RNA, 18 nt, Artificial Sequence
  Description of Artificial Sequence: Synthetic oligonucleotide
ccauucaagaguucgugu

SEQ ID NO: 69517 - RNA, 18 nt, Artificial Sequence
  Description of Artificial Sequence: Synthetic oligonucleotide
gaguuccauucaagaguu

SEQ ID NO: 69518 - RNA, 18 nt, Artificial Sequence
  Description of Artificial Sequence: Synthetic oligonucleotide
uccacgaguuccauucaa

SEQ ID NO: 69519 - RNA, 18 nt, Artificial Sequence
  Description of Artificial Sequence: Synthetic oligonucleotide
aagaguccacgaguucca

SEQ ID NO: 69520 - RNA, 18 nt, Artificial Sequence
  Description of Artificial Sequence: Synthetic oligonucleotide
caggaaagaguccacgag

SEQ ID NO: 69521 - RNA, 18 nt, Artificial Sequence
  Description of Artificial Sequence: Synthetic oligonucleotide
ggguccaggaaagagucc

SEQ ID NO: 69522 - RNA, 18 nt, Artificial Sequence
  Description of Artificial Sequence: Synthetic oligonucleotide
cgugaggguccaggaaag

SEQ ID NO: 69523 - RNA, 18 nt, Artificial Sequence
  Description of Artificial Sequence: Synthetic oligonucleotide
uccugcgugaggguccag

SEQ ID NO: 69524 - RNA, 18 nt, Artificial Sequence
  Description of Artificial Sequence: Synthetic oligonucleotide
uaggguccugcgugaggg

SEQ ID NO: 69525 - RNA, 18 nt, Artificial Sequence
  Description of Artificial Sequence: Synthetic oligonucleotide
gcuccuaggguccugcgu

SEQ ID NO: 69526 - RNA, 18 nt, Artificial Sequence
  Description of Artificial Sequence: Synthetic oligonucleotide
gggcuccuaggguccugc

SEQ ID NO: 69527 - RNA, 18 nt, Artificial Sequence
  Description of Artificial Sequence: Synthetic oligonucleotide
ccugaggaaauguccggg

SEQ ID NO: 69528 - RNA, 18 nt, Artificial Sequence
  Description of Artificial Sequence: Synthetic oligonucleotide
auguuccugaggaaaugu

SEQ ID NO: 69529 - RNA, 18 nt, Artificial Sequence
  Description of Artificial Sequence: Synthetic oligonucleotide
gucugauguuccugagga

SEQ ID NO: 69530 - RNA, 18 nt, Artificial Sequence
  Description of Artificial Sequence: Synthetic oligonucleotide
ccugugucugauguuccu

SEQ ID NO: 69531 - RNA, 18 nt, Artificial Sequence
  Description of Artificial Sequence: Synthetic oligonucleotide
gggagccugugucugaug

SEQ ID NO: 69532 - RNA, 18 nt, Artificial Sequence
  Description of Artificial Sequence: Synthetic oligonucleotide
uggcagggagccuguguc

SEQ ID NO: 69533 - RNA, 18 nt, Artificial Sequence
  Description of Artificial Sequence: Synthetic oligonucleotide
uuggguggcagggagccu

SEQ ID NO: 69534 - RNA, 18 nt, Artificial Sequence
  Description of Artificial Sequence: Synthetic oligonucleotide
ggagguuggguggcaggg

SEQ ID NO: 69535 - RNA, 18 nt, Artificial Sequence
  Description of Artificial Sequence: Synthetic oligonucleotide
aggcuggagguugggugg

SEQ ID NO: 69536 - RNA, 18 nt, Artificial Sequence
  Description of Artificial Sequence: Synthetic oligonucleotide
uauccaggcuggagguug

SEQ ID NO: 69537 - RNA, 18 nt, Artificial Sequence
  Description of Artificial Sequence: Synthetic oligonucleotide
gagaauauccaggcugga

SEQ ID NO: 69538 - RNA, 18 nt, Artificial Sequence
  Description of Artificial Sequence: Synthetic oligonucleotide
ggaaggagaauauccagg

SEQ ID NO: 69539 - RNA, 18 nt, Artificial Sequence
  Description of Artificial Sequence: Synthetic oligonucleotide
gggaaggagaauauccag

SEQ ID NO: 69540 - RNA, 18 nt, Artificial Sequence
  Description of Artificial Sequence: Synthetic oligonucleotide
guaggaggauggguuggg

SEQ ID NO: 69541 - RNA, 18 nt, Artificial Sequence
  Description of Artificial Sequence: Synthetic oligonucleotide
guccaguaggaggauggg

SEQ ID NO: 69542 - RNA, 18 nt, Artificial Sequence
  Description of Artificial Sequence: Synthetic oligonucleotide
auacuguccaguaggagg

SEQ ID NO: 69543 - RNA, 18 nt, Artificial Sequence
  Description of Artificial Sequence: Synthetic oligonucleotide
agcguauacuguccagua

SEQ ID NO: 69544 - RNA, 18 nt, Artificial Sequence
  Description of Artificial Sequence: Synthetic oligonucleotide
ggaagagcguauacuguc

SEQ ID NO: 69545 - RNA, 18 nt, Artificial Sequence
  Description of Artificial Sequence: Synthetic oligonucleotide
aagagggaagagcguaua

SEQ ID NO: 69546 - RNA, 18 nt, Artificial Sequence
  Description of Artificial Sequence: Synthetic oligonucleotide
gguggaagagggaagagc

SEQ ID NO: 69547 - RNA, 18 nt, Artificial Sequence
  Description of Artificial Sequence: Synthetic oligonucleotide
agguggguggaagaggga

SEQ ID NO: 69548 - RNA, 18 nt, Artificial Sequence
  Description of Artificial Sequence: Synthetic oligonucleotide
gggcaagguggguggaag

SEQ ID NO: 69549 - RNA, 18 nt, Artificial Sequence
  Description of Artificial Sequence: Synthetic oligonucleotide
gggugggcaaggugggug

SEQ ID NO: 69550 - RNA, 18 nt, Artificial Sequence
  Description of Artificial Sequence: Synthetic oligonucleotide
uggagcuggaccacaggg

SEQ ID NO: 69551 - RNA, 18 nt, Artificial Sequence
  Description of Artificial Sequence: Synthetic oligonucleotide
ggguggagcuggaccaca

SEQ ID NO: 69552 - RNA, 18 nt, Artificial Sequence
  Description of Artificial Sequence: Synthetic oligonucleotide
aagggucaggaagcaggg

SEQ ID NO: 69553 - RNA, 18 nt, Artificial Sequence
  Description of Artificial Sequence: Synthetic oligonucleotide
agcagaagggucaggaag

SEQ ID NO: 69554 - RNA, 18 nt, Artificial Sequence
  Description of Artificial Sequence: Synthetic oligonucleotide
guuggagcagaaggguca

SEQ ID NO: 69555 - RNA, 18 nt, Artificial Sequence
  Description of Artificial Sequence: Synthetic oligonucleotide
ugggcguuggagcagaag

SEQ ID NO: 69556 - RNA, 18 nt, Artificial Sequence
  Description of Artificial Sequence: Synthetic oligonucleotide
gggugggcguuggagcag

SEQ ID NO: 69557 - RNA, 18 nt, Artificial Sequence
  Description of Artificial Sequence: Synthetic oligonucleotide
agaagagggcugguaggg

SEQ ID NO: 69558 - RNA, 18 nt, Artificial Sequence
  Description of Artificial Sequence: Synthetic oligonucleotide
uguuuagaagagggcugg

SEQ ID NO: 69559 - RNA, 18 nt, Artificial Sequence
  Description of Artificial Sequence: Synthetic oligonucleotide
ggauguguuuagaagagg

SEQ ID NO: 69560 - RNA, 18 nt, Artificial Sequence
  Description of Artificial Sequence: Synthetic oligonucleotide
guguaggauguguuuaga

SEQ ID NO: 69561 - RNA, 18 nt, Artificial Sequence
  Description of Artificial Sequence: Synthetic oligonucleotide
aguggguguaggaugugu

SEQ ID NO: 69562 - RNA, 18 nt, Artificial Sequence
  Description of Artificial Sequence: Synthetic oligonucleotide
cugggaguggguguagga

SEQ ID NO: 69563 - RNA, 18 nt, Artificial Sequence
  Description of Artificial Sequence: Synthetic oligonucleotide
agauucugggagugggug

SEQ ID NO: 69564 - RNA, 18 nt, Artificial Sequence
  Description of Artificial Sequence: Synthetic oligonucleotide
gagacagauucugggagu

SEQ ID NO: 69565 - RNA, 18 nt, Artificial Sequence
  Description of Artificial Sequence: Synthetic oligonucleotide
uuccugagacagauucug

SEQ ID NO: 69566 - RNA, 18 nt, Artificial Sequence
  Description of Artificial Sequence: Synthetic oligonucleotide
uacccuuccugagacaga

SEQ ID NO: 69567 - RNA, 18 nt, Artificial Sequence
  Description of Artificial Sequence: Synthetic oligonucleotide
aaccuuacccuuccugag

SEQ ID NO: 69568 - RNA, 18 nt, Artificial Sequence
  Description of Artificial Sequence: Synthetic oligonucleotide
cugagaaccuuacccuuc

SEQ ID NO: 69569 - RNA, 18 nt, Artificial Sequence
  Description of Artificial Sequence: Synthetic oligonucleotide
agugucugagaaccuuac

SEQ ID NO: 69570 - RNA, 18 nt, Artificial Sequence
  Description of Artificial Sequence: Synthetic oligonucleotide
ucggcagugucugagaac

SEQ ID NO: 69571 - RNA, 18 nt, Artificial Sequence
  Description of Artificial Sequence: Synthetic oligonucleotide
ugaugucggcagugucug

SEQ ID NO: 69572 - RNA, 18 nt, Artificial Sequence
  Description of Artificial Sequence: Synthetic oligonucleotide
aaugcugaugucggcagu

SEQ ID NO: 69573 - RNA, 18 nt, Artificial Sequence
  Description of Artificial Sequence: Synthetic oligonucleotide
gagacaaugcugaugucg

SEQ ID NO: 69574 - RNA, 18 nt, Artificial Sequence
  Description of Artificial Sequence: Synthetic oligonucleotide
uacacgagacaaugcuga

SEQ ID NO: 69575 - RNA, 18 nt, Artificial Sequence
  Description of Artificial Sequence: Synthetic oligonucleotide
agcuguacacgagacaau

SEQ ID NO: 69576 - RNA, 18 nt, Artificial Sequence
  Description of Artificial Sequence: Synthetic oligonucleotide
aagggagcuguacacgag

SEQ ID NO: 69577 - RNA, 18 nt, Artificial Sequence
  Description of Artificial Sequence: Synthetic oligonucleotide
cagggaagggagcuguac

SEQ ID NO: 69578 - RNA, 18 nt, Artificial Sequence
  Description of Artificial Sequence: Synthetic oligonucleotide
cccugcagggaagggagc

SEQ ID NO: 69579 - RNA, 18 nt, Artificial Sequence
  Description of Artificial Sequence: Synthetic oligonucleotide
gggcgcccugcagggaag

SEQ ID NO: 69580 - RNA, 18 nt, Artificial Sequence
  Description of Artificial Sequence: Synthetic oligonucleotide
cuuguccaguugucuccc

SEQ ID NO: 69581 - RNA, 18 nt, Artificial Sequence
  Description of Artificial Sequence: Synthetic oligonucleotide
gaaaucuuguccaguugu

SEQ ID NO: 69582 - RNA, 18 nt, Artificial Sequence
  Description of Artificial Sequence: Synthetic oligonucleotide
aguaggaaaucuugucca

SEQ ID NO: 69583 - RNA, 18 nt, Artificial Sequence
  Description of Artificial Sequence: Synthetic oligonucleotide
gagaaaguaggaaaucuu

SEQ ID NO: 69584 - RNA, 18 nt, Artificial Sequence
  Description of Artificial Sequence: Synthetic oligonucleotide
uucaggagaaaguaggaa

SEQ ID NO: 69585 - RNA, 18 nt, Artificial Sequence
  Description of Artificial Sequence: Synthetic oligonucleotide
uggguuucaggagaaagu

SEQ ID NO: 69586 - RNA, 18 nt, Artificial Sequence
  Description of Artificial Sequence: Synthetic oligonucleotide
ggcuuuggguuucaggag

SEQ ID NO: 69587 - RNA, 18 nt, Artificial Sequence
  Description of Artificial Sequence: Synthetic oligonucleotide
accagggcuuuggguuuc

SEQ ID NO: 69588 - RNA, 18 nt, Artificial Sequence
  Description of Artificial Sequence: Synthetic oligonucleotide
cuuuuaccagggcuuugg

SEQ ID NO: 69589 - RNA, 18 nt, Artificial Sequence
  Description of Artificial Sequence: Synthetic oligonucleotide
uaucccuuuuaccagggc

SEQ ID NO: 69590 - RNA, 18 nt, Artificial Sequence
  Description of Artificial Sequence: Synthetic oligonucleotide
cuguguaucccuuuuacc

SEQ ID NO: 69591 - RNA, 18 nt, Artificial Sequence
  Description of Artificial Sequence: Synthetic oligonucleotide
caguccuguguaucccuu

SEQ ID NO: 69592 - RNA, 18 nt, Artificial Sequence
  Description of Artificial Sequence: Synthetic oligonucleotide
cuuuucaguccuguguau

SEQ ID NO: 69593 - RNA, 18 nt, Artificial Sequence
  Description of Artificial Sequence: Synthetic oligonucleotide
auucccuuuucaguccug

SEQ ID NO: 69594 - RNA, 18 nt, Artificial Sequence
  Description of Artificial Sequence: Synthetic oligonucleotide
aaaugauucccuuuucag

SEQ ID NO: 69595 - RNA, 18 nt, Artificial Sequence
  Description of Artificial Sequence: Synthetic oligonucleotide
gugaaaaaugauucccuu

SEQ ID NO: 69596 - RNA, 18 nt, Artificial Sequence
  Description of Artificial Sequence: Synthetic oligonucleotide
guacagugaaaaaugauu

SEQ ID NO: 69597 - RNA, 18 nt, Artificial Sequence
  Description of Artificial Sequence: Synthetic oligonucleotide
auaauguacagugaaaaa

SEQ ID NO: 69598 - RNA, 18 nt, Artificial Sequence
  Description of Artificial Sequence: Synthetic oligonucleotide
gguuuauaauguacagug

SEQ ID NO: 69599 - RNA, 18 nt, Artificial Sequence
  Description of Artificial Sequence: Synthetic oligonucleotide
cugaagguuuauaaugua

SEQ ID NO: 69600 - RNA, 18 nt, Artificial Sequence
  Description of Artificial Sequence: Synthetic oligonucleotide
agcuucugaagguuuaua

SEQ ID NO: 69601 - RNA, 18 nt, Artificial Sequence
  Description of Artificial Sequence: Synthetic oligonucleotide
aaaauagcuucugaaggu

SEQ ID NO: 69602 - RNA, 18 nt, Artificial Sequence
  Description of Artificial Sequence: Synthetic oligonucleotide
uuaaaaaaauagcuucug

SEQ ID NO: 69603 - RNA, 18 nt, Artificial Sequence
  Description of Artificial Sequence: Synthetic oligonucleotide
auagcuuaaaaaaauagc

SEQ ID NO: 69604 - RNA, 18 nt, Artificial Sequence
  Description of Artificial Sequence: Synthetic oligonucleotide
ugcugauagcuuaaaaaa

SEQ ID NO: 69605 - RNA, 18 nt, Artificial Sequence
  Description of Artificial Sequence: Synthetic oligonucleotide
aguauugcugauagcuua

SEQ ID NO: 69606 - RNA, 18 nt, Artificial Sequence
  Description of Artificial Sequence: Synthetic oligonucleotide
ugaugaguauugcugaua

SEQ ID NO: 69607 - RNA, 18 nt, Artificial Sequence
  Description of Artificial Sequence: Synthetic oligonucleotide
ugcucugaugaguauugc

SEQ ID NO: 69608 - RNA, 18 nt, Artificial Sequence
  Description of Artificial Sequence: Synthetic oligonucleotide
cuagcugcucugaugagu

SEQ ID NO: 69609 - RNA, 18 nt, Artificial Sequence
  Description of Artificial Sequence: Synthetic oligonucleotide
aagagcuagcugcucuga

SEQ ID NO: 69610 - RNA, 18 nt, Artificial Sequence
  Description of Artificial Sequence: Synthetic oligonucleotide
gaccaaagagcuagcugc

SEQ ID NO: 69611 - RNA, 18 nt, Artificial Sequence
  Description of Artificial Sequence: Synthetic oligonucleotide
aaauagaccaaagagcua

SEQ ID NO: 69612 - RNA, 18 nt, Artificial Sequence
  Description of Artificial Sequence: Synthetic oligonucleotide
gcagaaaauagaccaaag

SEQ ID NO: 69613 - RNA, 18 nt, Artificial Sequence
  Description of Artificial Sequence: Synthetic oligonucleotide
uuucugcagaaaauagac

SEQ ID NO: 69614 - RNA, 18 nt, Artificial Sequence
  Description of Artificial Sequence: Synthetic oligonucleotide
gcaaauuucugcagaaaa

SEQ ID NO: 69615 - RNA, 18 nt, Artificial Sequence
  Description of Artificial Sequence: Synthetic oligonucleotide
gaguugcaaauuucugca

SEQ ID NO: 69616 - RNA, 18 nt, Artificial Sequence
  Description of Artificial Sequence: Synthetic oligonucleotide
ucagugaguugcaaauuu

SEQ ID NO: 69617 - RNA, 18 nt, Artificial Sequence
  Description of Artificial Sequence: Synthetic oligonucleotide
gagaaucagugaguugca

SEQ ID NO: 69618 - RNA, 18 nt, Artificial Sequence
  Description of Artificial Sequence: Synthetic oligonucleotide
auguagagaaucagugag

SEQ ID NO: 69619 - RNA, 18 nt, Artificial Sequence
  Description of Artificial Sequence: Synthetic oligonucleotide
agagcauguagagaauca

SEQ ID NO: 69620 - RNA, 18 nt, Artificial Sequence
  Description of Artificial Sequence: Synthetic oligonucleotide
gaaaaagagcauguagag

SEQ ID NO: 69621 - RNA, 18 nt, Artificial Sequence
  Description of Artificial Sequence: Synthetic oligonucleotide
ucacagaaaaagagcaug

SEQ ID NO: 69622 - RNA, 18 nt, Artificial Sequence
  Description of Artificial Sequence: Synthetic oligonucleotide
aguuaucacagaaaaaga

SEQ ID NO: 69623 - RNA, 18 nt, Artificial Sequence
  Description of Artificial Sequence: Synthetic oligonucleotide
ugcagaguuaucacagaa

SEQ ID NO: 69624 - RNA, 18 nt, Artificial Sequence
  Description of Artificial Sequence: Synthetic oligonucleotide
gccuuugcagaguuauca

SEQ ID NO: 69625 - RNA, 18 nt, Artificial Sequence
  Description of Artificial Sequence: Synthetic oligonucleotide
cccaggccuuugcagagu

SEQ ID NO: 69626 - RNA, 18 nt, Artificial Sequence
  Description of Artificial Sequence: Synthetic oligonucleotide
gccagcccaggccuuugc

SEQ ID NO: 69627 - RNA, 18 nt, Artificial Sequence
  Description of Artificial Sequence: Synthetic oligonucleotide
gccaggccagcccaggcc

SEQ ID NO: 69628 - RNA, 18 nt, Artificial Sequence
  Description of Artificial Sequence: Synthetic oligonucleotide
caacugccaggccagccc

SEQ ID NO: 69629 - RNA, 18 nt, Artificial Sequence
  Description of Artificial Sequence: Synthetic oligonucleotide
cuguucaacugccaggcc

SEQ ID NO: 69630 - RNA, 18 nt, Artificial Sequence
  Description of Artificial Sequence: Synthetic oligonucleotide
ucccucuguucaacugcc

SEQ ID NO: 69631 - RNA, 18 nt, Artificial Sequence
  Description of Artificial Sequence: Synthetic oligonucleotide
gucucucccucuguucaa

SEQ ID NO: 69632 - RNA, 18 nt, Artificial Sequence
  Description of Artificial Sequence: Synthetic oligonucleotide
gguuagucucucccucug

SEQ ID NO: 69633 - RNA, 18 nt, Artificial Sequence
  Description of Artificial Sequence: Synthetic oligonucleotide
cucaagguuagucucucc

SEQ ID NO: 69634 - RNA, 18 nt, Artificial Sequence
  Description of Artificial Sequence: Synthetic oligonucleotide
ucugacucaagguuaguc

SEQ ID NO: 69635 - RNA, 18 nt, Artificial Sequence
  Description of Artificial Sequence: Synthetic oligonucleotide
uguuuucugacucaaggu

SEQ ID NO: 69636 - RNA, 18 nt, Artificial Sequence
  Description of Artificial Sequence: Synthetic oligonucleotide
uucucuguuuucugacuc

SEQ ID NO: 69637 - RNA, 18 nt, Artificial Sequence
  Description of Artificial Sequence: Synthetic oligonucleotide
acccuuucucuguuuucu

SEQ ID NO: 69638 - RNA, 18 nt, Artificial Sequence
  Description of Artificial Sequence: Synthetic oligonucleotide
aaauuacccuuucucugu

SEQ ID NO: 69639 - RNA, 18 nt, Artificial Sequence
  Description of Artificial Sequence: Synthetic oligonucleotide
aaaggaaauuacccuuuc

SEQ ID NO: 69640 - RNA, 18 nt, Artificial Sequence
  Description of Artificial Sequence: Synthetic oligonucleotide
gaagcaaaggaaauuacc

SEQ ID NO: 69641 - RNA, 18 nt, Artificial Sequence
  Description of Artificial Sequence: Synthetic oligonucleotide
aauuugaagcaaaggaaa

SEQ ID NO: 69642 - RNA, 18 nt, Artificial Sequence
  Description of Artificial Sequence: Synthetic oligonucleotide
ccuugaauuugaagcaaa

SEQ ID NO: 69643 - RNA, 18 nt, Artificial Sequence
  Description of Artificial Sequence: Synthetic oligonucleotide
gaaggccuugaauuugaa

SEQ ID NO: 69644 - RNA, 18 nt, Artificial Sequence
  Description of Artificial Sequence: Synthetic oligonucleotide
cguuggaaggccuugaau

SEQ ID NO: 69645 - RNA, 18 nt, Artificial Sequence
  Description of Artificial Sequence: Synthetic oligonucleotide
gggcguuggaaggccuug

SEQ ID NO: 69646 - RNA, 18 nt, Artificial Sequence
  Description of Artificial Sequence: Synthetic oligonucleotide
gagaaugauaguaaaggg

SEQ ID NO: 69647 - RNA, 18 nt, Artificial Sequence
  Description of Artificial Sequence: Synthetic oligonucleotide
ccacugagaaugauagua

SEQ ID NO: 69648 - RNA, 18 nt, Artificial Sequence
  Description of Artificial Sequence: Synthetic oligonucleotide
gagucccacugagaauga

SEQ ID NO: 69649 - RNA, 18 nt, Artificial Sequence
  Description of Artificial Sequence: Synthetic oligonucleotide
gaucagagucccacugag

SEQ ID NO: 69650 - RNA, 18 nt, Artificial Sequence
  Description of Artificial Sequence: Synthetic oligonucleotide
uaugggaucagaguccca

SEQ ID NO: 69651 - RNA, 18 nt, Artificial Sequence
  Description of Artificial Sequence: Synthetic oligonucleotide
aagaauaugggaucagag

SEQ ID NO: 69652 - RNA, 18 nt, Artificial Sequence
  Description of Artificial Sequence: Synthetic oligonucleotide
cuguuaagaauaugggau

SEQ ID NO: 69653 - RNA, 18 nt, Artificial Sequence
  Description of Artificial Sequence: Synthetic oligonucleotide
aagaucuguuaagaauau

SEQ ID NO: 69654 - RNA, 18 nt, Artificial Sequence
  Description of Artificial Sequence: Synthetic oligonucleotide
gaguaaagaucuguuaag

SEQ ID NO: 69655 - RNA, 18 nt, Artificial Sequence
  Description of Artificial Sequence: Synthetic oligonucleotide
cucaagaguaaagaucug

SEQ ID NO: 69656 - RNA, 18 nt, Artificial Sequence
  Description of Artificial Sequence: Synthetic oligonucleotide
cauuucucaagaguaaag

SEQ ID NO: 69657 - RNA, 18 nt, Artificial Sequence
  Description of Artificial Sequence: Synthetic oligonucleotide
uuauucauuucucaagag

SEQ ID NO: 69658 - RNA, 18 nt, Artificial Sequence
  Description of Artificial Sequence: Synthetic oligonucleotide
aaagcuuauucauuucuc

SEQ ID NO: 69659 - RNA, 18 nt, Artificial Sequence
  Description of Artificial Sequence: Synthetic oligonucleotide
gagagaaagcuuauucau

SEQ ID NO: 69660 - RNA, 18 nt, Artificial Sequence
  Description of Artificial Sequence: Synthetic oligonucleotide
uuucugagagaaagcuua

SEQ ID NO: 69661 - RNA, 18 nt, Artificial Sequence
  Description of Artificial Sequence: Synthetic oligonucleotide
cagcauuucugagagaaa

SEQ ID NO: 69662 - RNA, 18 nt, Artificial Sequence
  Description of Artificial Sequence: Synthetic oligonucleotide
agggacagcauuucugag

SEQ ID NO: 69663 - RNA, 18 nt, Artificial Sequence
  Description of Artificial Sequence: Synthetic oligonucleotide
uguauagggacagcauuu

SEQ ID NO: 69664 - RNA, 18 nt, Artificial Sequence
  Description of Artificial Sequence: Synthetic oligonucleotide
ucuaguguauagggacag

SEQ ID NO: 69665 - RNA, 18 nt, Artificial Sequence
  Description of Artificial Sequence: Synthetic oligonucleotide
uuuugucuaguguauagg

SEQ ID NO: 69666 - RNA, 18 nt, Artificial Sequence
  Description of Artificial Sequence: Synthetic oligonucleotide
cucaguuuugucuagugu

SEQ ID NO: 69667 - RNA, 18 nt, Artificial Sequence
  Description of Artificial Sequence: Synthetic oligonucleotide
acaggcucaguuuugucu

SEQ ID NO: 69668 - RNA, 18 nt, Artificial Sequence
  Description of Artificial Sequence: Synthetic oligonucleotide
cuuauacaggcucaguuu

SEQ ID NO: 69669 - RNA, 18 nt, Artificial Sequence
  Description of Artificial Sequence: Synthetic oligonucleotide
uauuccuuauacaggcuc

SEQ ID NO: 69670 - RNA, 18 nt, Artificial Sequence
  Description of Artificial Sequence: Synthetic oligonucleotide
ccauuuauuccuuauaca

SEQ ID NO: 69671 - RNA, 18 nt, Artificial Sequence
  Description of Artificial Sequence: Synthetic oligonucleotide
cgcucccauuuauuccuu

SEQ ID NO: 69672 - RNA, 18 nt, Artificial Sequence
  Description of Artificial Sequence: Synthetic oligonucleotide
uucggcgcucccauuuau

SEQ ID NO: 69673 - RNA, 18 nt, Artificial Sequence
  Description of Artificial Sequence: Synthetic oligonucleotide
agcuuuucggcgcuccca

SEQ ID NO: 69674 - RNA, 18 nt, Artificial Sequence
  Description of Artificial Sequence: Synthetic oligonucleotide
uagggagcuuuucggcgc

SEQ ID NO: 69675 - RNA, 18 nt, Artificial Sequence
  Description of Artificial Sequence: Synthetic oligonucleotide
cuuuuuagggagcuuuuc

SEQ ID NO: 69676 - RNA, 18 nt, Artificial Sequence
  Description of Artificial Sequence: Synthetic oligonucleotide
cuggacaugggcaaccug

SEQ ID NO: 69677 - RNA, 18 nt, Artificial Sequence
  Description of Artificial Sequence: Synthetic oligonucleotide
uuuuccuggacaugggca

SEQ ID NO: 69678 - RNA, 18 nt, Artificial Sequence
  Description of Artificial Sequence: Synthetic oligonucleotide
ccaucuuuuccuggacau

SEQ ID NO: 69679 - RNA, 18 nt, Artificial Sequence
  Description of Artificial Sequence: Synthetic oligonucleotide
gggauccaucuuuuccug

SEQ ID NO: 69680 - RNA, 18 nt, Artificial Sequence
  Description of Artificial Sequence: Synthetic oligonucleotide
gagaagauuuggauaggg

SEQ ID NO: 69681 - RNA, 18 nt, Artificial Sequence
  Description of Artificial Sequence: Synthetic oligonucleotide
cggagaagauuuggauag

SEQ ID NO: 69682 - RNA, 18 nt, Artificial Sequence
  Description of Artificial Sequence: Synthetic oligonucleotide
caccacggagaagauuug

SEQ ID NO: 69683 - RNA, 18 nt, Artificial Sequence
  Description of Artificial Sequence: Synthetic oligonucleotide
acacacaccacggagaag

SEQ ID NO: 69684 - RNA, 18 nt, Artificial Sequence
  Description of Artificial Sequence: Synthetic oligonucleotide
cacccacacacaccacgg

SEQ ID NO: 69685 - RNA, 18 nt, Artificial Sequence
  Description of Artificial Sequence: Synthetic oligonucleotide
uccuccacccacacacac

SEQ ID NO: 69686 - RNA, 18 nt, Artificial Sequence
  Description of Artificial Sequence: Synthetic oligonucleotide
uccacuccuccacccaca

SEQ ID NO: 69687 - RNA, 18 nt, Artificial Sequence
  Description of Artificial Sequence: Synthetic oligonucleotide
caggguccacuccuccac

SEQ ID NO: 69688 - RNA, 18 nt, Artificial Sequence
  Description of Artificial Sequence: Synthetic oligonucleotide
uggaccaggguccacucc

SEQ ID NO: 69689 - RNA, 18 nt, Artificial Sequence
  Description of Artificial Sequence: Synthetic oligonucleotide
cugccuggaccagggucc

SEQ ID NO: 69690 - RNA, 18 nt, Artificial Sequence
  Description of Artificial Sequence: Synthetic oligonucleotide
agccccugccuggaccag

SEQ ID NO: 69691 - RNA, 18 nt, Artificial Sequence
  Description of Artificial Sequence: Synthetic oligonucleotide
ccuggagccccugccugg

SEQ ID NO: 69692 - RNA, 18 nt, Artificial Sequence
  Description of Artificial Sequence: Synthetic oligonucleotide
ucuucccuggagccccug

SEQ ID NO: 69693 - RNA, 18 nt, Artificial Sequence
  Description of Artificial Sequence: Synthetic oligonucleotide
ccuucucuucccuggagc

SEQ ID NO: 69694 - RNA, 18 nt, Artificial Sequence
  Description of Artificial Sequence: Synthetic oligonucleotide
ugacgccuucucuucccu

SEQ ID NO: 69695 - RNA, 18 nt, Artificial Sequence
  Description of Artificial Sequence: Synthetic oligonucleotide
ggaagugacgccuucucu

SEQ ID NO: 69696 - RNA, 18 nt, Artificial Sequence
  Description of Artificial Sequence: Synthetic oligonucleotide
cccccggaagugacgccu

SEQ ID NO: 69697 - RNA, 18 nt, Artificial Sequence
  Description of Artificial Sequence: Synthetic oligonucleotide
gaaggcccccggaaguga

SEQ ID NO: 69698 - RNA, 18 nt, Artificial Sequence
  Description of Artificial Sequence: Synthetic oligonucleotide
cuggugaaggcccccgga

SEQ ID NO: 69699 - RNA, 18 nt, Artificial Sequence
  Description of Artificial Sequence: Synthetic oligonucleotide
agacacuggugaaggccc

SEQ ID NO: 69700 - RNA, 18 nt, Artificial Sequence
  Description of Artificial Sequence: Synthetic oligonucleotide
ccaccagacacuggugaa

SEQ ID NO: 69701 - RNA, 18 nt, Artificial Sequence
  Description of Artificial Sequence: Synthetic oligonucleotide
gggagccaccagacacug

SEQ ID NO: 69702 - RNA, 18 nt, Artificial Sequence
  Description of Artificial Sequence: Synthetic oligonucleotide
gagaagggagccaccaga

SEQ ID NO: 69703 - RNA, 18 nt, Artificial Sequence
  Description of Artificial Sequence: Synthetic oligonucleotide
aaucagagaagggagcca

SEQ ID NO: 69704 - RNA, 18 nt, Artificial Sequence
  Description of Artificial Sequence: Synthetic oligonucleotide
ugcccaaucagagaaggg

SEQ ID NO: 69705 - RNA, 18 nt, Artificial Sequence
  Description of Artificial Sequence: Synthetic oligonucleotide
acuucugcccaaucagag

SEQ ID NO: 69706 - RNA, 18 nt, Artificial Sequence
  Description of Artificial Sequence: Synthetic oligonucleotide
gggccacuucugcccaau

SEQ ID NO: 69707 - RNA, 18 nt, Artificial Sequence
  Description of Artificial Sequence: Synthetic oligonucleotide
ugccugggccacuucugc

SEQ ID NO: 69708 - RNA, 18 nt, Artificial Sequence
  Description of Artificial Sequence: Synthetic oligonucleotide
acgccugccugggccacu

SEQ ID NO: 69709 - RNA, 18 nt, Artificial Sequence
  Description of Artificial Sequence: Synthetic oligonucleotide
gucauacgccugccuggg

SEQ ID NO: 69710 - RNA, 18 nt, Artificial Sequence
  Description of Artificial Sequence: Synthetic oligonucleotide
agcaggucauacgccugc

SEQ ID NO: 69711 - RNA, 18 nt, Artificial Sequence
  Description of Artificial Sequence: Synthetic oligonucleotide
acagcagcaggucauacg

SEQ ID NO: 69712 - RNA, 18 nt, Artificial Sequence
  Description of Artificial Sequence: Synthetic oligonucleotide
ccuccacagcagcagguc

SEQ ID NO: 69713 - RNA, 18 nt, Artificial Sequence
  Description of Artificial Sequence: Synthetic oligonucleotide
cagccccuccacagcagc

SEQ ID NO: 69714 - RNA, 18 nt, Artificial Sequence
  Description of Artificial Sequence: Synthetic oligonucleotide
gggcacagccccuccaca

SEQ ID NO: 69715 - RNA, 18 nt, Artificial Sequence
  Description of Artificial Sequence: Synthetic oligonucleotide
aagacauguggcgguggg

SEQ ID NO: 69716 - RNA, 18 nt, Artificial Sequence
  Description of Artificial Sequence: Synthetic oligonucleotide
aggaagacauguggcggu

SEQ ID NO: 69717 - RNA, 18 nt, Artificial Sequence
  Description of Artificial Sequence: Synthetic oligonucleotide
uggguaggaagacaugug

SEQ ID NO: 69718 - RNA, 18 nt, Artificial Sequence
  Description of Artificial Sequence: Synthetic oligonucleotide
gcagauggguaggaagac

SEQ ID NO: 69719 - RNA, 18 nt, Artificial Sequence
  Description of Artificial Sequence: Synthetic oligonucleotide
agcaggcagcccucuggg

SEQ ID NO: 69720 - RNA, 18 nt, Artificial Sequence
  Description of Artificial Sequence: Synthetic oligonucleotide
ugcacagcaggcagcccu

SEQ ID NO: 69721 - RNA, 18 nt, Artificial Sequence
  Description of Artificial Sequence: Synthetic oligonucleotide
ccaagugcacagcaggca

SEQ ID NO: 69722 - RNA, 18 nt, Artificial Sequence
  Description of Artificial Sequence: Synthetic oligonucleotide
aggacccaagugcacagc

SEQ ID NO: 69723 - RNA, 18 nt, Artificial Sequence
  Description of Artificial Sequence: Synthetic oligonucleotide
gcuccaggacccaagugc

SEQ ID NO: 69724 - RNA, 18 nt, Artificial Sequence
  Description of Artificial Sequence: Synthetic oligonucleotide
gaagggcuccaggaccca

SEQ ID NO: 69725 - RNA, 18 nt, Artificial Sequence
  Description of Artificial Sequence: Synthetic oligonucleotide
guggagaagggcuccagg

SEQ ID NO: 69726 - RNA, 18 nt, Artificial Sequence
  Description of Artificial Sequence: Synthetic oligonucleotide
cccacacccugcuggcca

SEQ ID NO: 69727 - RNA, 18 nt, Artificial Sequence
  Description of Artificial Sequence: Synthetic oligonucleotide
auaaccccacacccugcu

SEQ ID NO: 69728 - RNA, 18 nt, Artificial Sequence
  Description of Artificial Sequence: Synthetic oligonucleotide
cucacauaaccccacacc

SEQ ID NO: 69729 - RNA, 18 nt, Artificial Sequence
  Description of Artificial Sequence: Synthetic oligonucleotide
cuacccucacauaacccc

SEQ ID NO: 69730 - RNA, 18 nt, Artificial Sequence
  Description of Artificial Sequence: Synthetic oligonucleotide
ccuuucuacccucacaua

SEQ ID NO: 69731 - RNA, 18 nt, Artificial Sequence
  Description of Artificial Sequence: Synthetic oligonucleotide
gcuguccuuucuacccuc

SEQ ID NO: 69732 - RNA, 18 nt, Artificial Sequence
  Description of Artificial Sequence: Synthetic oligonucleotide
ucuuugcuguccuuucua

SEQ ID NO: 69733 - RNA, 18 nt, Artificial Sequence
  Description of Artificial Sequence: Synthetic oligonucleotide
auuucucuuugcuguccu

SEQ ID NO: 69734 - RNA, 18 nt, Artificial Sequence
  Description of Artificial Sequence: Synthetic oligonucleotide
agcccauuucucuuugcu

SEQ ID NO: 69735 - RNA, 18 nt, Artificial Sequence
  Description of Artificial Sequence: Synthetic oligonucleotide
cugggagcccauuucucu

SEQ ID NO: 69736 - RNA, 18 nt, Artificial Sequence
  Description of Artificial Sequence: Synthetic oligonucleotide
cccagcugggagcccauu

SEQ ID NO: 69737 - RNA, 18 nt, Artificial Sequence
  Description of Artificial Sequence: Synthetic oligonucleotide
ccucccccagcugggagc

SEQ ID NO: 69738 - RNA, 18 nt, Artificial Sequence
  Description of Artificial Sequence: Synthetic oligonucleotide
cugccccucccccagcug

SEQ ID NO: 69739 - RNA, 18 nt, Artificial Sequence
  Description of Artificial Sequence: Synthetic oligonucleotide
uuugccugccccuccccc

SEQ ID NO: 69740 - RNA, 18 nt, Artificial Sequence
  Description of Artificial Sequence: Synthetic oligonucleotide
uccaguuugccugccccu

SEQ ID NO: 69741 - RNA, 18 nt, Artificial Sequence
  Description of Artificial Sequence: Synthetic oligonucleotide
uagguuccaguuugccug

SEQ ID NO: 69742 - RNA, 18 nt, Artificial Sequence
  Description of Artificial Sequence: Synthetic oligonucleotide
gccuguagguuccaguuu

SEQ ID NO: 69743 - RNA, 18 nt, Artificial Sequence
  Description of Artificial Sequence: Synthetic oligonucleotide
ucagugccuguagguucc

SEQ ID NO: 69744 - RNA, 18 nt, Artificial Sequence
  Description of Artificial Sequence: Synthetic oligonucleotide
aaaggucagugccuguag

SEQ ID NO: 69745 - RNA, 18 nt, Artificial Sequence
  Description of Artificial Sequence: Synthetic oligonucleotide
ucgacaaaggucagugcc

SEQ ID NO: 69746 - RNA, 18 nt, Artificial Sequence
  Description of Artificial Sequence: Synthetic oligonucleotide
ucuucucgacaaagguca

SEQ ID NO: 69747 - RNA, 18 nt, Artificial Sequence
  Description of Artificial Sequence: Synthetic oligonucleotide
uacacucuucucgacaaa

SEQ ID NO: 69748 - RNA, 18 nt, Artificial Sequence
  Description of Artificial Sequence: Synthetic oligonucleotide
aaggcuacacucuucucg

SEQ ID NO: 69749 - RNA, 18 nt, Artificial Sequence
  Description of Artificial Sequence: Synthetic oligonucleotide
cugggaaggcuacacucu

SEQ ID NO: 69750 - RNA, 18 nt, Artificial Sequence
  Description of Artificial Sequence: Synthetic oligonucleotide
ccauucugggaaggcuac

SEQ ID NO: 69751 - RNA, 18 nt, Artificial Sequence
  Description of Artificial Sequence: Synthetic oligonucleotide
uccucccauucugggaag

SEQ ID NO: 69752 - RNA, 18 nt, Artificial Sequence
  Description of Artificial Sequence: Synthetic oligonucleotide
ccugcuccucccauucug

SEQ ID NO: 69753 - RNA, 18 nt, Artificial Sequence
  Description of Artificial Sequence: Synthetic oligonucleotide
ucugcccugcuccuccca

SEQ ID NO: 69754 - RNA, 18 nt, Artificial Sequence
  Description of Artificial Sequence: Synthetic oligonucleotide
ccugcucugcccugcucc

SEQ ID NO: 69755 - RNA, 18 nt, Artificial Sequence
  Description of Artificial Sequence: Synthetic oligonucleotide
cuaccccugcucugcccu

SEQ ID NO: 69756 - RNA, 18 nt, Artificial Sequence
  Description of Artificial Sequence: Synthetic oligonucleotide
acccccuaccccugcucu

SEQ ID NO: 69757 - RNA, 18 nt, Artificial Sequence
  Description of Artificial Sequence: Synthetic oligonucleotide
accccacccccuaccccu

SEQ ID NO: 69758 - RNA, 18 nt, Artificial Sequence
  Description of Artificial Sequence: Synthetic oligonucleotide
ccagcaccccacccccua

SEQ ID NO: 69759 - RNA, 18 nt, Artificial Sequence
  Description of Artificial Sequence: Synthetic oligonucleotide
agaaaccagcaccccacc

SEQ ID NO: 69760 - RNA, 18 nt, Artificial Sequence
  Description of Artificial Sequence: Synthetic oligonucleotide
cccucagaaaccagcacc

SEQ ID NO: 69761 - RNA, 18 nt, Artificial Sequence
  Description of Artificial Sequence: Synthetic oligonucleotide
ucagucccucagaaacca

SEQ ID NO: 69762 - RNA, 18 nt, Artificial Sequence
  Description of Artificial Sequence: Synthetic oligonucleotide
agugaucagucccucaga

SEQ ID NO: 69763 - RNA, 18 nt, Artificial Sequence
  Description of Artificial Sequence: Synthetic oligonucleotide
aaguaagugaucaguccc

SEQ ID NO: 69764 - RNA, 18 nt, Artificial Sequence
  Description of Artificial Sequence: Synthetic oligonucleotide
ccaccaaguaagugauca

SEQ ID NO: 69765 - RNA, 18 nt, Artificial Sequence
  Description of Artificial Sequence: Synthetic oligonucleotide
guauuccaccaaguaagu

SEQ ID NO: 69766 - RNA, 18 nt, Artificial Sequence
  Description of Artificial Sequence: Synthetic oligonucleotide
gugcuguauuccaccaag

SEQ ID NO: 69767 - RNA, 18 nt, Artificial Sequence
  Description of Artificial Sequence: Synthetic oligonucleotide
gggcugugcuguauucca

SEQ ID NO: 69768 - RNA, 18 nt, Artificial Sequence
  Description of Artificial Sequence: Synthetic oligonucleotide
agccagggcugugcugua

SEQ ID NO: 69769 - RNA, 18 nt, Artificial Sequence
  Description of Artificial Sequence: Synthetic oligonucleotide
gggccagccagggcugug

SEQ ID NO: 69770 - RNA, 18 nt, Artificial Sequence
  Description of Artificial Sequence: Synthetic oligonucleotide
ccuuagggccagccaggg

SEQ ID NO: 69771 - RNA, 18 nt, Artificial Sequence
  Description of Artificial Sequence: Synthetic oligonucleotide
ccuuuccuuagggccagc

SEQ ID NO: 69772 - RNA, 18 nt, Artificial Sequence
  Description of Artificial Sequence: Synthetic oligonucleotide
uguccccuuuccuuaggg

SEQ ID NO: 69773 - RNA, 18 nt, Artificial Sequence
  Description of Artificial Sequence: Synthetic oligonucleotide
gcucauguccccuuuccu

SEQ ID NO: 69774 - RNA, 18 nt, Artificial Sequence
  Description of Artificial Sequence: Synthetic oligonucleotide
ccugggcucauguccccu

SEQ ID NO: 69775 - RNA, 18 nt, Artificial Sequence
  Description of Artificial Sequence: Synthetic oligonucleotide
uucucccugggcucaugu

SEQ ID NO: 69776 - RNA, 18 nt, Artificial Sequence
  Description of Artificial Sequence: Synthetic oligonucleotide
uuauuuucucccugggcu

SEQ ID NO: 69777 - RNA, 18 nt, Artificial Sequence
  Description of Artificial Sequence: Synthetic oligonucleotide
cucucuuauuuucucccu

SEQ ID NO: 69778 - RNA, 18 nt, Artificial Sequence
  Description of Artificial Sequence: Synthetic oligonucleotide
gcucccucucuuauuuuc

SEQ ID NO: 69779 - RNA, 18 nt, Artificial Sequence
  Description of Artificial Sequence: Synthetic oligonucleotide
gugcagcucccucucuua

SEQ ID NO: 69780 - RNA, 18 nt, Artificial Sequence
  Description of Artificial Sequence: Synthetic oligonucleotide
ccuaagugcagcucccuc

SEQ ID NO: 69781 - RNA, 18 nt, Artificial Sequence
  Description of Artificial Sequence: Synthetic oligonucleotide
uaagcccuaagugcagcu

SEQ ID NO: 69782 - RNA, 18 nt, Artificial Sequence
  Description of Artificial Sequence: Synthetic oligonucleotide
uuugcuaagcccuaagug

SEQ ID NO: 69783 - RNA, 18 nt, Artificial Sequence
  Description of Artificial Sequence: Synthetic oligonucleotide
cuguguuugcuaagcccu

SEQ ID NO: 69784 - RNA, 18 nt, Artificial Sequence
  Description of Artificial Sequence: Synthetic oligonucleotide
uacuacuguguuugcuaa

SEQ ID NO: 69785 - RNA, 18 nt, Artificial Sequence
  Description of Artificial Sequence: Synthetic oligonucleotide
caucuuacuacuguguuu

SEQ ID NO: 69786 - RNA, 18 nt, Artificial Sequence
  Description of Artificial Sequence: Synthetic oligonucleotide
guguccaucuuacuacug

SEQ ID NO: 69787 - RNA, 18 nt, Artificial Sequence
  Description of Artificial Sequence: Synthetic oligonucleotide
gggcuguguccaucuuac

SEQ ID NO: 69788 - RNA, 18 nt, Artificial Sequence
  Description of Artificial Sequence: Synthetic oligonucleotide
aaugaccagcuaagaaug

SEQ ID NO: 69789 - RNA, 18 nt, Artificial Sequence
  Description of Artificial Sequence: Synthetic oligonucleotide
cgaggaaugaccagcuaa

SEQ ID NO: 69790 - RNA, 18 nt, Artificial Sequence
  Description of Artificial Sequence: Synthetic oligonucleotide
gcuaacgaggaaugacca

SEQ ID NO: 69791 - RNA, 18 nt, Artificial Sequence
  Description of Artificial Sequence: Synthetic oligonucleotide
cuuaagcuaacgaggaau

SEQ ID NO: 69792 - RNA, 18 nt, Artificial Sequence
  Description of Artificial Sequence: Synthetic oligonucleotide
agaaccuuaagcuaacga

SEQ ID NO: 69793 - RNA, 18 nt, Artificial Sequence
  Description of Artificial Sequence: Synthetic oligonucleotide
gauucagaaccuuaagcu

SEQ ID NO: 69794 - RNA, 18 nt, Artificial Sequence
  Description of Artificial Sequence: Synthetic oligonucleotide
caccagauucagaaccuu

SEQ ID NO: 69795 - RNA, 18 nt, Artificial Sequence
  Description of Artificial Sequence: Synthetic oligonucleotide
cccagcaccagauucaga

SEQ ID NO: 69796 - RNA, 18 nt, Artificial Sequence
  Description of Artificial Sequence: Synthetic oligonucleotide
gcuuccccagcaccagau

SEQ ID NO: 69797 - RNA, 18 nt, Artificial Sequence
  Description of Artificial Sequence: Synthetic oligonucleotide
gcccagcuuccccagcac

SEQ ID NO: 69798 - RNA, 18 nt, Artificial Sequence
  Description of Artificial Sequence: Synthetic oligonucleotide
gccuggcccagcuucccc

SEQ ID NO: 69799 - RNA, 18 nt, Artificial Sequence
  Description of Artificial Sequence: Synthetic oligonucleotide
ggcuugccuggcccagcu

SEQ ID NO: 69800 - RNA, 18 nt, Artificial Sequence
  Description of Artificial Sequence: Synthetic oligonucleotide
gcccuggcuugccuggcc

SEQ ID NO: 69801 - RNA, 18 nt, Artificial Sequence
  Description of Artificial Sequence: Synthetic oligonucleotide
cuugcgcccuggcuugcc

SEQ ID NO: 69802 - RNA, 18 nt, Artificial Sequence
  Description of Artificial Sequence: Synthetic oligonucleotide
cucuccuugcgcccuggc

SEQ ID NO: 69803 - RNA, 18 nt, Artificial Sequence
  Description of Artificial Sequence: Synthetic oligonucleotide
uuacccucuccuugcgcc

SEQ ID NO: 69804 - RNA, 18 nt, Artificial Sequence
  Description of Artificial Sequence: Synthetic oligonucleotide
ucccauuacccucuccuu

SEQ ID NO: 69805 - RNA, 18 nt, Artificial Sequence
  Description of Artificial Sequence: Synthetic oligonucleotide
ccuccucccauuacccuc

SEQ ID NO: 69806 - RNA, 18 nt, Artificial Sequence
  Description of Artificial Sequence: Synthetic oligonucleotide
ugggcccuccucccauua

SEQ ID NO: 69807 - RNA, 18 nt, Artificial Sequence
  Description of Artificial Sequence: Synthetic oligonucleotide
augagugggcccuccucc

SEQ ID NO: 69808 - RNA, 18 nt, Artificial Sequence
  Description of Artificial Sequence: Synthetic oligonucleotide
ucaacaugagugggcccu

SEQ ID NO: 69809 - RNA, 18 nt, Artificial Sequence
  Description of Artificial Sequence: Synthetic oligonucleotide
gucugucaacaugagugg

SEQ ID NO: 69810 - RNA, 18 nt, Artificial Sequence
  Description of Artificial Sequence: Synthetic oligonucleotide
uguaggucugucaacaug

SEQ ID NO: 69811 - RNA, 18 nt, Artificial Sequence
  Description of Artificial Sequence: Synthetic oligonucleotide
uuuccuguaggucuguca

SEQ ID NO: 69812 - RNA, 18 nt, Artificial Sequence
  Description of Artificial Sequence: Synthetic oligonucleotide
ugggauuuccuguagguc

SEQ ID NO: 69813 - RNA, 18 nt, Artificial Sequence
  Description of Artificial Sequence: Synthetic oligonucleotide
aauauugggauuuccugu

SEQ ID NO: 69814 - RNA, 18 nt, Artificial Sequence
  Description of Artificial Sequence: Synthetic oligonucleotide
gauucaauauugggauuu

SEQ ID NO: 69815 - RNA, 18 nt, Artificial Sequence
  Description of Artificial Sequence: Synthetic oligonucleotide
caccugauucaauauugg

SEQ ID NO: 69816 - RNA, 18 nt, Artificial Sequence
  Description of Artificial Sequence: Synthetic oligonucleotide
gcuugcaccugauucaau

SEQ ID NO: 69817 - RNA, 18 nt, Artificial Sequence
  Description of Artificial Sequence: Synthetic oligonucleotide
aagaggcuugcaccugau

SEQ ID NO: 69818 - RNA, 18 nt, Artificial Sequence
  Description of Artificial Sequence: Synthetic oligonucleotide
gugcaaagaggcuugcac

SEQ ID NO: 69819 - RNA, 18 nt, Artificial Sequence
  Description of Artificial Sequence: Synthetic oligonucleotide
aaguugugcaaagaggcu

SEQ ID NO: 69820 - RNA, 18 nt, Artificial Sequence
  Description of Artificial Sequence: Synthetic oligonucleotide
uucacaaguugugcaaag

SEQ ID NO: 69821 - RNA, 18 nt, Artificial Sequence
  Description of Artificial Sequence: Synthetic oligonucleotide
ucuccuuuuugucaggac

SEQ ID NO: 69822 - RNA, 18 nt, Artificial Sequence
  Description of Artificial Sequence: Synthetic oligonucleotide
uggugucuccuuuuuguc

SEQ ID NO: 69823 - RNA, 18 nt, Artificial Sequence
  Description of Artificial Sequence: Synthetic oligonucleotide
gcauauggugucuccuuu

SEQ ID NO: 69824 - RNA, 18 nt, Artificial Sequence
  Description of Artificial Sequence: Synthetic oligonucleotide
agaaagcauauggugucu

SEQ ID NO: 69825 - RNA, 18 nt, Artificial Sequence
  Description of Artificial Sequence: Synthetic oligonucleotide
aagcaagaaagcauaugg

SEQ ID NO: 69826 - RNA, 18 nt, Artificial Sequence
  Description of Artificial Sequence: Synthetic oligonucleotide
aaagaaagcaagaaagca

SEQ ID NO: 69827 - RNA, 18 nt, Artificial Sequence
  Description of Artificial Sequence: Synthetic oligonucleotide
gaaagaaagaaagcaaga

SEQ ID NO: 69828 - RNA, 18 nt, Artificial Sequence
  Description of Artificial Sequence: Synthetic oligonucleotide
agaaagaaagaaagaaag

SEQ ID NO: 69829 - RNA, 18 nt, Artificial Sequence
  Description of Artificial Sequence: Synthetic oligonucleotide
aagaaagaaagaaagaaa

SEQ ID NO: 69830 - RNA, 18 nt, Artificial Sequence
  Description of Artificial Sequence: Synthetic oligonucleotide
aaagaaagaaagaaagaa

SEQ ID NO: 69831 - RNA, 18 nt, Artificial Sequence
  Description of Artificial Sequence: Synthetic oligonucleotide
aaaaaaaagaaagaaaga

SEQ ID NO: 69832 - RNA, 18 nt, Artificial Sequence
  Description of Artificial Sequence: Synthetic oligonucleotide
caaaaaaaaaaaagaaag

SEQ ID NO: 69833 - RNA, 18 nt, Artificial Sequence
  Description of Artificial Sequence: Synthetic oligonucleotide
cgucucaaaaaaaaaaaa

SEQ ID NO: 69834 - RNA, 18 nt, Artificial Sequence
  Description of Artificial Sequence: Synthetic oligonucleotide
aacuccgucucaaaaaaa

SEQ ID NO: 69835 - RNA, 18 nt, Artificial Sequence
  Description of Artificial Sequence: Synthetic oligonucleotide
agugaaacuccgucucaa

SEQ ID NO: 69836 - RNA, 18 nt, Artificial Sequence
  Description of Artificial Sequence: Synthetic oligonucleotide
auaagagugaaacuccgu

SEQ ID NO: 69837 - RNA, 18 nt, Artificial Sequence
  Description of Artificial Sequence: Synthetic oligonucleotide
gggcaauaagagugaaac

SEQ ID NO: 69838 - RNA, 18 nt, Artificial Sequence
  Description of Artificial Sequence: Synthetic oligonucleotide
agccugggcaauaagagu

SEQ ID NO: 69839 - RNA, 18 nt, Artificial Sequence
  Description of Artificial Sequence: Synthetic oligonucleotide
acuccagccugggcaaua

SEQ ID NO: 69840 - RNA, 18 nt, Artificial Sequence
  Description of Artificial Sequence: Synthetic oligonucleotide
auugcacuccagccuggg

SEQ ID NO: 69841 - RNA, 18 nt, Artificial Sequence
  Description of Artificial Sequence: Synthetic oligonucleotide
gcaccauugcacuccagc

SEQ ID NO: 69842 - RNA, 18 nt, Artificial Sequence
  Description of Artificial Sequence: Synthetic oligonucleotide
agaucgcaccauugcacu

SEQ ID NO: 69843 - RNA, 18 nt, Artificial Sequence
  Description of Artificial Sequence: Synthetic oligonucleotide
agccgagaucgcaccauu

SEQ ID NO: 69844 - RNA, 18 nt, Artificial Sequence
  Description of Artificial Sequence: Synthetic oligonucleotide
uggugagccgagaucgca

SEQ ID NO: 69845 - RNA, 18 nt, Artificial Sequence
  Description of Artificial Sequence: Synthetic oligonucleotide
gguuguggugagccgaga

SEQ ID NO: 69846 - RNA, 18 nt, Artificial Sequence
  Description of Artificial Sequence: Synthetic oligonucleotide
gcggagguuguggugagc

SEQ ID NO: 69847 - RNA, 18 nt, Artificial Sequence
  Description of Artificial Sequence: Synthetic oligonucleotide
gggaggcggagguugugg

SEQ ID NO: 69848 - RNA, 18 nt, Artificial Sequence
  Description of Artificial Sequence: Synthetic oligonucleotide
uaccugggaggcggaggu

SEQ ID NO: 69849 - RNA, 18 nt, Artificial Sequence
  Description of Artificial Sequence: Synthetic oligonucleotide
gcuuguaccugggaggcg

SEQ ID NO: 69850 - RNA, 18 nt, Artificial Sequence
  Description of Artificial Sequence: Synthetic oligonucleotide
gaaucgcuuguaccuggg

SEQ ID NO: 69851 - RNA, 18 nt, Artificial Sequence
  Description of Artificial Sequence: Synthetic oligonucleotide
caggagaaucgcuuguac

SEQ ID NO: 69852 - RNA, 18 nt, Artificial Sequence
  Description of Artificial Sequence: Synthetic oligonucleotide
ugagacaggagaaucgcu

SEQ ID NO: 69853 - RNA, 18 nt, Artificial Sequence
  Description of Artificial Sequence: Synthetic oligonucleotide
gaggcugagacaggagaa

SEQ ID NO: 69854 - RNA, 18 nt, Artificial Sequence
  Description of Artificial Sequence: Synthetic oligonucleotide
cuugggaggcugagacag

SEQ ID NO: 69855 - RNA, 18 nt, Artificial Sequence
  Description of Artificial Sequence: Synthetic oligonucleotide
agcuacuugggaggcuga

SEQ ID NO: 69856 - RNA, 18 nt, Artificial Sequence
  Description of Artificial Sequence: Synthetic oligonucleotide
auccaagcuacuugggag

SEQ ID NO: 69857 - RNA, 18 nt, Artificial Sequence
  Description of Artificial Sequence: Synthetic oligonucleotide
cuguaauccaagcuacuu

SEQ ID NO: 69858 - RNA, 18 nt, Artificial Sequence
  Description of Artificial Sequence: Synthetic oligonucleotide
caugccuguaauccaagc

SEQ ID NO: 69859 - RNA, 18 nt, Artificial Sequence
  Description of Artificial Sequence: Synthetic oligonucleotide
ugguucaugccuguaauc

SEQ ID NO: 69860 - RNA, 18 nt, Artificial Sequence
  Description of Artificial Sequence: Synthetic oligonucleotide
uguggugguucaugccug

SEQ ID NO: 69861 - RNA, 18 nt, Artificial Sequence
  Description of Artificial Sequence: Synthetic oligonucleotide
caggguguggugguucau

SEQ ID NO: 69862 - RNA, 18 nt, Artificial Sequence
  Description of Artificial Sequence: Synthetic oligonucleotide
acuagcaggguguggugg

SEQ ID NO: 69863 - RNA, 18 nt, Artificial Sequence
  Description of Artificial Sequence: Synthetic oligonucleotide
aaaaaacuagcagggugu

SEQ ID NO: 69864 - RNA, 18 nt, Artificial Sequence
  Description of Artificial Sequence: Synthetic oligonucleotide
auacaaaaaaacuagcag

SEQ ID NO: 69865 - RNA, 18 nt, Artificial Sequence
  Description of Artificial Sequence: Synthetic oligonucleotide
acgaaauacaaaaaaacu

SEQ ID NO: 69866 - RNA, 18 nt, Artificial Sequence
  Description of Artificial Sequence: Synthetic oligonucleotide
gcucuacgaaauacaaaa

SEQ ID NO: 69867 - RNA, 18 nt, Artificial Sequence
  Description of Artificial Sequence: Synthetic oligonucleotide
ccccggcucuacgaaaua

SEQ ID NO: 69868 - RNA, 18 nt, Artificial Sequence
  Description of Artificial Sequence: Synthetic oligonucleotide
ugaaaccccggcucuacg

SEQ ID NO: 69869 - RNA, 18 nt, Artificial Sequence
  Description of Artificial Sequence: Synthetic oligonucleotide
cauggugaaaccccggcu

SEQ ID NO: 69870 - RNA, 18 nt, Artificial Sequence
  Description of Artificial Sequence: Synthetic oligonucleotide
acuaacauggugaaaccc

SEQ ID NO: 69871 - RNA, 18 nt, Artificial Sequence
  Description of Artificial Sequence: Synthetic oligonucleotide
gccucacuaacaugguga

SEQ ID NO: 69872 - RNA, 18 nt, Artificial Sequence
  Description of Artificial Sequence: Synthetic oligonucleotide
caccagccucacuaacau

SEQ ID NO: 69873 - RNA, 18 nt, Artificial Sequence
  Description of Artificial Sequence: Synthetic oligonucleotide
uucgccaccagccucacu

SEQ ID NO: 69874 - RNA, 18 nt, Artificial Sequence
  Description of Artificial Sequence: Synthetic oligonucleotide
aggaguucgccaccagcc

SEQ ID NO: 69875 - RNA, 18 nt, Artificial Sequence
  Description of Artificial Sequence: Synthetic oligonucleotide
aggucaggaguucgccac

SEQ ID NO: 69876 - RNA, 18 nt, Artificial Sequence
  Description of Artificial Sequence: Synthetic oligonucleotide
accugaggucaggaguuc

SEQ ID NO: 69877 - RNA, 18 nt, Artificial Sequence
  Description of Artificial Sequence: Synthetic oligonucleotide
ggaucaccugaggucagg

SEQ ID NO: 69878 - RNA, 18 nt, Artificial Sequence
  Description of Artificial Sequence: Synthetic oligonucleotide
cggguggaucaccugagg

SEQ ID NO: 69879 - RNA, 18 nt, Artificial Sequence
  Description of Artificial Sequence: Synthetic oligonucleotide
caaggcggguggaucacc

SEQ ID NO: 69880 - RNA, 18 nt, Artificial Sequence
  Description of Artificial Sequence: Synthetic oligonucleotide
gaguccaaggcgggugga

SEQ ID NO: 69881 - RNA, 18 nt, Artificial Sequence
  Description of Artificial Sequence: Synthetic oligonucleotide
uuugggaguccaaggcgg

SEQ ID NO: 69882 - RNA, 18 nt, Artificial Sequence
  Description of Artificial Sequence: Synthetic oligonucleotide
agcacuuugggaguccaa

SEQ ID NO: 69883 - RNA, 18 nt, Artificial Sequence
  Description of Artificial Sequence: Synthetic oligonucleotide
aucccagcacuuugggag

SEQ ID NO: 69884 - RNA, 18 nt, Artificial Sequence
  Description of Artificial Sequence: Synthetic oligonucleotide
cuguaaucccagcacuuu

SEQ ID NO: 69885 - RNA, 18 nt, Artificial Sequence
  Description of Artificial Sequence: Synthetic oligonucleotide
caugccuguaaucccagc

SEQ ID NO: 69886 - RNA, 18 nt, Artificial Sequence
  Description of Artificial Sequence: Synthetic oligonucleotide
uggcucaugccuguaauc

SEQ ID NO: 69887 - RNA, 18 nt, Artificial Sequence
  Description of Artificial Sequence: Synthetic oligonucleotide
ugcaguggcucaugccug

SEQ ID NO: 69888 - RNA, 18 nt, Artificial Sequence
  Description of Artificial Sequence: Synthetic oligonucleotide
ccgggugcaguggcucau

SEQ ID NO: 69889 - RNA, 18 nt, Artificial Sequence
  Description of Artificial Sequence: Synthetic oligonucleotide
gugugccgggugcagugg

SEQ ID NO: 69890 - RNA, 18 nt, Artificial Sequence
  Description of Artificial Sequence: Synthetic oligonucleotide
auauggugugccgggugc

SEQ ID NO: 69891 - RNA, 18 nt, Artificial Sequence
  Description of Artificial Sequence: Synthetic oligonucleotide
aaagcauauggugugccg

SEQ ID NO: 69892 - RNA, 18 nt, Artificial Sequence
  Description of Artificial Sequence: Synthetic oligonucleotide
ugaugaaagcauauggug

SEQ ID NO: 69893 - RNA, 18 nt, Artificial Sequence
  Description of Artificial Sequence: Synthetic oligonucleotide
ucuugugaugaaagcaua

SEQ ID NO: 69894 - RNA, 18 nt, Artificial Sequence
  Description of Artificial Sequence: Synthetic oligonucleotide
cauuuucuugugaugaaa

SEQ ID NO: 69895 - RNA, 18 nt, Artificial Sequence
  Description of Artificial Sequence: Synthetic oligonucleotide
ucucacauuuucuuguga

SEQ ID NO: 69896 - RNA, 18 nt, Artificial Sequence
  Description of Artificial Sequence: Synthetic oligonucleotide
aauucucucacauuuucu

SEQ ID NO: 69897 - RNA, 18 nt, Artificial Sequence
  Description of Artificial Sequence: Synthetic oligonucleotide
cccugaauucucucacau

SEQ ID NO: 69898 - RNA, 18 nt, Artificial Sequence
  Description of Artificial Sequence: Synthetic oligonucleotide
caaagcccugaauucucu

SEQ ID NO: 69899 - RNA, 18 nt, Artificial Sequence
  Description of Artificial Sequence: Synthetic oligonucleotide
acugccaaagcccugaau

SEQ ID NO: 69900 - RNA, 18 nt, Artificial Sequence
  Description of Artificial Sequence: Synthetic oligonucleotide
cuggaacugccaaagccc

SEQ ID NO: 69901 - RNA, 18 nt, Artificial Sequence
  Description of Artificial Sequence: Synthetic oligonucleotide
ccagccuggaacugccaa

SEQ ID NO: 69902 - RNA, 18 nt, Artificial Sequence
  Description of Artificial Sequence: Synthetic oligonucleotide
gcugaccagccuggaacu

SEQ ID NO: 69903 - RNA, 18 nt, Artificial Sequence
  Description of Artificial Sequence: Synthetic oligonucleotide
gagaugcugaccagccug

SEQ ID NO: 69904 - RNA, 18 nt, Artificial Sequence
  Description of Artificial Sequence: Synthetic oligonucleotide
ggcuugagaugcugacca

SEQ ID NO: 69905 - RNA, 18 nt, Artificial Sequence
  Description of Artificial Sequence: Synthetic oligonucleotide
gggagggcuugagaugcu

SEQ ID NO: 69906 - RNA, 18 nt, Artificial Sequence
  Description of Artificial Sequence: Synthetic oligonucleotide
gggugaacagaugcuggg

SEQ ID NO: 69907 - RNA, 18 nt, Artificial Sequence
  Description of Artificial Sequence: Synthetic oligonucleotide
ggcagggugaacagaugc

SEQ ID NO: 69908 - RNA, 18 nt, Artificial Sequence
  Description of Artificial Sequence: Synthetic oligonucleotide
ugccuggcagggugaaca

SEQ ID NO: 69909 - RNA, 18 nt, Artificial Sequence
  Description of Artificial Sequence: Synthetic oligonucleotide
gagacugccuggcagggu

SEQ ID NO: 69910 - RNA, 18 nt, Artificial Sequence
  Description of Artificial Sequence: Synthetic oligonucleotide
aggaagagacugccuggc

SEQ ID NO: 69911 - RNA, 18 nt, Artificial Sequence
  Description of Artificial Sequence: Synthetic oligonucleotide
uuucuaggaagagacugc

SEQ ID NO: 69912 - RNA, 18 nt, Artificial Sequence
  Description of Artificial Sequence: Synthetic oligonucleotide
ccaaguuucuaggaagag

SEQ ID NO: 69913 - RNA, 18 nt, Artificial Sequence
  Description of Artificial Sequence: Synthetic oligonucleotide
uuuaaccaaguuucuagg

SEQ ID NO: 69914 - RNA, 18 nt, Artificial Sequence
  Description of Artificial Sequence: Synthetic oligonucleotide
gaacauuuaaccaaguuu

SEQ ID NO: 69915 - RNA, 18 nt, Artificial Sequence
  Description of Artificial Sequence: Synthetic oligonucleotide
agagugaacauuuaacca

SEQ ID NO: 69916 - RNA, 18 nt, Artificial Sequence
  Description of Artificial Sequence: Synthetic oligonucleotide
caagggugaagaaucuau

SEQ ID NO: 69917 - RNA, 18 nt, Artificial Sequence
  Description of Artificial Sequence: Synthetic oligonucleotide
cgggccaagggugaagaa

SEQ ID NO: 69918 - RNA, 18 nt, Artificial Sequence
  Description of Artificial Sequence: Synthetic oligonucleotide
aaaggcgggccaagggug

SEQ ID NO: 69919 - RNA, 18 nt, Artificial Sequence
  Description of Artificial Sequence: Synthetic oligonucleotide
gggcaaaggcgggccaag

SEQ ID NO: 69920 - RNA, 18 nt, Artificial Sequence
  Description of Artificial Sequence: Synthetic oligonucleotide
ugggcagaguaggguggg

SEQ ID NO: 69921 - RNA, 18 nt, Artificial Sequence
  Description of Artificial Sequence: Synthetic oligonucleotide
acuucugggcagaguagg

SEQ ID NO: 69922 - RNA, 18 nt, Artificial Sequence
  Description of Artificial Sequence: Synthetic oligonucleotide
cuugcacuucugggcaga

SEQ ID NO: 69923 - RNA, 18 nt, Artificial Sequence
  Description of Artificial Sequence: Synthetic oligonucleotide
aggcucuugcacuucugg

SEQ ID NO: 69924 - RNA, 18 nt, Artificial Sequence
  Description of Artificial Sequence: Synthetic oligonucleotide
ggcuuaggcucuugcacu

SEQ ID NO: 69925 - RNA, 18 nt, Artificial Sequence
  Description of Artificial Sequence: Synthetic oligonucleotide
gaggcggcuuaggcucuu

SEQ ID NO: 69926 - RNA, 18 nt, Artificial Sequence
  Description of Artificial Sequence: Synthetic oligonucleotide
ccauggaggcggcuuagg

SEQ ID NO: 69927 - RNA, 18 nt, Artificial Sequence
  Description of Artificial Sequence: Synthetic oligonucleotide
gggccauggaggcggcuu

SEQ ID NO: 69928 - RNA, 18 nt, Artificial Sequence
  Description of Artificial Sequence: Synthetic oligonucleotide
cccugaauccuuccuggg

SEQ ID NO: 69929 - RNA, 18 nt, Artificial Sequence
  Description of Artificial Sequence: Synthetic oligonucleotide
cucuccccugaauccuuc

SEQ ID NO: 69930 - RNA, 18 nt, Artificial Sequence
  Description of Artificial Sequence: Synthetic oligonucleotide
gggccucuccccugaauc

SEQ ID NO: 69931 - RNA, 18 nt, Artificial Sequence
  Description of Artificial Sequence: Synthetic oligonucleotide
cguggcucccuguuuggg

SEQ ID NO: 69932 - RNA, 18 nt, Artificial Sequence
  Description of Artificial Sequence: Synthetic oligonucleotide
gcuggcguggcucccugu

SEQ ID NO: 69933 - RNA, 18 nt, Artificial Sequence
  Description of Artificial Sequence: Synthetic oligonucleotide
gucuggcuggcguggcuc

SEQ ID NO: 69934 - RNA, 18 nt, Artificial Sequence
  Description of Artificial Sequence: Synthetic oligonucleotide
gggugucuggcuggcgug

SEQ ID NO: 69935 - RNA, 18 nt, Artificial Sequence
  Description of Artificial Sequence: Synthetic oligonucleotide
agcuccauucuggccggg

SEQ ID NO: 69936 - RNA, 18 nt, Artificial Sequence
  Description of Artificial Sequence: Synthetic oligonucleotide
cagucagcuccauucugg

SEQ ID NO: 69937 - RNA, 18 nt, Artificial Sequence
  Description of Artificial Sequence: Synthetic oligonucleotide
aagggugaagaaucuauc

SEQ ID NO: 69938 - RNA, 18 nt, Artificial Sequence
  Description of Artificial Sequence: Synthetic oligonucleotide
gggccaagggugaagaau

SEQ ID NO: 69939 - RNA, 18 nt, Artificial Sequence
  Description of Artificial Sequence: Synthetic oligonucleotide
aaggcgggccaaggguga

SEQ ID NO: 69940 - RNA, 18 nt, Artificial Sequence
  Description of Artificial Sequence: Synthetic oligonucleotide
gggcaaaggcgggccaag

SEQ ID NO: 69941 - RNA, 18 nt, Artificial Sequence
  Description of Artificial Sequence: Synthetic oligonucleotide
ugggcagaguaggguggg

SEQ ID NO: 69942 - RNA, 18 nt, Artificial Sequence
  Description of Artificial Sequence: Synthetic oligonucleotide
uucugggcagaguagggu

SEQ ID NO: 69943 - RNA, 18 nt, Artificial Sequence
  Description of Artificial Sequence: Synthetic oligonucleotide
ugcacuucugggcagagu

SEQ ID NO: 69944 - RNA, 18 nt, Artificial Sequence
  Description of Artificial Sequence: Synthetic oligonucleotide
gcucuugcacuucugggc

SEQ ID NO: 69945 - RNA, 18 nt, Artificial Sequence
  Description of Artificial Sequence: Synthetic oligonucleotide
cuuaggcucuugcacuuc

SEQ ID NO: 69946 - RNA, 18 nt, Artificial Sequence
  Description of Artificial Sequence: Synthetic oligonucleotide
ggcggcuuaggcucuugc

SEQ ID NO: 69947 - RNA, 18 nt, Artificial Sequence
  Description of Artificial Sequence: Synthetic oligonucleotide
auggaggcggcuuaggcu

SEQ ID NO: 69948 - RNA, 18 nt, Artificial Sequence
  Description of Artificial Sequence: Synthetic oligonucleotide
gggccauggaggcggcuu

SEQ ID NO: 69949 - RNA, 18 nt, Artificial Sequence
  Description of Artificial Sequence: Synthetic oligonucleotide
cccugaauccuuccuggg

SEQ ID NO: 69950 - RNA, 18 nt, Artificial Sequence
  Description of Artificial Sequence: Synthetic oligonucleotide
ucuccccugaauccuucc

SEQ ID NO: 69951 - RNA, 18 nt, Artificial Sequence
  Description of Artificial Sequence: Synthetic oligonucleotide
gggccucuccccugaauc

SEQ ID NO: 69952 - RNA, 18 nt, Artificial Sequence
  Description of Artificial Sequence: Synthetic oligonucleotide
cguggcucccuguuuggg

SEQ ID NO: 69953 - RNA, 18 nt, Artificial Sequence
  Description of Artificial Sequence: Synthetic oligonucleotide
cuggcguggcucccuguu

SEQ ID NO: 69954 - RNA, 18 nt, Artificial Sequence
  Description of Artificial Sequence: Synthetic oligonucleotide
ucuggcuggcguggcucc

SEQ ID NO: 69955 - RNA, 18 nt, Artificial Sequence
  Description of Artificial Sequence: Synthetic oligonucleotide
gggugucuggcuggcgug

SEQ ID NO: 69956 - RNA, 18 nt, Artificial Sequence
  Description of Artificial Sequence: Synthetic oligonucleotide
agcuccauucuggccggg

SEQ ID NO: 69957 - RNA, 18 nt, Artificial Sequence
  Description of Artificial Sequence: Synthetic oligonucleotide
ucagcuccauucuggccg

SEQ ID NO: 69958 - RNA, 18 nt, Artificial Sequence
  Description of Artificial Sequence: Synthetic oligonucleotide
uagccccucagguguguu

SEQ ID NO: 69959 - RNA, 18 nt, Artificial Sequence
  Description of Artificial Sequence: Synthetic oligonucleotide
ggcccuagccccucaggu

SEQ ID NO: 69960 - RNA, 18 nt, Artificial Sequence
  Description of Artificial Sequence: Synthetic oligonucleotide
cauauggcccuagccccu

SEQ ID NO: 69961 - RNA, 18 nt, Artificial Sequence
  Description of Artificial Sequence: Synthetic oligonucleotide
guuuccauauggcccuag

SEQ ID NO: 69962 - RNA, 18 nt, Artificial Sequence
  Description of Artificial Sequence: Synthetic oligonucleotide
gucauguuuccauauggc

SEQ ID NO: 69963 - RNA, 18 nt, Artificial Sequence
  Description of Artificial Sequence: Synthetic oligonucleotide
cuucugucauguuuccau

SEQ ID NO: 69964 - RNA, 18 nt, Artificial Sequence
  Description of Artificial Sequence: Synthetic oligonucleotide
cuccccuucugucauguu

SEQ ID NO: 69965 - RNA, 18 nt, Artificial Sequence
  Description of Artificial Sequence: Synthetic oligonucleotide
ucucucuccccuucuguc

SEQ ID NO: 69966 - RNA, 18 nt, Artificial Sequence
  Description of Artificial Sequence: Synthetic oligonucleotide
uccuuucucucuccccuu

SEQ ID NO: 69967 - RNA, 18 nt, Artificial Sequence
  Description of Artificial Sequence: Synthetic oligonucleotide
gugucuccuuucucucuc

SEQ ID NO: 69968 - RNA, 18 nt, Artificial Sequence
  Description of Artificial Sequence: Synthetic oligonucleotide
gcagcgugucuccuuucu

SEQ ID NO: 69969 - RNA, 18 nt, Artificial Sequence
  Description of Artificial Sequence: Synthetic oligonucleotide
ccccugcagcgugucucc

SEQ ID NO: 69970 - RNA, 18 nt, Artificial Sequence
  Description of Artificial Sequence: Synthetic oligonucleotide
ccugcccccugcagcgug

SEQ ID NO: 69971 - RNA, 18 nt, Artificial Sequence
  Description of Artificial Sequence: Synthetic oligonucleotide
agcuuccugcccccugca

SEQ ID NO: 69972 - RNA, 18 nt, Artificial Sequence
  Description of Artificial Sequence: Synthetic oligonucleotide
cccccagcuuccugcccc

SEQ ID NO: 69973 - RNA, 18 nt, Artificial Sequence
  Description of Artificial Sequence: Synthetic oligonucleotide
ggguucccccagcuuccu

SEQ ID NO: 69974 - RNA, 18 nt, Artificial Sequence
  Description of Artificial Sequence: Synthetic oligonucleotide
agaauggguucccccagc

SEQ ID NO: 69975 - RNA, 18 nt, Artificial Sequence
  Description of Artificial Sequence: Synthetic oligonucleotide
uugggagaauggguuccc

SEQ ID NO: 69976 - RNA, 18 nt, Artificial Sequence
  Description of Artificial Sequence: Synthetic oligonucleotide
uauuuuugggagaauggg

SEQ ID NO: 69977 - RNA, 18 nt, Artificial Sequence
  Description of Artificial Sequence: Synthetic oligonucleotide
ccccuuauuuuugggaga

SEQ ID NO: 69978 - RNA, 18 nt, Artificial Sequence
  Description of Artificial Sequence: Synthetic oligonucleotide
ucagaccccuuauuuuug

SEQ ID NO: 69979 - RNA, 18 nt, Artificial Sequence
  Description of Artificial Sequence: Synthetic oligonucleotide
accccucagaccccuuau

SEQ ID NO: 69980 - RNA, 18 nt, Artificial Sequence
  Description of Artificial Sequence: Synthetic oligonucleotide
aauccaccccucagaccc

SEQ ID NO: 69981 - RNA, 18 nt, Artificial Sequence
  Description of Artificial Sequence: Synthetic oligonucleotide
cagggaauccaccccuca

SEQ ID NO: 69982 - RNA, 18 nt, Artificial Sequence
  Description of Artificial Sequence: Synthetic oligonucleotide
aaacccagggaauccacc

SEQ ID NO: 69983 - RNA, 18 nt, Artificial Sequence
  Description of Artificial Sequence: Synthetic oligonucleotide
gggagaauggguuccccc

SEQ ID NO: 69984 - RNA, 18 nt, Artificial Sequence
  Description of Artificial Sequence: Synthetic oligonucleotide
uuuuugggagaauggguu

SEQ ID NO: 69985 - RNA, 18 nt, Artificial Sequence
  Description of Artificial Sequence: Synthetic oligonucleotide
ccuuauuuuugggagaau

SEQ ID NO: 69986 - RNA, 18 nt, Artificial Sequence
  Description of Artificial Sequence: Synthetic oligonucleotide
agaccccuuauuuuuggg

SEQ ID NO: 69987 - RNA, 18 nt, Artificial Sequence
  Description of Artificial Sequence: Synthetic oligonucleotide
cccucagaccccuuauuu

SEQ ID NO: 69988 - RNA, 18 nt, Artificial Sequence
  Description of Artificial Sequence: Synthetic oligonucleotide
uccaccccucagaccccu

SEQ ID NO: 69989 - RNA, 18 nt, Artificial Sequence
  Description of Artificial Sequence: Synthetic oligonucleotide
gggaauccaccccucaga

SEQ ID NO: 69990 - RNA, 18 nt, Artificial Sequence
  Description of Artificial Sequence: Synthetic oligonucleotide
acccagggaauccacccc

SEQ ID NO: 69991 - RNA, 18 nt, Artificial Sequence
  Description of Artificial Sequence: Synthetic oligonucleotide
cugaaacccagggaaucc

SEQ ID NO: 69992 - RNA, 18 nt, Artificial Sequence
  Description of Artificial Sequence: Synthetic oligonucleotide
cagaccugaaacccaggg

SEQ ID NO: 69993 - RNA, 18 nt, Artificial Sequence
  Description of Artificial Sequence: Synthetic oligonucleotide
ggacccagaccugaaacc

SEQ ID NO: 69994 - RNA, 18 nt, Artificial Sequence
  Description of Artificial Sequence: Synthetic oligonucleotide
auucaggacccagaccug

SEQ ID NO: 69995 - RNA, 18 nt, Artificial Sequence
  Description of Artificial Sequence: Synthetic oligonucleotide
uucccauucaggacccag

SEQ ID NO: 69996 - RNA, 18 nt, Artificial Sequence
  Description of Artificial Sequence: Synthetic oligonucleotide
aggaauucccauucagga

SEQ ID NO: 69997 - RNA, 18 nt, Artificial Sequence
  Description of Artificial Sequence: Synthetic oligonucleotide
auuccaggaauucccauu

SEQ ID NO: 69998 - RNA, 18 nt, Artificial Sequence
  Description of Artificial Sequence: Synthetic oligonucleotide
cugguauuccaggaauuc

SEQ ID NO: 69999 - RNA, 18 nt, Artificial Sequence
  Description of Artificial Sequence: Synthetic oligonucleotide
gucagcugguauuccagg

SEQ ID NO: 70000 - RNA, 18 nt, Artificial Sequence
  Description of Artificial Sequence: Synthetic oligonucleotide
ucauugucagcugguauu

SEQ ID NO: 70001 - RNA, 18 nt, Artificial Sequence
  Description of Artificial Sequence: Synthetic oligonucleotide
ggaaaucauugucagcug

SEQ ID NO: 70002 - RNA, 18 nt, Artificial Sequence
  Description of Artificial Sequence: Synthetic oligonucleotide
gaggaggaaaucauuguc

SEQ ID NO: 70003 - RNA, 18 nt, Artificial Sequence
  Description of Artificial Sequence: Synthetic oligonucleotide
aagaugaggaggaaauca

SEQ ID NO: 70004 - RNA, 18 nt, Artificial Sequence
  Description of Artificial Sequence: Synthetic oligonucleotide
guugaaagaugaggagga

SEQ ID NO: 70005 - RNA, 18 nt, Artificial Sequence
  Description of Artificial Sequence: Synthetic oligonucleotide
gugagguugaaagaugag

SEQ ID NO: 70006 - RNA, 18 nt, Artificial Sequence
  Description of Artificial Sequence: Synthetic oligonucleotide
augaccacgaggagcaau

SEQ ID NO: 70007 - RNA, 18 nt, Artificial Sequence
  Description of Artificial Sequence: Synthetic oligonucleotide
gaagcaugaccacgagga

SEQ ID NO: 70008 - RNA, 18 nt, Artificial Sequence
  Description of Artificial Sequence: Synthetic oligonucleotide
uaggagaagcaugaccac

SEQ ID NO: 70009 - RNA, 18 nt, Artificial Sequence
  Description of Artificial Sequence: Synthetic oligonucleotide
gcaguuaggagaagcaug

SEQ ID NO: 70010 - RNA, 18 nt, Artificial Sequence
  Description of Artificial Sequence: Synthetic oligonucleotide
gccuugcaguuaggagaa

SEQ ID NO: 70011 - RNA, 18 nt, Artificial Sequence
  Description of Artificial Sequence: Synthetic oligonucleotide
cguuagccuugcaguuag

SEQ ID NO: 70012 - RNA, 18 nt, Artificial Sequence
  Description of Artificial Sequence: Synthetic oligonucleotide
gacagcguuagccuugca

SEQ ID NO: 70013 - RNA, 18 nt, Artificial Sequence
  Description of Artificial Sequence: Synthetic oligonucleotide
ggcuggacagcguuagcc

SEQ ID NO: 70014 - RNA, 18 nt, Artificial Sequence
  Description of Artificial Sequence: Synthetic oligonucleotide
agccgggcuggacagcgu

SEQ ID NO: 70015 - RNA, 18 nt, Artificial Sequence
  Description of Artificial Sequence: Synthetic oligonucleotide
ggaggagccgggcuggac

SEQ ID NO: 70016 - RNA, 18 nt, Artificial Sequence
  Description of Artificial Sequence: Synthetic oligonucleotide
aagcaggaggagccgggc

SEQ ID NO: 70017 - RNA, 18 nt, Artificial Sequence
  Description of Artificial Sequence: Synthetic oligonucleotide
gucacaagcaggaggagc

SEQ ID NO: 70018 - RNA, 18 nt, Artificial Sequence
  Description of Artificial Sequence: Synthetic oligonucleotide
cggaggucacaagcagga

SEQ ID NO: 70019 - RNA, 18 nt, Artificial Sequence
  Description of Artificial Sequence: Synthetic oligonucleotide
ggacucggaggucacaag

SEQ ID NO: 70020 - RNA, 18 nt, Artificial Sequence
  Description of Artificial Sequence: Synthetic oligonucleotide
acugaggacucggagguc

SEQ ID NO: 70021 - RNA, 18 nt, Artificial Sequence
  Description of Artificial Sequence: Synthetic oligonucleotide
aguuuacugaggacucgg

SEQ ID NO: 70022 - RNA, 18 nt, Artificial Sequence
  Description of Artificial Sequence: Synthetic oligonucleotide
gaagcaguuuacugagga

SEQ ID NO: 70023 - RNA, 18 nt, Artificial Sequence
  Description of Artificial Sequence: Synthetic oligonucleotide
gucacgaagcaguuuacu

SEQ ID NO: 70024 - RNA, 18 nt, Artificial Sequence
  Description of Artificial Sequence: Synthetic oligonucleotide
ugggagucacgaagcagu

SEQ ID NO: 70025 - RNA, 18 nt, Artificial Sequence
  Description of Artificial Sequence: Synthetic oligonucleotide
ggacaugggagucacgaa

SEQ ID NO: 70026 - RNA, 18 nt, Artificial Sequence
  Description of Artificial Sequence: Synthetic oligonucleotide
gugaaggacaugggaguc

SEQ ID NO: 70027 - RNA, 18 nt, Artificial Sequence
  Description of Artificial Sequence: Synthetic oligonucleotide
cugcugugaaggacaugg

SEQ ID NO: 70028 - RNA, 18 nt, Artificial Sequence
  Description of Artificial Sequence: Synthetic oligonucleotide
caugaccacgaggagcaa

SEQ ID NO: 70029 - RNA, 18 nt, Artificial Sequence
  Description of Artificial Sequence: Synthetic oligonucleotide
agaagcaugaccacgagg

SEQ ID NO: 70030 - RNA, 18 nt, Artificial Sequence
  Description of Artificial Sequence: Synthetic oligonucleotide
uuaggagaagcaugacca

SEQ ID NO: 70031 - RNA, 18 nt, Artificial Sequence
  Description of Artificial Sequence: Synthetic oligonucleotide
ugcaguuaggagaagcau

SEQ ID NO: 70032 - RNA, 18 nt, Artificial Sequence
  Description of Artificial Sequence: Synthetic oligonucleotide
agccuugcaguuaggaga

SEQ ID NO: 70033 - RNA, 18 nt, Artificial Sequence
  Description of Artificial Sequence: Synthetic oligonucleotide
gcguuagccuugcaguua

SEQ ID NO: 70034 - RNA, 18 nt, Artificial Sequence
  Description of Artificial Sequence: Synthetic oligonucleotide
ggacagcguuagccuugc

SEQ ID NO: 70035 - RNA, 18 nt, Artificial Sequence
  Description of Artificial Sequence: Synthetic oligonucleotide
gggcuggacagcguuagc

SEQ ID NO: 70036 - RNA, 18 nt, Artificial Sequence
  Description of Artificial Sequence: Synthetic oligonucleotide
gagccgggcuggacagcg

SEQ ID NO: 70037 - RNA, 18 nt, Artificial Sequence
  Description of Artificial Sequence: Synthetic oligonucleotide
aggaggagccgggcugga

SEQ ID NO: 70038 - RNA, 18 nt, Artificial Sequence
  Description of Artificial Sequence: Synthetic oligonucleotide
caagcaggaggagccggg

SEQ ID NO: 70039 - RNA, 18 nt, Artificial Sequence
  Description of Artificial Sequence: Synthetic oligonucleotide
ggucacaagcaggaggag

SEQ ID NO: 70040 - RNA, 18 nt, Artificial Sequence
  Description of Artificial Sequence: Synthetic oligonucleotide
ucggaggucacaagcagg

SEQ ID NO: 70041 - RNA, 18 nt, Artificial Sequence
  Description of Artificial Sequence: Synthetic oligonucleotide
aggacucggaggucacaa

SEQ ID NO: 70042 - RNA, 18 nt, Artificial Sequence
  Description of Artificial Sequence: Synthetic oligonucleotide
uacugaggacucggaggu

SEQ ID NO: 70043 - RNA, 18 nt, Artificial Sequence
  Description of Artificial Sequence: Synthetic oligonucleotide
caguuuacugaggacucg

SEQ ID NO: 70044 - RNA, 18 nt, Artificial Sequence
  Description of Artificial Sequence: Synthetic oligonucleotide
cgaagcaguuuacugagg

SEQ ID NO: 70045 - RNA, 18 nt, Artificial Sequence
  Description of Artificial Sequence: Synthetic oligonucleotide
agucacgaagcaguuuac

SEQ ID NO: 70046 - RNA, 18 nt, Artificial Sequence
  Description of Artificial Sequence: Synthetic oligonucleotide
augggagucacgaagcag

SEQ ID NO: 70047 - RNA, 18 nt, Artificial Sequence
  Description of Artificial Sequence: Synthetic oligonucleotide
aggacaugggagucacga

SEQ ID NO: 70048 - RNA, 18 nt, Artificial Sequence
  Description of Artificial Sequence: Synthetic oligonucleotide
ugugaaggacaugggagu

SEQ ID NO: 70049 - RNA, 18 nt, Artificial Sequence
  Description of Artificial Sequence: Synthetic oligonucleotide
ucugcugugaaggacaug

SEQ ID NO: 70050 - RNA, 18 nt, Artificial Sequence
  Description of Artificial Sequence: Synthetic oligonucleotide
gggauaauguugggaguu

SEQ ID NO: 70051 - RNA, 18 nt, Artificial Sequence
  Description of Artificial Sequence: Synthetic oligonucleotide
uaccaguuacgcggauaa

SEQ ID NO: 70052 - RNA, 18 nt, Artificial Sequence
  Description of Artificial Sequence: Synthetic oligonucleotide
ugucuuaccaguuacgcg

SEQ ID NO: 70053 - RNA, 18 nt, Artificial Sequence
  Description of Artificial Sequence: Synthetic oligonucleotide
augggugucuuaccaguu

SEQ ID NO: 70054 - RNA, 18 nt, Artificial Sequence
  Description of Artificial Sequence: Synthetic oligonucleotide
ggaguaugggugucuuac

SEQ ID NO: 70055 - RNA, 18 nt, Artificial Sequence
  Description of Artificial Sequence: Synthetic oligonucleotide
uccugggaguaugggugu

SEQ ID NO: 70056 - RNA, 18 nt, Artificial Sequence
  Description of Artificial Sequence: Synthetic oligonucleotide
ugucuuccugggaguaug

SEQ ID NO: 70057 - RNA, 18 nt, Artificial Sequence
  Description of Artificial Sequence: Synthetic oligonucleotide
gauggugucuuccuggga

SEQ ID NO: 70058 - RNA, 18 nt, Artificial Sequence
  Description of Artificial Sequence: Synthetic oligonucleotide
gaagugauggugucuucc

SEQ ID NO: 70059 - RNA, 18 nt, Artificial Sequence
  Description of Artificial Sequence: Synthetic oligonucleotide
uagaggaagugauggugu

SEQ ID NO: 70060 - RNA, 18 nt, Artificial Sequence
  Description of Artificial Sequence: Synthetic oligonucleotide
ggaguuagaggaagugau

SEQ ID NO: 70061 - RNA, 18 nt, Artificial Sequence
  Description of Artificial Sequence: Synthetic oligonucleotide
gucaaggaguuagaggaa

SEQ ID NO: 70062 - RNA, 18 nt, Artificial Sequence
  Description of Artificial Sequence: Synthetic oligonucleotide
auugggucaaggaguuag

SEQ ID NO: 70063 - RNA, 18 nt, Artificial Sequence
  Description of Artificial Sequence: Synthetic oligonucleotide
uagucauugggucaagga

SEQ ID NO: 70064 - RNA, 18 nt, Artificial Sequence
  Description of Artificial Sequence: Synthetic oligonucleotide
aagaauagucauuggguc

SEQ ID NO: 70065 - RNA, 18 nt, Artificial Sequence
  Description of Artificial Sequence: Synthetic oligonucleotide
augggaagaauagucauu

SEQ ID NO: 70066 - RNA, 18 nt, Artificial Sequence
  Description of Artificial Sequence: Synthetic oligonucleotide
acaauaugggaagaauag

SEQ ID NO: 70067 - RNA, 18 nt, Artificial Sequence
  Description of Artificial Sequence: Synthetic oligonucleotide
gggacaauaugggaagaa

SEQ ID NO: 70068 - RNA, 18 nt, Artificial Sequence
  Description of Artificial Sequence: Synthetic oligonucleotide
gugugaucaguagguggg

SEQ ID NO: 70069 - RNA, 18 nt, Artificial Sequence
  Description of Artificial Sequence: Synthetic oligonucleotide
agagagugugaucaguag

SEQ ID NO: 70070 - RNA, 18 nt, Artificial Sequence
  Description of Artificial Sequence: Synthetic oligonucleotide
uugucagagagugugauc

SEQ ID NO: 70071 - RNA, 18 nt, Artificial Sequence
  Description of Artificial Sequence: Synthetic oligonucleotide
aauccuugucagagagug

SEQ ID NO: 70072 - RNA, 18 nt, Artificial Sequence
  Description of Artificial Sequence: Synthetic oligonucleotide
agaauaauccuugucaga

SEQ ID NO: 70073 - RNA, 18 nt, Artificial Sequence
  Description of Artificial Sequence: Synthetic oligonucleotide
ugugaagaauaauccuug

SEQ ID NO: 70074 - RNA, 18 nt, Artificial Sequence
  Description of Artificial Sequence: Synthetic oligonucleotide
uguauugugaagaauaau

SEQ ID NO: 70075 - RNA, 18 nt, Artificial Sequence
  Description of Artificial Sequence: Synthetic oligonucleotide
cgggcuguauugugaaga

SEQ ID NO: 70076 - RNA, 18 nt, Artificial Sequence
  Description of Artificial Sequence: Synthetic oligonucleotide
gugugaucaguagguggg

SEQ ID NO: 70077 - RNA, 18 nt, Artificial Sequence
  Description of Artificial Sequence: Synthetic oligonucleotide
gagagugugaucaguagg

SEQ ID NO: 70078 - RNA, 18 nt, Artificial Sequence
  Description of Artificial Sequence: Synthetic oligonucleotide
ugucagagagugugauca

SEQ ID NO: 70079 - RNA, 18 nt, Artificial Sequence
  Description of Artificial Sequence: Synthetic oligonucleotide
auccuugucagagagugu

SEQ ID NO: 70080 - RNA, 18 nt, Artificial Sequence
  Description of Artificial Sequence: Synthetic oligonucleotide
gaauaauccuugucagag

SEQ ID NO: 70081 - RNA, 18 nt, Artificial Sequence
  Description of Artificial Sequence: Synthetic oligonucleotide
gugaagaauaauccuugu

SEQ ID NO: 70082 - RNA, 18 nt, Artificial Sequence
  Description of Artificial Sequence: Synthetic oligonucleotide
guauugugaagaauaauc

SEQ ID NO: 70083 - RNA, 18 nt, Artificial Sequence
  Description of Artificial Sequence: Synthetic oligonucleotide
gggcuguauugugaagaa

SEQ ID NO: 70084 - RNA, 18 nt, Artificial Sequence
  Description of Artificial Sequence: Synthetic oligonucleotide
aaugcgggcuguauugug

SEQ ID NO: 70085 - RNA, 18 nt, Artificial Sequence
  Description of Artificial Sequence: Synthetic oligonucleotide
uuuuaaaugcgggcugua

SEQ ID NO: 70086 - RNA, 18 nt, Artificial Sequence
  Description of Artificial Sequence: Synthetic oligonucleotide
agagcuuuuaaaugcggg

SEQ ID NO: 70087 - RNA, 18 nt, Artificial Sequence
  Description of Artificial Sequence: Synthetic oligonucleotide
agacgagagcuuuuaaau

SEQ ID NO: 70088 - RNA, 18 nt, Artificial Sequence
  Description of Artificial Sequence: Synthetic oligonucleotide
ucucuagacgagagcuuu

SEQ ID NO: 70089 - RNA, 18 nt, Artificial Sequence
  Description of Artificial Sequence: Synthetic oligonucleotide
uacuaucucuagacgaga

SEQ ID NO: 70090 - RNA, 18 nt, Artificial Sequence
  Description of Artificial Sequence: Synthetic oligonucleotide
augaguacuaucucuaga

SEQ ID NO: 70091 - RNA, 18 nt, Artificial Sequence
  Description of Artificial Sequence: Synthetic oligonucleotide
ccuccaugaguacuaucu

SEQ ID NO: 70092 - RNA, 18 nt, Artificial Sequence
  Description of Artificial Sequence: Synthetic oligonucleotide
cuaguccuccaugaguac

SEQ ID NO: 70093 - RNA, 18 nt, Artificial Sequence
  Description of Artificial Sequence: Synthetic oligonucleotide
gcaggcuaguccuccaug

SEQ ID NO: 70094 - RNA, 18 nt, Artificial Sequence
  Description of Artificial Sequence: Synthetic oligonucleotide
aauaagcaggcuaguccu

SEQ ID NO: 70095 - RNA, 18 nt, Artificial Sequence
  Description of Artificial Sequence: Synthetic oligonucleotide
agccuaauaagcaggcua

SEQ ID NO: 70096 - RNA, 18 nt, Artificial Sequence
  Description of Artificial Sequence: Synthetic oligonucleotide
augguagccuaauaagca

SEQ ID NO: 70097 - RNA, 18 nt, Artificial Sequence
  Description of Artificial Sequence: Synthetic oligonucleotide
gagcuaugguagccuaau

SEQ ID NO: 70098 - RNA, 18 nt, Artificial Sequence
  Description of Artificial Sequence: Synthetic oligonucleotide
agagagagcuaugguagc

SEQ ID NO: 70099 - RNA, 18 nt, Artificial Sequence
  Description of Artificial Sequence: Synthetic oligonucleotide
gaaauagagagagcuaug

SEQ ID NO: 70100 - RNA, 18 nt, Artificial Sequence
  Description of Artificial Sequence: Synthetic oligonucleotide
gagcugaaauagagagag

SEQ ID NO: 70101 - RNA, 18 nt, Artificial Sequence
  Description of Artificial Sequence: Synthetic oligonucleotide
gaagggagcugaaauaga

SEQ ID NO: 70102 - RNA, 18 nt, Artificial Sequence
  Description of Artificial Sequence: Synthetic oligonucleotide
gaaccucugggcacuggc

SEQ ID NO: 70103 - RNA, 18 nt, Artificial Sequence
  Description of Artificial Sequence: Synthetic oligonucleotide
agggugaaccucugggca

SEQ ID NO: 70104 - RNA, 18 nt, Artificial Sequence
  Description of Artificial Sequence: Synthetic oligonucleotide
ggcaaagggugaaccucu

SEQ ID NO: 70105 - RNA, 18 nt, Artificial Sequence
  Description of Artificial Sequence: Synthetic oligonucleotide
guguaggcaaagggugaa

SEQ ID NO: 70106 - RNA, 18 nt, Artificial Sequence
  Description of Artificial Sequence: Synthetic oligonucleotide
gacagguguaggcaaagg

SEQ ID NO: 70107 - RNA, 18 nt, Artificial Sequence
  Description of Artificial Sequence: Synthetic oligonucleotide
agcaggacagguguaggc

SEQ ID NO: 70108 - RNA, 18 nt, Artificial Sequence
  Description of Artificial Sequence: Synthetic oligonucleotide
caggcagcaggacaggug

SEQ ID NO: 70109 - RNA, 18 nt, Artificial Sequence
  Description of Artificial Sequence: Synthetic oligonucleotide
cacagcaggcagcaggac

SEQ ID NO: 70110 - RNA, 18 nt, Artificial Sequence
  Description of Artificial Sequence: Synthetic oligonucleotide
aaguccacagcaggcagc

SEQ ID NO: 70111 - RNA, 18 nt, Artificial Sequence
  Description of Artificial Sequence: Synthetic oligonucleotide
agcuaaaguccacagcag

SEQ ID NO: 70112 - RNA, 18 nt, Artificial Sequence
  Description of Artificial Sequence: Synthetic oligonucleotide
ucccaagcuaaaguccac

SEQ ID NO: 70113 - RNA, 18 nt, Artificial Sequence
  Description of Artificial Sequence: Synthetic oligonucleotide
cauucucccaagcuaaag

SEQ ID NO: 70114 - RNA, 18 nt, Artificial Sequence
  Description of Artificial Sequence: Synthetic oligonucleotide
uuuuccauucucccaagc

SEQ ID NO: 70115 - RNA, 18 nt, Artificial Sequence
  Description of Artificial Sequence: Synthetic oligonucleotide
cuggguuuuccauucucc

SEQ ID NO: 70116 - RNA, 18 nt, Artificial Sequence
  Description of Artificial Sequence: Synthetic oligonucleotide
gaaccucugggcacuggc

SEQ ID NO: 70117 - RNA, 18 nt, Artificial Sequence
  Description of Artificial Sequence: Synthetic oligonucleotide
agggugaaccucugggca

SEQ ID NO: 70118 - RNA, 18 nt, Artificial Sequence
  Description of Artificial Sequence: Synthetic oligonucleotide
ggcaaagggugaaccucu

SEQ ID NO: 70119 - RNA, 18 nt, Artificial Sequence
  Description of Artificial Sequence: Synthetic oligonucleotide
guguaggcaaagggugaa

SEQ ID NO: 70120 - RNA, 18 nt, Artificial Sequence
  Description of Artificial Sequence: Synthetic oligonucleotide
gacagguguaggcaaagg

SEQ ID NO: 70121 - RNA, 18 nt, Artificial Sequence
  Description of Artificial Sequence: Synthetic oligonucleotide
agcaggacagguguaggc

SEQ ID NO: 70122 - RNA, 18 nt, Artificial Sequence
  Description of Artificial Sequence: Synthetic oligonucleotide
caggcagcaggacaggug

SEQ ID NO: 70123 - RNA, 18 nt, Artificial Sequence
  Description of Artificial Sequence: Synthetic oligonucleotide
cacagcaggcagcaggac

SEQ ID NO: 70124 - RNA, 18 nt, Artificial Sequence
  Description of Artificial Sequence: Synthetic oligonucleotide
aaguccacagcaggcagc

SEQ ID NO: 70125 - RNA, 18 nt, Artificial Sequence
  Description of Artificial Sequence: Synthetic oligonucleotide
agcuaaaguccacagcag

SEQ ID NO: 70126 - RNA, 18 nt, Artificial Sequence
  Description of Artificial Sequence: Synthetic oligonucleotide
ucccaagcuaaaguccac

SEQ ID NO: 70127 - RNA, 18 nt, Artificial Sequence
  Description of Artificial Sequence: Synthetic oligonucleotide
cauucucccaagcuaaag

SEQ ID NO: 70128 - RNA, 18 nt, Artificial Sequence
  Description of Artificial Sequence: Synthetic oligonucleotide
uuuuccauucucccaagc

SEQ ID NO: 70129 - RNA, 18 nt, Artificial Sequence
  Description of Artificial Sequence: Synthetic oligonucleotide
cuggguuuuccauucucc

SEQ ID NO: 70130 - RNA, 18 nt, Artificial Sequence
  Description of Artificial Sequence: Synthetic oligonucleotide
aagguuagggauggcuuu

SEQ ID NO: 70131 - RNA, 18 nt, Artificial Sequence
  Description of Artificial Sequence: Synthetic oligonucleotide
aagccaagguuagggaug

SEQ ID NO: 70132 - RNA, 18 nt, Artificial Sequence
  Description of Artificial Sequence: Synthetic oligonucleotide
uagggaagccaagguuag

SEQ ID NO: 70133 - RNA, 18 nt, Artificial Sequence
  Description of Artificial Sequence: Synthetic oligonucleotide
ggacuuagggaagccaag

SEQ ID NO: 70134 - RNA, 18 nt, Artificial Sequence
  Description of Artificial Sequence: Synthetic oligonucleotide
agacaggacuuagggaag

SEQ ID NO: 70135 - RNA, 18 nt, Artificial Sequence
  Description of Artificial Sequence: Synthetic oligonucleotide
acugaagacaggacuuag

SEQ ID NO: 70136 - RNA, 18 nt, Artificial Sequence
  Description of Artificial Sequence: Synthetic oligonucleotide
gggaaacugaagacagga

SEQ ID NO: 70137 - RNA, 18 nt, Artificial Sequence
  Description of Artificial Sequence: Synthetic oligonucleotide
gcagugggaaacugaaga

SEQ ID NO: 70138 - RNA, 18 nt, Artificial Sequence
  Description of Artificial Sequence: Synthetic oligonucleotide
gggaagcagugggaaacu

SEQ ID NO: 70139 - RNA, 18 nt, Artificial Sequence
  Description of Artificial Sequence: Synthetic oligonucleotide
uccaugggaagcaguggg

SEQ ID NO: 70140 - RNA, 18 nt, Artificial Sequence
  Description of Artificial Sequence: Synthetic oligonucleotide
gagaauccaugggaagca

SEQ ID NO: 70141 - RNA, 18 nt, Artificial Sequence
  Description of Artificial Sequence: Synthetic oligonucleotide
uguuggagaauccauggg

SEQ ID NO: 70142 - RNA, 18 nt, Artificial Sequence
  Description of Artificial Sequence: Synthetic oligonucleotide
aagaauguuggagaaucc

SEQ ID NO: 70143 - RNA, 18 nt, Artificial Sequence
  Description of Artificial Sequence: Synthetic oligonucleotide
agcucaagaauguuggag

SEQ ID NO: 70144 - RNA, 18 nt, Artificial Sequence
  Description of Artificial Sequence: Synthetic oligonucleotide
uaaaaagcucaagaaugu

SEQ ID NO: 70145 - RNA, 18 nt, Artificial Sequence
  Description of Artificial Sequence: Synthetic oligonucleotide
auuuuuaaaaagcucaag

SEQ ID NO: 70146 - RNA, 18 nt, Artificial Sequence
  Description of Artificial Sequence: Synthetic oligonucleotide
gagauauuuuuaaaaagc

SEQ ID NO: 70147 - RNA, 18 nt, Artificial Sequence
  Description of Artificial Sequence: Synthetic oligonucleotide
aaggugagauauuuuuaa

SEQ ID NO: 70148 - RNA, 18 nt, Artificial Sequence
  Description of Artificial Sequence: Synthetic oligonucleotide
agcugaaggugagauauu

SEQ ID NO: 70149 - RNA, 18 nt, Artificial Sequence
  Description of Artificial Sequence: Synthetic oligonucleotide
ggccaagcugaaggugag

SEQ ID NO: 70150 - RNA, 18 nt, Artificial Sequence
  Description of Artificial Sequence: Synthetic oligonucleotide
aggguggccaagcugaag

SEQ ID NO: 70151 - RNA, 18 nt, Artificial Sequence
  Description of Artificial Sequence: Synthetic oligonucleotide
ggguuaggguggccaagc

SEQ ID NO: 70152 - RNA, 18 nt, Artificial Sequence
  Description of Artificial Sequence: Synthetic oligonucleotide
agauuggguuaggguggc

SEQ ID NO: 70153 - RNA, 18 nt, Artificial Sequence
  Description of Artificial Sequence: Synthetic oligonucleotide
aauguagauuggguuagg

SEQ ID NO: 70154 - RNA, 18 nt, Artificial Sequence
  Description of Artificial Sequence: Synthetic oligonucleotide
aggugaauguagauuggg

SEQ ID NO: 70155 - RNA, 18 nt, Artificial Sequence
  Description of Artificial Sequence: Synthetic oligonucleotide
aucauaggugaauguaga

SEQ ID NO: 70156 - RNA, 18 nt, Artificial Sequence
  Description of Artificial Sequence: Synthetic oligonucleotide
cuaucaucauaggugaau

SEQ ID NO: 70157 - RNA, 18 nt, Artificial Sequence
  Description of Artificial Sequence: Synthetic oligonucleotide
acaggcuaucaucauagg

SEQ ID NO: 70158 - RNA, 18 nt, Artificial Sequence
  Description of Artificial Sequence: Synthetic oligonucleotide
uauccacaggcuaucauc

SEQ ID NO: 70159 - RNA, 18 nt, Artificial Sequence
  Description of Artificial Sequence: Synthetic oligonucleotide
caucuuauccacaggcua

SEQ ID NO: 70160 - RNA, 18 nt, Artificial Sequence
  Description of Artificial Sequence: Synthetic oligonucleotide
gccaucaucuuauccaca

SEQ ID NO: 70161 - RNA, 18 nt, Artificial Sequence
  Description of Artificial Sequence: Synthetic oligonucleotide
ugcaagccaucaucuuau

SEQ ID NO: 70162 - RNA, 18 nt, Artificial Sequence
  Description of Artificial Sequence: Synthetic oligonucleotide
ggaccugcaagccaucau

SEQ ID NO: 70163 - RNA, 18 nt, Artificial Sequence
  Description of Artificial Sequence: Synthetic oligonucleotide
auauuggaccugcaagcc

SEQ ID NO: 70164 - RNA, 18 nt, Artificial Sequence
  Description of Artificial Sequence: Synthetic oligonucleotide
uucacauauuggaccugc

SEQ ID NO: 70165 - RNA, 18 nt, Artificial Sequence
  Description of Artificial Sequence: Synthetic oligonucleotide
aucuauucacauauugga

SEQ ID NO: 70166 - RNA, 18 nt, Artificial Sequence
  Description of Artificial Sequence: Synthetic oligonucleotide
uucaaaucuauucacaua

SEQ ID NO: 70167 - RNA, 18 nt, Artificial Sequence
  Description of Artificial Sequence: Synthetic oligonucleotide
ucagcuucaaaucuauuc

SEQ ID NO: 70168 - RNA, 18 nt, Artificial Sequence
  Description of Artificial Sequence: Synthetic oligonucleotide
gguguucagcuucaaauc

SEQ ID NO: 70169 - RNA, 18 nt, Artificial Sequence
  Description of Artificial Sequence: Synthetic oligonucleotide
uucaugguguucagcuuc

SEQ ID NO: 70170 - RNA, 18 nt, Artificial Sequence
  Description of Artificial Sequence: Synthetic oligonucleotide
agcuuuucaugguguuca

SEQ ID NO: 70171 - RNA, 18 nt, Artificial Sequence
  Description of Artificial Sequence: Synthetic oligonucleotide
ucuccagcuuuucauggu

SEQ ID NO: 70172 - RNA, 18 nt, Artificial Sequence
  Description of Artificial Sequence: Synthetic oligonucleotide
auuucucuccagcuuuuc

SEQ ID NO: 70173 - RNA, 18 nt, Artificial Sequence
  Description of Artificial Sequence: Synthetic oligonucleotide
gagcgauuucucuccagc

SEQ ID NO: 70174 - RNA, 18 nt, Artificial Sequence
  Description of Artificial Sequence: Synthetic oligonucleotide
gccaugagcgauuucucu

SEQ ID NO: 70175 - RNA, 18 nt, Artificial Sequence
  Description of Artificial Sequence: Synthetic oligonucleotide
gcauggccaugagcgauu

SEQ ID NO: 70176 - RNA, 18 nt, Artificial Sequence
  Description of Artificial Sequence: Synthetic oligonucleotide
caaaggcauggccaugag

SEQ ID NO: 70177 - RNA, 18 nt, Artificial Sequence
  Description of Artificial Sequence: Synthetic oligonucleotide
uaggucaaaggcauggcc

SEQ ID NO: 70178 - RNA, 18 nt, Artificial Sequence
  Description of Artificial Sequence: Synthetic oligonucleotide
gggaauaggucaaaggca

SEQ ID NO: 70179 - RNA, 18 nt, Artificial Sequence
  Description of Artificial Sequence: Synthetic oligonucleotide
ugaacgggaauaggucaa

SEQ ID NO: 70180 - RNA, 18 nt, Artificial Sequence
  Description of Artificial Sequence: Synthetic oligonucleotide
aagacugaacgggaauag

SEQ ID NO: 70181 - RNA, 18 nt, Artificial Sequence
  Description of Artificial Sequence: Synthetic oligonucleotide
uuaagaagacugaacggg

SEQ ID NO: 70182 - RNA, 18 nt, Artificial Sequence
  Description of Artificial Sequence: Synthetic oligonucleotide
ccaauuuaagaagacuga

SEQ ID NO: 70183 - RNA, 18 nt, Artificial Sequence
  Description of Artificial Sequence: Synthetic oligonucleotide
ucaugccaauuuaagaag

SEQ ID NO: 70184 - RNA, 18 nt, Artificial Sequence
  Description of Artificial Sequence: Synthetic oligonucleotide
cuucuucaugccaauuua

SEQ ID NO: 70185 - RNA, 18 nt, Artificial Sequence
  Description of Artificial Sequence: Synthetic oligonucleotide
ucuugcuucuucaugcca

SEQ ID NO: 70186 - RNA, 18 nt, Artificial Sequence
  Description of Artificial Sequence: Synthetic oligonucleotide
augagucuugcuucuuca

SEQ ID NO: 70187 - RNA, 18 nt, Artificial Sequence
  Description of Artificial Sequence: Synthetic oligonucleotide
gacauaugagucuugcuu

SEQ ID NO: 70188 - RNA, 18 nt, Artificial Sequence
  Description of Artificial Sequence: Synthetic oligonucleotide
uggaugacauaugagucu

SEQ ID NO: 70189 - RNA, 18 nt, Artificial Sequence
  Description of Artificial Sequence: Synthetic oligonucleotide
aucuguggaugacauaug

SEQ ID NO: 70190 - RNA, 18 nt, Artificial Sequence
  Description of Artificial Sequence: Synthetic oligonucleotide
gugucaucuguggaugac

SEQ ID NO: 70191 - RNA, 18 nt, Artificial Sequence
  Description of Artificial Sequence: Synthetic oligonucleotide
gcuuugugucaucugugg

SEQ ID NO: 70192 - RNA, 18 nt, Artificial Sequence
  Description of Artificial Sequence: Synthetic oligonucleotide
ucccagcuuugugucauc

SEQ ID NO: 70193 - RNA, 18 nt, Artificial Sequence
  Description of Artificial Sequence: Synthetic oligonucleotide
guacuucccagcuuugug

SEQ ID NO: 70194 - RNA, 18 nt, Artificial Sequence
  Description of Artificial Sequence: Synthetic oligonucleotide
uagugguacuucccagcu

SEQ ID NO: 70195 - RNA, 18 nt, Artificial Sequence
  Description of Artificial Sequence: Synthetic oligonucleotide
uauuuuagugguacuucc

SEQ ID NO: 70196 - RNA, 18 nt, Artificial Sequence
  Description of Artificial Sequence: Synthetic oligonucleotide
uuuguuauuuuaguggua

SEQ ID NO: 70197 - RNA, 18 nt, Artificial Sequence
  Description of Artificial Sequence: Synthetic oligonucleotide
agucuuuuguuauuuuag

SEQ ID NO: 70198 - RNA, 18 nt, Artificial Sequence
  Description of Artificial Sequence: Synthetic oligonucleotide
gauucagucuuuuguuau

SEQ ID NO: 70199 - RNA, 18 nt, Artificial Sequence
  Description of Artificial Sequence: Synthetic oligonucleotide
aucuugauucagucuuuu

SEQ ID NO: 70200 - RNA, 18 nt, Artificial Sequence
  Description of Artificial Sequence: Synthetic oligonucleotide
uuugaaucuugauucagu

SEQ ID NO: 70201 - RNA, 18 nt, Artificial Sequence
  Description of Artificial Sequence: Synthetic oligonucleotide
agugauuugaaucuugau

SEQ ID NO: 70202 - RNA, 18 nt, Artificial Sequence
  Description of Artificial Sequence: Synthetic oligonucleotide
cuuucagugauuugaauc

SEQ ID NO: 70203 - RNA, 18 nt, Artificial Sequence
  Description of Artificial Sequence: Synthetic oligonucleotide
cuagucuuucagugauuu

SEQ ID NO: 70204 - RNA, 18 nt, Artificial Sequence
  Description of Artificial Sequence: Synthetic oligonucleotide
uugaccuagucuuucagu

SEQ ID NO: 70205 - RNA, 18 nt, Artificial Sequence
  Description of Artificial Sequence: Synthetic oligonucleotide
uguuuuugaccuagucuu

SEQ ID NO: 70206 - RNA, 18 nt, Artificial Sequence
  Description of Artificial Sequence: Synthetic oligonucleotide
caccuuguuuuugaccua

SEQ ID NO: 70207 - RNA, 18 nt, Artificial Sequence
  Description of Artificial Sequence: Synthetic oligonucleotide
uguuucaccuuguuuuug

SEQ ID NO: 70208 - RNA, 18 nt, Artificial Sequence
  Description of Artificial Sequence: Synthetic oligonucleotide
ucuguuguuucaccuugu

SEQ ID NO: 70209 - RNA, 18 nt, Artificial Sequence
  Description of Artificial Sequence: Synthetic oligonucleotide
auaucucuguuguuucac

SEQ ID NO: 70210 - RNA, 18 nt, Artificial Sequence
  Description of Artificial Sequence: Synthetic oligonucleotide
aguuuauaucucuguugu

SEQ ID NO: 70211 - RNA, 18 nt, Artificial Sequence
  Description of Artificial Sequence: Synthetic oligonucleotide
guagaaguuuauaucucu

SEQ ID NO: 70212 - RNA, 18 nt, Artificial Sequence
  Description of Artificial Sequence: Synthetic oligonucleotide
cacauguagaaguuuaua

SEQ ID NO: 70213 - RNA, 18 nt, Artificial Sequence
  Description of Artificial Sequence: Synthetic oligonucleotide
cggcccacauguagaagu

SEQ ID NO: 70214 - RNA, 18 nt, Artificial Sequence
  Description of Artificial Sequence: Synthetic oligonucleotide
gcccccggcccacaugua

SEQ ID NO: 70215 - RNA, 18 nt, Artificial Sequence
  Description of Artificial Sequence: Synthetic oligonucleotide
cgugagcccccggcccac

SEQ ID NO: 70216 - RNA, 18 nt, Artificial Sequence
  Description of Artificial Sequence: Synthetic oligonucleotide
acaggcgugagcccccgg

SEQ ID NO: 70217 - RNA, 18 nt, Artificial Sequence
  Description of Artificial Sequence: Synthetic oligonucleotide
ggauuacaggcgugagcc

SEQ ID NO: 70218 - RNA, 18 nt, Artificial Sequence
  Description of Artificial Sequence: Synthetic oligonucleotide
ugcugggauuacaggcgu

SEQ ID NO: 70219 - RNA, 18 nt, Artificial Sequence
  Description of Artificial Sequence: Synthetic oligonucleotide
caaagugcugggauuaca

SEQ ID NO: 70220 - RNA, 18 nt, Artificial Sequence
  Description of Artificial Sequence: Synthetic oligonucleotide
ccucccaaagugcuggga

SEQ ID NO: 70221 - RNA, 18 nt, Artificial Sequence
  Description of Artificial Sequence: Synthetic oligonucleotide
cucggccucccaaagugc

SEQ ID NO: 70222 - RNA, 18 nt, Artificial Sequence
  Description of Artificial Sequence: Synthetic oligonucleotide
ccugccucggccucccaa

SEQ ID NO: 70223 - RNA, 18 nt, Artificial Sequence
  Description of Artificial Sequence: Synthetic oligonucleotide
aucugccugccucggccu

SEQ ID NO: 70224 - RNA, 18 nt, Artificial Sequence
  Description of Artificial Sequence: Synthetic oligonucleotide
aggugaucugccugccuc

SEQ ID NO: 70225 - RNA, 18 nt, Artificial Sequence
  Description of Artificial Sequence: Synthetic oligonucleotide
cccucaggugaucugccu

SEQ ID NO: 70226 - RNA, 18 nt, Artificial Sequence
  Description of Artificial Sequence: Synthetic oligonucleotide
uccugcccucaggugauc

SEQ ID NO: 70227 - RNA, 18 nt, Artificial Sequence
  Description of Artificial Sequence: Synthetic oligonucleotide
caaacuccugcccucagg

SEQ ID NO: 70228 - RNA, 18 nt, Artificial Sequence
  Description of Artificial Sequence: Synthetic oligonucleotide
gcucucaaacuccugccc

SEQ ID NO: 70229 - RNA, 18 nt, Artificial Sequence
  Description of Artificial Sequence: Synthetic oligonucleotide
gcugggcauggugguggg

SEQ ID NO: 70230 - RNA, 18 nt, Artificial Sequence
  Description of Artificial Sequence: Synthetic oligonucleotide
aauuagcugggcauggug

SEQ ID NO: 70231 - RNA, 18 nt, Artificial Sequence
  Description of Artificial Sequence: Synthetic oligonucleotide
acaaaaauuagcugggca

SEQ ID NO: 70232 - RNA, 18 nt, Artificial Sequence
  Description of Artificial Sequence: Synthetic oligonucleotide
aaaauacaaaaauuagcu

SEQ ID NO: 70233 - RNA, 18 nt, Artificial Sequence
  Description of Artificial Sequence: Synthetic oligonucleotide
uaccaaaaauacaaaaau

SEQ ID NO: 70234 - RNA, 18 nt, Artificial Sequence
  Description of Artificial Sequence: Synthetic oligonucleotide
aucucuaccaaaaauaca

SEQ ID NO: 70235 - RNA, 18 nt, Artificial Sequence
  Description of Artificial Sequence: Synthetic oligonucleotide
accccaucucuaccaaaa

SEQ ID NO: 70236 - RNA, 18 nt, Artificial Sequence
  Description of Artificial Sequence: Synthetic oligonucleotide
gugaaaccccaucucuac

SEQ ID NO: 70237 - RNA, 18 nt, Artificial Sequence
  Description of Artificial Sequence: Synthetic oligonucleotide
acauggugaaaccccauc

SEQ ID NO: 70238 - RNA, 18 nt, Artificial Sequence
  Description of Artificial Sequence: Synthetic oligonucleotide
ggccaacauggugaaacc

SEQ ID NO: 70239 - RNA, 18 nt, Artificial Sequence
  Description of Artificial Sequence: Synthetic oligonucleotide
agccuggccaacauggug

SEQ ID NO: 70240 - RNA, 18 nt, Artificial Sequence
  Description of Artificial Sequence: Synthetic oligonucleotide
agaucagccuggccaaca

SEQ ID NO: 70241 - RNA, 18 nt, Artificial Sequence
  Description of Artificial Sequence: Synthetic oligonucleotide
guucaagaucagccuggc

SEQ ID NO: 70242 - RNA, 18 nt, Artificial Sequence
  Description of Artificial Sequence: Synthetic oligonucleotide
caggaguucaagaucagc

SEQ ID NO: 70243 - RNA, 18 nt, Artificial Sequence
  Description of Artificial Sequence: Synthetic oligonucleotide
gaggucaggaguucaaga

SEQ ID NO: 70244 - RNA, 18 nt, Artificial Sequence
  Description of Artificial Sequence: Synthetic oligonucleotide
caccugaggucaggaguu

SEQ ID NO: 70245 - RNA, 18 nt, Artificial Sequence
  Description of Artificial Sequence: Synthetic oligonucleotide
uggaucaccugaggucag

SEQ ID NO: 70246 - RNA, 18 nt, Artificial Sequence
  Description of Artificial Sequence: Synthetic oligonucleotide
gcagguggaucaccugag

SEQ ID NO: 70247 - RNA, 18 nt, Artificial Sequence
  Description of Artificial Sequence: Synthetic oligonucleotide
cugaggcagguggaucac

SEQ ID NO: 70248 - RNA, 18 nt, Artificial Sequence
  Description of Artificial Sequence: Synthetic oligonucleotide
ggaggcugaggcaggugg

SEQ ID NO: 70249 - RNA, 18 nt, Artificial Sequence
  Description of Artificial Sequence: Synthetic oligonucleotide
cuuugggaggcugaggca

SEQ ID NO: 70250 - RNA, 18 nt, Artificial Sequence
  Description of Artificial Sequence: Synthetic oligonucleotide
cagcacuuugggaggcug

SEQ ID NO: 70251 - RNA, 18 nt, Artificial Sequence
  Description of Artificial Sequence: Synthetic oligonucleotide
aaucccagcacuuuggga

SEQ ID NO: 70252 - RNA, 18 nt, Artificial Sequence
  Description of Artificial Sequence: Synthetic oligonucleotide
ccuguaaucccagcacuu

SEQ ID NO: 70253 - RNA, 18 nt, Artificial Sequence
  Description of Artificial Sequence: Synthetic oligonucleotide
ucacgccuguaaucccag

SEQ ID NO: 70254 - RNA, 18 nt, Artificial Sequence
  Description of Artificial Sequence: Synthetic oligonucleotide
guggcucacgccuguaau

SEQ ID NO: 70255 - RNA, 18 nt, Artificial Sequence
  Description of Artificial Sequence: Synthetic oligonucleotide
gugcaguggcucacgccu

SEQ ID NO: 70256 - RNA, 18 nt, Artificial Sequence
  Description of Artificial Sequence: Synthetic oligonucleotide
gcugggugcaguggcuca

SEQ ID NO: 70257 - RNA, 18 nt, Artificial Sequence
  Description of Artificial Sequence: Synthetic oligonucleotide
ugaaggcugggugcagug

SEQ ID NO: 70258 - RNA, 18 nt, Artificial Sequence
  Description of Artificial Sequence: Synthetic oligonucleotide
cugaaugaaggcugggug

SEQ ID NO: 70259 - RNA, 18 nt, Artificial Sequence
  Description of Artificial Sequence: Synthetic oligonucleotide
uuaaacugaaugaaggcu

SEQ ID NO: 70260 - RNA, 18 nt, Artificial Sequence
  Description of Artificial Sequence: Synthetic oligonucleotide
gauuuuuaaacugaauga

SEQ ID NO: 70261 - RNA, 18 nt, Artificial Sequence
  Description of Artificial Sequence: Synthetic oligonucleotide
cauuugauuuuuaaacug

SEQ ID NO: 70262 - RNA, 18 nt, Artificial Sequence
  Description of Artificial Sequence: Synthetic oligonucleotide
aggaucauuugauuuuua

SEQ ID NO: 70263 - RNA, 18 nt, Artificial Sequence
  Description of Artificial Sequence: Synthetic oligonucleotide
accuuaggaucauuugau

SEQ ID NO: 70264 - RNA, 18 nt, Artificial Sequence
  Description of Artificial Sequence: Synthetic oligonucleotide
gcaaaaccuuaggaucau

SEQ ID NO: 70265 - RNA, 18 nt, Artificial Sequence
  Description of Artificial Sequence: Synthetic oligonucleotide
cugcugcaaaaccuuagg

SEQ ID NO: 70266 - RNA, 18 nt, Artificial Sequence
  Description of Artificial Sequence: Synthetic oligonucleotide
ucuuucugcugcaaaacc

SEQ ID NO: 70267 - RNA, 18 nt, Artificial Sequence
  Description of Artificial Sequence: Synthetic oligonucleotide
uuuacucuuucugcugca

SEQ ID NO: 70268 - RNA, 18 nt, Artificial Sequence
  Description of Artificial Sequence: Synthetic oligonucleotide
gcaaauuuacucuuucug

SEQ ID NO: 70269 - RNA, 18 nt, Artificial Sequence
  Description of Artificial Sequence: Synthetic oligonucleotide
gugcugcaaauuuacucu

SEQ ID NO: 70270 - RNA, 18 nt, Artificial Sequence
  Description of Artificial Sequence: Synthetic oligonucleotide
uucuagugcugcaaauuu

SEQ ID NO: 70271 - RNA, 18 nt, Artificial Sequence
  Description of Artificial Sequence: Synthetic oligonucleotide
cuugguucuagugcugca

SEQ ID NO: 70272 - RNA, 18 nt, Artificial Sequence
  Description of Artificial Sequence: Synthetic oligonucleotide
uaccucuugguucuagug

SEQ ID NO: 70273 - RNA, 18 nt, Artificial Sequence
  Description of Artificial Sequence: Synthetic oligonucleotide
gcuuuuaccucuugguuc

SEQ ID NO: 70274 - RNA, 18 nt, Artificial Sequence
  Description of Artificial Sequence: Synthetic oligonucleotide
uuacagcuuuuaccucuu

SEQ ID NO: 70275 - RNA, 18 nt, Artificial Sequence
  Description of Artificial Sequence: Synthetic oligonucleotide
cccuguuacagcuuuuac

SEQ ID NO: 70276 - RNA, 18 nt, Artificial Sequence
  Description of Artificial Sequence: Synthetic oligonucleotide
aucugcccuguuacagcu

SEQ ID NO: 70277 - RNA, 18 nt, Artificial Sequence
  Description of Artificial Sequence: Synthetic oligonucleotide
cugaaaucugcccuguua

SEQ ID NO: 70278 - RNA, 18 nt, Artificial Sequence
  Description of Artificial Sequence: Synthetic oligonucleotide
cguugcugaaaucugccc

SEQ ID NO: 70279 - RNA, 18 nt, Artificial Sequence
  Description of Artificial Sequence: Synthetic oligonucleotide
ucuuacguugcugaaauc

SEQ ID NO: 70280 - RNA, 18 nt, Artificial Sequence
  Description of Artificial Sequence: Synthetic oligonucleotide
uuuuuucuuacguugcug

SEQ ID NO: 70281 - RNA, 18 nt, Artificial Sequence
  Description of Artificial Sequence: Synthetic oligonucleotide
gcuccuuuuuucuuacgu

SEQ ID NO: 70282 - RNA, 18 nt, Artificial Sequence
  Description of Artificial Sequence: Synthetic oligonucleotide
gaagagcuccuuuuuucu

SEQ ID NO: 70283 - RNA, 18 nt, Artificial Sequence
  Description of Artificial Sequence: Synthetic oligonucleotide
agugagaagagcuccuuu

SEQ ID NO: 70284 - RNA, 18 nt, Artificial Sequence
  Description of Artificial Sequence: Synthetic oligonucleotide
guuucagugagaagagcu

SEQ ID NO: 70285 - RNA, 18 nt, Artificial Sequence
  Description of Artificial Sequence: Synthetic oligonucleotide
acuugguuucagugagaa

SEQ ID NO: 70286 - RNA, 18 nt, Artificial Sequence
  Description of Artificial Sequence: Synthetic oligonucleotide
cuuacacuugguuucagu

SEQ ID NO: 70287 - RNA, 18 nt, Artificial Sequence
  Description of Artificial Sequence: Synthetic oligonucleotide
cuggucuuacacuugguu

SEQ ID NO: 70288 - RNA, 18 nt, Artificial Sequence
  Description of Artificial Sequence: Synthetic oligonucleotide
ccagccuggucuuacacu

SEQ ID NO: 70289 - RNA, 18 nt, Artificial Sequence
  Description of Artificial Sequence: Synthetic oligonucleotide
cuaguccagccuggucuu

SEQ ID NO: 70290 - RNA, 18 nt, Artificial Sequence
  Description of Artificial Sequence: Synthetic oligonucleotide
guccucuaguccagccug

SEQ ID NO: 70291 - RNA, 18 nt, Artificial Sequence
  Description of Artificial Sequence: Synthetic oligonucleotide
cccguguccucuagucca

SEQ ID NO: 70292 - RNA, 18 nt, Artificial Sequence
  Description of Artificial Sequence: Synthetic oligonucleotide
aaacucccguguccucua

SEQ ID NO: 70293 - RNA, 18 nt, Artificial Sequence
  Description of Artificial Sequence: Synthetic oligonucleotide
uucaaaaacucccguguc

SEQ ID NO: 70294 - RNA, 18 nt, Artificial Sequence
  Description of Artificial Sequence: Synthetic oligonucleotide
ucugcuucaaaaacuccc

SEQ ID NO: 70295 - RNA, 18 nt, Artificial Sequence
  Description of Artificial Sequence: Synthetic oligonucleotide
cagccucugcuucaaaaa

SEQ ID NO: 70296 - RNA, 18 nt, Artificial Sequence
  Description of Artificial Sequence: Synthetic oligonucleotide
gucaucagccucugcuuc

SEQ ID NO: 70297 - RNA, 18 nt, Artificial Sequence
  Description of Artificial Sequence: Synthetic oligonucleotide
agcuggucaucagccucu

SEQ ID NO: 70298 - RNA, 18 nt, Artificial Sequence
  Description of Artificial Sequence: Synthetic oligonucleotide
ccgacagcuggucaucag

SEQ ID NO: 70299 - RNA, 18 nt, Artificial Sequence
  Description of Artificial Sequence: Synthetic oligonucleotide
gucucccgacagcugguc

SEQ ID NO: 70300 - RNA, 18 nt, Artificial Sequence
  Description of Artificial Sequence: Synthetic oligonucleotide
ucacagucucccgacagc

SEQ ID NO: 70301 - RNA, 18 nt, Artificial Sequence
  Description of Artificial Sequence: Synthetic oligonucleotide
uuccuucacagucucccg

SEQ ID NO: 70302 - RNA, 18 nt, Artificial Sequence
  Description of Artificial Sequence: Synthetic oligonucleotide
aggaauuccuucacaguc

SEQ ID NO: 70303 - RNA, 18 nt, Artificial Sequence
  Description of Artificial Sequence: Synthetic oligonucleotide
agggcaggaauuccuuca

SEQ ID NO: 70304 - RNA, 18 nt, Artificial Sequence
  Description of Artificial Sequence: Synthetic oligonucleotide
cacccagggcaggaauuc

SEQ ID NO: 70305 - RNA, 18 nt, Artificial Sequence
  Description of Artificial Sequence: Synthetic oligonucleotide
ggucccacccagggcagg

SEQ ID NO: 70306 - RNA, 18 nt, Artificial Sequence
  Description of Artificial Sequence: Synthetic oligonucleotide
accaaggucccacccagg

SEQ ID NO: 70307 - RNA, 18 nt, Artificial Sequence
  Description of Artificial Sequence: Synthetic oligonucleotide
acaggaccaaggucccac

SEQ ID NO: 70308 - RNA, 18 nt, Artificial Sequence
  Description of Artificial Sequence: Synthetic oligonucleotide
acuggacaggaccaaggu

SEQ ID NO: 70309 - RNA, 18 nt, Artificial Sequence
  Description of Artificial Sequence: Synthetic oligonucleotide
ugagaacuggacaggacc

SEQ ID NO: 70310 - RNA, 18 nt, Artificial Sequence
  Description of Artificial Sequence: Synthetic oligonucleotide
caggcugagaacuggaca

SEQ ID NO: 70311 - RNA, 18 nt, Artificial Sequence
  Description of Artificial Sequence: Synthetic oligonucleotide
ucauacaggcugagaacu

SEQ ID NO: 70312 - RNA, 18 nt, Artificial Sequence
  Description of Artificial Sequence: Synthetic oligonucleotide
gugaaucauacaggcuga

SEQ ID NO: 70313 - RNA, 18 nt, Artificial Sequence
  Description of Artificial Sequence: Synthetic oligonucleotide
gcagagugaaucauacag

SEQ ID NO: 70314 - RNA, 18 nt, Artificial Sequence
  Description of Artificial Sequence: Synthetic oligonucleotide
agccagcagagugaauca

SEQ ID NO: 70315 - RNA, 18 nt, Artificial Sequence
  Description of Artificial Sequence: Synthetic oligonucleotide
ggaguagccagcagagug

SEQ ID NO: 70316 - RNA, 18 nt, Artificial Sequence
  Description of Artificial Sequence: Synthetic oligonucleotide
ccuuaggaguagccagca

SEQ ID NO: 70317 - RNA, 18 nt, Artificial Sequence
  Description of Artificial Sequence: Synthetic oligonucleotide
gggagccuuaggaguagc

SEQ ID NO: 70318 - RNA, 18 nt, Artificial Sequence
  Description of Artificial Sequence: Synthetic oligonucleotide
acacuaaaagcggguggg

SEQ ID NO: 70319 - RNA, 18 nt, Artificial Sequence
  Description of Artificial Sequence: Synthetic oligonucleotide
ggcacacuaaaagcgggu

SEQ ID NO: 70320 - RNA, 18 nt, Artificial Sequence
  Description of Artificial Sequence: Synthetic oligonucleotide
caaagggcacacuaaaag

SEQ ID NO: 70321 - RNA, 18 nt, Artificial Sequence
  Description of Artificial Sequence: Synthetic oligonucleotide
ugccucaaagggcacacu

SEQ ID NO: 70322 - RNA, 18 nt, Artificial Sequence
  Description of Artificial Sequence: Synthetic oligonucleotide
cgcacugccucaaagggc

SEQ ID NO: 70323 - RNA, 18 nt, Artificial Sequence
  Description of Artificial Sequence: Synthetic oligonucleotide
agaagcgcacugccucaa

SEQ ID NO: 70324 - RNA, 18 nt, Artificial Sequence
  Description of Artificial Sequence: Synthetic oligonucleotide
aagagagaagcgcacugc

SEQ ID NO: 70325 - RNA, 18 nt, Artificial Sequence
  Description of Artificial Sequence: Synthetic oligonucleotide
ccugugccuuggucuccu

SEQ ID NO: 70326 - RNA, 18 nt, Artificial Sequence
  Description of Artificial Sequence: Synthetic oligonucleotide
aauguccugugccuuggu

SEQ ID NO: 70327 - RNA, 18 nt, Artificial Sequence
  Description of Artificial Sequence: Synthetic oligonucleotide
cccagaauguccugugcc

SEQ ID NO: 70328 - RNA, 18 nt, Artificial Sequence
  Description of Artificial Sequence: Synthetic oligonucleotide
cugcucccagaauguccu

SEQ ID NO: 70329 - RNA, 18 nt, Artificial Sequence
  Description of Artificial Sequence: Synthetic oligonucleotide
ggucacugcucccagaau

SEQ ID NO: 70330 - RNA, 18 nt, Artificial Sequence
  Description of Artificial Sequence: Synthetic oligonucleotide
agaagggucacugcuccc

SEQ ID NO: 70331 - RNA, 18 nt, Artificial Sequence
  Description of Artificial Sequence: Synthetic oligonucleotide
ccagcagaagggucacug

SEQ ID NO: 70332 - RNA, 18 nt, Artificial Sequence
  Description of Artificial Sequence: Synthetic oligonucleotide
ucccuccagcagaagggu

SEQ ID NO: 70333 - RNA, 18 nt, Artificial Sequence
  Description of Artificial Sequence: Synthetic oligonucleotide
aucacucccuccagcaga

SEQ ID NO: 70334 - RNA, 18 nt, Artificial Sequence
  Description of Artificial Sequence: Synthetic oligonucleotide
cugccaucacucccucca

SEQ ID NO: 70335 - RNA, 18 nt, Artificial Sequence
  Description of Artificial Sequence: Synthetic oligonucleotide
ccgugcugccaucacucc

SEQ ID NO: 70336 - RNA, 18 nt, Artificial Sequence
  Description of Artificial Sequence: Synthetic oligonucleotide
uguccccgugcugccauc

SEQ ID NO: 70337 - RNA, 18 nt, Artificial Sequence
  Description of Artificial Sequence: Synthetic oligonucleotide
ccaguuguccccgugcug

SEQ ID NO: 70338 - RNA, 18 nt, Artificial Sequence
  Description of Artificial Sequence: Synthetic oligonucleotide
gggucccaguuguccccg

SEQ ID NO: 70339 - RNA, 18 nt, Artificial Sequence
  Description of Artificial Sequence: Synthetic oligonucleotide
caagugggucccaguugu

SEQ ID NO: 70340 - RNA, 18 nt, Artificial Sequence
  Description of Artificial Sequence: Synthetic oligonucleotide
agaggcaaguggguccca

SEQ ID NO: 70341 - RNA, 18 nt, Artificial Sequence
  Description of Artificial Sequence: Synthetic oligonucleotide
ggaugagaggcaaguggg

SEQ ID NO: 70342 - RNA, 18 nt, Artificial Sequence
  Description of Artificial Sequence: Synthetic oligonucleotide
aggagggaugagaggcaa

SEQ ID NO: 70343 - RNA, 18 nt, Artificial Sequence
  Description of Artificial Sequence: Synthetic oligonucleotide
gccccaggagggaugaga

SEQ ID NO: 70344 - RNA, 18 nt, Artificial Sequence
  Description of Artificial Sequence: Synthetic oligonucleotide
aagcugccccaggaggga

SEQ ID NO: 70345 - RNA, 18 nt, Artificial Sequence
  Description of Artificial Sequence: Synthetic oligonucleotide
ccagaaagcugccccagg

SEQ ID NO: 70346 - RNA, 18 nt, Artificial Sequence
  Description of Artificial Sequence: Synthetic oligonucleotide
ccuguccagaaagcugcc

SEQ ID NO: 70347 - RNA, 18 nt, Artificial Sequence
  Description of Artificial Sequence: Synthetic oligonucleotide
acggaccuguccagaaag

SEQ ID NO: 70348 - RNA, 18 nt, Artificial Sequence
  Description of Artificial Sequence: Synthetic oligonucleotide
aggagacggaccugucca

SEQ ID NO: 70349 - RNA, 18 nt, Artificial Sequence
  Description of Artificial Sequence: Synthetic oligonucleotide
caaggaggagacggaccu

SEQ ID NO: 70350 - RNA, 18 nt, Artificial Sequence
  Description of Artificial Sequence: Synthetic oligonucleotide
ggccccaaggaggagacg

SEQ ID NO: 70351 - RNA, 18 nt, Artificial Sequence
  Description of Artificial Sequence: Synthetic oligonucleotide
ugcagggccccaaggagg

SEQ ID NO: 70352 - RNA, 18 nt, Artificial Sequence
  Description of Artificial Sequence: Synthetic oligonucleotide
ggcucugcagggccccaa

SEQ ID NO: 70353 - RNA, 18 nt, Artificial Sequence
  Description of Artificial Sequence: Synthetic oligonucleotide
aaggaggcucugcagggc

SEQ ID NO: 70354 - RNA, 18 nt, Artificial Sequence
  Description of Artificial Sequence: Synthetic oligonucleotide
guuccaaggaggcucugc

SEQ ID NO: 70355 - RNA, 18 nt, Artificial Sequence
  Description of Artificial Sequence: Synthetic oligonucleotide
uccugugccuuggucucc

SEQ ID NO: 70356 - RNA, 18 nt, Artificial Sequence
  Description of Artificial Sequence: Synthetic oligonucleotide
gaauguccugugccuugg

SEQ ID NO: 70357 - RNA, 18 nt, Artificial Sequence
  Description of Artificial Sequence: Synthetic oligonucleotide
ucccagaauguccugugc

SEQ ID NO: 70358 - RNA, 18 nt, Artificial Sequence
  Description of Artificial Sequence: Synthetic oligonucleotide
acugcucccagaaugucc

SEQ ID NO: 70359 - RNA, 18 nt, Artificial Sequence
  Description of Artificial Sequence: Synthetic oligonucleotide
gggucacugcucccagaa

SEQ ID NO: 70360 - RNA, 18 nt, Artificial Sequence
  Description of Artificial Sequence: Synthetic oligonucleotide
cagaagggucacugcucc

SEQ ID NO: 70361 - RNA, 18 nt, Artificial Sequence
  Description of Artificial Sequence: Synthetic oligonucleotide
uccagcagaagggucacu

SEQ ID NO: 70362 - RNA, 18 nt, Artificial Sequence
  Description of Artificial Sequence: Synthetic oligonucleotide
cucccuccagcagaaggg

SEQ ID NO: 70363 - RNA, 18 nt, Artificial Sequence
  Description of Artificial Sequence: Synthetic oligonucleotide
caucacucccuccagcag

SEQ ID NO: 70364 - RNA, 18 nt, Artificial Sequence
  Description of Artificial Sequence: Synthetic oligonucleotide
gcugccaucacucccucc

SEQ ID NO: 70365 - RNA, 18 nt, Artificial Sequence
  Description of Artificial Sequence: Synthetic oligonucleotide
cccgugcugccaucacuc

SEQ ID NO: 70366 - RNA, 18 nt, Artificial Sequence
  Description of Artificial Sequence: Synthetic oligonucleotide
uuguccccgugcugccau

SEQ ID NO: 70367 - RNA, 18 nt, Artificial Sequence
  Description of Artificial Sequence: Synthetic oligonucleotide
cccaguuguccccgugcu

SEQ ID NO: 70368 - RNA, 18 nt, Artificial Sequence
  Description of Artificial Sequence: Synthetic oligonucleotide
ugggucccaguugucccc

SEQ ID NO: 70369 - RNA, 18 nt, Artificial Sequence
  Description of Artificial Sequence: Synthetic oligonucleotide
gcaagugggucccaguug

SEQ ID NO: 70370 - RNA, 18 nt, Artificial Sequence
  Description of Artificial Sequence: Synthetic oligonucleotide
gagaggcaaguggguccc

SEQ ID NO: 70371 - RNA, 18 nt, Artificial Sequence
  Description of Artificial Sequence: Synthetic oligonucleotide
gggaugagaggcaagugg

SEQ ID NO: 70372 - RNA, 18 nt, Artificial Sequence
  Description of Artificial Sequence: Synthetic oligonucleotide
caggagggaugagaggca

SEQ ID NO: 70373 - RNA, 18 nt, Artificial Sequence
  Description of Artificial Sequence: Synthetic oligonucleotide
ugccccaggagggaugag

SEQ ID NO: 70374 - RNA, 18 nt, Artificial Sequence
  Description of Artificial Sequence: Synthetic oligonucleotide
aaagcugccccaggaggg

SEQ ID NO: 70375 - RNA, 18 nt, Artificial Sequence
  Description of Artificial Sequence: Synthetic oligonucleotide
uccagaaagcugccccag

SEQ ID NO: 70376 - RNA, 18 nt, Artificial Sequence
  Description of Artificial Sequence: Synthetic oligonucleotide
accuguccagaaagcugc

SEQ ID NO: 70377 - RNA, 18 nt, Artificial Sequence
  Description of Artificial Sequence: Synthetic oligonucleotide
gacggaccuguccagaaa

SEQ ID NO: 70378 - RNA, 18 nt, Artificial Sequence
  Description of Artificial Sequence: Synthetic oligonucleotide
gaggagacggaccugucc

SEQ ID NO: 70379 - RNA, 18 nt, Artificial Sequence
  Description of Artificial Sequence: Synthetic oligonucleotide
ccaaggaggagacggacc

SEQ ID NO: 70380 - RNA, 18 nt, Artificial Sequence
  Description of Artificial Sequence: Synthetic oligonucleotide
gggccccaaggaggagac

SEQ ID NO: 70381 - RNA, 18 nt, Artificial Sequence
  Description of Artificial Sequence: Synthetic oligonucleotide
cugcagggccccaaggag

SEQ ID NO: 70382 - RNA, 18 nt, Artificial Sequence
  Description of Artificial Sequence: Synthetic oligonucleotide
aggcucugcagggcccca

SEQ ID NO: 70383 - RNA, 18 nt, Artificial Sequence
  Description of Artificial Sequence: Synthetic oligonucleotide
caaggaggcucugcaggg

SEQ ID NO: 70384 - RNA, 18 nt, Artificial Sequence
  Description of Artificial Sequence: Synthetic oligonucleotide
gguuccaaggaggcucug

SEQ ID NO: 70385 - RNA, 18 nt, Artificial Sequence
  Description of Artificial Sequence: Synthetic oligonucleotide
ucuacagaucccuugacu

SEQ ID NO: 70386 - RNA, 18 nt, Artificial Sequence
  Description of Artificial Sequence: Synthetic oligonucleotide
caguuucuacagaucccu

SEQ ID NO: 70387 - RNA, 18 nt, Artificial Sequence
  Description of Artificial Sequence: Synthetic oligonucleotide
aagaacaguuucuacaga

SEQ ID NO: 70388 - RNA, 18 nt, Artificial Sequence
  Description of Artificial Sequence: Synthetic oligonucleotide
cagaaaagaacaguuucu

SEQ ID NO: 70389 - RNA, 18 nt, Artificial Sequence
  Description of Artificial Sequence: Synthetic oligonucleotide
ugagucagaaaagaacag

SEQ ID NO: 70390 - RNA, 18 nt, Artificial Sequence
  Description of Artificial Sequence: Synthetic oligonucleotide
gggacugagucagaaaag

SEQ ID NO: 70391 - RNA, 18 nt, Artificial Sequence
  Description of Artificial Sequence: Synthetic oligonucleotide
cuucccucaggucuucua

SEQ ID NO: 70392 - RNA, 18 nt, Artificial Sequence
  Description of Artificial Sequence: Synthetic oligonucleotide
cccuucuucccucagguc

SEQ ID NO: 70393 - RNA, 18 nt, Artificial Sequence
  Description of Artificial Sequence: Synthetic oligonucleotide
aagagcccuucuucccuc

SEQ ID NO: 70394 - RNA, 18 nt, Artificial Sequence
  Description of Artificial Sequence: Synthetic oligonucleotide
ccuggaagagcccuucuu

SEQ ID NO: 70395 - RNA, 18 nt, Artificial Sequence
  Description of Artificial Sequence: Synthetic oligonucleotide
agcucccuggaagagccc

SEQ ID NO: 70396 - RNA, 18 nt, Artificial Sequence
  Description of Artificial Sequence: Synthetic oligonucleotide
ccuugagcucccuggaag

SEQ ID NO: 70397 - RNA, 18 nt, Artificial Sequence
  Description of Artificial Sequence: Synthetic oligonucleotide
ucugcccuugagcucccu

SEQ ID NO: 70398 - RNA, 18 nt, Artificial Sequence
  Description of Artificial Sequence: Synthetic oligonucleotide
gcucuucugcccuugagc

SEQ ID NO: 70399 - RNA, 18 nt, Artificial Sequence
  Description of Artificial Sequence: Synthetic oligonucleotide
gaucagcucuucugcccu

SEQ ID NO: 70400 - RNA, 18 nt, Artificial Sequence
  Description of Artificial Sequence: Synthetic oligonucleotide
uaguagaucagcucuucu

SEQ ID NO: 70401 - RNA, 18 nt, Artificial Sequence
  Description of Artificial Sequence: Synthetic oligonucleotide
acucuuaguagaucagcu

SEQ ID NO: 70402 - RNA, 18 nt, Artificial Sequence
  Description of Artificial Sequence: Synthetic oligonucleotide
ggagcacucuuaguagau

SEQ ID NO: 70403 - RNA, 18 nt, Artificial Sequence
  Description of Artificial Sequence: Synthetic oligonucleotide
ggcagggagcacucuuag

SEQ ID NO: 70404 - RNA, 18 nt, Artificial Sequence
  Description of Artificial Sequence: Synthetic oligonucleotide
uggcuggcagggagcacu

SEQ ID NO: 70405 - RNA, 18 nt, Artificial Sequence
  Description of Artificial Sequence: Synthetic oligonucleotide
cauuguggcuggcaggga

SEQ ID NO: 70406 - RNA, 18 nt, Artificial Sequence
  Description of Artificial Sequence: Synthetic oligonucleotide
ccaggcauuguggcuggc

SEQ ID NO: 70407 - RNA, 18 nt, Artificial Sequence
  Description of Artificial Sequence: Synthetic oligonucleotide
ucuucugcccuugagcuc

SEQ ID NO: 70408 - RNA, 18 nt, Artificial Sequence
  Description of Artificial Sequence: Synthetic oligonucleotide
ucagcucuucugcccuug

SEQ ID NO: 70409 - RNA, 18 nt, Artificial Sequence
  Description of Artificial Sequence: Synthetic oligonucleotide
guagaucagcucuucugc

SEQ ID NO: 70410 - RNA, 18 nt, Artificial Sequence
  Description of Artificial Sequence: Synthetic oligonucleotide
ucuuaguagaucagcucu

SEQ ID NO: 70411 - RNA, 18 nt, Artificial Sequence
  Description of Artificial Sequence: Synthetic oligonucleotide
agcacucuuaguagauca

SEQ ID NO: 70412 - RNA, 18 nt, Artificial Sequence
  Description of Artificial Sequence: Synthetic oligonucleotide
cagggagcacucuuagua

SEQ ID NO: 70413 - RNA, 18 nt, Artificial Sequence
  Description of Artificial Sequence: Synthetic oligonucleotide
gcuggcagggagcacucu

SEQ ID NO: 70414 - RNA, 18 nt, Artificial Sequence
  Description of Artificial Sequence: Synthetic oligonucleotide
uuguggcuggcagggagc

SEQ ID NO: 70415 - RNA, 18 nt, Artificial Sequence
  Description of Artificial Sequence: Synthetic oligonucleotide
aggcauuguggcuggcag

SEQ ID NO: 70416 - RNA, 18 nt, Artificial Sequence
  Description of Artificial Sequence: Synthetic oligonucleotide
uacccaggcauuguggcu

SEQ ID NO: 70417 - RNA, 18 nt, Artificial Sequence
  Description of Artificial Sequence: Synthetic oligonucleotide
gccaguacccaggcauug

SEQ ID NO: 70418 - RNA, 18 nt, Artificial Sequence
  Description of Artificial Sequence: Synthetic oligonucleotide
aggaugccaguacccagg

SEQ ID NO: 70419 - RNA, 18 nt, Artificial Sequence
  Description of Artificial Sequence: Synthetic oligonucleotide
aagacaggaugccaguac

SEQ ID NO: 70420 - RNA, 18 nt, Artificial Sequence
  Description of Artificial Sequence: Synthetic oligonucleotide
uaggaaagacaggaugcc

SEQ ID NO: 70421 - RNA, 18 nt, Artificial Sequence
  Description of Artificial Sequence: Synthetic oligonucleotide
cuaaguaggaaagacagg

SEQ ID NO: 70422 - RNA, 18 nt, Artificial Sequence
  Description of Artificial Sequence: Synthetic oligonucleotide
cuugucuaaguaggaaag

SEQ ID NO: 70423 - RNA, 18 nt, Artificial Sequence
  Description of Artificial Sequence: Synthetic oligonucleotide
ccucccuugucuaaguag

SEQ ID NO: 70424 - RNA, 18 nt, Artificial Sequence
  Description of Artificial Sequence: Synthetic oligonucleotide
ucaggccucccuugucua

SEQ ID NO: 70425 - RNA, 18 nt, Artificial Sequence
  Description of Artificial Sequence: Synthetic oligonucleotide
agaucucaggccucccuu

SEQ ID NO: 70426 - RNA, 18 nt, Artificial Sequence
  Description of Artificial Sequence: Synthetic oligonucleotide
gggccagaucucaggccu

SEQ ID NO: 70427 - RNA, 18 nt, Artificial Sequence
  Description of Artificial Sequence: Synthetic oligonucleotide
caccagggccagaucuca

SEQ ID NO: 70428 - RNA, 18 nt, Artificial Sequence
  Description of Artificial Sequence: Synthetic oligonucleotide
ccaaacaccagggccaga

SEQ ID NO: 70429 - RNA, 18 nt, Artificial Sequence
  Description of Artificial Sequence: Synthetic oligonucleotide
ugaggccaaacaccaggg

SEQ ID NO: 70430 - RNA, 18 nt, Artificial Sequence
  Description of Artificial Sequence: Synthetic oligonucleotide
gguccugaggccaaacac

SEQ ID NO: 70431 - RNA, 18 nt, Artificial Sequence
  Description of Artificial Sequence: Synthetic oligonucleotide
uccugcccuguggaggaa

SEQ ID NO: 70432 - RNA, 18 nt, Artificial Sequence
  Description of Artificial Sequence: Synthetic oligonucleotide
ugugguccugcccugugg

SEQ ID NO: 70433 - RNA, 18 nt, Artificial Sequence
  Description of Artificial Sequence: Synthetic oligonucleotide
ugagcugugguccugccc

SEQ ID NO: 70434 - RNA, 18 nt, Artificial Sequence
  Description of Artificial Sequence: Synthetic oligonucleotide
ccuugugagcuguggucc

SEQ ID NO: 70435 - RNA, 18 nt, Artificial Sequence
  Description of Artificial Sequence: Synthetic oligonucleotide
gggauccuugugagcugu

SEQ ID NO: 70436 - RNA, 18 nt, Artificial Sequence
  Description of Artificial Sequence: Synthetic oligonucleotide
gcauugggauccuuguga

SEQ ID NO: 70437 - RNA, 18 nt, Artificial Sequence
  Description of Artificial Sequence: Synthetic oligonucleotide
agauggcauugggauccu

SEQ ID NO: 70438 - RNA, 18 nt, Artificial Sequence
  Description of Artificial Sequence: Synthetic oligonucleotide
caggaagauggcauuggg

SEQ ID NO: 70439 - RNA, 18 nt, Artificial Sequence
  Description of Artificial Sequence: Synthetic oligonucleotide
aagcucaggaagauggca

SEQ ID NO: 70440 - RNA, 18 nt, Artificial Sequence
  Description of Artificial Sequence: Synthetic oligonucleotide
guuggaagcucaggaaga

SEQ ID NO: 70441 - RNA, 18 nt, Artificial Sequence
  Description of Artificial Sequence: Synthetic oligonucleotide
cagguguuggaagcucag

SEQ ID NO: 70442 - RNA, 18 nt, Artificial Sequence
  Description of Artificial Sequence: Synthetic oligonucleotide
cggagcagguguuggaag

SEQ ID NO: 70443 - RNA, 18 nt, Artificial Sequence
  Description of Artificial Sequence: Synthetic oligonucleotide
uuccucggagcagguguu

SEQ ID NO: 70444 - RNA, 18 nt, Artificial Sequence
  Description of Artificial Sequence: Synthetic oligonucleotide
caccuuuccucggagcag

SEQ ID NO: 70445 - RNA, 18 nt, Artificial Sequence
  Description of Artificial Sequence: Synthetic oligonucleotide
aaacgcaccuuuccucgg

SEQ ID NO: 70446 - RNA, 18 nt, Artificial Sequence
  Description of Artificial Sequence: Synthetic oligonucleotide
ucaggaaacgcaccuuuc

SEQ ID NO: 70447 - RNA, 18 nt, Artificial Sequence
  Description of Artificial Sequence: Synthetic oligonucleotide
aagcaucaggaaacgcac

SEQ ID NO: 70448 - RNA, 18 nt, Artificial Sequence
  Description of Artificial Sequence: Synthetic oligonucleotide
ccuacaagcaucaggaaa

SEQ ID NO: 70449 - RNA, 18 nt, Artificial Sequence
  Description of Artificial Sequence: Synthetic oligonucleotide
acccuccuacaagcauca

SEQ ID NO: 70450 - RNA, 18 nt, Artificial Sequence
  Description of Artificial Sequence: Synthetic oligonucleotide
gguggacccuccuacaag

SEQ ID NO: 70451 - RNA, 18 nt, Artificial Sequence
  Description of Artificial Sequence: Synthetic oligonucleotide
cagaggguggacccuccu

SEQ ID NO: 70452 - RNA, 18 nt, Artificial Sequence
  Description of Artificial Sequence: Synthetic oligonucleotide
ugacgcagaggguggacc

SEQ ID NO: 70453 - RNA, 18 nt, Artificial Sequence
  Description of Artificial Sequence: Synthetic oligonucleotide
ccgccugacgcagagggu

SEQ ID NO: 70454 - RNA, 18 nt, Artificial Sequence
  Description of Artificial Sequence: Synthetic oligonucleotide
gggcccgccugacgcaga

SEQ ID NO: 70455 - RNA, 18 nt, Artificial Sequence
  Description of Artificial Sequence: Synthetic oligonucleotide
acagcugugguggguggg

SEQ ID NO: 70456 - RNA, 18 nt, Artificial Sequence
  Description of Artificial Sequence: Synthetic oligonucleotide
gggacagcuguggugggu

SEQ ID NO: 70457 - RNA, 18 nt, Artificial Sequence
  Description of Artificial Sequence: Synthetic oligonucleotide
uagagagguucugcuggg

SEQ ID NO: 70458 - RNA, 18 nt, Artificial Sequence
  Description of Artificial Sequence: Synthetic oligonucleotide
aggacuagagagguucug

SEQ ID NO: 70459 - RNA, 18 nt, Artificial Sequence
  Description of Artificial Sequence: Synthetic oligonucleotide
gugugaggacuagagagg

SEQ ID NO: 70460 - RNA, 18 nt, Artificial Sequence
  Description of Artificial Sequence: Synthetic oligonucleotide
guucagugugaggacuag

SEQ ID NO: 70461 - RNA, 18 nt, Artificial Sequence
  Description of Artificial Sequence: Synthetic oligonucleotide
agcucguucagugugagg

SEQ ID NO: 70462 - RNA, 18 nt, Artificial Sequence
  Description of Artificial Sequence: Synthetic oligonucleotide
uugggagcucguucagug

SEQ ID NO: 70463 - RNA, 18 nt, Artificial Sequence
  Description of Artificial Sequence: Synthetic oligonucleotide
ccuguuugggagcucguu

SEQ ID NO: 70464 - RNA, 18 nt, Artificial Sequence
  Description of Artificial Sequence: Synthetic oligonucleotide
gaaguccuguuugggagc

SEQ ID NO: 70465 - RNA, 18 nt, Artificial Sequence
  Description of Artificial Sequence: Synthetic oligonucleotide
auccagaaguccuguuug

SEQ ID NO: 70466 - RNA, 18 nt, Artificial Sequence
  Description of Artificial Sequence: Synthetic oligonucleotide
caacaauccagaaguccu

SEQ ID NO: 70467 - RNA, 18 nt, Artificial Sequence
  Description of Artificial Sequence: Synthetic oligonucleotide
gucuccaacaauccagaa

SEQ ID NO: 70468 - RNA, 18 nt, Artificial Sequence
  Description of Artificial Sequence: Synthetic oligonucleotide
aguuugucuccaacaauc

SEQ ID NO: 70469 - RNA, 18 nt, Artificial Sequence
  Description of Artificial Sequence: Synthetic oligonucleotide
agugaaguuugucuccaa

SEQ ID NO: 70470 - RNA, 18 nt, Artificial Sequence
  Description of Artificial Sequence: Synthetic oligonucleotide
gaggcagugaaguuuguc

SEQ ID NO: 70471 - RNA, 18 nt, Artificial Sequence
  Description of Artificial Sequence: Synthetic oligonucleotide
uggcugaggcagugaagu

SEQ ID NO: 70472 - RNA, 18 nt, Artificial Sequence
  Description of Artificial Sequence: Synthetic oligonucleotide
aguucuggcugaggcagu

SEQ ID NO: 70473 - RNA, 18 nt, Artificial Sequence
  Description of Artificial Sequence: Synthetic oligonucleotide
ccaguaguucuggcugag

SEQ ID NO: 70474 - RNA, 18 nt, Artificial Sequence
  Description of Artificial Sequence: Synthetic oligonucleotide
cagagccaguaguucugg

SEQ ID NO: 70475 - RNA, 18 nt, Artificial Sequence
  Description of Artificial Sequence: Synthetic oligonucleotide
aagcccagagccaguagu

SEQ ID NO: 70476 - RNA, 18 nt, Artificial Sequence
  Description of Artificial Sequence: Synthetic oligonucleotide
uucagaagcccagagcca

SEQ ID NO: 70477 - RNA, 18 nt, Artificial Sequence
  Description of Artificial Sequence: Synthetic oligonucleotide
gccacuucagaagcccag

SEQ ID NO: 70478 - RNA, 18 nt, Artificial Sequence
  Description of Artificial Sequence: Synthetic oligonucleotide
cugcugccacuucagaag

SEQ ID NO: 70479 - RNA, 18 nt, Artificial Sequence
  Description of Artificial Sequence: Synthetic oligonucleotide
aaucccugcugccacuuc

SEQ ID NO: 70480 - RNA, 18 nt, Artificial Sequence
  Description of Artificial Sequence: Synthetic oligonucleotide
cucugaaucccugcugcc

SEQ ID NO: 70481 - RNA, 18 nt, Artificial Sequence
  Description of Artificial Sequence: Synthetic oligonucleotide
cuuggcucugaaucccug

SEQ ID NO: 70482 - RNA, 18 nt, Artificial Sequence
  Description of Artificial Sequence: Synthetic oligonucleotide
ggaaucuuggcucugaau

SEQ ID NO: 70483 - RNA, 18 nt, Artificial Sequence
  Description of Artificial Sequence: Synthetic oligonucleotide
gaccaggaaucuuggcuc

SEQ ID NO: 70484 - RNA, 18 nt, Artificial Sequence
  Description of Artificial Sequence: Synthetic oligonucleotide
cagcagaccaggaaucuu

SEQ ID NO: 70485 - RNA, 18 nt, Artificial Sequence
  Description of Artificial Sequence: Synthetic oligonucleotide
ugguucagcagaccagga

SEQ ID NO: 70486 - RNA, 18 nt, Artificial Sequence
  Description of Artificial Sequence: Synthetic oligonucleotide
agguuugguucagcagac

SEQ ID NO: 70487 - RNA, 18 nt, Artificial Sequence
  Description of Artificial Sequence: Synthetic oligonucleotide
ccuggagguuugguucag

SEQ ID NO: 70488 - RNA, 18 nt, Artificial Sequence
  Description of Artificial Sequence: Synthetic oligonucleotide
agggaccuggagguuugg

SEQ ID NO: 70489 - RNA, 18 nt, Artificial Sequence
  Description of Artificial Sequence: Synthetic oligonucleotide
gguccagggaccuggagg

SEQ ID NO: 70490 - RNA, 18 nt, Artificial Sequence
  Description of Artificial Sequence: Synthetic oligonucleotide
gauuugguccagggaccu

SEQ ID NO: 70491 - RNA, 18 nt, Artificial Sequence
  Description of Artificial Sequence: Synthetic oligonucleotide
gggauuugguccagggac

SEQ ID NO: 70492 - RNA, 18 nt, Artificial Sequence
  Description of Artificial Sequence: Synthetic oligonucleotide
ccuguucagguauccggg

SEQ ID NO: 70493 - RNA, 18 nt, Artificial Sequence
  Description of Artificial Sequence: Synthetic oligonucleotide
uguauccuguucagguau

SEQ ID NO: 70494 - RNA, 18 nt, Artificial Sequence
  Description of Artificial Sequence: Synthetic oligonucleotide
guucguguauccuguuca

SEQ ID NO: 70495 - RNA, 18 nt, Artificial Sequence
  Description of Artificial Sequence: Synthetic oligonucleotide
caagaguucguguauccu

SEQ ID NO: 70496 - RNA, 18 nt, Artificial Sequence
  Description of Artificial Sequence: Synthetic oligonucleotide
ccauucaagaguucgugu

SEQ ID NO: 70497 - RNA, 18 nt, Artificial Sequence
  Description of Artificial Sequence: Synthetic oligonucleotide
gaguuccauucaagaguu

SEQ ID NO: 70498 - RNA, 18 nt, Artificial Sequence
  Description of Artificial Sequence: Synthetic oligonucleotide
uccacgaguuccauucaa

SEQ ID NO: 70499 - RNA, 18 nt, Artificial Sequence
  Description of Artificial Sequence: Synthetic oligonucleotide
aagaguccacgaguucca

SEQ ID NO: 70500 - RNA, 18 nt, Artificial Sequence
  Description of Artificial Sequence: Synthetic oligonucleotide
caggaaagaguccacgag

SEQ ID NO: 70501 - RNA, 18 nt, Artificial Sequence
  Description of Artificial Sequence: Synthetic oligonucleotide
ggguccaggaaagagucc

SEQ ID NO: 70502 - RNA, 18 nt, Artificial Sequence
  Description of Artificial Sequence: Synthetic oligonucleotide
cgugaggguccaggaaag

SEQ ID NO: 70503 - RNA, 18 nt, Artificial Sequence
  Description of Artificial Sequence: Synthetic oligonucleotide
uccugcgugaggguccag

SEQ ID NO: 70504 - RNA, 18 nt, Artificial Sequence
  Description of Artificial Sequence: Synthetic oligonucleotide
uaggguccugcgugaggg

SEQ ID NO: 70505 - RNA, 18 nt, Artificial Sequence
  Description of Artificial Sequence: Synthetic oligonucleotide
gcuccuaggguccugcgu

SEQ ID NO: 70506 - RNA, 18 nt, Artificial Sequence
  Description of Artificial Sequence: Synthetic oligonucleotide
gggcuccuaggguccugc

SEQ ID NO: 70507 - RNA, 18 nt, Artificial Sequence
  Description of Artificial Sequence: Synthetic oligonucleotide
ccugaggaaauguccggg

SEQ ID NO: 70508 - RNA, 18 nt, Artificial Sequence
  Description of Artificial Sequence: Synthetic oligonucleotide
auguuccugaggaaaugu

SEQ ID NO: 70509 - RNA, 18 nt, Artificial Sequence
  Description of Artificial Sequence: Synthetic oligonucleotide
gucugauguuccugagga

SEQ ID NO: 70510 - RNA, 18 nt, Artificial Sequence
  Description of Artificial Sequence: Synthetic oligonucleotide
ccugugucugauguuccu

SEQ ID NO: 70511 - RNA, 18 nt, Artificial Sequence
  Description of Artificial Sequence: Synthetic oligonucleotide
gggagccugugucugaug

SEQ ID NO: 70512 - RNA, 18 nt, Artificial Sequence
  Description of Artificial Sequence: Synthetic oligonucleotide
uggcagggagccuguguc

SEQ ID NO: 70513 - RNA, 18 nt, Artificial Sequence
  Description of Artificial Sequence: Synthetic oligonucleotide
uuggguggcagggagccu

SEQ ID NO: 70514 - RNA, 18 nt, Artificial Sequence
  Description of Artificial Sequence: Synthetic oligonucleotide
ggagguuggguggcaggg

SEQ ID NO: 70515 - RNA, 18 nt, Artificial Sequence
  Description of Artificial Sequence: Synthetic oligonucleotide
aggcuggagguugggugg

SEQ ID NO: 70516 - RNA, 18 nt, Artificial Sequence
  Description of Artificial Sequence: Synthetic oligonucleotide
uauccaggcuggagguug

SEQ ID NO: 70517 - RNA, 18 nt, Artificial Sequence
  Description of Artificial Sequence: Synthetic oligonucleotide
gagaauauccaggcugga

SEQ ID NO: 70518 - RNA, 18 nt, Artificial Sequence
  Description of Artificial Sequence: Synthetic oligonucleotide
ggaaggagaauauccagg

SEQ ID NO: 70519 - RNA, 18 nt, Artificial Sequence
  Description of Artificial Sequence: Synthetic oligonucleotide
gggaaggagaauauccag

SEQ ID NO: 70520 - RNA, 18 nt, Artificial Sequence
  Description of Artificial Sequence: Synthetic oligonucleotide
guaggaggauggguuggg

SEQ ID NO: 70521 - RNA, 18 nt, Artificial Sequence
  Description of Artificial Sequence: Synthetic oligonucleotide
guccaguaggaggauggg

SEQ ID NO: 70522 - RNA, 18 nt, Artificial Sequence
  Description of Artificial Sequence: Synthetic oligonucleotide
auacuguccaguaggagg

SEQ ID NO: 70523 - RNA, 18 nt, Artificial Sequence
  Description of Artificial Sequence: Synthetic oligonucleotide
agcguauacuguccagua

SEQ ID NO: 70524 - RNA, 18 nt, Artificial Sequence
  Description of Artificial Sequence: Synthetic oligonucleotide
ggaagagcguauacuguc

SEQ ID NO: 70525 - RNA, 18 nt, Artificial Sequence
  Description of Artificial Sequence: Synthetic oligonucleotide
aagagggaagagcguaua

SEQ ID NO: 70526 - RNA, 18 nt, Artificial Sequence
  Description of Artificial Sequence: Synthetic oligonucleotide
gguggaagagggaagagc

SEQ ID NO: 70527 - RNA, 18 nt, Artificial Sequence
  Description of Artificial Sequence: Synthetic oligonucleotide
agguggguggaagaggga

SEQ ID NO: 70528 - RNA, 18 nt, Artificial Sequence
  Description of Artificial Sequence: Synthetic oligonucleotide
gggcaagguggguggaag

SEQ ID NO: 70529 - RNA, 18 nt, Artificial Sequence
  Description of Artificial Sequence: Synthetic oligonucleotide
gggugggcaaggugggug

SEQ ID NO: 70530 - RNA, 18 nt, Artificial Sequence
  Description of Artificial Sequence: Synthetic oligonucleotide
uggagcuggaccacaggg

SEQ ID NO: 70531 - RNA, 18 nt, Artificial Sequence
  Description of Artificial Sequence: Synthetic oligonucleotide
ggguggagcuggaccaca

SEQ ID NO: 70532 - RNA, 18 nt, Artificial Sequence
  Description of Artificial Sequence: Synthetic oligonucleotide
aagggucaggaagcaggg

SEQ ID NO: 70533 - RNA, 18 nt, Artificial Sequence
  Description of Artificial Sequence: Synthetic oligonucleotide
agcagaagggucaggaag

SEQ ID NO: 70534 - RNA, 18 nt, Artificial Sequence
  Description of Artificial Sequence: Synthetic oligonucleotide
guuggagcagaaggguca

SEQ ID NO: 70535 - RNA, 18 nt, Artificial Sequence
  Description of Artificial Sequence: Synthetic oligonucleotide
ugggcguuggagcagaag

SEQ ID NO: 70536 - RNA, 18 nt, Artificial Sequence
  Description of Artificial Sequence: Synthetic oligonucleotide
gggugggcguuggagcag

SEQ ID NO: 70537 - RNA, 18 nt, Artificial Sequence
  Description of Artificial Sequence: Synthetic oligonucleotide
agaagagggcugguaggg

SEQ ID NO: 70538 - RNA, 18 nt, Artificial Sequence
  Description of Artificial Sequence: Synthetic oligonucleotide
uguuuagaagagggcugg

SEQ ID NO: 70539 - RNA, 18 nt, Artificial Sequence
  Description of Artificial Sequence: Synthetic oligonucleotide
ggauguguuuagaagagg

SEQ ID NO: 70540 - RNA, 18 nt, Artificial Sequence
  Description of Artificial Sequence: Synthetic oligonucleotide
guguaggauguguuuaga

SEQ ID NO: 70541 - RNA, 18 nt, Artificial Sequence
  Description of Artificial Sequence: Synthetic oligonucleotide
aguggguguaggaugugu

SEQ ID NO: 70542 - RNA, 18 nt, Artificial Sequence
  Description of Artificial Sequence: Synthetic oligonucleotide
cugggaguggguguagga

SEQ ID NO: 70543 - RNA, 18 nt, Artificial Sequence
  Description of Artificial Sequence: Synthetic oligonucleotide
agauucugggagugggug

SEQ ID NO: 70544 - RNA, 18 nt, Artificial Sequence
  Description of Artificial Sequence: Synthetic oligonucleotide
gagacagauucugggagu

SEQ ID NO: 70545 - RNA, 18 nt, Artificial Sequence
  Description of Artificial Sequence: Synthetic oligonucleotide
uuccugagacagauucug

SEQ ID NO: 70546 - RNA, 18 nt, Artificial Sequence
  Description of Artificial Sequence: Synthetic oligonucleotide
uacccuuccugagacaga

SEQ ID NO: 70547 - RNA, 18 nt, Artificial Sequence
  Description of Artificial Sequence: Synthetic oligonucleotide
aaccuuacccuuccugag

SEQ ID NO: 70548 - RNA, 18 nt, Artificial Sequence
  Description of Artificial Sequence: Synthetic oligonucleotide
cugagaaccuuacccuuc

SEQ ID NO: 70549 - RNA, 18 nt, Artificial Sequence
  Description of Artificial Sequence: Synthetic oligonucleotide
agugucugagaaccuuac

SEQ ID NO: 70550 - RNA, 18 nt, Artificial Sequence
  Description of Artificial Sequence: Synthetic oligonucleotide
ucggcagugucugagaac

SEQ ID NO: 70551 - RNA, 18 nt, Artificial Sequence
  Description of Artificial Sequence: Synthetic oligonucleotide
ugaugucggcagugucug

SEQ ID NO: 70552 - RNA, 18 nt, Artificial Sequence
  Description of Artificial Sequence: Synthetic oligonucleotide
aaugcugaugucggcagu

SEQ ID NO: 70553 - RNA, 18 nt, Artificial Sequence
  Description of Artificial Sequence: Synthetic oligonucleotide
gagacaaugcugaugucg

SEQ ID NO: 70554 - RNA, 18 nt, Artificial Sequence
  Description of Artificial Sequence: Synthetic oligonucleotide
uacacgagacaaugcuga

SEQ ID NO: 70555 - RNA, 18 nt, Artificial Sequence
  Description of Artificial Sequence: Synthetic oligonucleotide
agcuguacacgagacaau

SEQ ID NO: 70556 - RNA, 18 nt, Artificial Sequence
  Description of Artificial Sequence: Synthetic oligonucleotide
aagggagcuguacacgag

SEQ ID NO: 70557 - RNA, 18 nt, Artificial Sequence
  Description of Artificial Sequence: Synthetic oligonucleotide
cagggaagggagcuguac

SEQ ID NO: 70558 - RNA, 18 nt, Artificial Sequence
  Description of Artificial Sequence: Synthetic oligonucleotide
cccugcagggaagggagc

SEQ ID NO: 70559 - RNA, 18 nt, Artificial Sequence
  Description of Artificial Sequence: Synthetic oligonucleotide
gggcgcccugcagggaag

SEQ ID NO: 70560 - RNA, 18 nt, Artificial Sequence
  Description of Artificial Sequence: Synthetic oligonucleotide
cuuguccaguugucuccc

SEQ ID NO: 70561 - RNA, 18 nt, Artificial Sequence
  Description of Artificial Sequence: Synthetic oligonucleotide
gaaaucuuguccaguugu

SEQ ID NO: 70562 - RNA, 18 nt, Artificial Sequence
  Description of Artificial Sequence: Synthetic oligonucleotide
aguaggaaaucuugucca

SEQ ID NO: 70563 - RNA, 18 nt, Artificial Sequence
  Description of Artificial Sequence: Synthetic oligonucleotide
gagaaaguaggaaaucuu

SEQ ID NO: 70564 - RNA, 18 nt, Artificial Sequence
  Description of Artificial Sequence: Synthetic oligonucleotide
uucaggagaaaguaggaa

SEQ ID NO: 70565 - RNA, 18 nt, Artificial Sequence
  Description of Artificial Sequence: Synthetic oligonucleotide
uggguuucaggagaaagu

SEQ ID NO: 70566 - RNA, 18 nt, Artificial Sequence
  Description of Artificial Sequence: Synthetic oligonucleotide
ggcuuuggguuucaggag

SEQ ID NO: 70567 - RNA, 18 nt, Artificial Sequence
  Description of Artificial Sequence: Synthetic oligonucleotide
accagggcuuuggguuuc

SEQ ID NO: 70568 - RNA, 18 nt, Artificial Sequence
  Description of Artificial Sequence: Synthetic oligonucleotide
cuuuuaccagggcuuugg

SEQ ID NO: 70569 - RNA, 18 nt, Artificial Sequence
  Description of Artificial Sequence: Synthetic oligonucleotide
uaucccuuuuaccagggc

SEQ ID NO: 70570 - RNA, 18 nt, Artificial Sequence
  Description of Artificial Sequence: Synthetic oligonucleotide
cuguguaucccuuuuacc

SEQ ID NO: 70571 - RNA, 18 nt, Artificial Sequence
  Description of Artificial Sequence: Synthetic oligonucleotide
caguccuguguaucccuu

SEQ ID NO: 70572 - RNA, 18 nt, Artificial Sequence
  Description of Artificial Sequence: Synthetic oligonucleotide
cuuuucaguccuguguau

SEQ ID NO: 70573 - RNA, 18 nt, Artificial Sequence
  Description of Artificial Sequence: Synthetic oligonucleotide
auucccuuuucaguccug

SEQ ID NO: 70574 - RNA, 18 nt, Artificial Sequence
  Description of Artificial Sequence: Synthetic oligonucleotide
aaaugauucccuuuucag

SEQ ID NO: 70575 - RNA, 18 nt, Artificial Sequence
  Description of Artificial Sequence: Synthetic oligonucleotide
gugaaaaaugauucccuu

SEQ ID NO: 70576 - RNA, 18 nt, Artificial Sequence
  Description of Artificial Sequence: Synthetic oligonucleotide
guacagugaaaaaugauu

SEQ ID NO: 70577 - RNA, 18 nt, Artificial Sequence
  Description of Artificial Sequence: Synthetic oligonucleotide
auaauguacagugaaaaa

SEQ ID NO: 70578 - RNA, 18 nt, Artificial Sequence
  Description of Artificial Sequence: Synthetic oligonucleotide
gguuuauaauguacagug

SEQ ID NO: 70579 - RNA, 18 nt, Artificial Sequence
  Description of Artificial Sequence: Synthetic oligonucleotide
cugaagguuuauaaugua

SEQ ID NO: 70580 - RNA, 18 nt, Artificial Sequence
  Description of Artificial Sequence: Synthetic oligonucleotide
agcuucugaagguuuaua

SEQ ID NO: 70581 - RNA, 18 nt, Artificial Sequence
  Description of Artificial Sequence: Synthetic oligonucleotide
aaaauagcuucugaaggu

SEQ ID NO: 70582 - RNA, 18 nt, Artificial Sequence
  Description of Artificial Sequence: Synthetic oligonucleotide
uuaaaaaaauagcuucug

SEQ ID NO: 70583 - RNA, 18 nt, Artificial Sequence
  Description of Artificial Sequence: Synthetic oligonucleotide
auagcuuaaaaaaauagc

SEQ ID NO: 70584 - RNA, 18 nt, Artificial Sequence
  Description of Artificial Sequence: Synthetic oligonucleotide
ugcugauagcuuaaaaaa

SEQ ID NO: 70585 - RNA, 18 nt, Artificial Sequence
  Description of Artificial Sequence: Synthetic oligonucleotide
aguauugcugauagcuua

SEQ ID NO: 70586 - RNA, 18 nt, Artificial Sequence
  Description of Artificial Sequence: Synthetic oligonucleotide
ugaugaguauugcugaua

SEQ ID NO: 70587 - RNA, 18 nt, Artificial Sequence
  Description of Artificial Sequence: Synthetic oligonucleotide
ugcucugaugaguauugc

SEQ ID NO: 70588 - RNA, 18 nt, Artificial Sequence
  Description of Artificial Sequence: Synthetic oligonucleotide
cuagcugcucugaugagu

SEQ ID NO: 70589 - RNA, 18 nt, Artificial Sequence
  Description of Artificial Sequence: Synthetic oligonucleotide
aagagcuagcugcucuga

SEQ ID NO: 70590 - RNA, 18 nt, Artificial Sequence
  Description of Artificial Sequence: Synthetic oligonucleotide
gaccaaagagcuagcugc

SEQ ID NO: 70591 - RNA, 18 nt, Artificial Sequence
  Description of Artificial Sequence: Synthetic oligonucleotide
aaauagaccaaagagcua

SEQ ID NO: 70592 - RNA, 18 nt, Artificial Sequence
  Description of Artificial Sequence: Synthetic oligonucleotide
gcagaaaauagaccaaag

SEQ ID NO: 70593 - RNA, 18 nt, Artificial Sequence
  Description of Artificial Sequence: Synthetic oligonucleotide
uuucugcagaaaauagac

SEQ ID NO: 70594 - RNA, 18 nt, Artificial Sequence
  Description of Artificial Sequence: Synthetic oligonucleotide
gcaaauuucugcagaaaa

SEQ ID NO: 70595 - RNA, 18 nt, Artificial Sequence
  Description of Artificial Sequence: Synthetic oligonucleotide
gaguugcaaauuucugca

SEQ ID NO: 70596 - RNA, 18 nt, Artificial Sequence
  Description of Artificial Sequence: Synthetic oligonucleotide
ucagugaguugcaaauuu

SEQ ID NO: 70597 - RNA, 18 nt, Artificial Sequence
  Description of Artificial Sequence: Synthetic oligonucleotide
gagaaucagugaguugca

SEQ ID NO: 70598 - RNA, 18 nt, Artificial Sequence
  Description of Artificial Sequence: Synthetic oligonucleotide
auguagagaaucagugag

SEQ ID NO: 70599 - RNA, 18 nt, Artificial Sequence
  Description of Artificial Sequence: Synthetic oligonucleotide
agagcauguagagaauca

SEQ ID NO: 70600 - RNA, 18 nt, Artificial Sequence
  Description of Artificial Sequence: Synthetic oligonucleotide
gaaaaagagcauguagag

SEQ ID NO: 70601 - RNA, 18 nt, Artificial Sequence
  Description of Artificial Sequence: Synthetic oligonucleotide
ucacagaaaaagagcaug

SEQ ID NO: 70602 - RNA, 18 nt, Artificial Sequence
  Description of Artificial Sequence: Synthetic oligonucleotide
aguuaucacagaaaaaga

SEQ ID NO: 70603 - RNA, 18 nt, Artificial Sequence
  Description of Artificial Sequence: Synthetic oligonucleotide
ugcagaguuaucacagaa

SEQ ID NO: 70604 - RNA, 18 nt, Artificial Sequence
  Description of Artificial Sequence: Synthetic oligonucleotide
gccuuugcagaguuauca

SEQ ID NO: 70605 - RNA, 18 nt, Artificial Sequence
  Description of Artificial Sequence: Synthetic oligonucleotide
cccaggccuuugcagagu

SEQ ID NO: 70606 - RNA, 18 nt, Artificial Sequence
  Description of Artificial Sequence: Synthetic oligonucleotide
gccagcccaggccuuugc

SEQ ID NO: 70607 - RNA, 18 nt, Artificial Sequence
  Description of Artificial Sequence: Synthetic oligonucleotide
gccaggccagcccaggcc

SEQ ID NO: 70608 - RNA, 18 nt, Artificial Sequence
  Description of Artificial Sequence: Synthetic oligonucleotide
caacugccaggccagccc

SEQ ID NO: 70609 - RNA, 18 nt, Artificial Sequence
  Description of Artificial Sequence: Synthetic oligonucleotide
cuguucaacugccaggcc

SEQ ID NO: 70610 - RNA, 18 nt, Artificial Sequence
  Description of Artificial Sequence: Synthetic oligonucleotide
ucccucuguucaacugcc

SEQ ID NO: 70611 - RNA, 18 nt, Artificial Sequence
  Description of Artificial Sequence: Synthetic oligonucleotide
gucucucccucuguucaa

SEQ ID NO: 70612 - RNA, 18 nt, Artificial Sequence
  Description of Artificial Sequence: Synthetic oligonucleotide
gguuagucucucccucug

SEQ ID NO: 70613 - RNA, 18 nt, Artificial Sequence
  Description of Artificial Sequence: Synthetic oligonucleotide
cucaagguuagucucucc

SEQ ID NO: 70614 - RNA, 18 nt, Artificial Sequence
  Description of Artificial Sequence: Synthetic oligonucleotide
ucugacucaagguuaguc

SEQ ID NO: 70615 - RNA, 18 nt, Artificial Sequence
  Description of Artificial Sequence: Synthetic oligonucleotide
uguuuucugacucaaggu

SEQ ID NO: 70616 - RNA, 18 nt, Artificial Sequence
  Description of Artificial Sequence: Synthetic oligonucleotide
uucucuguuuucugacuc

SEQ ID NO: 70617 - RNA, 18 nt, Artificial Sequence
  Description of Artificial Sequence: Synthetic oligonucleotide
acccuuucucuguuuucu

SEQ ID NO: 70618 - RNA, 18 nt, Artificial Sequence
  Description of Artificial Sequence: Synthetic oligonucleotide
aaauuacccuuucucugu

SEQ ID NO: 70619 - RNA, 18 nt, Artificial Sequence
  Description of Artificial Sequence: Synthetic oligonucleotide
aaaggaaauuacccuuuc

SEQ ID NO: 70620 - RNA, 18 nt, Artificial Sequence
  Description of Artificial Sequence: Synthetic oligonucleotide
gaagcaaaggaaauuacc

SEQ ID NO: 70621 - RNA, 18 nt, Artificial Sequence
  Description of Artificial Sequence: Synthetic oligonucleotide
aauuugaagcaaaggaaa

SEQ ID NO: 70622 - RNA, 18 nt, Artificial Sequence
  Description of Artificial Sequence: Synthetic oligonucleotide
ccuugaauuugaagcaaa

SEQ ID NO: 70623 - RNA, 18 nt, Artificial Sequence
  Description of Artificial Sequence: Synthetic oligonucleotide
gaaggccuugaauuugaa

SEQ ID NO: 70624 - RNA, 18 nt, Artificial Sequence
  Description of Artificial Sequence: Synthetic oligonucleotide
cguuggaaggccuugaau

SEQ ID NO: 70625 - RNA, 18 nt, Artificial Sequence
  Description of Artificial Sequence: Synthetic oligonucleotide
gggcguuggaaggccuug

SEQ ID NO: 70626 - RNA, 18 nt, Artificial Sequence
  Description of Artificial Sequence: Synthetic oligonucleotide
gagaaugauaguaaaggg

SEQ ID NO: 70627 - RNA, 18 nt, Artificial Sequence
  Description of Artificial Sequence: Synthetic oligonucleotide
ccacugagaaugauagua

SEQ ID NO: 70628 - RNA, 18 nt, Artificial Sequence
  Description of Artificial Sequence: Synthetic oligonucleotide
gagucccacugagaauga

SEQ ID NO: 70629 - RNA, 18 nt, Artificial Sequence
  Description of Artificial Sequence: Synthetic oligonucleotide
gaucagagucccacugag

SEQ ID NO: 70630 - RNA, 18 nt, Artificial Sequence
  Description of Artificial Sequence: Synthetic oligonucleotide
uaugggaucagaguccca

SEQ ID NO: 70631 - RNA, 18 nt, Artificial Sequence
  Description of Artificial Sequence: Synthetic oligonucleotide
aagaauaugggaucagag

SEQ ID NO: 70632 - RNA, 18 nt, Artificial Sequence
  Description of Artificial Sequence: Synthetic oligonucleotide
cuguuaagaauaugggau

SEQ ID NO: 70633 - RNA, 18 nt, Artificial Sequence
  Description of Artificial Sequence: Synthetic oligonucleotide
aagaucuguuaagaauau

SEQ ID NO: 70634 - RNA, 18 nt, Artificial Sequence
  Description of Artificial Sequence: Synthetic oligonucleotide
gaguaaagaucuguuaag

SEQ ID NO: 70635 - RNA, 18 nt, Artificial Sequence
  Description of Artificial Sequence: Synthetic oligonucleotide
cucaagaguaaagaucug

SEQ ID NO: 70636 - RNA, 18 nt, Artificial Sequence
  Description of Artificial Sequence: Synthetic oligonucleotide
cauuucucaagaguaaag

SEQ ID NO: 70637 - RNA, 18 nt, Artificial Sequence
  Description of Artificial Sequence: Synthetic oligonucleotide
uuauucauuucucaagag

SEQ ID NO: 70638 - RNA, 18 nt, Artificial Sequence
  Description of Artificial Sequence: Synthetic oligonucleotide
aaagcuuauucauuucuc

SEQ ID NO: 70639 - RNA, 18 nt, Artificial Sequence
  Description of Artificial Sequence: Synthetic oligonucleotide
gagagaaagcuuauucau

SEQ ID NO: 70640 - RNA, 18 nt, Artificial Sequence
  Description of Artificial Sequence: Synthetic oligonucleotide
uuucugagagaaagcuua

SEQ ID NO: 70641 - RNA, 18 nt, Artificial Sequence
  Description of Artificial Sequence: Synthetic oligonucleotide
cagcauuucugagagaaa

SEQ ID NO: 70642 - RNA, 18 nt, Artificial Sequence
  Description of Artificial Sequence: Synthetic oligonucleotide
agggacagcauuucugag

SEQ ID NO: 70643 - RNA, 18 nt, Artificial Sequence
  Description of Artificial Sequence: Synthetic oligonucleotide
uguauagggacagcauuu

SEQ ID NO: 70644 - RNA, 18 nt, Artificial Sequence
  Description of Artificial Sequence: Synthetic oligonucleotide
ucuaguguauagggacag

SEQ ID NO: 70645 - RNA, 18 nt, Artificial Sequence
  Description of Artificial Sequence: Synthetic oligonucleotide
uuuugucuaguguauagg

SEQ ID NO: 70646 - RNA, 18 nt, Artificial Sequence
  Description of Artificial Sequence: Synthetic oligonucleotide
cucaguuuugucuagugu

SEQ ID NO: 70647 - RNA, 18 nt, Artificial Sequence
  Description of Artificial Sequence: Synthetic oligonucleotide
acaggcucaguuuugucu

SEQ ID NO: 70648 - RNA, 18 nt, Artificial Sequence
  Description of Artificial Sequence: Synthetic oligonucleotide
cuuauacaggcucaguuu

SEQ ID NO: 70649 - RNA, 18 nt, Artificial Sequence
  Description of Artificial Sequence: Synthetic oligonucleotide
uauuccuuauacaggcuc

SEQ ID NO: 70650 - RNA, 18 nt, Artificial Sequence
  Description of Artificial Sequence: Synthetic oligonucleotide
ccauuuauuccuuauaca

SEQ ID NO: 70651 - RNA, 18 nt, Artificial Sequence
  Description of Artificial Sequence: Synthetic oligonucleotide
cgcucccauuuauuccuu

SEQ ID NO: 70652 - RNA, 18 nt, Artificial Sequence
  Description of Artificial Sequence: Synthetic oligonucleotide
uucggcgcucccauuuau

SEQ ID NO: 70653 - RNA, 18 nt, Artificial Sequence
  Description of Artificial Sequence: Synthetic oligonucleotide
agcuuuucggcgcuccca

SEQ ID NO: 70654 - RNA, 18 nt, Artificial Sequence
  Description of Artificial Sequence: Synthetic oligonucleotide
uagggagcuuuucggcgc

SEQ ID NO: 70655 - RNA, 18 nt, Artificial Sequence
  Description of Artificial Sequence: Synthetic oligonucleotide
cuuuuuagggagcuuuuc

SEQ ID NO: 70656 - RNA, 18 nt, Artificial Sequence
  Description of Artificial Sequence: Synthetic oligonucleotide
acgccugccugggccacu

SEQ ID NO: 70657 - RNA, 18 nt, Artificial Sequence
  Description of Artificial Sequence: Synthetic oligonucleotide
gucauacgccugccuggg

SEQ ID NO: 70658 - RNA, 18 nt, Artificial Sequence
  Description of Artificial Sequence: Synthetic oligonucleotide
agcaggucauacgccugc

SEQ ID NO: 70659 - RNA, 18 nt, Artificial Sequence
  Description of Artificial Sequence: Synthetic oligonucleotide
acagcagcaggucauacg

SEQ ID NO: 70660 - RNA, 18 nt, Artificial Sequence
  Description of Artificial Sequence: Synthetic oligonucleotide
ccuccacagcagcagguc

SEQ ID NO: 70661 - RNA, 18 nt, Artificial Sequence
  Description of Artificial Sequence: Synthetic oligonucleotide
cagccccuccacagcagc

SEQ ID NO: 70662 - RNA, 18 nt, Artificial Sequence
  Description of Artificial Sequence: Synthetic oligonucleotide
gggcacagccccuccaca

SEQ ID NO: 70663 - RNA, 18 nt, Artificial Sequence
  Description of Artificial Sequence: Synthetic oligonucleotide
aagacauguggcgguggg

SEQ ID NO: 70664 - RNA, 18 nt, Artificial Sequence
  Description of Artificial Sequence: Synthetic oligonucleotide
aggaagacauguggcggu

SEQ ID NO: 70665 - RNA, 18 nt, Artificial Sequence
  Description of Artificial Sequence: Synthetic oligonucleotide
uggguaggaagacaugug

SEQ ID NO: 70666 - RNA, 18 nt, Artificial Sequence
  Description of Artificial Sequence: Synthetic oligonucleotide
gcagauggguaggaagac

SEQ ID NO: 70667 - RNA, 18 nt, Artificial Sequence
  Description of Artificial Sequence: Synthetic oligonucleotide
agcaggcagcccucuggg

SEQ ID NO: 70668 - RNA, 18 nt, Artificial Sequence
  Description of Artificial Sequence: Synthetic oligonucleotide
ugcacagcaggcagcccu

SEQ ID NO: 70669 - RNA, 18 nt, Artificial Sequence
  Description of Artificial Sequence: Synthetic oligonucleotide
ccaagugcacagcaggca

SEQ ID NO: 70670 - RNA, 18 nt, Artificial Sequence
  Description of Artificial Sequence: Synthetic oligonucleotide
aggacccaagugcacagc

SEQ ID NO: 70671 - RNA, 18 nt, Artificial Sequence
  Description of Artificial Sequence: Synthetic oligonucleotide
gcuccaggacccaagugc

SEQ ID NO: 70672 - RNA, 18 nt, Artificial Sequence
  Description of Artificial Sequence: Synthetic oligonucleotide
gaagggcuccaggaccca

SEQ ID NO: 70673 - RNA, 18 nt, Artificial Sequence
  Description of Artificial Sequence: Synthetic oligonucleotide
guggagaagggcuccagg

SEQ ID NO: 70674 - RNA, 18 nt, Artificial Sequence
  Description of Artificial Sequence: Synthetic oligonucleotide
cccacacccugcuggcca

SEQ ID NO: 70675 - RNA, 18 nt, Artificial Sequence
  Description of Artificial Sequence: Synthetic oligonucleotide
auaaccccacacccugcu

SEQ ID NO: 70676 - RNA, 18 nt, Artificial Sequence
  Description of Artificial Sequence: Synthetic oligonucleotide
cucacauaaccccacacc

SEQ ID NO: 70677 - RNA, 18 nt, Artificial Sequence
  Description of Artificial Sequence: Synthetic oligonucleotide
cuacccucacauaacccc

SEQ ID NO: 70678 - RNA, 18 nt, Artificial Sequence
  Description of Artificial Sequence: Synthetic oligonucleotide
ccuuucuacccucacaua

SEQ ID NO: 70679 - RNA, 18 nt, Artificial Sequence
  Description of Artificial Sequence: Synthetic oligonucleotide
gcuguccuuucuacccuc

SEQ ID NO: 70680 - RNA, 18 nt, Artificial Sequence
  Description of Artificial Sequence: Synthetic oligonucleotide
ucuuugcuguccuuucua

SEQ ID NO: 70681 - RNA, 18 nt, Artificial Sequence
  Description of Artificial Sequence: Synthetic oligonucleotide
auuucucuuugcuguccu

SEQ ID NO: 70682 - RNA, 18 nt, Artificial Sequence
  Description of Artificial Sequence: Synthetic oligonucleotide
agcccauuucucuuugcu

SEQ ID NO: 70683 - RNA, 18 nt, Artificial Sequence
  Description of Artificial Sequence: Synthetic oligonucleotide
cugggagcccauuucucu

SEQ ID NO: 70684 - RNA, 18 nt, Artificial Sequence
  Description of Artificial Sequence: Synthetic oligonucleotide
cccagcugggagcccauu

SEQ ID NO: 70685 - RNA, 18 nt, Artificial Sequence
  Description of Artificial Sequence: Synthetic oligonucleotide
ccucccccagcugggagc

SEQ ID NO: 70686 - RNA, 18 nt, Artificial Sequence
  Description of Artificial Sequence: Synthetic oligonucleotide
cugccccucccccagcug

SEQ ID NO: 70687 - RNA, 18 nt, Artificial Sequence
  Description of Artificial Sequence: Synthetic oligonucleotide
uuugccugccccuccccc

SEQ ID NO: 70688 - RNA, 18 nt, Artificial Sequence
  Description of Artificial Sequence: Synthetic oligonucleotide
uccaguuugccugccccu

SEQ ID NO: 70689 - RNA, 18 nt, Artificial Sequence
  Description of Artificial Sequence: Synthetic oligonucleotide
uagguuccaguuugccug

SEQ ID NO: 70690 - RNA, 18 nt, Artificial Sequence
  Description of Artificial Sequence: Synthetic oligonucleotide
gccuguagguuccaguuu

SEQ ID NO: 70691 - RNA, 18 nt, Artificial Sequence
  Description of Artificial Sequence: Synthetic oligonucleotide
ucagugccuguagguucc

SEQ ID NO: 70692 - RNA, 18 nt, Artificial Sequence
  Description of Artificial Sequence: Synthetic oligonucleotide
aaaggucagugccuguag

SEQ ID NO: 70693 - RNA, 18 nt, Artificial Sequence
  Description of Artificial Sequence: Synthetic oligonucleotide
ucgacaaaggucagugcc

SEQ ID NO: 70694 - RNA, 18 nt, Artificial Sequence
  Description of Artificial Sequence: Synthetic oligonucleotide
ucuucucgacaaagguca

SEQ ID NO: 70695 - RNA, 18 nt, Artificial Sequence
  Description of Artificial Sequence: Synthetic oligonucleotide
uacacucuucucgacaaa

SEQ ID NO: 70696 - RNA, 18 nt, Artificial Sequence
  Description of Artificial Sequence: Synthetic oligonucleotide
aaggcuacacucuucucg

SEQ ID NO: 70697 - RNA, 18 nt, Artificial Sequence
  Description of Artificial Sequence: Synthetic oligonucleotide
cugggaaggcuacacucu

SEQ ID NO: 70698 - RNA, 18 nt, Artificial Sequence
  Description of Artificial Sequence: Synthetic oligonucleotide
ccauucugggaaggcuac

SEQ ID NO: 70699 - RNA, 18 nt, Artificial Sequence
  Description of Artificial Sequence: Synthetic oligonucleotide
uccucccauucugggaag

SEQ ID NO: 70700 - RNA, 18 nt, Artificial Sequence
  Description of Artificial Sequence: Synthetic oligonucleotide
ccugcuccucccauucug

SEQ ID NO: 70701 - RNA, 18 nt, Artificial Sequence
  Description of Artificial Sequence: Synthetic oligonucleotide
ucugcccugcuccuccca

SEQ ID NO: 70702 - RNA, 18 nt, Artificial Sequence
  Description of Artificial Sequence: Synthetic oligonucleotide
ccugcucugcccugcucc

SEQ ID NO: 70703 - RNA, 18 nt, Artificial Sequence
  Description of Artificial Sequence: Synthetic oligonucleotide
cuaccccugcucugcccu

SEQ ID NO: 70704 - RNA, 18 nt, Artificial Sequence
  Description of Artificial Sequence: Synthetic oligonucleotide
acccccuaccccugcucu

SEQ ID NO: 70705 - RNA, 18 nt, Artificial Sequence
  Description of Artificial Sequence: Synthetic oligonucleotide
accccacccccuaccccu

SEQ ID NO: 70706 - RNA, 18 nt, Artificial Sequence
  Description of Artificial Sequence: Synthetic oligonucleotide
ccagcaccccacccccua

SEQ ID NO: 70707 - RNA, 18 nt, Artificial Sequence
  Description of Artificial Sequence: Synthetic oligonucleotide
agaaaccagcaccccacc

SEQ ID NO: 70708 - RNA, 18 nt, Artificial Sequence
  Description of Artificial Sequence: Synthetic oligonucleotide
cccucagaaaccagcacc

SEQ ID NO: 70709 - RNA, 18 nt, Artificial Sequence
  Description of Artificial Sequence: Synthetic oligonucleotide
ucagucccucagaaacca

SEQ ID NO: 70710 - RNA, 18 nt, Artificial Sequence
  Description of Artificial Sequence: Synthetic oligonucleotide
agugaucagucccucaga

SEQ ID NO: 70711 - RNA, 18 nt, Artificial Sequence
  Description of Artificial Sequence: Synthetic oligonucleotide
aaguaagugaucaguccc

SEQ ID NO: 70712 - RNA, 18 nt, Artificial Sequence
  Description of Artificial Sequence: Synthetic oligonucleotide
ccaccaaguaagugauca

SEQ ID NO: 70713 - RNA, 18 nt, Artificial Sequence
  Description of Artificial Sequence: Synthetic oligonucleotide
guauuccaccaaguaagu

SEQ ID NO: 70714 - RNA, 18 nt, Artificial Sequence
  Description of Artificial Sequence: Synthetic oligonucleotide
gugcuguauuccaccaag

SEQ ID NO: 70715 - RNA, 18 nt, Artificial Sequence
  Description of Artificial Sequence: Synthetic oligonucleotide
gggcugugcuguauucca

SEQ ID NO: 70716 - RNA, 18 nt, Artificial Sequence
  Description of Artificial Sequence: Synthetic oligonucleotide
agccagggcugugcugua

SEQ ID NO: 70717 - RNA, 18 nt, Artificial Sequence
  Description of Artificial Sequence: Synthetic oligonucleotide
gggccagccagggcugug

SEQ ID NO: 70718 - RNA, 18 nt, Artificial Sequence
  Description of Artificial Sequence: Synthetic oligonucleotide
ccuuagggccagccaggg

SEQ ID NO: 70719 - RNA, 18 nt, Artificial Sequence
  Description of Artificial Sequence: Synthetic oligonucleotide
ccuuuccuuagggccagc

SEQ ID NO: 70720 - RNA, 18 nt, Artificial Sequence
  Description of Artificial Sequence: Synthetic oligonucleotide
uguccccuuuccuuaggg

SEQ ID NO: 70721 - RNA, 18 nt, Artificial Sequence
  Description of Artificial Sequence: Synthetic oligonucleotide
gcucauguccccuuuccu

SEQ ID NO: 70722 - RNA, 18 nt, Artificial Sequence
  Description of Artificial Sequence: Synthetic oligonucleotide
ccugggcucauguccccu

SEQ ID NO: 70723 - RNA, 18 nt, Artificial Sequence
  Description of Artificial Sequence: Synthetic oligonucleotide
uucucccugggcucaugu

SEQ ID NO: 70724 - RNA, 18 nt, Artificial Sequence
  Description of Artificial Sequence: Synthetic oligonucleotide
uuauuuucucccugggcu

SEQ ID NO: 70725 - RNA, 18 nt, Artificial Sequence
  Description of Artificial Sequence: Synthetic oligonucleotide
cucucuuauuuucucccu

SEQ ID NO: 70726 - RNA, 18 nt, Artificial Sequence
  Description of Artificial Sequence: Synthetic oligonucleotide
gcucccucucuuauuuuc

SEQ ID NO: 70727 - RNA, 18 nt, Artificial Sequence
  Description of Artificial Sequence: Synthetic oligonucleotide
gugcagcucccucucuua

SEQ ID NO: 70728 - RNA, 18 nt, Artificial Sequence
  Description of Artificial Sequence: Synthetic oligonucleotide
ccuaagugcagcucccuc

SEQ ID NO: 70729 - RNA, 18 nt, Artificial Sequence
  Description of Artificial Sequence: Synthetic oligonucleotide
uaagcccuaagugcagcu

SEQ ID NO: 70730 - RNA, 18 nt, Artificial Sequence
  Description of Artificial Sequence: Synthetic oligonucleotide
uuugcuaagcccuaagug

SEQ ID NO: 70731 - RNA, 18 nt, Artificial Sequence
  Description of Artificial Sequence: Synthetic oligonucleotide
cuguguuugcuaagcccu

SEQ ID NO: 70732 - RNA, 18 nt, Artificial Sequence
  Description of Artificial Sequence: Synthetic oligonucleotide
uacuacuguguuugcuaa

SEQ ID NO: 70733 - RNA, 18 nt, Artificial Sequence
  Description of Artificial Sequence: Synthetic oligonucleotide
caucuuacuacuguguuu

SEQ ID NO: 70734 - RNA, 18 nt, Artificial Sequence
  Description of Artificial Sequence: Synthetic oligonucleotide
guguccaucuuacuacug

SEQ ID NO: 70735 - RNA, 18 nt, Artificial Sequence
  Description of Artificial Sequence: Synthetic oligonucleotide
gggcuguguccaucuuac

SEQ ID NO: 70736 - RNA, 18 nt, Artificial Sequence
  Description of Artificial Sequence: Synthetic oligonucleotide
aaugaccagcuaagaaug

SEQ ID NO: 70737 - RNA, 18 nt, Artificial Sequence
  Description of Artificial Sequence: Synthetic oligonucleotide
cgaggaaugaccagcuaa

SEQ ID NO: 70738 - RNA, 18 nt, Artificial Sequence
  Description of Artificial Sequence: Synthetic oligonucleotide
gcuaacgaggaaugacca

SEQ ID NO: 70739 - RNA, 18 nt, Artificial Sequence
  Description of Artificial Sequence: Synthetic oligonucleotide
cuuaagcuaacgaggaau

SEQ ID NO: 70740 - RNA, 18 nt, Artificial Sequence
  Description of Artificial Sequence: Synthetic oligonucleotide
agaaccuuaagcuaacga

SEQ ID NO: 70741 - RNA, 18 nt, Artificial Sequence
  Description of Artificial Sequence: Synthetic oligonucleotide
gauucagaaccuuaagcu

SEQ ID NO: 70742 - RNA, 18 nt, Artificial Sequence
  Description of Artificial Sequence: Synthetic oligonucleotide
caccagauucagaaccuu

SEQ ID NO: 70743 - RNA, 18 nt, Artificial Sequence
  Description of Artificial Sequence: Synthetic oligonucleotide
cccagcaccagauucaga

SEQ ID NO: 70744 - RNA, 18 nt, Artificial Sequence
  Description of Artificial Sequence: Synthetic oligonucleotide
gcuuccccagcaccagau

SEQ ID NO: 70745 - RNA, 18 nt, Artificial Sequence
  Description of Artificial Sequence: Synthetic oligonucleotide
gcccagcuuccccagcac

SEQ ID NO: 70746 - RNA, 18 nt, Artificial Sequence
  Description of Artificial Sequence: Synthetic oligonucleotide
gccuggcccagcuucccc

SEQ ID NO: 70747 - RNA, 18 nt, Artificial Sequence
  Description of Artificial Sequence: Synthetic oligonucleotide
ggcuugccuggcccagcu

SEQ ID NO: 70748 - RNA, 18 nt, Artificial Sequence
  Description of Artificial Sequence: Synthetic oligonucleotide
gcccuggcuugccuggcc

SEQ ID NO: 70749 - RNA, 18 nt, Artificial Sequence
  Description of Artificial Sequence: Synthetic oligonucleotide
cuugcgcccuggcuugcc

SEQ ID NO: 70750 - RNA, 18 nt, Artificial Sequence
  Description of Artificial Sequence: Synthetic oligonucleotide
cucuccuugcgcccuggc

SEQ ID NO: 70751 - RNA, 18 nt, Artificial Sequence
  Description of Artificial Sequence: Synthetic oligonucleotide
uuacccucuccuugcgcc

SEQ ID NO: 70752 - RNA, 18 nt, Artificial Sequence
  Description of Artificial Sequence: Synthetic oligonucleotide
ucccauuacccucuccuu

SEQ ID NO: 70753 - RNA, 18 nt, Artificial Sequence
  Description of Artificial Sequence: Synthetic oligonucleotide
ccuccucccauuacccuc

SEQ ID NO: 70754 - RNA, 18 nt, Artificial Sequence
  Description of Artificial Sequence: Synthetic oligonucleotide
ugggcccuccucccauua

SEQ ID NO: 70755 - RNA, 18 nt, Artificial Sequence
  Description of Artificial Sequence: Synthetic oligonucleotide
augagugggcccuccucc

SEQ ID NO: 70756 - RNA, 18 nt, Artificial Sequence
  Description of Artificial Sequence: Synthetic oligonucleotide
ucaacaugagugggcccu

SEQ ID NO: 70757 - RNA, 18 nt, Artificial Sequence
  Description of Artificial Sequence: Synthetic oligonucleotide
gucugucaacaugagugg

SEQ ID NO: 70758 - RNA, 18 nt, Artificial Sequence
  Description of Artificial Sequence: Synthetic oligonucleotide
uguaggucugucaacaug

SEQ ID NO: 70759 - RNA, 18 nt, Artificial Sequence
  Description of Artificial Sequence: Synthetic oligonucleotide
uuuccuguaggucuguca

SEQ ID NO: 70760 - RNA, 18 nt, Artificial Sequence
  Description of Artificial Sequence: Synthetic oligonucleotide
ugggauuuccuguagguc

SEQ ID NO: 70761 - RNA, 18 nt, Artificial Sequence
  Description of Artificial Sequence: Synthetic oligonucleotide
aauauugggauuuccugu

SEQ ID NO: 70762 - RNA, 18 nt, Artificial Sequence
  Description of Artificial Sequence: Synthetic oligonucleotide
gauucaauauugggauuu

SEQ ID NO: 70763 - RNA, 18 nt, Artificial Sequence
  Description of Artificial Sequence: Synthetic oligonucleotide
caccugauucaauauugg

SEQ ID NO: 70764 - RNA, 18 nt, Artificial Sequence
  Description of Artificial Sequence: Synthetic oligonucleotide
gcuugcaccugauucaau

SEQ ID NO: 70765 - RNA, 18 nt, Artificial Sequence
  Description of Artificial Sequence: Synthetic oligonucleotide
aagaggcuugcaccugau

SEQ ID NO: 70766 - RNA, 18 nt, Artificial Sequence
  Description of Artificial Sequence: Synthetic oligonucleotide
gugcaaagaggcuugcac

SEQ ID NO: 70767 - RNA, 18 nt, Artificial Sequence
  Description of Artificial Sequence: Synthetic oligonucleotide
aaguugugcaaagaggcu

SEQ ID NO: 70768 - RNA, 18 nt, Artificial Sequence
  Description of Artificial Sequence: Synthetic oligonucleotide
uucacaaguugugcaaag

SEQ ID NO: 70769 - RNA, 18 nt, Artificial Sequence
  Description of Artificial Sequence: Synthetic oligonucleotide
ucuccuuuuugucaggac

SEQ ID NO: 70770 - RNA, 18 nt, Artificial Sequence
  Description of Artificial Sequence: Synthetic oligonucleotide
uggugucuccuuuuuguc

SEQ ID NO: 70771 - RNA, 18 nt, Artificial Sequence
  Description of Artificial Sequence: Synthetic oligonucleotide
gcauauggugucuccuuu

SEQ ID NO: 70772 - RNA, 18 nt, Artificial Sequence
  Description of Artificial Sequence: Synthetic oligonucleotide
agaaagcauauggugucu

SEQ ID NO: 70773 - RNA, 18 nt, Artificial Sequence
  Description of Artificial Sequence: Synthetic oligonucleotide
aagcaagaaagcauaugg

SEQ ID NO: 70774 - RNA, 18 nt, Artificial Sequence
  Description of Artificial Sequence: Synthetic oligonucleotide
aaagaaagcaagaaagca

SEQ ID NO: 70775 - RNA, 18 nt, Artificial Sequence
  Description of Artificial Sequence: Synthetic oligonucleotide
gaaagaaagaaagcaaga

SEQ ID NO: 70776 - RNA, 18 nt, Artificial Sequence
  Description of Artificial Sequence: Synthetic oligonucleotide
agaaagaaagaaagaaag

SEQ ID NO: 70777 - RNA, 18 nt, Artificial Sequence
  Description of Artificial Sequence: Synthetic oligonucleotide
aagaaagaaagaaagaaa

SEQ ID NO: 70778 - RNA, 18 nt, Artificial Sequence
  Description of Artificial Sequence: Synthetic oligonucleotide
aaagaaagaaagaaagaa

SEQ ID NO: 70779 - RNA, 18 nt, Artificial Sequence
  Description of Artificial Sequence: Synthetic oligonucleotide
aaaaaaaagaaagaaaga

SEQ ID NO: 70780 - RNA, 18 nt, Artificial Sequence
  Description of Artificial Sequence: Synthetic oligonucleotide
caaaaaaaaaaaagaaag

SEQ ID NO: 70781 - RNA, 18 nt, Artificial Sequence
  Description of Artificial Sequence: Synthetic oligonucleotide
cgucucaaaaaaaaaaaa

SEQ ID NO: 70782 - RNA, 18 nt, Artificial Sequence
  Description of Artificial Sequence: Synthetic oligonucleotide
aacuccgucucaaaaaaa

SEQ ID NO: 70783 - RNA, 18 nt, Artificial Sequence
  Description of Artificial Sequence: Synthetic oligonucleotide
agugaaacuccgucucaa

SEQ ID NO: 70784 - RNA, 18 nt, Artificial Sequence
  Description of Artificial Sequence: Synthetic oligonucleotide
auaagagugaaacuccgu

SEQ ID NO: 70785 - RNA, 18 nt, Artificial Sequence
  Description of Artificial Sequence: Synthetic oligonucleotide
gggcaauaagagugaaac

SEQ ID NO: 70786 - RNA, 18 nt, Artificial Sequence
  Description of Artificial Sequence: Synthetic oligonucleotide
agccugggcaauaagagu

SEQ ID NO: 70787 - RNA, 18 nt, Artificial Sequence
  Description of Artificial Sequence: Synthetic oligonucleotide
acuccagccugggcaaua

SEQ ID NO: 70788 - RNA, 18 nt, Artificial Sequence
  Description of Artificial Sequence: Synthetic oligonucleotide
auugcacuccagccuggg

SEQ ID NO: 70789 - RNA, 18 nt, Artificial Sequence
  Description of Artificial Sequence: Synthetic oligonucleotide
gcaccauugcacuccagc

SEQ ID NO: 70790 - RNA, 18 nt, Artificial Sequence
  Description of Artificial Sequence: Synthetic oligonucleotide
agaucgcaccauugcacu

SEQ ID NO: 70791 - RNA, 18 nt, Artificial Sequence
  Description of Artificial Sequence: Synthetic oligonucleotide
agccgagaucgcaccauu

SEQ ID NO: 70792 - RNA, 18 nt, Artificial Sequence
  Description of Artificial Sequence: Synthetic oligonucleotide
uggugagccgagaucgca

SEQ ID NO: 70793 - RNA, 18 nt, Artificial Sequence
  Description of Artificial Sequence: Synthetic oligonucleotide
gguuguggugagccgaga

SEQ ID NO: 70794 - RNA, 18 nt, Artificial Sequence
  Description of Artificial Sequence: Synthetic oligonucleotide
gcggagguuguggugagc

SEQ ID NO: 70795 - RNA, 18 nt, Artificial Sequence
  Description of Artificial Sequence: Synthetic oligonucleotide
gggaggcggagguugugg

SEQ ID NO: 70796 - RNA, 18 nt, Artificial Sequence
  Description of Artificial Sequence: Synthetic oligonucleotide
uaccugggaggcggaggu

SEQ ID NO: 70797 - RNA, 18 nt, Artificial Sequence
  Description of Artificial Sequence: Synthetic oligonucleotide
gcuuguaccugggaggcg

SEQ ID NO: 70798 - RNA, 18 nt, Artificial Sequence
  Description of Artificial Sequence: Synthetic oligonucleotide
gaaucgcuuguaccuggg

SEQ ID NO: 70799 - RNA, 18 nt, Artificial Sequence
  Description of Artificial Sequence: Synthetic oligonucleotide
caggagaaucgcuuguac

SEQ ID NO: 70800 - RNA, 18 nt, Artificial Sequence
  Description of Artificial Sequence: Synthetic oligonucleotide
ugagacaggagaaucgcu

SEQ ID NO: 70801 - RNA, 18 nt, Artificial Sequence
  Description of Artificial Sequence: Synthetic oligonucleotide
gaggcugagacaggagaa

SEQ ID NO: 70802 - RNA, 18 nt, Artificial Sequence
  Description of Artificial Sequence: Synthetic oligonucleotide
cuugggaggcugagacag

SEQ ID NO: 70803 - RNA, 18 nt, Artificial Sequence
  Description of Artificial Sequence: Synthetic oligonucleotide
agcuacuugggaggcuga

SEQ ID NO: 70804 - RNA, 18 nt, Artificial Sequence
  Description of Artificial Sequence: Synthetic oligonucleotide
auccaagcuacuugggag

SEQ ID NO: 70805 - RNA, 18 nt, Artificial Sequence
  Description of Artificial Sequence: Synthetic oligonucleotide
cuguaauccaagcuacuu

SEQ ID NO: 70806 - RNA, 18 nt, Artificial Sequence
  Description of Artificial Sequence: Synthetic oligonucleotide
caugccuguaauccaagc

SEQ ID NO: 70807 - RNA, 18 nt, Artificial Sequence
  Description of Artificial Sequence: Synthetic oligonucleotide
ugguucaugccuguaauc

SEQ ID NO: 70808 - RNA, 18 nt, Artificial Sequence
  Description of Artificial Sequence: Synthetic oligonucleotide
uguggugguucaugccug

SEQ ID NO: 70809 - RNA, 18 nt, Artificial Sequence
  Description of Artificial Sequence: Synthetic oligonucleotide
caggguguggugguucau

SEQ ID NO: 70810 - RNA, 18 nt, Artificial Sequence
  Description of Artificial Sequence: Synthetic oligonucleotide
acuagcaggguguggugg

SEQ ID NO: 70811 - RNA, 18 nt, Artificial Sequence
  Description of Artificial Sequence: Synthetic oligonucleotide
aaaaaacuagcagggugu

SEQ ID NO: 70812 - RNA, 18 nt, Artificial Sequence
  Description of Artificial Sequence: Synthetic oligonucleotide
auacaaaaaaacuagcag

SEQ ID NO: 70813 - RNA, 18 nt, Artificial Sequence
  Description of Artificial Sequence: Synthetic oligonucleotide
acgaaauacaaaaaaacu

SEQ ID NO: 70814 - RNA, 18 nt, Artificial Sequence
  Description of Artificial Sequence: Synthetic oligonucleotide
gcucuacgaaauacaaaa

SEQ ID NO: 70815 - RNA, 18 nt, Artificial Sequence
  Description of Artificial Sequence: Synthetic oligonucleotide
ccccggcucuacgaaaua

SEQ ID NO: 70816 - RNA, 18 nt, Artificial Sequence
  Description of Artificial Sequence: Synthetic oligonucleotide
ugaaaccccggcucuacg

SEQ ID NO: 70817 - RNA, 18 nt, Artificial Sequence
  Description of Artificial Sequence: Synthetic oligonucleotide
cauggugaaaccccggcu

SEQ ID NO: 70818 - RNA, 18 nt, Artificial Sequence
  Description of Artificial Sequence: Synthetic oligonucleotide
acuaacauggugaaaccc

SEQ ID NO: 70819 - RNA, 18 nt, Artificial Sequence
  Description of Artificial Sequence: Synthetic oligonucleotide
gccucacuaacaugguga

SEQ ID NO: 70820 - RNA, 18 nt, Artificial Sequence
  Description of Artificial Sequence: Synthetic oligonucleotide
caccagccucacuaacau

SEQ ID NO: 70821 - RNA, 18 nt, Artificial Sequence
  Description of Artificial Sequence: Synthetic oligonucleotide
uucgccaccagccucacu

SEQ ID NO: 70822 - RNA, 18 nt, Artificial Sequence
  Description of Artificial Sequence: Synthetic oligonucleotide
aggaguucgccaccagcc

SEQ ID NO: 70823 - RNA, 18 nt, Artificial Sequence
  Description of Artificial Sequence: Synthetic oligonucleotide
aggucaggaguucgccac

SEQ ID NO: 70824 - RNA, 18 nt, Artificial Sequence
  Description of Artificial Sequence: Synthetic oligonucleotide
accugaggucaggaguuc

SEQ ID NO: 70825 - RNA, 18 nt, Artificial Sequence
  Description of Artificial Sequence: Synthetic oligonucleotide
ggaucaccugaggucagg

SEQ ID NO: 70826 - RNA, 18 nt, Artificial Sequence
  Description of Artificial Sequence: Synthetic oligonucleotide
cggguggaucaccugagg

SEQ ID NO: 70827 - RNA, 18 nt, Artificial Sequence
  Description of Artificial Sequence: Synthetic oligonucleotide
caaggcggguggaucacc

SEQ ID NO: 70828 - RNA, 18 nt, Artificial Sequence
  Description of Artificial Sequence: Synthetic oligonucleotide
gaguccaaggcgggugga

SEQ ID NO: 70829 - RNA, 18 nt, Artificial Sequence
  Description of Artificial Sequence: Synthetic oligonucleotide
uuugggaguccaaggcgg

SEQ ID NO: 70830 - RNA, 18 nt, Artificial Sequence
  Description of Artificial Sequence: Synthetic oligonucleotide
agcacuuugggaguccaa

SEQ ID NO: 70831 - RNA, 18 nt, Artificial Sequence
  Description of Artificial Sequence: Synthetic oligonucleotide
aucccagcacuuugggag

SEQ ID NO: 70832 - RNA, 18 nt, Artificial Sequence
  Description of Artificial Sequence: Synthetic oligonucleotide
cuguaaucccagcacuuu

SEQ ID NO: 70833 - RNA, 18 nt, Artificial Sequence
  Description of Artificial Sequence: Synthetic oligonucleotide
caugccuguaaucccagc

SEQ ID NO: 70834 - RNA, 18 nt, Artificial Sequence
  Description of Artificial Sequence: Synthetic oligonucleotide
uggcucaugccuguaauc

SEQ ID NO: 70835 - RNA, 18 nt, Artificial Sequence
  Description of Artificial Sequence: Synthetic oligonucleotide
ugcaguggcucaugccug

SEQ ID NO: 70836 - RNA, 18 nt, Artificial Sequence
  Description of Artificial Sequence: Synthetic oligonucleotide
ccgggugcaguggcucau

SEQ ID NO: 70837 - RNA, 18 nt, Artificial Sequence
  Description of Artificial Sequence: Synthetic oligonucleotide
gugugccgggugcagugg

SEQ ID NO: 70838 - RNA, 18 nt, Artificial Sequence
  Description of Artificial Sequence: Synthetic oligonucleotide
auauggugugccgggugc

SEQ ID NO: 70839 - RNA, 18 nt, Artificial Sequence
  Description of Artificial Sequence: Synthetic oligonucleotide
aaagcauauggugugccg

SEQ ID NO: 70840 - RNA, 18 nt, Artificial Sequence
  Description of Artificial Sequence: Synthetic oligonucleotide
ugaugaaagcauauggug

SEQ ID NO: 70841 - RNA, 18 nt, Artificial Sequence
  Description of Artificial Sequence: Synthetic oligonucleotide
ucuugugaugaaagcaua

SEQ ID NO: 70842 - RNA, 18 nt, Artificial Sequence
  Description of Artificial Sequence: Synthetic oligonucleotide
cauuuucuugugaugaaa

SEQ ID NO: 70843 - RNA, 18 nt, Artificial Sequence
  Description of Artificial Sequence: Synthetic oligonucleotide
ucucacauuuucuuguga

SEQ ID NO: 70844 - RNA, 18 nt, Artificial Sequence
  Description of Artificial Sequence: Synthetic oligonucleotide
aauucucucacauuuucu

SEQ ID NO: 70845 - RNA, 18 nt, Artificial Sequence
  Description of Artificial Sequence: Synthetic oligonucleotide
cccugaauucucucacau

SEQ ID NO: 70846 - RNA, 18 nt, Artificial Sequence
  Description of Artificial Sequence: Synthetic oligonucleotide
caaagcccugaauucucu

SEQ ID NO: 70847 - RNA, 18 nt, Artificial Sequence
  Description of Artificial Sequence: Synthetic oligonucleotide
acugccaaagcccugaau

SEQ ID NO: 70848 - RNA, 18 nt, Artificial Sequence
  Description of Artificial Sequence: Synthetic oligonucleotide
cuggaacugccaaagccc

SEQ ID NO: 70849 - RNA, 18 nt, Artificial Sequence
  Description of Artificial Sequence: Synthetic oligonucleotide
ccagccuggaacugccaa

SEQ ID NO: 70850 - RNA, 18 nt, Artificial Sequence
  Description of Artificial Sequence: Synthetic oligonucleotide
gcugaccagccuggaacu

SEQ ID NO: 70851 - RNA, 18 nt, Artificial Sequence
  Description of Artificial Sequence: Synthetic oligonucleotide
gagaugcugaccagccug

SEQ ID NO: 70852 - RNA, 18 nt, Artificial Sequence
  Description of Artificial Sequence: Synthetic oligonucleotide
ggcuugagaugcugacca

SEQ ID NO: 70853 - RNA, 18 nt, Artificial Sequence
  Description of Artificial Sequence: Synthetic oligonucleotide
gggagggcuugagaugcu

SEQ ID NO: 70854 - RNA, 18 nt, Artificial Sequence
  Description of Artificial Sequence: Synthetic oligonucleotide
gggugaacagaugcuggg

SEQ ID NO: 70855 - RNA, 18 nt, Artificial Sequence
  Description of Artificial Sequence: Synthetic oligonucleotide
ggcagggugaacagaugc

SEQ ID NO: 70856 - RNA, 18 nt, Artificial Sequence
  Description of Artificial Sequence: Synthetic oligonucleotide
ugccuggcagggugaaca

SEQ ID NO: 70857 - RNA, 18 nt, Artificial Sequence
  Description of Artificial Sequence: Synthetic oligonucleotide
gagacugccuggcagggu

SEQ ID NO: 70858 - RNA, 18 nt, Artificial Sequence
  Description of Artificial Sequence: Synthetic oligonucleotide
aggaagagacugccuggc

SEQ ID NO: 70859 - RNA, 18 nt, Artificial Sequence
  Description of Artificial Sequence: Synthetic oligonucleotide
uuucuaggaagagacugc

SEQ ID NO: 70860 - RNA, 18 nt, Artificial Sequence
  Description of Artificial Sequence: Synthetic oligonucleotide
ccaaguuucuaggaagag

SEQ ID NO: 70861 - RNA, 18 nt, Artificial Sequence
  Description of Artificial Sequence: Synthetic oligonucleotide
uuuaaccaaguuucuagg

SEQ ID NO: 70862 - RNA, 18 nt, Artificial Sequence
  Description of Artificial Sequence: Synthetic oligonucleotide
gaacauuuaaccaaguuu

SEQ ID NO: 70863 - RNA, 18 nt, Artificial Sequence
  Description of Artificial Sequence: Synthetic oligonucleotide
agagugaacauuuaacca

SEQ ID NO: 70864 - RNA, 18 nt, Artificial Sequence
  Description of Artificial Sequence: Synthetic oligonucleotide
caagggugaagaaucuau

SEQ ID NO: 70865 - RNA, 18 nt, Artificial Sequence
  Description of Artificial Sequence: Synthetic oligonucleotide
cgggccaagggugaagaa

SEQ ID NO: 70866 - RNA, 18 nt, Artificial Sequence
  Description of Artificial Sequence: Synthetic oligonucleotide
aaaggcgggccaagggug

SEQ ID NO: 70867 - RNA, 18 nt, Artificial Sequence
  Description of Artificial Sequence: Synthetic oligonucleotide
gggcaaaggcgggccaag

SEQ ID NO: 70868 - RNA, 18 nt, Artificial Sequence
  Description of Artificial Sequence: Synthetic oligonucleotide
ugggcagaguaggguggg

SEQ ID NO: 70869 - RNA, 18 nt, Artificial Sequence
  Description of Artificial Sequence: Synthetic oligonucleotide
acuucugggcagaguagg

SEQ ID NO: 70870 - RNA, 18 nt, Artificial Sequence
  Description of Artificial Sequence: Synthetic oligonucleotide
cuugcacuucugggcaga

SEQ ID NO: 70871 - RNA, 18 nt, Artificial Sequence
  Description of Artificial Sequence: Synthetic oligonucleotide
aggcucuugcacuucugg

SEQ ID NO: 70872 - RNA, 18 nt, Artificial Sequence
  Description of Artificial Sequence: Synthetic oligonucleotide
ggcuuaggcucuugcacu

SEQ ID NO: 70873 - RNA, 18 nt, Artificial Sequence
  Description of Artificial Sequence: Synthetic oligonucleotide
gaggcggcuuaggcucuu

SEQ ID NO: 70874 - RNA, 18 nt, Artificial Sequence
  Description of Artificial Sequence: Synthetic oligonucleotide
ccauggaggcggcuuagg

SEQ ID NO: 70875 - RNA, 18 nt, Artificial Sequence
  Description of Artificial Sequence: Synthetic oligonucleotide
gggccauggaggcggcuu

SEQ ID NO: 70876 - RNA, 18 nt, Artificial Sequence
  Description of Artificial Sequence: Synthetic oligonucleotide
cccugaauccuuccuggg

SEQ ID NO: 70877 - RNA, 18 nt, Artificial Sequence
  Description of Artificial Sequence: Synthetic oligonucleotide
cucuccccugaauccuuc

SEQ ID NO: 70878 - RNA, 18 nt, Artificial Sequence
  Description of Artificial Sequence: Synthetic oligonucleotide
gggccucuccccugaauc

SEQ ID NO: 70879 - RNA, 18 nt, Artificial Sequence
  Description of Artificial Sequence: Synthetic oligonucleotide
cguggcucccuguuuggg

SEQ ID NO: 70880 - RNA, 18 nt, Artificial Sequence
  Description of Artificial Sequence: Synthetic oligonucleotide
gcuggcguggcucccugu

SEQ ID NO: 70881 - RNA, 18 nt, Artificial Sequence
  Description of Artificial Sequence: Synthetic oligonucleotide
gucuggcuggcguggcuc

SEQ ID NO: 70882 - RNA, 18 nt, Artificial Sequence
  Description of Artificial Sequence: Synthetic oligonucleotide
gggugucuggcuggcgug

SEQ ID NO: 70883 - RNA, 18 nt, Artificial Sequence
  Description of Artificial Sequence: Synthetic oligonucleotide
agcuccauucuggccggg

SEQ ID NO: 70884 - RNA, 18 nt, Artificial Sequence
  Description of Artificial Sequence: Synthetic oligonucleotide
cagucagcuccauucugg

SEQ ID NO: 70885 - RNA, 18 nt, Artificial Sequence
  Description of Artificial Sequence: Synthetic oligonucleotide
aagggugaagaaucuauc

SEQ ID NO: 70886 - RNA, 18 nt, Artificial Sequence
  Description of Artificial Sequence: Synthetic oligonucleotide
gggccaagggugaagaau

SEQ ID NO: 70887 - RNA, 18 nt, Artificial Sequence
  Description of Artificial Sequence: Synthetic oligonucleotide
aaggcgggccaaggguga

SEQ ID NO: 70888 - RNA, 18 nt, Artificial Sequence
  Description of Artificial Sequence: Synthetic oligonucleotide
gggcaaaggcgggccaag

SEQ ID NO: 70889 - RNA, 18 nt, Artificial Sequence
  Description of Artificial Sequence: Synthetic oligonucleotide
ugggcagaguaggguggg

SEQ ID NO: 70890 - RNA, 18 nt, Artificial Sequence
  Description of Artificial Sequence: Synthetic oligonucleotide
uucugggcagaguagggu

SEQ ID NO: 70891 - RNA, 18 nt, Artificial Sequence
  Description of Artificial Sequence: Synthetic oligonucleotide
ugcacuucugggcagagu

SEQ ID NO: 70892 - RNA, 18 nt, Artificial Sequence
  Description of Artificial Sequence: Synthetic oligonucleotide
gcucuugcacuucugggc

SEQ ID NO: 70893 - RNA, 18 nt, Artificial Sequence
  Description of Artificial Sequence: Synthetic oligonucleotide
cuuaggcucuugcacuuc

SEQ ID NO: 70894 - RNA, 18 nt, Artificial Sequence
  Description of Artificial Sequence: Synthetic oligonucleotide
ggcggcuuaggcucuugc

SEQ ID NO: 70895 - RNA, 18 nt, Artificial Sequence
  Description of Artificial Sequence: Synthetic oligonucleotide
auggaggcggcuuaggcu

SEQ ID NO: 70896 - RNA, 18 nt, Artificial Sequence
  Description of Artificial Sequence: Synthetic oligonucleotide
gggccauggaggcggcuu

SEQ ID NO: 70897 - RNA, 18 nt, Artificial Sequence
  Description of Artificial Sequence: Synthetic oligonucleotide
cccugaauccuuccuggg

SEQ ID NO: 70898 - RNA, 18 nt, Artificial Sequence
  Description of Artificial Sequence: Synthetic oligonucleotide
ucuccccugaauccuucc

SEQ ID NO: 70899 - RNA, 18 nt, Artificial Sequence
  Description of Artificial Sequence: Synthetic oligonucleotide
gggccucuccccugaauc

SEQ ID NO: 70900 - RNA, 18 nt, Artificial Sequence
  Description of Artificial Sequence: Synthetic oligonucleotide
cguggcucccuguuuggg

SEQ ID NO: 70901 - RNA, 18 nt, Artificial Sequence
  Description of Artificial Sequence: Synthetic oligonucleotide
cuggcguggcucccuguu

SEQ ID NO: 70902 - RNA, 18 nt, Artificial Sequence
  Description of Artificial Sequence: Synthetic oligonucleotide
ucuggcuggcguggcucc

SEQ ID NO: 70903 - RNA, 18 nt, Artificial Sequence
  Description of Artificial Sequence: Synthetic oligonucleotide
gggugucuggcuggcgug

SEQ ID NO: 70904 - RNA, 18 nt, Artificial Sequence
  Description of Artificial Sequence: Synthetic oligonucleotide
agcuccauucuggccggg

SEQ ID NO: 70905 - RNA, 18 nt, Artificial Sequence
  Description of Artificial Sequence: Synthetic oligonucleotide
ucagcuccauucuggccg

SEQ ID NO: 70906 - RNA, 18 nt, Artificial Sequence
  Description of Artificial Sequence: Synthetic oligonucleotide
uagccccucagguguguu

SEQ ID NO: 70907 - RNA, 18 nt, Artificial Sequence
  Description of Artificial Sequence: Synthetic oligonucleotide
ggcccuagccccucaggu

SEQ ID NO: 70908 - RNA, 18 nt, Artificial Sequence
  Description of Artificial Sequence: Synthetic oligonucleotide
cauauggcccuagccccu

SEQ ID NO: 70909 - RNA, 18 nt, Artificial Sequence
  Description of Artificial Sequence: Synthetic oligonucleotide
guuuccauauggcccuag

SEQ ID NO: 70910 - RNA, 18 nt, Artificial Sequence
  Description of Artificial Sequence: Synthetic oligonucleotide
gucauguuuccauauggc

SEQ ID NO: 70911 - RNA, 18 nt, Artificial Sequence
  Description of Artificial Sequence: Synthetic oligonucleotide
cuucugucauguuuccau

SEQ ID NO: 70912 - RNA, 18 nt, Artificial Sequence
  Description of Artificial Sequence: Synthetic oligonucleotide
cuccccuucugucauguu

SEQ ID NO: 70913 - RNA, 18 nt, Artificial Sequence
  Description of Artificial Sequence: Synthetic oligonucleotide
ucucucuccccuucuguc

SEQ ID NO: 70914 - RNA, 18 nt, Artificial Sequence
  Description of Artificial Sequence: Synthetic oligonucleotide
uccuuucucucuccccuu

SEQ ID NO: 70915 - RNA, 18 nt, Artificial Sequence
  Description of Artificial Sequence: Synthetic oligonucleotide
gugucuccuuucucucuc

SEQ ID NO: 70916 - RNA, 18 nt, Artificial Sequence
  Description of Artificial Sequence: Synthetic oligonucleotide
gcagcgugucuccuuucu

SEQ ID NO: 70917 - RNA, 18 nt, Artificial Sequence
  Description of Artificial Sequence: Synthetic oligonucleotide
ccccugcagcgugucucc

SEQ ID NO: 70918 - RNA, 18 nt, Artificial Sequence
  Description of Artificial Sequence: Synthetic oligonucleotide
ccugcccccugcagcgug

SEQ ID NO: 70919 - RNA, 18 nt, Artificial Sequence
  Description of Artificial Sequence: Synthetic oligonucleotide
agcuuccugcccccugca

SEQ ID NO: 70920 - RNA, 18 nt, Artificial Sequence
  Description of Artificial Sequence: Synthetic oligonucleotide
cccccagcuuccugcccc

SEQ ID NO: 70921 - RNA, 18 nt, Artificial Sequence
  Description of Artificial Sequence: Synthetic oligonucleotide
ggguucccccagcuuccu

SEQ ID NO: 70922 - RNA, 18 nt, Artificial Sequence
  Description of Artificial Sequence: Synthetic oligonucleotide
agaauggguucccccagc

SEQ ID NO: 70923 - RNA, 18 nt, Artificial Sequence
  Description of Artificial Sequence: Synthetic oligonucleotide
uugggagaauggguuccc

SEQ ID NO: 70924 - RNA, 18 nt, Artificial Sequence
  Description of Artificial Sequence: Synthetic oligonucleotide
uauuuuugggagaauggg

SEQ ID NO: 70925 - RNA, 18 nt, Artificial Sequence
  Description of Artificial Sequence: Synthetic oligonucleotide
ccccuuauuuuugggaga

SEQ ID NO: 70926 - RNA, 18 nt, Artificial Sequence
  Description of Artificial Sequence: Synthetic oligonucleotide
ucagaccccuuauuuuug

SEQ ID NO: 70927 - RNA, 18 nt, Artificial Sequence
  Description of Artificial Sequence: Synthetic oligonucleotide
accccucagaccccuuau

SEQ ID NO: 70928 - RNA, 18 nt, Artificial Sequence
  Description of Artificial Sequence: Synthetic oligonucleotide
aauccaccccucagaccc

SEQ ID NO: 70929 - RNA, 18 nt, Artificial Sequence
  Description of Artificial Sequence: Synthetic oligonucleotide
cagggaauccaccccuca

SEQ ID NO: 70930 - RNA, 18 nt, Artificial Sequence
  Description of Artificial Sequence: Synthetic oligonucleotide
aaacccagggaauccacc

SEQ ID NO: 70931 - RNA, 18 nt, Artificial Sequence
  Description of Artificial Sequence: Synthetic oligonucleotide
gggagaauggguuccccc

SEQ ID NO: 70932 - RNA, 18 nt, Artificial Sequence
  Description of Artificial Sequence: Synthetic oligonucleotide
uuuuugggagaauggguu

SEQ ID NO: 70933 - RNA, 18 nt, Artificial Sequence
  Description of Artificial Sequence: Synthetic oligonucleotide
ccuuauuuuugggagaau

SEQ ID NO: 70934 - RNA, 18 nt, Artificial Sequence
  Description of Artificial Sequence: Synthetic oligonucleotide
agaccccuuauuuuuggg

SEQ ID NO: 70935 - RNA, 18 nt, Artificial Sequence
  Description of Artificial Sequence: Synthetic oligonucleotide
cccucagaccccuuauuu

SEQ ID NO: 70936 - RNA, 18 nt, Artificial Sequence
  Description of Artificial Sequence: Synthetic oligonucleotide
uccaccccucagaccccu

SEQ ID NO: 70937 - RNA, 18 nt, Artificial Sequence
  Description of Artificial Sequence: Synthetic oligonucleotide
gggaauccaccccucaga

SEQ ID NO: 70938 - RNA, 18 nt, Artificial Sequence
  Description of Artificial Sequence: Synthetic oligonucleotide
acccagggaauccacccc

SEQ ID NO: 70939 - RNA, 18 nt, Artificial Sequence
  Description of Artificial Sequence: Synthetic oligonucleotide
cugaaacccagggaaucc

SEQ ID NO: 70940 - RNA, 18 nt, Artificial Sequence
  Description of Artificial Sequence: Synthetic oligonucleotide
cagaccugaaacccaggg

SEQ ID NO: 70941 - RNA, 18 nt, Artificial Sequence
  Description of Artificial Sequence: Synthetic oligonucleotide
ggacccagaccugaaacc

SEQ ID NO: 70942 - RNA, 18 nt, Artificial Sequence
  Description of Artificial Sequence: Synthetic oligonucleotide
auucaggacccagaccug

SEQ ID NO: 70943 - RNA, 18 nt, Artificial Sequence
  Description of Artificial Sequence: Synthetic oligonucleotide
uucccauucaggacccag

SEQ ID NO: 70944 - RNA, 18 nt, Artificial Sequence
  Description of Artificial Sequence: Synthetic oligonucleotide
aggaauucccauucagga

SEQ ID NO: 70945 - RNA, 18 nt, Artificial Sequence
  Description of Artificial Sequence: Synthetic oligonucleotide
auuccaggaauucccauu

SEQ ID NO: 70946 - RNA, 18 nt, Artificial Sequence
  Description of Artificial Sequence: Synthetic oligonucleotide
cugguauuccaggaauuc

SEQ ID NO: 70947 - RNA, 18 nt, Artificial Sequence
  Description of Artificial Sequence: Synthetic oligonucleotide
gucagcugguauuccagg

SEQ ID NO: 70948 - RNA, 18 nt, Artificial Sequence
  Description of Artificial Sequence: Synthetic oligonucleotide
ucauugucagcugguauu

SEQ ID NO: 70949 - RNA, 18 nt, Artificial Sequence
  Description of Artificial Sequence: Synthetic oligonucleotide
ggaaaucauugucagcug

SEQ ID NO: 70950 - RNA, 18 nt, Artificial Sequence
  Description of Artificial Sequence: Synthetic oligonucleotide
gaggaggaaaucauuguc

SEQ ID NO: 70951 - RNA, 18 nt, Artificial Sequence
  Description of Artificial Sequence: Synthetic oligonucleotide
aagaugaggaggaaauca

SEQ ID NO: 70952 - RNA, 18 nt, Artificial Sequence
  Description of Artificial Sequence: Synthetic oligonucleotide
guugaaagaugaggagga

SEQ ID NO: 70953 - RNA, 18 nt, Artificial Sequence
  Description of Artificial Sequence: Synthetic oligonucleotide
gugagguugaaagaugag

SEQ ID NO: 70954 - RNA, 18 nt, Artificial Sequence
  Description of Artificial Sequence: Synthetic oligonucleotide
augaccacgaggagcaau

SEQ ID NO: 70955 - RNA, 18 nt, Artificial Sequence
  Description of Artificial Sequence: Synthetic oligonucleotide
gaagcaugaccacgagga

SEQ ID NO: 70956 - RNA, 18 nt, Artificial Sequence
  Description of Artificial Sequence: Synthetic oligonucleotide
uaggagaagcaugaccac

SEQ ID NO: 70957 - RNA, 18 nt, Artificial Sequence
  Description of Artificial Sequence: Synthetic oligonucleotide
gcaguuaggagaagcaug

SEQ ID NO: 70958 - RNA, 18 nt, Artificial Sequence
  Description of Artificial Sequence: Synthetic oligonucleotide
gccuugcaguuaggagaa

SEQ ID NO: 70959 - RNA, 18 nt, Artificial Sequence
  Description of Artificial Sequence: Synthetic oligonucleotide
cguuagccuugcaguuag

SEQ ID NO: 70960 - RNA, 18 nt, Artificial Sequence
  Description of Artificial Sequence: Synthetic oligonucleotide
gacagcguuagccuugca

SEQ ID NO: 70961 - RNA, 18 nt, Artificial Sequence
  Description of Artificial Sequence: Synthetic oligonucleotide
ggcuggacagcguuagcc

SEQ ID NO: 70962 - RNA, 18 nt, Artificial Sequence
  Description of Artificial Sequence: Synthetic oligonucleotide
agccgggcuggacagcgu

SEQ ID NO: 70963 - RNA, 18 nt, Artificial Sequence
  Description of Artificial Sequence: Synthetic oligonucleotide
ggaggagccgggcuggac

SEQ ID NO: 70964 - RNA, 18 nt, Artificial Sequence
  Description of Artificial Sequence: Synthetic oligonucleotide
aagcaggaggagccgggc

SEQ ID NO: 70965 - RNA, 18 nt, Artificial Sequence
  Description of Artificial Sequence: Synthetic oligonucleotide
gucacaagcaggaggagc

SEQ ID NO: 70966 - RNA, 18 nt, Artificial Sequence
  Description of Artificial Sequence: Synthetic oligonucleotide
cggaggucacaagcagga

SEQ ID NO: 70967 - RNA, 18 nt, Artificial Sequence
  Description of Artificial Sequence: Synthetic oligonucleotide
ggacucggaggucacaag

SEQ ID NO: 70968 - RNA, 18 nt, Artificial Sequence
  Description of Artificial Sequence: Synthetic oligonucleotide
acugaggacucggagguc

SEQ ID NO: 70969 - RNA, 18 nt, Artificial Sequence
  Description of Artificial Sequence: Synthetic oligonucleotide
aguuuacugaggacucgg

SEQ ID NO: 70970 - RNA, 18 nt, Artificial Sequence
  Description of Artificial Sequence: Synthetic oligonucleotide
gaagcaguuuacugagga

SEQ ID NO: 70971 - RNA, 18 nt, Artificial Sequence
  Description of Artificial Sequence: Synthetic oligonucleotide
gucacgaagcaguuuacu

SEQ ID NO: 70972 - RNA, 18 nt, Artificial Sequence
  Description of Artificial Sequence: Synthetic oligonucleotide
ugggagucacgaagcagu

SEQ ID NO: 70973 - RNA, 18 nt, Artificial Sequence
  Description of Artificial Sequence: Synthetic oligonucleotide
ggacaugggagucacgaa

SEQ ID NO: 70974 - RNA, 18 nt, Artificial Sequence
  Description of Artificial Sequence: Synthetic oligonucleotide
gugaaggacaugggaguc

SEQ ID NO: 70975 - RNA, 18 nt, Artificial Sequence
  Description of Artificial Sequence: Synthetic oligonucleotide
cugcugugaaggacaugg

SEQ ID NO: 70976 - RNA, 18 nt, Artificial Sequence
  Description of Artificial Sequence: Synthetic oligonucleotide
caugaccacgaggagcaa

SEQ ID NO: 70977 - RNA, 18 nt, Artificial Sequence
  Description of Artificial Sequence: Synthetic oligonucleotide
agaagcaugaccacgagg

SEQ ID NO: 70978 - RNA, 18 nt, Artificial Sequence
  Description of Artificial Sequence: Synthetic oligonucleotide
uuaggagaagcaugacca

SEQ ID NO: 70979 - RNA, 18 nt, Artificial Sequence
  Description of Artificial Sequence: Synthetic oligonucleotide
ugcaguuaggagaagcau

SEQ ID NO: 70980 - RNA, 18 nt, Artificial Sequence
  Description of Artificial Sequence: Synthetic oligonucleotide
agccuugcaguuaggaga

SEQ ID NO: 70981 - RNA, 18 nt, Artificial Sequence
  Description of Artificial Sequence: Synthetic oligonucleotide
gcguuagccuugcaguua

SEQ ID NO: 70982 - RNA, 18 nt, Artificial Sequence
  Description of Artificial Sequence: Synthetic oligonucleotide
ggacagcguuagccuugc

SEQ ID NO: 70983 - RNA, 18 nt, Artificial Sequence
  Description of Artificial Sequence: Synthetic oligonucleotide
gggcuggacagcguuagc

SEQ ID NO: 70984 - RNA, 18 nt, Artificial Sequence
  Description of Artificial Sequence: Synthetic oligonucleotide
gagccgggcuggacagcg

SEQ ID NO: 70985 - RNA, 18 nt, Artificial Sequence
  Description of Artificial Sequence: Synthetic oligonucleotide
aggaggagccgggcugga

SEQ ID NO: 70986 - RNA, 18 nt, Artificial Sequence
  Description of Artificial Sequence: Synthetic oligonucleotide
caagcaggaggagccggg

SEQ ID NO: 70987 - RNA, 18 nt, Artificial Sequence
  Description of Artificial Sequence: Synthetic oligonucleotide
ggucacaagcaggaggag

SEQ ID NO: 70988 - RNA, 18 nt, Artificial Sequence
  Description of Artificial Sequence: Synthetic oligonucleotide
ucggaggucacaagcagg

SEQ ID NO: 70989 - RNA, 18 nt, Artificial Sequence
  Description of Artificial Sequence: Synthetic oligonucleotide
aggacucggaggucacaa

SEQ ID NO: 70990 - RNA, 18 nt, Artificial Sequence
  Description of Artificial Sequence: Synthetic oligonucleotide
uacugaggacucggaggu

SEQ ID NO: 70991 - RNA, 18 nt, Artificial Sequence
  Description of Artificial Sequence: Synthetic oligonucleotide
caguuuacugaggacucg

SEQ ID NO: 70992 - RNA, 18 nt, Artificial Sequence
  Description of Artificial Sequence: Synthetic oligonucleotide
cgaagcaguuuacugagg

SEQ ID NO: 70993 - RNA, 18 nt, Artificial Sequence
  Description of Artificial Sequence: Synthetic oligonucleotide
agucacgaagcaguuuac

SEQ ID NO: 70994 - RNA, 18 nt, Artificial Sequence
  Description of Artificial Sequence: Synthetic oligonucleotide
augggagucacgaagcag

SEQ ID NO: 70995 - RNA, 18 nt, Artificial Sequence
  Description of Artificial Sequence: Synthetic oligonucleotide
aggacaugggagucacga

SEQ ID NO: 70996 - RNA, 18 nt, Artificial Sequence
  Description of Artificial Sequence: Synthetic oligonucleotide
ugugaaggacaugggagu

SEQ ID NO: 70997 - RNA, 18 nt, Artificial Sequence
  Description of Artificial Sequence: Synthetic oligonucleotide
ucugcugugaaggacaug

SEQ ID NO: 70998 - RNA, 18 nt, Artificial Sequence
  Description of Artificial Sequence: Synthetic oligonucleotide
gggauaauguugggaguu

SEQ ID NO: 70999 - RNA, 18 nt, Artificial Sequence
  Description of Artificial Sequence: Synthetic oligonucleotide
uaccaguuacgcggauaa

SEQ ID NO: 71000 - RNA, 18 nt, Artificial Sequence
  Description of Artificial Sequence: Synthetic oligonucleotide
ugucuuaccaguuacgcg

SEQ ID NO: 71001 - RNA, 18 nt, Artificial Sequence
  Description of Artificial Sequence: Synthetic oligonucleotide
augggugucuuaccaguu

SEQ ID NO: 71002 - RNA, 18 nt, Artificial Sequence
  Description of Artificial Sequence: Synthetic oligonucleotide
ggaguaugggugucuuac

SEQ ID NO: 71003 - RNA, 18 nt, Artificial Sequence
  Description of Artificial Sequence: Synthetic oligonucleotide
uccugggaguaugggugu

SEQ ID NO: 71004 - RNA, 18 nt, Artificial Sequence
  Description of Artificial Sequence: Synthetic oligonucleotide
ugucuuccugggaguaug

SEQ ID NO: 71005 - RNA, 18 nt, Artificial Sequence
  Description of Artificial Sequence: Synthetic oligonucleotide
gauggugucuuccuggga

SEQ ID NO: 71006 - RNA, 18 nt, Artificial Sequence
  Description of Artificial Sequence: Synthetic oligonucleotide
gaagugauggugucuucc

SEQ ID NO: 71007 - RNA, 18 nt, Artificial Sequence
  Description of Artificial Sequence: Synthetic oligonucleotide
uagaggaagugauggugu

SEQ ID NO: 71008 - RNA, 18 nt, Artificial Sequence
  Description of Artificial Sequence: Synthetic oligonucleotide
ggaguuagaggaagugau

SEQ ID NO: 71009 - RNA, 18 nt, Artificial Sequence
  Description of Artificial Sequence: Synthetic oligonucleotide
gucaaggaguuagaggaa

SEQ ID NO: 71010 - RNA, 18 nt, Artificial Sequence
  Description of Artificial Sequence: Synthetic oligonucleotide
auugggucaaggaguuag

SEQ ID NO: 71011 - RNA, 18 nt, Artificial Sequence
  Description of Artificial Sequence: Synthetic oligonucleotide
uagucauugggucaagga

SEQ ID NO: 71012 - RNA, 18 nt, Artificial Sequence
  Description of Artificial Sequence: Synthetic oligonucleotide
aagaauagucauuggguc

SEQ ID NO: 71013 - RNA, 18 nt, Artificial Sequence
  Description of Artificial Sequence: Synthetic oligonucleotide
augggaagaauagucauu

SEQ ID NO: 71014 - RNA, 18 nt, Artificial Sequence
  Description of Artificial Sequence: Synthetic oligonucleotide
acaauaugggaagaauag

SEQ ID NO: 71015 - RNA, 18 nt, Artificial Sequence
  Description of Artificial Sequence: Synthetic oligonucleotide
gggacaauaugggaagaa

SEQ ID NO: 71016 - RNA, 18 nt, Artificial Sequence
  Description of Artificial Sequence: Synthetic oligonucleotide
gugugaucaguagguggg

SEQ ID NO: 71017 - RNA, 18 nt, Artificial Sequence
  Description of Artificial Sequence: Synthetic oligonucleotide
agagagugugaucaguag

SEQ ID NO: 71018 - RNA, 18 nt, Artificial Sequence
  Description of Artificial Sequence: Synthetic oligonucleotide
uugucagagagugugauc

SEQ ID NO: 71019 - RNA, 18 nt, Artificial Sequence
  Description of Artificial Sequence: Synthetic oligonucleotide
aauccuugucagagagug

SEQ ID NO: 71020 - RNA, 18 nt, Artificial Sequence
  Description of Artificial Sequence: Synthetic oligonucleotide
agaauaauccuugucaga

SEQ ID NO: 71021 - RNA, 18 nt, Artificial Sequence
  Description of Artificial Sequence: Synthetic oligonucleotide
ugugaagaauaauccuug

SEQ ID NO: 71022 - RNA, 18 nt, Artificial Sequence
  Description of Artificial Sequence: Synthetic oligonucleotide
uguauugugaagaauaau

SEQ ID NO: 71023 - RNA, 18 nt, Artificial Sequence
  Description of Artificial Sequence: Synthetic oligonucleotide
cgggcuguauugugaaga

SEQ ID NO: 71024 - RNA, 18 nt, Artificial Sequence
  Description of Artificial Sequence: Synthetic oligonucleotide
gugugaucaguagguggg

SEQ ID NO: 71025 - RNA, 18 nt, Artificial Sequence
  Description of Artificial Sequence: Synthetic oligonucleotide
gagagugugaucaguagg

SEQ ID NO: 71026 - RNA, 18 nt, Artificial Sequence
  Description of Artificial Sequence: Synthetic oligonucleotide
ugucagagagugugauca

SEQ ID NO: 71027 - RNA, 18 nt, Artificial Sequence
  Description of Artificial Sequence: Synthetic oligonucleotide
auccuugucagagagugu

SEQ ID NO: 71028 - RNA, 18 nt, Artificial Sequence
  Description of Artificial Sequence: Synthetic oligonucleotide
gaauaauccuugucagag

SEQ ID NO: 71029 - RNA, 18 nt, Artificial Sequence
  Description of Artificial Sequence: Synthetic oligonucleotide
gugaagaauaauccuugu

SEQ ID NO: 71030 - RNA, 18 nt, Artificial Sequence
  Description of Artificial Sequence: Synthetic oligonucleotide
guauugugaagaauaauc

SEQ ID NO: 71031 - RNA, 18 nt, Artificial Sequence
  Description of Artificial Sequence: Synthetic oligonucleotide
gggcuguauugugaagaa

SEQ ID NO: 71032 - RNA, 18 nt, Artificial Sequence
  Description of Artificial Sequence: Synthetic oligonucleotide
aaugcgggcuguauugug

SEQ ID NO: 71033 - RNA, 18 nt, Artificial Sequence
  Description of Artificial Sequence: Synthetic oligonucleotide
uuuuaaaugcgggcugua

SEQ ID NO: 71034 - RNA, 18 nt, Artificial Sequence
  Description of Artificial Sequence: Synthetic oligonucleotide
agagcuuuuaaaugcggg

SEQ ID NO: 71035 - RNA, 18 nt, Artificial Sequence
  Description of Artificial Sequence: Synthetic oligonucleotide
agacgagagcuuuuaaau

SEQ ID NO: 71036 - RNA, 18 nt, Artificial Sequence
  Description of Artificial Sequence: Synthetic oligonucleotide
ucucuagacgagagcuuu

SEQ ID NO: 71037 - RNA, 18 nt, Artificial Sequence
  Description of Artificial Sequence: Synthetic oligonucleotide
uacuaucucuagacgaga

SEQ ID NO: 71038 - RNA, 18 nt, Artificial Sequence
  Description of Artificial Sequence: Synthetic oligonucleotide
augaguacuaucucuaga

SEQ ID NO: 71039 - RNA, 18 nt, Artificial Sequence
  Description of Artificial Sequence: Synthetic oligonucleotide
ccuccaugaguacuaucu

SEQ ID NO: 71040 - RNA, 18 nt, Artificial Sequence
  Description of Artificial Sequence: Synthetic oligonucleotide
cuaguccuccaugaguac

SEQ ID NO: 71041 - RNA, 18 nt, Artificial Sequence
  Description of Artificial Sequence: Synthetic oligonucleotide
gcaggcuaguccuccaug

SEQ ID NO: 71042 - RNA, 18 nt, Artificial Sequence
  Description of Artificial Sequence: Synthetic oligonucleotide
aauaagcaggcuaguccu

SEQ ID NO: 71043 - RNA, 18 nt, Artificial Sequence
  Description of Artificial Sequence: Synthetic oligonucleotide
agccuaauaagcaggcua

SEQ ID NO: 71044 - RNA, 18 nt, Artificial Sequence
  Description of Artificial Sequence: Synthetic oligonucleotide
augguagccuaauaagca

SEQ ID NO: 71045 - RNA, 18 nt, Artificial Sequence
  Description of Artificial Sequence: Synthetic oligonucleotide
gagcuaugguagccuaau

SEQ ID NO: 71046 - RNA, 18 nt, Artificial Sequence
  Description of Artificial Sequence: Synthetic oligonucleotide
agagagagcuaugguagc

SEQ ID NO: 71047 - RNA, 18 nt, Artificial Sequence
  Description of Artificial Sequence: Synthetic oligonucleotide
gaaauagagagagcuaug

SEQ ID NO: 71048 - RNA, 18 nt, Artificial Sequence
  Description of Artificial Sequence: Synthetic oligonucleotide
gagcugaaauagagagag

SEQ ID NO: 71049 - RNA, 18 nt, Artificial Sequence
  Description of Artificial Sequence: Synthetic oligonucleotide
gaagggagcugaaauaga

SEQ ID NO: 71050 - RNA, 18 nt, Artificial Sequence
  Description of Artificial Sequence: Synthetic oligonucleotide
gaaccucugggcacuggc

SEQ ID NO: 71051 - RNA, 18 nt, Artificial Sequence
  Description of Artificial Sequence: Synthetic oligonucleotide
agggugaaccucugggca

SEQ ID NO: 71052 - RNA, 18 nt, Artificial Sequence
  Description of Artificial Sequence: Synthetic oligonucleotide
ggcaaagggugaaccucu

SEQ ID NO: 71053 - RNA, 18 nt, Artificial Sequence
  Description of Artificial Sequence: Synthetic oligonucleotide
guguaggcaaagggugaa

SEQ ID NO: 71054 - RNA, 18 nt, Artificial Sequence
  Description of Artificial Sequence: Synthetic oligonucleotide
gacagguguaggcaaagg

SEQ ID NO: 71055 - RNA, 18 nt, Artificial Sequence
  Description of Artificial Sequence: Synthetic oligonucleotide
agcaggacagguguaggc

SEQ ID NO: 71056 - RNA, 18 nt, Artificial Sequence
  Description of Artificial Sequence: Synthetic oligonucleotide
caggcagcaggacaggug

SEQ ID NO: 71057 - RNA, 18 nt, Artificial Sequence
  Description of Artificial Sequence: Synthetic oligonucleotide
cacagcaggcagcaggac

SEQ ID NO: 71058 - RNA, 18 nt, Artificial Sequence
  Description of Artificial Sequence: Synthetic oligonucleotide
aaguccacagcaggcagc

SEQ ID NO: 71059 - RNA, 18 nt, Artificial Sequence
  Description of Artificial Sequence: Synthetic oligonucleotide
agcuaaaguccacagcag

SEQ ID NO: 71060 - RNA, 18 nt, Artificial Sequence
  Description of Artificial Sequence: Synthetic oligonucleotide
ucccaagcuaaaguccac

SEQ ID NO: 71061 - RNA, 18 nt, Artificial Sequence
  Description of Artificial Sequence: Synthetic oligonucleotide
cauucucccaagcuaaag

SEQ ID NO: 71062 - RNA, 18 nt, Artificial Sequence
  Description of Artificial Sequence: Synthetic oligonucleotide
uuuuccauucucccaagc

SEQ ID NO: 71063 - RNA, 18 nt, Artificial Sequence
  Description of Artificial Sequence: Synthetic oligonucleotide
cuggguuuuccauucucc

SEQ ID NO: 71064 - RNA, 18 nt, Artificial Sequence
  Description of Artificial Sequence: Synthetic oligonucleotide
gaaccucugggcacuggc

SEQ ID NO: 71065 - RNA, 18 nt, Artificial Sequence
  Description of Artificial Sequence: Synthetic oligonucleotide
agggugaaccucugggca

SEQ ID NO: 71066 - RNA, 18 nt, Artificial Sequence
  Description of Artificial Sequence: Synthetic oligonucleotide
ggcaaagggugaaccucu

SEQ ID NO: 71067 - RNA, 18 nt, Artificial Sequence
  Description of Artificial Sequence: Synthetic oligonucleotide
guguaggcaaagggugaa

SEQ ID NO: 71068 - RNA, 18 nt, Artificial Sequence
  Description of Artificial Sequence: Synthetic oligonucleotide
gacagguguaggcaaagg

SEQ ID NO: 71069 - RNA, 18 nt, Artificial Sequence
  Description of Artificial Sequence: Synthetic oligonucleotide
agcaggacagguguaggc

SEQ ID NO: 71070 - RNA, 18 nt, Artificial Sequence
  Description of Artificial Sequence: Synthetic oligonucleotide
caggcagcaggacaggug

SEQ ID NO: 71071 - RNA, 18 nt, Artificial Sequence
  Description of Artificial Sequence: Synthetic oligonucleotide
cacagcaggcagcaggac

SEQ ID NO: 71072 - RNA, 18 nt, Artificial Sequence
  Description of Artificial Sequence: Synthetic oligonucleotide
aaguccacagcaggcagc

SEQ ID NO: 71073 - RNA, 18 nt, Artificial Sequence
  Description of Artificial Sequence: Synthetic oligonucleotide
agcuaaaguccacagcag

SEQ ID NO: 71074 - RNA, 18 nt, Artificial Sequence
  Description of Artificial Sequence: Synthetic oligonucleotide
ucccaagcuaaaguccac

SEQ ID NO: 71075 - RNA, 18 nt, Artificial Sequence
  Description of Artificial Sequence: Synthetic oligonucleotide
cauucucccaagcuaaag

SEQ ID NO: 71076 - RNA, 18 nt, Artificial Sequence
  Description of Artificial Sequence: Synthetic oligonucleotide
uuuuccauucucccaagc

SEQ ID NO: 71077 - RNA, 18 nt, Artificial Sequence
  Description of Artificial Sequence: Synthetic oligonucleotide
cuggguuuuccauucucc

SEQ ID NO: 71078 - RNA, 18 nt, Artificial Sequence
  Description of Artificial Sequence: Synthetic oligonucleotide
aagguuagggauggcuuu

SEQ ID NO: 71079 - RNA, 18 nt, Artificial Sequence
  Description of Artificial Sequence: Synthetic oligonucleotide
aagccaagguuagggaug

SEQ ID NO: 71080 - RNA, 18 nt, Artificial Sequence
  Description of Artificial Sequence: Synthetic oligonucleotide
uagggaagccaagguuag

SEQ ID NO: 71081 - RNA, 18 nt, Artificial Sequence
  Description of Artificial Sequence: Synthetic oligonucleotide
ggacuuagggaagccaag

SEQ ID NO: 71082 - RNA, 18 nt, Artificial Sequence
  Description of Artificial Sequence: Synthetic oligonucleotide
agacaggacuuagggaag

SEQ ID NO: 71083 - RNA, 18 nt, Artificial Sequence
  Description of Artificial Sequence: Synthetic oligonucleotide
acugaagacaggacuuag

SEQ ID NO: 71084 - RNA, 18 nt, Artificial Sequence
  Description of Artificial Sequence: Synthetic oligonucleotide
gggaaacugaagacagga

SEQ ID NO: 71085 - RNA, 18 nt, Artificial Sequence
  Description of Artificial Sequence: Synthetic oligonucleotide
gcagugggaaacugaaga

SEQ ID NO: 71086 - RNA, 18 nt, Artificial Sequence
  Description of Artificial Sequence: Synthetic oligonucleotide
gggaagcagugggaaacu

SEQ ID NO: 71087 - RNA, 18 nt, Artificial Sequence
  Description of Artificial Sequence: Synthetic oligonucleotide
uccaugggaagcaguggg

SEQ ID NO: 71088 - RNA, 18 nt, Artificial Sequence
  Description of Artificial Sequence: Synthetic oligonucleotide
gagaauccaugggaagca

SEQ ID NO: 71089 - RNA, 18 nt, Artificial Sequence
  Description of Artificial Sequence: Synthetic oligonucleotide
uguuggagaauccauggg

SEQ ID NO: 71090 - RNA, 18 nt, Artificial Sequence
  Description of Artificial Sequence: Synthetic oligonucleotide
aagaauguuggagaaucc

SEQ ID NO: 71091 - RNA, 18 nt, Artificial Sequence
  Description of Artificial Sequence: Synthetic oligonucleotide
agcucaagaauguuggag

SEQ ID NO: 71092 - RNA, 18 nt, Artificial Sequence
  Description of Artificial Sequence: Synthetic oligonucleotide
uaaaaagcucaagaaugu

SEQ ID NO: 71093 - RNA, 18 nt, Artificial Sequence
  Description of Artificial Sequence: Synthetic oligonucleotide
auuuuuaaaaagcucaag

SEQ ID NO: 71094 - RNA, 18 nt, Artificial Sequence
  Description of Artificial Sequence: Synthetic oligonucleotide
gagauauuuuuaaaaagc

SEQ ID NO: 71095 - RNA, 18 nt, Artificial Sequence
  Description of Artificial Sequence: Synthetic oligonucleotide
aaggugagauauuuuuaa

SEQ ID NO: 71096 - RNA, 18 nt, Artificial Sequence
  Description of Artificial Sequence: Synthetic oligonucleotide
agcugaaggugagauauu

SEQ ID NO: 71097 - RNA, 18 nt, Artificial Sequence
  Description of Artificial Sequence: Synthetic oligonucleotide
ggccaagcugaaggugag

SEQ ID NO: 71098 - RNA, 18 nt, Artificial Sequence
  Description of Artificial Sequence: Synthetic oligonucleotide
aggguggccaagcugaag

SEQ ID NO: 71099 - RNA, 18 nt, Artificial Sequence
  Description of Artificial Sequence: Synthetic oligonucleotide
ggguuaggguggccaagc

SEQ ID NO: 71100 - RNA, 18 nt, Artificial Sequence
  Description of Artificial Sequence: Synthetic oligonucleotide
agauuggguuaggguggc

SEQ ID NO: 71101 - RNA, 18 nt, Artificial Sequence
  Description of Artificial Sequence: Synthetic oligonucleotide
aauguagauuggguuagg

SEQ ID NO: 71102 - RNA, 18 nt, Artificial Sequence
  Description of Artificial Sequence: Synthetic oligonucleotide
aggugaauguagauuggg

SEQ ID NO: 71103 - RNA, 18 nt, Artificial Sequence
  Description of Artificial Sequence: Synthetic oligonucleotide
aucauaggugaauguaga

SEQ ID NO: 71104 - RNA, 18 nt, Artificial Sequence
  Description of Artificial Sequence: Synthetic oligonucleotide
cuaucaucauaggugaau

SEQ ID NO: 71105 - RNA, 18 nt, Artificial Sequence
  Description of Artificial Sequence: Synthetic oligonucleotide
acaggcuaucaucauagg

SEQ ID NO: 71106 - RNA, 18 nt, Artificial Sequence
  Description of Artificial Sequence: Synthetic oligonucleotide
uauccacaggcuaucauc

SEQ ID NO: 71107 - RNA, 18 nt, Artificial Sequence
  Description of Artificial Sequence: Synthetic oligonucleotide
caucuuauccacaggcua

SEQ ID NO: 71108 - RNA, 18 nt, Artificial Sequence
  Description of Artificial Sequence: Synthetic oligonucleotide
gccaucaucuuauccaca

SEQ ID NO: 71109 - RNA, 18 nt, Artificial Sequence
  Description of Artificial Sequence: Synthetic oligonucleotide
ugcaagccaucaucuuau

SEQ ID NO: 71110 - RNA, 18 nt, Artificial Sequence
  Description of Artificial Sequence: Synthetic oligonucleotide
ggaccugcaagccaucau

SEQ ID NO: 71111 - RNA, 18 nt, Artificial Sequence
  Description of Artificial Sequence: Synthetic oligonucleotide
auauuggaccugcaagcc

SEQ ID NO: 71112 - RNA, 18 nt, Artificial Sequence
  Description of Artificial Sequence: Synthetic oligonucleotide
uucacauauuggaccugc

SEQ ID NO: 71113 - RNA, 18 nt, Artificial Sequence
  Description of Artificial Sequence: Synthetic oligonucleotide
aucuauucacauauugga

SEQ ID NO: 71114 - RNA, 18 nt, Artificial Sequence
  Description of Artificial Sequence: Synthetic oligonucleotide
uucaaaucuauucacaua

SEQ ID NO: 71115 - RNA, 18 nt, Artificial Sequence
  Description of Artificial Sequence: Synthetic oligonucleotide
ucagcuucaaaucuauuc

SEQ ID NO: 71116 - RNA, 18 nt, Artificial Sequence
  Description of Artificial Sequence: Synthetic oligonucleotide
gguguucagcuucaaauc

SEQ ID NO: 71117 - RNA, 18 nt, Artificial Sequence
  Description of Artificial Sequence: Synthetic oligonucleotide
uucaugguguucagcuuc

SEQ ID NO: 71118 - RNA, 18 nt, Artificial Sequence
  Description of Artificial Sequence: Synthetic oligonucleotide
agcuuuucaugguguuca

SEQ ID NO: 71119 - RNA, 18 nt, Artificial Sequence
  Description of Artificial Sequence: Synthetic oligonucleotide
ucuccagcuuuucauggu

SEQ ID NO: 71120 - RNA, 18 nt, Artificial Sequence
  Description of Artificial Sequence: Synthetic oligonucleotide
auuucucuccagcuuuuc

SEQ ID NO: 71121 - RNA, 18 nt, Artificial Sequence
  Description of Artificial Sequence: Synthetic oligonucleotide
gagcgauuucucuccagc

SEQ ID NO: 71122 - RNA, 18 nt, Artificial Sequence
  Description of Artificial Sequence: Synthetic oligonucleotide
gccaugagcgauuucucu

SEQ ID NO: 71123 - RNA, 18 nt, Artificial Sequence
  Description of Artificial Sequence: Synthetic oligonucleotide
gcauggccaugagcgauu

SEQ ID NO: 71124 - RNA, 18 nt, Artificial Sequence
  Description of Artificial Sequence: Synthetic oligonucleotide
caaaggcauggccaugag

SEQ ID NO: 71125 - RNA, 18 nt, Artificial Sequence
  Description of Artificial Sequence: Synthetic oligonucleotide
uaggucaaaggcauggcc

SEQ ID NO: 71126 - RNA, 18 nt, Artificial Sequence
  Description of Artificial Sequence: Synthetic oligonucleotide
gggaauaggucaaaggca

SEQ ID NO: 71127 - RNA, 18 nt, Artificial Sequence
  Description of Artificial Sequence: Synthetic oligonucleotide
ugaacgggaauaggucaa

SEQ ID NO: 71128 - RNA, 18 nt, Artificial Sequence
  Description of Artificial Sequence: Synthetic oligonucleotide
aagacugaacgggaauag

SEQ ID NO: 71129 - RNA, 18 nt, Artificial Sequence
  Description of Artificial Sequence: Synthetic oligonucleotide
uuaagaagacugaacggg

SEQ ID NO: 71130 - RNA, 18 nt, Artificial Sequence
  Description of Artificial Sequence: Synthetic oligonucleotide
ccaauuuaagaagacuga

SEQ ID NO: 71131 - RNA, 18 nt, Artificial Sequence
  Description of Artificial Sequence: Synthetic oligonucleotide
ucaugccaauuuaagaag

SEQ ID NO: 71132 - RNA, 18 nt, Artificial Sequence
  Description of Artificial Sequence: Synthetic oligonucleotide
cuucuucaugccaauuua

SEQ ID NO: 71133 - RNA, 18 nt, Artificial Sequence
  Description of Artificial Sequence: Synthetic oligonucleotide
ucuugcuucuucaugcca

SEQ ID NO: 71134 - RNA, 18 nt, Artificial Sequence
  Description of Artificial Sequence: Synthetic oligonucleotide
augagucuugcuucuuca

SEQ ID NO: 71135 - RNA, 18 nt, Artificial Sequence
  Description of Artificial Sequence: Synthetic oligonucleotide
gacauaugagucuugcuu

SEQ ID NO: 71136 - RNA, 18 nt, Artificial Sequence
  Description of Artificial Sequence: Synthetic oligonucleotide
uggaugacauaugagucu

SEQ ID NO: 71137 - RNA, 18 nt, Artificial Sequence
  Description of Artificial Sequence: Synthetic oligonucleotide
aucuguggaugacauaug

SEQ ID NO: 71138 - RNA, 18 nt, Artificial Sequence
  Description of Artificial Sequence: Synthetic oligonucleotide
gugucaucuguggaugac

SEQ ID NO: 71139 - RNA, 18 nt, Artificial Sequence
  Description of Artificial Sequence: Synthetic oligonucleotide
gcuuugugucaucugugg

SEQ ID NO: 71140 - RNA, 18 nt, Artificial Sequence
  Description of Artificial Sequence: Synthetic oligonucleotide
ucccagcuuugugucauc

SEQ ID NO: 71141 - RNA, 18 nt, Artificial Sequence
  Description of Artificial Sequence: Synthetic oligonucleotide
guacuucccagcuuugug

SEQ ID NO: 71142 - RNA, 18 nt, Artificial Sequence
  Description of Artificial Sequence: Synthetic oligonucleotide
uagugguacuucccagcu

SEQ ID NO: 71143 - RNA, 18 nt, Artificial Sequence
  Description of Artificial Sequence: Synthetic oligonucleotide
uauuuuagugguacuucc

SEQ ID NO: 71144 - RNA, 18 nt, Artificial Sequence
  Description of Artificial Sequence: Synthetic oligonucleotide
uuuguuauuuuaguggua

SEQ ID NO: 71145 - RNA, 18 nt, Artificial Sequence
  Description of Artificial Sequence: Synthetic oligonucleotide
agucuuuuguuauuuuag

SEQ ID NO: 71146 - RNA, 18 nt, Artificial Sequence
  Description of Artificial Sequence: Synthetic oligonucleotide
gauucagucuuuuguuau

SEQ ID NO: 71147 - RNA, 18 nt, Artificial Sequence
  Description of Artificial Sequence: Synthetic oligonucleotide
aucuugauucagucuuuu

SEQ ID NO: 71148 - RNA, 18 nt, Artificial Sequence
  Description of Artificial Sequence: Synthetic oligonucleotide
uuugaaucuugauucagu

SEQ ID NO: 71149 - RNA, 18 nt, Artificial Sequence
  Description of Artificial Sequence: Synthetic oligonucleotide
agugauuugaaucuugau

SEQ ID NO: 71150 - RNA, 18 nt, Artificial Sequence
  Description of Artificial Sequence: Synthetic oligonucleotide
cuuucagugauuugaauc

SEQ ID NO: 71151 - RNA, 18 nt, Artificial Sequence
  Description of Artificial Sequence: Synthetic oligonucleotide
cuagucuuucagugauuu

SEQ ID NO: 71152 - RNA, 18 nt, Artificial Sequence
  Description of Artificial Sequence: Synthetic oligonucleotide
uugaccuagucuuucagu

SEQ ID NO: 71153 - RNA, 18 nt, Artificial Sequence
  Description of Artificial Sequence: Synthetic oligonucleotide
uguuuuugaccuagucuu

SEQ ID NO: 71154 - RNA, 18 nt, Artificial Sequence
  Description of Artificial Sequence: Synthetic oligonucleotide
caccuuguuuuugaccua

SEQ ID NO: 71155 - RNA, 18 nt, Artificial Sequence
  Description of Artificial Sequence: Synthetic oligonucleotide
uguuucaccuuguuuuug

SEQ ID NO: 71156 - RNA, 18 nt, Artificial Sequence
  Description of Artificial Sequence: Synthetic oligonucleotide
ucuguuguuucaccuugu

SEQ ID NO: 71157 - RNA, 18 nt, Artificial Sequence
  Description of Artificial Sequence: Synthetic oligonucleotide
auaucucuguuguuucac

SEQ ID NO: 71158 - RNA, 18 nt, Artificial Sequence
  Description of Artificial Sequence: Synthetic oligonucleotide
aguuuauaucucuguugu

SEQ ID NO: 71159 - RNA, 18 nt, Artificial Sequence
  Description of Artificial Sequence: Synthetic oligonucleotide
guagaaguuuauaucucu

SEQ ID NO: 71160 - RNA, 18 nt, Artificial Sequence
  Description of Artificial Sequence: Synthetic oligonucleotide
cacauguagaaguuuaua

SEQ ID NO: 71161 - RNA, 18 nt, Artificial Sequence
  Description of Artificial Sequence: Synthetic oligonucleotide
cggcccacauguagaagu

SEQ ID NO: 71162 - RNA, 18 nt, Artificial Sequence
  Description of Artificial Sequence: Synthetic oligonucleotide
gcccccggcccacaugua

SEQ ID NO: 71163 - RNA, 18 nt, Artificial Sequence
  Description of Artificial Sequence: Synthetic oligonucleotide
cgugagcccccggcccac

SEQ ID NO: 71164 - RNA, 18 nt, Artificial Sequence
  Description of Artificial Sequence: Synthetic oligonucleotide
acaggcgugagcccccgg

SEQ ID NO: 71165 - RNA, 18 nt, Artificial Sequence
  Description of Artificial Sequence: Synthetic oligonucleotide
ggauuacaggcgugagcc

SEQ ID NO: 71166 - RNA, 18 nt, Artificial Sequence
  Description of Artificial Sequence: Synthetic oligonucleotide
ugcugggauuacaggcgu

SEQ ID NO: 71167 - RNA, 18 nt, Artificial Sequence
  Description of Artificial Sequence: Synthetic oligonucleotide
caaagugcugggauuaca

SEQ ID NO: 71168 - RNA, 18 nt, Artificial Sequence
  Description of Artificial Sequence: Synthetic oligonucleotide
ccucccaaagugcuggga

SEQ ID NO: 71169 - RNA, 18 nt, Artificial Sequence
  Description of Artificial Sequence: Synthetic oligonucleotide
cucggccucccaaagugc

SEQ ID NO: 71170 - RNA, 18 nt, Artificial Sequence
  Description of Artificial Sequence: Synthetic oligonucleotide
ccugccucggccucccaa

SEQ ID NO: 71171 - RNA, 18 nt, Artificial Sequence
  Description of Artificial Sequence: Synthetic oligonucleotide
aucugccugccucggccu

SEQ ID NO: 71172 - RNA, 18 nt, Artificial Sequence
  Description of Artificial Sequence: Synthetic oligonucleotide
aggugaucugccugccuc

SEQ ID NO: 71173 - RNA, 18 nt, Artificial Sequence
  Description of Artificial Sequence: Synthetic oligonucleotide
cccucaggugaucugccu

SEQ ID NO: 71174 - RNA, 18 nt, Artificial Sequence
  Description of Artificial Sequence: Synthetic oligonucleotide
uccugcccucaggugauc

SEQ ID NO: 71175 - RNA, 18 nt, Artificial Sequence
  Description of Artificial Sequence: Synthetic oligonucleotide
caaacuccugcccucagg

SEQ ID NO: 71176 - RNA, 18 nt, Artificial Sequence
  Description of Artificial Sequence: Synthetic oligonucleotide
gcucucaaacuccugccc

SEQ ID NO: 71177 - RNA, 18 nt, Artificial Sequence
  Description of Artificial Sequence: Synthetic oligonucleotide
gcugggcauggugguggg

SEQ ID NO: 71178 - RNA, 18 nt, Artificial Sequence
  Description of Artificial Sequence: Synthetic oligonucleotide
aauuagcugggcauggug

SEQ ID NO: 71179 - RNA, 18 nt, Artificial Sequence
  Description of Artificial Sequence: Synthetic oligonucleotide
acaaaaauuagcugggca

SEQ ID NO: 71180 - RNA, 18 nt, Artificial Sequence
  Description of Artificial Sequence: Synthetic oligonucleotide
aaaauacaaaaauuagcu

SEQ ID NO: 71181 - RNA, 18 nt, Artificial Sequence
  Description of Artificial Sequence: Synthetic oligonucleotide
uaccaaaaauacaaaaau

SEQ ID NO: 71182 - RNA, 18 nt, Artificial Sequence
  Description of Artificial Sequence: Synthetic oligonucleotide
aucucuaccaaaaauaca

SEQ ID NO: 71183 - RNA, 18 nt, Artificial Sequence
  Description of Artificial Sequence: Synthetic oligonucleotide
accccaucucuaccaaaa

SEQ ID NO: 71184 - RNA, 18 nt, Artificial Sequence
  Description of Artificial Sequence: Synthetic oligonucleotide
gugaaaccccaucucuac

SEQ ID NO: 71185 - RNA, 18 nt, Artificial Sequence
  Description of Artificial Sequence: Synthetic oligonucleotide
acauggugaaaccccauc

SEQ ID NO: 71186 - RNA, 18 nt, Artificial Sequence
  Description of Artificial Sequence: Synthetic oligonucleotide
ggccaacauggugaaacc

SEQ ID NO: 71187 - RNA, 18 nt, Artificial Sequence
  Description of Artificial Sequence: Synthetic oligonucleotide
agccuggccaacauggug

SEQ ID NO: 71188 - RNA, 18 nt, Artificial Sequence
  Description of Artificial Sequence: Synthetic oligonucleotide
agaucagccuggccaaca

SEQ ID NO: 71189 - RNA, 18 nt, Artificial Sequence
  Description of Artificial Sequence: Synthetic oligonucleotide
guucaagaucagccuggc

SEQ ID NO: 71190 - RNA, 18 nt, Artificial Sequence
  Description of Artificial Sequence: Synthetic oligonucleotide
caggaguucaagaucagc

SEQ ID NO: 71191 - RNA, 18 nt, Artificial Sequence
  Description of Artificial Sequence: Synthetic oligonucleotide
gaggucaggaguucaaga

SEQ ID NO: 71192 - RNA, 18 nt, Artificial Sequence
  Description of Artificial Sequence: Synthetic oligonucleotide
caccugaggucaggaguu

SEQ ID NO: 71193 - RNA, 18 nt, Artificial Sequence
  Description of Artificial Sequence: Synthetic oligonucleotide
uggaucaccugaggucag

SEQ ID NO: 71194 - RNA, 18 nt, Artificial Sequence
  Description of Artificial Sequence: Synthetic oligonucleotide
gcagguggaucaccugag

SEQ ID NO: 71195 - RNA, 18 nt, Artificial Sequence
  Description of Artificial Sequence: Synthetic oligonucleotide
cugaggcagguggaucac

SEQ ID NO: 71196 - RNA, 18 nt, Artificial Sequence
  Description of Artificial Sequence: Synthetic oligonucleotide
ggaggcugaggcaggugg

SEQ ID NO: 71197 - RNA, 18 nt, Artificial Sequence
  Description of Artificial Sequence: Synthetic oligonucleotide
cuuugggaggcugaggca

SEQ ID NO: 71198 - RNA, 18 nt, Artificial Sequence
  Description of Artificial Sequence: Synthetic oligonucleotide
cagcacuuugggaggcug

SEQ ID NO: 71199 - RNA, 18 nt, Artificial Sequence
  Description of Artificial Sequence: Synthetic oligonucleotide
aaucccagcacuuuggga

SEQ ID NO: 71200 - RNA, 18 nt, Artificial Sequence
  Description of Artificial Sequence: Synthetic oligonucleotide
ccuguaaucccagcacuu

SEQ ID NO: 71201 - RNA, 18 nt, Artificial Sequence
  Description of Artificial Sequence: Synthetic oligonucleotide
ucacgccuguaaucccag

SEQ ID NO: 71202 - RNA, 18 nt, Artificial Sequence
  Description of Artificial Sequence: Synthetic oligonucleotide
guggcucacgccuguaau

SEQ ID NO: 71203 - RNA, 18 nt, Artificial Sequence
  Description of Artificial Sequence: Synthetic oligonucleotide
gugcaguggcucacgccu

SEQ ID NO: 71204 - RNA, 18 nt, Artificial Sequence
  Description of Artificial Sequence: Synthetic oligonucleotide
gcugggugcaguggcuca

SEQ ID NO: 71205 - RNA, 18 nt, Artificial Sequence
  Description of Artificial Sequence: Synthetic oligonucleotide
ugaaggcugggugcagug

SEQ ID NO: 71206 - RNA, 18 nt, Artificial Sequence
  Description of Artificial Sequence: Synthetic oligonucleotide
cugaaugaaggcugggug

SEQ ID NO: 71207 - RNA, 18 nt, Artificial Sequence
  Description of Artificial Sequence: Synthetic oligonucleotide
uuaaacugaaugaaggcu

SEQ ID NO: 71208 - RNA, 18 nt, Artificial Sequence
  Description of Artificial Sequence: Synthetic oligonucleotide
gauuuuuaaacugaauga

SEQ ID NO: 71209 - RNA, 18 nt, Artificial Sequence
  Description of Artificial Sequence: Synthetic oligonucleotide
cauuugauuuuuaaacug

SEQ ID NO: 71210 - RNA, 18 nt, Artificial Sequence
  Description of Artificial Sequence: Synthetic oligonucleotide
aggaucauuugauuuuua

SEQ ID NO: 71211 - RNA, 18 nt, Artificial Sequence
  Description of Artificial Sequence: Synthetic oligonucleotide
accuuaggaucauuugau

SEQ ID NO: 71212 - RNA, 18 nt, Artificial Sequence
  Description of Artificial Sequence: Synthetic oligonucleotide
gcaaaaccuuaggaucau

SEQ ID NO: 71213 - RNA, 18 nt, Artificial Sequence
  Description of Artificial Sequence: Synthetic oligonucleotide
cugcugcaaaaccuuagg

SEQ ID NO: 71214 - RNA, 18 nt, Artificial Sequence
  Description of Artificial Sequence: Synthetic oligonucleotide
ucuuucugcugcaaaacc

SEQ ID NO: 71215 - RNA, 18 nt, Artificial Sequence
  Description of Artificial Sequence: Synthetic oligonucleotide
uuuacucuuucugcugca

SEQ ID NO: 71216 - RNA, 18 nt, Artificial Sequence
  Description of Artificial Sequence: Synthetic oligonucleotide
gcaaauuuacucuuucug

SEQ ID NO: 71217 - RNA, 18 nt, Artificial Sequence
  Description of Artificial Sequence: Synthetic oligonucleotide
gugcugcaaauuuacucu

SEQ ID NO: 71218 - RNA, 18 nt, Artificial Sequence
  Description of Artificial Sequence: Synthetic oligonucleotide
uucuagugcugcaaauuu

SEQ ID NO: 71219 - RNA, 18 nt, Artificial Sequence
  Description of Artificial Sequence: Synthetic oligonucleotide
cuugguucuagugcugca

SEQ ID NO: 71220 - RNA, 18 nt, Artificial Sequence
  Description of Artificial Sequence: Synthetic oligonucleotide
uaccucuugguucuagug

SEQ ID NO: 71221 - RNA, 18 nt, Artificial Sequence
  Description of Artificial Sequence: Synthetic oligonucleotide
gcuuuuaccucuugguuc

SEQ ID NO: 71222 - RNA, 18 nt, Artificial Sequence
  Description of Artificial Sequence: Synthetic oligonucleotide
uuacagcuuuuaccucuu

SEQ ID NO: 71223 - RNA, 18 nt, Artificial Sequence
  Description of Artificial Sequence: Synthetic oligonucleotide
cccuguuacagcuuuuac

SEQ ID NO: 71224 - RNA, 18 nt, Artificial Sequence
  Description of Artificial Sequence: Synthetic oligonucleotide
aucugcccuguuacagcu

SEQ ID NO: 71225 - RNA, 18 nt, Artificial Sequence
  Description of Artificial Sequence: Synthetic oligonucleotide
cugaaaucugcccuguua

SEQ ID NO: 71226 - RNA, 18 nt, Artificial Sequence
  Description of Artificial Sequence: Synthetic oligonucleotide
cguugcugaaaucugccc

SEQ ID NO: 71227 - RNA, 18 nt, Artificial Sequence
  Description of Artificial Sequence: Synthetic oligonucleotide
ucuuacguugcugaaauc

SEQ ID NO: 71228 - RNA, 18 nt, Artificial Sequence
  Description of Artificial Sequence: Synthetic oligonucleotide
uuuuuucuuacguugcug

SEQ ID NO: 71229 - RNA, 18 nt, Artificial Sequence
  Description of Artificial Sequence: Synthetic oligonucleotide
gcuccuuuuuucuuacgu

SEQ ID NO: 71230 - RNA, 18 nt, Artificial Sequence
  Description of Artificial Sequence: Synthetic oligonucleotide
gaagagcuccuuuuuucu

SEQ ID NO: 71231 - RNA, 18 nt, Artificial Sequence
  Description of Artificial Sequence: Synthetic oligonucleotide
agugagaagagcuccuuu

SEQ ID NO: 71232 - RNA, 18 nt, Artificial Sequence
  Description of Artificial Sequence: Synthetic oligonucleotide
guuucagugagaagagcu

SEQ ID NO: 71233 - RNA, 18 nt, Artificial Sequence
  Description of Artificial Sequence: Synthetic oligonucleotide
acuugguuucagugagaa

SEQ ID NO: 71234 - RNA, 18 nt, Artificial Sequence
  Description of Artificial Sequence: Synthetic oligonucleotide
cuuacacuugguuucagu

SEQ ID NO: 71235 - RNA, 18 nt, Artificial Sequence
  Description of Artificial Sequence: Synthetic oligonucleotide
cuggucuuacacuugguu

SEQ ID NO: 71236 - RNA, 18 nt, Artificial Sequence
  Description of Artificial Sequence: Synthetic oligonucleotide
ccagccuggucuuacacu

SEQ ID NO: 71237 - RNA, 18 nt, Artificial Sequence
  Description of Artificial Sequence: Synthetic oligonucleotide
cuaguccagccuggucuu

SEQ ID NO: 71238 - RNA, 18 nt, Artificial Sequence
  Description of Artificial Sequence: Synthetic oligonucleotide
guccucuaguccagccug

SEQ ID NO: 71239 - RNA, 18 nt, Artificial Sequence
  Description of Artificial Sequence: Synthetic oligonucleotide
cccguguccucuagucca

SEQ ID NO: 71240 - RNA, 18 nt, Artificial Sequence
  Description of Artificial Sequence: Synthetic oligonucleotide
aaacucccguguccucua

SEQ ID NO: 71241 - RNA, 18 nt, Artificial Sequence
  Description of Artificial Sequence: Synthetic oligonucleotide
uucaaaaacucccguguc

SEQ ID NO: 71242 - RNA, 18 nt, Artificial Sequence
  Description of Artificial Sequence: Synthetic oligonucleotide
ucugcuucaaaaacuccc

SEQ ID NO: 71243 - RNA, 18 nt, Artificial Sequence
  Description of Artificial Sequence: Synthetic oligonucleotide
cagccucugcuucaaaaa

SEQ ID NO: 71244 - RNA, 18 nt, Artificial Sequence
  Description of Artificial Sequence: Synthetic oligonucleotide
gucaucagccucugcuuc

SEQ ID NO: 71245 - RNA, 18 nt, Artificial Sequence
  Description of Artificial Sequence: Synthetic oligonucleotide
agcuggucaucagccucu

SEQ ID NO: 71246 - RNA, 18 nt, Artificial Sequence
  Description of Artificial Sequence: Synthetic oligonucleotide
ccgacagcuggucaucag

SEQ ID NO: 71247 - RNA, 18 nt, Artificial Sequence
  Description of Artificial Sequence: Synthetic oligonucleotide
gucucccgacagcugguc

SEQ ID NO: 71248 - RNA, 18 nt, Artificial Sequence
  Description of Artificial Sequence: Synthetic oligonucleotide
ucacagucucccgacagc

SEQ ID NO: 71249 - RNA, 18 nt, Artificial Sequence
  Description of Artificial Sequence: Synthetic oligonucleotide
uuccuucacagucucccg

SEQ ID NO: 71250 - RNA, 18 nt, Artificial Sequence
  Description of Artificial Sequence: Synthetic oligonucleotide
aggaauuccuucacaguc

SEQ ID NO: 71251 - RNA, 18 nt, Artificial Sequence
  Description of Artificial Sequence: Synthetic oligonucleotide
agggcaggaauuccuuca

SEQ ID NO: 71252 - RNA, 18 nt, Artificial Sequence
  Description of Artificial Sequence: Synthetic oligonucleotide
cacccagggcaggaauuc

SEQ ID NO: 71253 - RNA, 18 nt, Artificial Sequence
  Description of Artificial Sequence: Synthetic oligonucleotide
ggucccacccagggcagg

SEQ ID NO: 71254 - RNA, 18 nt, Artificial Sequence
  Description of Artificial Sequence: Synthetic oligonucleotide
accaaggucccacccagg

SEQ ID NO: 71255 - RNA, 18 nt, Artificial Sequence
  Description of Artificial Sequence: Synthetic oligonucleotide
acaggaccaaggucccac

SEQ ID NO: 71256 - RNA, 18 nt, Artificial Sequence
  Description of Artificial Sequence: Synthetic oligonucleotide
acuggacaggaccaaggu

SEQ ID NO: 71257 - RNA, 18 nt, Artificial Sequence
  Description of Artificial Sequence: Synthetic oligonucleotide
ugagaacuggacaggacc

SEQ ID NO: 71258 - RNA, 18 nt, Artificial Sequence
  Description of Artificial Sequence: Synthetic oligonucleotide
caggcugagaacuggaca

SEQ ID NO: 71259 - RNA, 18 nt, Artificial Sequence
  Description of Artificial Sequence: Synthetic oligonucleotide
ucauacaggcugagaacu

SEQ ID NO: 71260 - RNA, 18 nt, Artificial Sequence
  Description of Artificial Sequence: Synthetic oligonucleotide
gugaaucauacaggcuga

SEQ ID NO: 71261 - RNA, 18 nt, Artificial Sequence
  Description of Artificial Sequence: Synthetic oligonucleotide
gcagagugaaucauacag

SEQ ID NO: 71262 - RNA, 18 nt, Artificial Sequence
  Description of Artificial Sequence: Synthetic oligonucleotide
agccagcagagugaauca

SEQ ID NO: 71263 - RNA, 18 nt, Artificial Sequence
  Description of Artificial Sequence: Synthetic oligonucleotide
ggaguagccagcagagug

SEQ ID NO: 71264 - RNA, 18 nt, Artificial Sequence
  Description of Artificial Sequence: Synthetic oligonucleotide
ccuuaggaguagccagca

SEQ ID NO: 71265 - RNA, 18 nt, Artificial Sequence
  Description of Artificial Sequence: Synthetic oligonucleotide
gggagccuuaggaguagc

SEQ ID NO: 71266 - RNA, 18 nt, Artificial Sequence
  Description of Artificial Sequence: Synthetic oligonucleotide
acacuaaaagcggguggg

SEQ ID NO: 71267 - RNA, 18 nt, Artificial Sequence
  Description of Artificial Sequence: Synthetic oligonucleotide
ggcacacuaaaagcgggu

SEQ ID NO: 71268 - RNA, 18 nt, Artificial Sequence
  Description of Artificial Sequence: Synthetic oligonucleotide
caaagggcacacuaaaag

SEQ ID NO: 71269 - RNA, 18 nt, Artificial Sequence
  Description of Artificial Sequence: Synthetic oligonucleotide
ugccucaaagggcacacu

SEQ ID NO: 71270 - RNA, 18 nt, Artificial Sequence
  Description of Artificial Sequence: Synthetic oligonucleotide
cgcacugccucaaagggc

SEQ ID NO: 71271 - RNA, 18 nt, Artificial Sequence
  Description of Artificial Sequence: Synthetic oligonucleotide
agaagcgcacugccucaa

SEQ ID NO: 71272 - RNA, 18 nt, Artificial Sequence
  Description of Artificial Sequence: Synthetic oligonucleotide
aagagagaagcgcacugc

SEQ ID NO: 71273 - RNA, 18 nt, Artificial Sequence
  Description of Artificial Sequence: Synthetic oligonucleotide
ccugugccuuggucuccu

SEQ ID NO: 71274 - RNA, 18 nt, Artificial Sequence
  Description of Artificial Sequence: Synthetic oligonucleotide
aauguccugugccuuggu

SEQ ID NO: 71275 - RNA, 18 nt, Artificial Sequence
  Description of Artificial Sequence: Synthetic oligonucleotide
cccagaauguccugugcc

SEQ ID NO: 71276 - RNA, 18 nt, Artificial Sequence
  Description of Artificial Sequence: Synthetic oligonucleotide
cugcucccagaauguccu

SEQ ID NO: 71277 - RNA, 18 nt, Artificial Sequence
  Description of Artificial Sequence: Synthetic oligonucleotide
ggucacugcucccagaau

SEQ ID NO: 71278 - RNA, 18 nt, Artificial Sequence
  Description of Artificial Sequence: Synthetic oligonucleotide
agaagggucacugcuccc

SEQ ID NO: 71279 - RNA, 18 nt, Artificial Sequence
  Description of Artificial Sequence: Synthetic oligonucleotide
ccagcagaagggucacug

SEQ ID NO: 71280 - RNA, 18 nt, Artificial Sequence
  Description of Artificial Sequence: Synthetic oligonucleotide
ucccuccagcagaagggu

SEQ ID NO: 71281 - RNA, 18 nt, Artificial Sequence
  Description of Artificial Sequence: Synthetic oligonucleotide
aucacucccuccagcaga

SEQ ID NO: 71282 - RNA, 18 nt, Artificial Sequence
  Description of Artificial Sequence: Synthetic oligonucleotide
cugccaucacucccucca

SEQ ID NO: 71283 - RNA, 18 nt, Artificial Sequence
  Description of Artificial Sequence: Synthetic oligonucleotide
ccgugcugccaucacucc

SEQ ID NO: 71284 - RNA, 18 nt, Artificial Sequence
  Description of Artificial Sequence: Synthetic oligonucleotide
uguccccgugcugccauc

SEQ ID NO: 71285 - RNA, 18 nt, Artificial Sequence
  Description of Artificial Sequence: Synthetic oligonucleotide
ccaguuguccccgugcug

SEQ ID NO: 71286 - RNA, 18 nt, Artificial Sequence
  Description of Artificial Sequence: Synthetic oligonucleotide
gggucccaguuguccccg

SEQ ID NO: 71287 - RNA, 18 nt, Artificial Sequence
  Description of Artificial Sequence: Synthetic oligonucleotide
caagugggucccaguugu

SEQ ID NO: 71288 - RNA, 18 nt, Artificial Sequence
  Description of Artificial Sequence: Synthetic oligonucleotide
agaggcaaguggguccca

SEQ ID NO: 71289 - RNA, 18 nt, Artificial Sequence
  Description of Artificial Sequence: Synthetic oligonucleotide
ggaugagaggcaaguggg

SEQ ID NO: 71290 - RNA, 18 nt, Artificial Sequence
  Description of Artificial Sequence: Synthetic oligonucleotide
aggagggaugagaggcaa

SEQ ID NO: 71291 - RNA, 18 nt, Artificial Sequence
  Description of Artificial Sequence: Synthetic oligonucleotide
gccccaggagggaugaga

SEQ ID NO: 71292 - RNA, 18 nt, Artificial Sequence
  Description of Artificial Sequence: Synthetic oligonucleotide
aagcugccccaggaggga

SEQ ID NO: 71293 - RNA, 18 nt, Artificial Sequence
  Description of Artificial Sequence: Synthetic oligonucleotide
ccagaaagcugccccagg

SEQ ID NO: 71294 - RNA, 18 nt, Artificial Sequence
  Description of Artificial Sequence: Synthetic oligonucleotide
ccuguccagaaagcugcc

SEQ ID NO: 71295 - RNA, 18 nt, Artificial Sequence
  Description of Artificial Sequence: Synthetic oligonucleotide
acggaccuguccagaaag

SEQ ID NO: 71296 - RNA, 18 nt, Artificial Sequence
  Description of Artificial Sequence: Synthetic oligonucleotide
aggagacggaccugucca

SEQ ID NO: 71297 - RNA, 18 nt, Artificial Sequence
  Description of Artificial Sequence: Synthetic oligonucleotide
caaggaggagacggaccu

SEQ ID NO: 71298 - RNA, 18 nt, Artificial Sequence
  Description of Artificial Sequence: Synthetic oligonucleotide
ggccccaaggaggagacg

SEQ ID NO: 71299 - RNA, 18 nt, Artificial Sequence
  Description of Artificial Sequence: Synthetic oligonucleotide
ugcagggccccaaggagg

SEQ ID NO: 71300 - RNA, 18 nt, Artificial Sequence
  Description of Artificial Sequence: Synthetic oligonucleotide
ggcucugcagggccccaa

SEQ ID NO: 71301 - RNA, 18 nt, Artificial Sequence
  Description of Artificial Sequence: Synthetic oligonucleotide
aaggaggcucugcagggc

SEQ ID NO: 71302 - RNA, 18 nt, Artificial Sequence
  Description of Artificial Sequence: Synthetic oligonucleotide
guuccaaggaggcucugc

SEQ ID NO: 71303 - RNA, 18 nt, Artificial Sequence
  Description of Artificial Sequence: Synthetic oligonucleotide
uccugugccuuggucucc

SEQ ID NO: 71304 - RNA, 18 nt, Artificial Sequence
  Description of Artificial Sequence: Synthetic oligonucleotide
gaauguccugugccuugg

SEQ ID NO: 71305 - RNA, 18 nt, Artificial Sequence
  Description of Artificial Sequence: Synthetic oligonucleotide
ucccagaauguccugugc

SEQ ID NO: 71306 - RNA, 18 nt, Artificial Sequence
  Description of Artificial Sequence: Synthetic oligonucleotide
acugcucccagaaugucc

SEQ ID NO: 71307 - RNA, 18 nt, Artificial Sequence
  Description of Artificial Sequence: Synthetic oligonucleotide
gggucacugcucccagaa

SEQ ID NO: 71308 - RNA, 18 nt, Artificial Sequence
  Description of Artificial Sequence: Synthetic oligonucleotide
cagaagggucacugcucc

SEQ ID NO: 71309 - RNA, 18 nt, Artificial Sequence
  Description of Artificial Sequence: Synthetic oligonucleotide
uccagcagaagggucacu

SEQ ID NO: 71310 - RNA, 18 nt, Artificial Sequence
  Description of Artificial Sequence: Synthetic oligonucleotide
cucccuccagcagaaggg

SEQ ID NO: 71311 - RNA, 18 nt, Artificial Sequence
  Description of Artificial Sequence: Synthetic oligonucleotide
caucacucccuccagcag

SEQ ID NO: 71312 - RNA, 18 nt, Artificial Sequence
  Description of Artificial Sequence: Synthetic oligonucleotide
gcugccaucacucccucc

SEQ ID NO: 71313 - RNA, 18 nt, Artificial Sequence
  Description of Artificial Sequence: Synthetic oligonucleotide
cccgugcugccaucacuc

SEQ ID NO: 71314 - RNA, 18 nt, Artificial Sequence
  Description of Artificial Sequence: Synthetic oligonucleotide
uuguccccgugcugccau

SEQ ID NO: 71315 - RNA, 18 nt, Artificial Sequence
  Description of Artificial Sequence: Synthetic oligonucleotide
cccaguuguccccgugcu

SEQ ID NO: 71316 - RNA, 18 nt, Artificial Sequence
  Description of Artificial Sequence: Synthetic oligonucleotide
ugggucccaguugucccc

SEQ ID NO: 71317 - RNA, 18 nt, Artificial Sequence
  Description of Artificial Sequence: Synthetic oligonucleotide
gcaagugggucccaguug

SEQ ID NO: 71318 - RNA, 18 nt, Artificial Sequence
  Description of Artificial Sequence: Synthetic oligonucleotide
gagaggcaaguggguccc

SEQ ID NO: 71319 - RNA, 18 nt, Artificial Sequence
  Description of Artificial Sequence: Synthetic oligonucleotide
gggaugagaggcaagugg

SEQ ID NO: 71320 - RNA, 18 nt, Artificial Sequence
  Description of Artificial Sequence: Synthetic oligonucleotide
caggagggaugagaggca

SEQ ID NO: 71321 - RNA, 18 nt, Artificial Sequence
  Description of Artificial Sequence: Synthetic oligonucleotide
ugccccaggagggaugag

SEQ ID NO: 71322 - RNA, 18 nt, Artificial Sequence
  Description of Artificial Sequence: Synthetic oligonucleotide
aaagcugccccaggaggg

SEQ ID NO: 71323 - RNA, 18 nt, Artificial Sequence
  Description of Artificial Sequence: Synthetic oligonucleotide
uccagaaagcugccccag

SEQ ID NO: 71324 - RNA, 18 nt, Artificial Sequence
  Description of Artificial Sequence: Synthetic oligonucleotide
accuguccagaaagcugc

SEQ ID NO: 71325 - RNA, 18 nt, Artificial Sequence
  Description of Artificial Sequence: Synthetic oligonucleotide
gacggaccuguccagaaa

SEQ ID NO: 71326 - RNA, 18 nt, Artificial Sequence
  Description of Artificial Sequence: Synthetic oligonucleotide
gaggagacggaccugucc

SEQ ID NO: 71327 - RNA, 18 nt, Artificial Sequence
  Description of Artificial Sequence: Synthetic oligonucleotide
ccaaggaggagacggacc

SEQ ID NO: 71328 - RNA, 18 nt, Artificial Sequence
  Description of Artificial Sequence: Synthetic oligonucleotide
gggccccaaggaggagac

SEQ ID NO: 71329 - RNA, 18 nt, Artificial Sequence
  Description of Artificial Sequence: Synthetic oligonucleotide
cugcagggccccaaggag

SEQ ID NO: 71330 - RNA, 18 nt, Artificial Sequence
  Description of Artificial Sequence: Synthetic oligonucleotide
aggcucugcagggcccca

SEQ ID NO: 71331 - RNA, 18 nt, Artificial Sequence
  Description of Artificial Sequence: Synthetic oligonucleotide
caaggaggcucugcaggg

SEQ ID NO: 71332 - RNA, 18 nt, Artificial Sequence
  Description of Artificial Sequence: Synthetic oligonucleotide
gguuccaaggaggcucug

SEQ ID NO: 71333 - RNA, 18 nt, Artificial Sequence
  Description of Artificial Sequence: Synthetic oligonucleotide
ucuacagaucccuugacu

SEQ ID NO: 71334 - RNA, 18 nt, Artificial Sequence
  Description of Artificial Sequence: Synthetic oligonucleotide
caguuucuacagaucccu

SEQ ID NO: 71335 - RNA, 18 nt, Artificial Sequence
  Description of Artificial Sequence: Synthetic oligonucleotide
aagaacaguuucuacaga

SEQ ID NO: 71336 - RNA, 18 nt, Artificial Sequence
  Description of Artificial Sequence: Synthetic oligonucleotide
cagaaaagaacaguuucu

SEQ ID NO: 71337 - RNA, 18 nt, Artificial Sequence
  Description of Artificial Sequence: Synthetic oligonucleotide
ugagucagaaaagaacag

SEQ ID NO: 71338 - RNA, 18 nt, Artificial Sequence
  Description of Artificial Sequence: Synthetic oligonucleotide
gggacugagucagaaaag

SEQ ID NO: 71339 - RNA, 18 nt, Artificial Sequence
  Description of Artificial Sequence: Synthetic oligonucleotide
cuucccucaggucuucua

SEQ ID NO: 71340 - RNA, 18 nt, Artificial Sequence
  Description of Artificial Sequence: Synthetic oligonucleotide
cccuucuucccucagguc

SEQ ID NO: 71341 - RNA, 18 nt, Artificial Sequence
  Description of Artificial Sequence: Synthetic oligonucleotide
aagagcccuucuucccuc

SEQ ID NO: 71342 - RNA, 18 nt, Artificial Sequence
  Description of Artificial Sequence: Synthetic oligonucleotide
ccuggaagagcccuucuu

SEQ ID NO: 71343 - RNA, 18 nt, Artificial Sequence
  Description of Artificial Sequence: Synthetic oligonucleotide
agcucccuggaagagccc

SEQ ID NO: 71344 - RNA, 18 nt, Artificial Sequence
  Description of Artificial Sequence: Synthetic oligonucleotide
ccuugagcucccuggaag

SEQ ID NO: 71345 - RNA, 18 nt, Artificial Sequence
  Description of Artificial Sequence: Synthetic oligonucleotide
ucugcccuugagcucccu

SEQ ID NO: 71346 - RNA, 18 nt, Artificial Sequence
  Description of Artificial Sequence: Synthetic oligonucleotide
gcucuucugcccuugagc

SEQ ID NO: 71347 - RNA, 18 nt, Artificial Sequence
  Description of Artificial Sequence: Synthetic oligonucleotide
gaucagcucuucugcccu

SEQ ID NO: 71348 - RNA, 18 nt, Artificial Sequence
  Description of Artificial Sequence: Synthetic oligonucleotide
uaguagaucagcucuucu

SEQ ID NO: 71349 - RNA, 18 nt, Artificial Sequence
  Description of Artificial Sequence: Synthetic oligonucleotide
acucuuaguagaucagcu

SEQ ID NO: 71350 - RNA, 18 nt, Artificial Sequence
  Description of Artificial Sequence: Synthetic oligonucleotide
ggagcacucuuaguagau

SEQ ID NO: 71351 - RNA, 18 nt, Artificial Sequence
  Description of Artificial Sequence: Synthetic oligonucleotide
ggcagggagcacucuuag

SEQ ID NO: 71352 - RNA, 18 nt, Artificial Sequence
  Description of Artificial Sequence: Synthetic oligonucleotide
uggcuggcagggagcacu

SEQ ID NO: 71353 - RNA, 18 nt, Artificial Sequence
  Description of Artificial Sequence: Synthetic oligonucleotide
cauuguggcuggcaggga

SEQ ID NO: 71354 - RNA, 18 nt, Artificial Sequence
  Description of Artificial Sequence: Synthetic oligonucleotide
ccaggcauuguggcuggc

SEQ ID NO: 71355 - RNA, 18 nt, Artificial Sequence
  Description of Artificial Sequence: Synthetic oligonucleotide
ucuucugcccuugagcuc

SEQ ID NO: 71356 - RNA, 18 nt, Artificial Sequence
  Description of Artificial Sequence: Synthetic oligonucleotide
ucagcucuucugcccuug

SEQ ID NO: 71357 - RNA, 18 nt, Artificial Sequence
  Description of Artificial Sequence: Synthetic oligonucleotide
guagaucagcucuucugc

SEQ ID NO: 71358 - RNA, 18 nt, Artificial Sequence
  Description of Artificial Sequence: Synthetic oligonucleotide
ucuuaguagaucagcucu

SEQ ID NO: 71359 - RNA, 18 nt, Artificial Sequence
  Description of Artificial Sequence: Synthetic oligonucleotide
agcacucuuaguagauca

SEQ ID NO: 71360 - RNA, 18 nt, Artificial Sequence
  Description of Artificial Sequence: Synthetic oligonucleotide
cagggagcacucuuagua

SEQ ID NO: 71361 - RNA, 18 nt, Artificial Sequence
  Description of Artificial Sequence: Synthetic oligonucleotide
gcuggcagggagcacucu

SEQ ID NO: 71362 - RNA, 18 nt, Artificial Sequence
  Description of Artificial Sequence: Synthetic oligonucleotide
uuguggcuggcagggagc

SEQ ID NO: 71363 - RNA, 18 nt, Artificial Sequence
  Description of Artificial Sequence: Synthetic oligonucleotide
aggcauuguggcuggcag

SEQ ID NO: 71364 - RNA, 18 nt, Artificial Sequence
  Description of Artificial Sequence: Synthetic oligonucleotide
uacccaggcauuguggcu

SEQ ID NO: 71365 - RNA, 18 nt, Artificial Sequence
  Description of Artificial Sequence: Synthetic oligonucleotide
gccaguacccaggcauug

SEQ ID NO: 71366 - RNA, 18 nt, Artificial Sequence
  Description of Artificial Sequence: Synthetic oligonucleotide
aggaugccaguacccagg

SEQ ID NO: 71367 - RNA, 18 nt, Artificial Sequence
  Description of Artificial Sequence: Synthetic oligonucleotide
aagacaggaugccaguac

SEQ ID NO: 71368 - RNA, 18 nt, Artificial Sequence
  Description of Artificial Sequence: Synthetic oligonucleotide
uaggaaagacaggaugcc

SEQ ID NO: 71369 - RNA, 18 nt, Artificial Sequence
  Description of Artificial Sequence: Synthetic oligonucleotide
cuaaguaggaaagacagg

SEQ ID NO: 71370 - RNA, 18 nt, Artificial Sequence
  Description of Artificial Sequence: Synthetic oligonucleotide
cuugucuaaguaggaaag

SEQ ID NO: 71371 - RNA, 18 nt, Artificial Sequence
  Description of Artificial Sequence: Synthetic oligonucleotide
ccucccuugucuaaguag

SEQ ID NO: 71372 - RNA, 18 nt, Artificial Sequence
  Description of Artificial Sequence: Synthetic oligonucleotide
ucaggccucccuugucua

SEQ ID NO: 71373 - RNA, 18 nt, Artificial Sequence
  Description of Artificial Sequence: Synthetic oligonucleotide
agaucucaggccucccuu

SEQ ID NO: 71374 - RNA, 18 nt, Artificial Sequence
  Description of Artificial Sequence: Synthetic oligonucleotide
gggccagaucucaggccu

SEQ ID NO: 71375 - RNA, 18 nt, Artificial Sequence
  Description of Artificial Sequence: Synthetic oligonucleotide
caccagggccagaucuca

SEQ ID NO: 71376 - RNA, 18 nt, Artificial Sequence
  Description of Artificial Sequence: Synthetic oligonucleotide
ccaaacaccagggccaga

SEQ ID NO: 71377 - RNA, 18 nt, Artificial Sequence
  Description of Artificial Sequence: Synthetic oligonucleotide
ugaggccaaacaccaggg

SEQ ID NO: 71378 - RNA, 18 nt, Artificial Sequence
  Description of Artificial Sequence: Synthetic oligonucleotide
gguccugaggccaaacac

SEQ ID NO: 71379 - RNA, 18 nt, Artificial Sequence
  Description of Artificial Sequence: Synthetic oligonucleotide
uccugcccuguggaggaa

SEQ ID NO: 71380 - RNA, 18 nt, Artificial Sequence
  Description of Artificial Sequence: Synthetic oligonucleotide
ugugguccugcccugugg

SEQ ID NO: 71381 - RNA, 18 nt, Artificial Sequence
  Description of Artificial Sequence: Synthetic oligonucleotide
ugagcugugguccugccc

SEQ ID NO: 71382 - RNA, 18 nt, Artificial Sequence
  Description of Artificial Sequence: Synthetic oligonucleotide
ccuugugagcuguggucc

SEQ ID NO: 71383 - RNA, 18 nt, Artificial Sequence
  Description of Artificial Sequence: Synthetic oligonucleotide
gggauccuugugagcugu

SEQ ID NO: 71384 - RNA, 18 nt, Artificial Sequence
  Description of Artificial Sequence: Synthetic oligonucleotide
gcauugggauccuuguga

SEQ ID NO: 71385 - RNA, 18 nt, Artificial Sequence
  Description of Artificial Sequence: Synthetic oligonucleotide
agauggcauugggauccu

SEQ ID NO: 71386 - RNA, 18 nt, Artificial Sequence
  Description of Artificial Sequence: Synthetic oligonucleotide
caggaagauggcauuggg

SEQ ID NO: 71387 - RNA, 18 nt, Artificial Sequence
  Description of Artificial Sequence: Synthetic oligonucleotide
aagcucaggaagauggca

SEQ ID NO: 71388 - RNA, 18 nt, Artificial Sequence
  Description of Artificial Sequence: Synthetic oligonucleotide
guuggaagcucaggaaga

SEQ ID NO: 71389 - RNA, 18 nt, Artificial Sequence
  Description of Artificial Sequence: Synthetic oligonucleotide
cagguguuggaagcucag

SEQ ID NO: 71390 - RNA, 18 nt, Artificial Sequence
  Description of Artificial Sequence: Synthetic oligonucleotide
cggagcagguguuggaag

SEQ ID NO: 71391 - RNA, 18 nt, Artificial Sequence
  Description of Artificial Sequence: Synthetic oligonucleotide
uuccucggagcagguguu

SEQ ID NO: 71392 - RNA, 18 nt, Artificial Sequence
  Description of Artificial Sequence: Synthetic oligonucleotide
acgccugccugggccacu

SEQ ID NO: 71393 - RNA, 18 nt, Artificial Sequence
  Description of Artificial Sequence: Synthetic oligonucleotide
gucauacgccugccuggg

SEQ ID NO: 71394 - RNA, 18 nt, Artificial Sequence
  Description of Artificial Sequence: Synthetic oligonucleotide
agcaggucauacgccugc

SEQ ID NO: 71395 - RNA, 18 nt, Artificial Sequence
  Description of Artificial Sequence: Synthetic oligonucleotide
acagcagcaggucauacg

SEQ ID NO: 71396 - RNA, 18 nt, Artificial Sequence
  Description of Artificial Sequence: Synthetic oligonucleotide
ccuccacagcagcagguc

SEQ ID NO: 71397 - RNA, 18 nt, Artificial Sequence
  Description of Artificial Sequence: Synthetic oligonucleotide
cagccccuccacagcagc

SEQ ID NO: 71398 - RNA, 18 nt, Artificial Sequence
  Description of Artificial Sequence: Synthetic oligonucleotide
gggcacagccccuccaca

SEQ ID NO: 71399 - RNA, 18 nt, Artificial Sequence
  Description of Artificial Sequence: Synthetic oligonucleotide
aagacauguggcgguggg

SEQ ID NO: 71400 - RNA, 18 nt, Artificial Sequence
  Description of Artificial Sequence: Synthetic oligonucleotide
aggaagacauguggcggu

SEQ ID NO: 71401 - RNA, 18 nt, Artificial Sequence
  Description of Artificial Sequence: Synthetic oligonucleotide
uggguaggaagacaugug

SEQ ID NO: 71402 - RNA, 18 nt, Artificial Sequence
  Description of Artificial Sequence: Synthetic oligonucleotide
gcagauggguaggaagac

SEQ ID NO: 71403 - RNA, 18 nt, Artificial Sequence
  Description of Artificial Sequence: Synthetic oligonucleotide
agcaggcagcccucuggg

SEQ ID NO: 71404 - RNA, 18 nt, Artificial Sequence
  Description of Artificial Sequence: Synthetic oligonucleotide
ugcacagcaggcagcccu

SEQ ID NO: 71405 - RNA, 18 nt, Artificial Sequence
  Description of Artificial Sequence: Synthetic oligonucleotide
ccaagugcacagcaggca

SEQ ID NO: 71406 - RNA, 18 nt, Artificial Sequence
  Description of Artificial Sequence: Synthetic oligonucleotide
aggacccaagugcacagc

SEQ ID NO: 71407 - RNA, 18 nt, Artificial Sequence
  Description of Artificial Sequence: Synthetic oligonucleotide
gcuccaggacccaagugc

SEQ ID NO: 71408 - RNA, 18 nt, Artificial Sequence
  Description of Artificial Sequence: Synthetic oligonucleotide
gaagggcuccaggaccca

SEQ ID NO: 71409 - RNA, 18 nt, Artificial Sequence
  Description of Artificial Sequence: Synthetic oligonucleotide
guggagaagggcuccagg

SEQ ID NO: 71410 - RNA, 18 nt, Artificial Sequence
  Description of Artificial Sequence: Synthetic oligonucleotide
cccacacccugcuggcca

SEQ ID NO: 71411 - RNA, 18 nt, Artificial Sequence
  Description of Artificial Sequence: Synthetic oligonucleotide
auaaccccacacccugcu

SEQ ID NO: 71412 - RNA, 18 nt, Artificial Sequence
  Description of Artificial Sequence: Synthetic oligonucleotide
cucacauaaccccacacc

SEQ ID NO: 71413 - RNA, 18 nt, Artificial Sequence
  Description of Artificial Sequence: Synthetic oligonucleotide
cuacccucacauaacccc

SEQ ID NO: 71414 - RNA, 18 nt, Artificial Sequence
  Description of Artificial Sequence: Synthetic oligonucleotide
ccuuucuacccucacaua

SEQ ID NO: 71415 - RNA, 18 nt, Artificial Sequence
  Description of Artificial Sequence: Synthetic oligonucleotide
gcuguccuuucuacccuc

SEQ ID NO: 71416 - RNA, 18 nt, Artificial Sequence
  Description of Artificial Sequence: Synthetic oligonucleotide
ucuuugcuguccuuucua

SEQ ID NO: 71417 - RNA, 18 nt, Artificial Sequence
  Description of Artificial Sequence: Synthetic oligonucleotide
auuucucuuugcuguccu

SEQ ID NO: 71418 - RNA, 18 nt, Artificial Sequence
  Description of Artificial Sequence: Synthetic oligonucleotide
agcccauuucucuuugcu

SEQ ID NO: 71419 - RNA, 18 nt, Artificial Sequence
  Description of Artificial Sequence: Synthetic oligonucleotide
cugggagcccauuucucu

SEQ ID NO: 71420 - RNA, 18 nt, Artificial Sequence
  Description of Artificial Sequence: Synthetic oligonucleotide
cccagcugggagcccauu

SEQ ID NO: 71421 - RNA, 18 nt, Artificial Sequence
  Description of Artificial Sequence: Synthetic oligonucleotide
ccucccccagcugggagc

SEQ ID NO: 71422 - RNA, 18 nt, Artificial Sequence
  Description of Artificial Sequence: Synthetic oligonucleotide
cugccccucccccagcug

SEQ ID NO: 71423 - RNA, 18 nt, Artificial Sequence
  Description of Artificial Sequence: Synthetic oligonucleotide
uuugccugccccuccccc

SEQ ID NO: 71424 - RNA, 18 nt, Artificial Sequence
  Description of Artificial Sequence: Synthetic oligonucleotide
uccaguuugccugccccu

SEQ ID NO: 71425 - RNA, 18 nt, Artificial Sequence
  Description of Artificial Sequence: Synthetic oligonucleotide
uagguuccaguuugccug

SEQ ID NO: 71426 - RNA, 18 nt, Artificial Sequence
  Description of Artificial Sequence: Synthetic oligonucleotide
gccuguagguuccaguuu

SEQ ID NO: 71427 - RNA, 18 nt, Artificial Sequence
  Description of Artificial Sequence: Synthetic oligonucleotide
ucagugccuguagguucc

SEQ ID NO: 71428 - RNA, 18 nt, Artificial Sequence
  Description of Artificial Sequence: Synthetic oligonucleotide
aaaggucagugccuguag

SEQ ID NO: 71429 - RNA, 18 nt, Artificial Sequence
  Description of Artificial Sequence: Synthetic oligonucleotide
ucgacaaaggucagugcc

SEQ ID NO: 71430 - RNA, 18 nt, Artificial Sequence
  Description of Artificial Sequence: Synthetic oligonucleotide
ucuucucgacaaagguca

SEQ ID NO: 71431 - RNA, 18 nt, Artificial Sequence
  Description of Artificial Sequence: Synthetic oligonucleotide
uacacucuucucgacaaa

SEQ ID NO: 71432 - RNA, 18 nt, Artificial Sequence
  Description of Artificial Sequence: Synthetic oligonucleotide
aaggcuacacucuucucg

SEQ ID NO: 71433 - RNA, 18 nt, Artificial Sequence
  Description of Artificial Sequence: Synthetic oligonucleotide
cugggaaggcuacacucu

SEQ ID NO: 71434 - RNA, 18 nt, Artificial Sequence
  Description of Artificial Sequence: Synthetic oligonucleotide
ccauucugggaaggcuac

SEQ ID NO: 71435 - RNA, 18 nt, Artificial Sequence
  Description of Artificial Sequence: Synthetic oligonucleotide
uccucccauucugggaag

SEQ ID NO: 71436 - RNA, 18 nt, Artificial Sequence
  Description of Artificial Sequence: Synthetic oligonucleotide
ccugcuccucccauucug

SEQ ID NO: 71437 - RNA, 18 nt, Artificial Sequence
  Description of Artificial Sequence: Synthetic oligonucleotide
ucugcccugcuccuccca

SEQ ID NO: 71438 - RNA, 18 nt, Artificial Sequence
  Description of Artificial Sequence: Synthetic oligonucleotide
ccugcucugcccugcucc

SEQ ID NO: 71439 - RNA, 18 nt, Artificial Sequence
  Description of Artificial Sequence: Synthetic oligonucleotide
cuaccccugcucugcccu

SEQ ID NO: 71440 - RNA, 18 nt, Artificial Sequence
  Description of Artificial Sequence: Synthetic oligonucleotide
acccccuaccccugcucu

SEQ ID NO: 71441 - RNA, 18 nt, Artificial Sequence
  Description of Artificial Sequence: Synthetic oligonucleotide
accccacccccuaccccu

SEQ ID NO: 71442 - RNA, 18 nt, Artificial Sequence
  Description of Artificial Sequence: Synthetic oligonucleotide
ccagcaccccacccccua

SEQ ID NO: 71443 - RNA, 18 nt, Artificial Sequence
  Description of Artificial Sequence: Synthetic oligonucleotide
agaaaccagcaccccacc

SEQ ID NO: 71444 - RNA, 18 nt, Artificial Sequence
  Description of Artificial Sequence: Synthetic oligonucleotide
cccucagaaaccagcacc

SEQ ID NO: 71445 - RNA, 18 nt, Artificial Sequence
  Description of Artificial Sequence: Synthetic oligonucleotide
ucagucccucagaaacca

SEQ ID NO: 71446 - RNA, 18 nt, Artificial Sequence
  Description of Artificial Sequence: Synthetic oligonucleotide
agugaucagucccucaga

SEQ ID NO: 71447 - RNA, 18 nt, Artificial Sequence
  Description of Artificial Sequence: Synthetic oligonucleotide
aaguaagugaucaguccc

SEQ ID NO: 71448 - RNA, 18 nt, Artificial Sequence
  Description of Artificial Sequence: Synthetic oligonucleotide
ccaccaaguaagugauca

SEQ ID NO: 71449 - RNA, 18 nt, Artificial Sequence
  Description of Artificial Sequence: Synthetic oligonucleotide
guauuccaccaaguaagu

SEQ ID NO: 71450 - RNA, 18 nt, Artificial Sequence
  Description of Artificial Sequence: Synthetic oligonucleotide
gugcuguauuccaccaag

SEQ ID NO: 71451 - RNA, 18 nt, Artificial Sequence
  Description of Artificial Sequence: Synthetic oligonucleotide
gggcugugcuguauucca

SEQ ID NO: 71452 - RNA, 18 nt, Artificial Sequence
  Description of Artificial Sequence: Synthetic oligonucleotide
agccagggcugugcugua

SEQ ID NO: 71453 - RNA, 18 nt, Artificial Sequence
  Description of Artificial Sequence: Synthetic oligonucleotide
gggccagccagggcugug

SEQ ID NO: 71454 - RNA, 18 nt, Artificial Sequence
  Description of Artificial Sequence: Synthetic oligonucleotide
ccuuagggccagccaggg

SEQ ID NO: 71455 - RNA, 18 nt, Artificial Sequence
  Description of Artificial Sequence: Synthetic oligonucleotide
ccuuuccuuagggccagc

SEQ ID NO: 71456 - RNA, 18 nt, Artificial Sequence
  Description of Artificial Sequence: Synthetic oligonucleotide
uguccccuuuccuuaggg

SEQ ID NO: 71457 - RNA, 18 nt, Artificial Sequence
  Description of Artificial Sequence: Synthetic oligonucleotide
gcucauguccccuuuccu

SEQ ID NO: 71458 - RNA, 18 nt, Artificial Sequence
  Description of Artificial Sequence: Synthetic oligonucleotide
ccugggcucauguccccu

SEQ ID NO: 71459 - RNA, 18 nt, Artificial Sequence
  Description of Artificial Sequence: Synthetic oligonucleotide
uucucccugggcucaugu

SEQ ID NO: 71460 - RNA, 18 nt, Artificial Sequence
  Description of Artificial Sequence: Synthetic oligonucleotide
uuauuuucucccugggcu

SEQ ID NO: 71461 - RNA, 18 nt, Artificial Sequence
  Description of Artificial Sequence: Synthetic oligonucleotide
cucucuuauuuucucccu

SEQ ID NO: 71462 - RNA, 18 nt, Artificial Sequence
  Description of Artificial Sequence: Synthetic oligonucleotide
gcucccucucuuauuuuc

SEQ ID NO: 71463 - RNA, 18 nt, Artificial Sequence
  Description of Artificial Sequence: Synthetic oligonucleotide
gugcagcucccucucuua

SEQ ID NO: 71464 - RNA, 18 nt, Artificial Sequence
  Description of Artificial Sequence: Synthetic oligonucleotide
ccuaagugcagcucccuc

SEQ ID NO: 71465 - RNA, 18 nt, Artificial Sequence
  Description of Artificial Sequence: Synthetic oligonucleotide
uaagcccuaagugcagcu

SEQ ID NO: 71466 - RNA, 18 nt, Artificial Sequence
  Description of Artificial Sequence: Synthetic oligonucleotide
uuugcuaagcccuaagug

SEQ ID NO: 71467 - RNA, 18 nt, Artificial Sequence
  Description of Artificial Sequence: Synthetic oligonucleotide
cuguguuugcuaagcccu

SEQ ID NO: 71468 - RNA, 18 nt, Artificial Sequence
  Description of Artificial Sequence: Synthetic oligonucleotide
uacuacuguguuugcuaa

SEQ ID NO: 71469 - RNA, 18 nt, Artificial Sequence
  Description of Artificial Sequence: Synthetic oligonucleotide
caucuuacuacuguguuu

SEQ ID NO: 71470 - RNA, 18 nt, Artificial Sequence
  Description of Artificial Sequence: Synthetic oligonucleotide
guguccaucuuacuacug

SEQ ID NO: 71471 - RNA, 18 nt, Artificial Sequence
  Description of Artificial Sequence: Synthetic oligonucleotide
gggcuguguccaucuuac

SEQ ID NO: 71472 - RNA, 18 nt, Artificial Sequence
  Description of Artificial Sequence: Synthetic oligonucleotide
aaugaccagcuaagaaug

SEQ ID NO: 71473 - RNA, 18 nt, Artificial Sequence
  Description of Artificial Sequence: Synthetic oligonucleotide
cgaggaaugaccagcuaa

SEQ ID NO: 71474 - RNA, 18 nt, Artificial Sequence
  Description of Artificial Sequence: Synthetic oligonucleotide
gcuaacgaggaaugacca

SEQ ID NO: 71475 - RNA, 18 nt, Artificial Sequence
  Description of Artificial Sequence: Synthetic oligonucleotide
cuuaagcuaacgaggaau

SEQ ID NO: 71476 - RNA, 18 nt, Artificial Sequence
  Description of Artificial Sequence: Synthetic oligonucleotide
agaaccuuaagcuaacga

SEQ ID NO: 71477 - RNA, 18 nt, Artificial Sequence
  Description of Artificial Sequence: Synthetic oligonucleotide
gauucagaaccuuaagcu

SEQ ID NO: 71478 - RNA, 18 nt, Artificial Sequence
  Description of Artificial Sequence: Synthetic oligonucleotide
caccagauucagaaccuu

SEQ ID NO: 71479 - RNA, 18 nt, Artificial Sequence
  Description of Artificial Sequence: Synthetic oligonucleotide
cccagcaccagauucaga

SEQ ID NO: 71480 - RNA, 18 nt, Artificial Sequence
  Description of Artificial Sequence: Synthetic oligonucleotide
gcuuccccagcaccagau

SEQ ID NO: 71481 - RNA, 18 nt, Artificial Sequence
  Description of Artificial Sequence: Synthetic oligonucleotide
gcccagcuuccccagcac

SEQ ID NO: 71482 - RNA, 18 nt, Artificial Sequence
  Description of Artificial Sequence: Synthetic oligonucleotide
gccuggcccagcuucccc

SEQ ID NO: 71483 - RNA, 18 nt, Artificial Sequence
  Description of Artificial Sequence: Synthetic oligonucleotide
ggcuugccuggcccagcu

SEQ ID NO: 71484 - RNA, 18 nt, Artificial Sequence
  Description of Artificial Sequence: Synthetic oligonucleotide
gcccuggcuugccuggcc

SEQ ID NO: 71485 - RNA, 18 nt, Artificial Sequence
  Description of Artificial Sequence: Synthetic oligonucleotide
cuugcgcccuggcuugcc

SEQ ID NO: 71486 - RNA, 18 nt, Artificial Sequence
  Description of Artificial Sequence: Synthetic oligonucleotide
cucuccuugcgcccuggc

SEQ ID NO: 71487 - RNA, 18 nt, Artificial Sequence
  Description of Artificial Sequence: Synthetic oligonucleotide
uuacccucuccuugcgcc

SEQ ID NO: 71488 - RNA, 18 nt, Artificial Sequence
  Description of Artificial Sequence: Synthetic oligonucleotide
ucccauuacccucuccuu

SEQ ID NO: 71489 - RNA, 18 nt, Artificial Sequence
  Description of Artificial Sequence: Synthetic oligonucleotide
ccuccucccauuacccuc

SEQ ID NO: 71490 - RNA, 18 nt, Artificial Sequence
  Description of Artificial Sequence: Synthetic oligonucleotide
ugggcccuccucccauua

SEQ ID NO: 71491 - RNA, 18 nt, Artificial Sequence
  Description of Artificial Sequence: Synthetic oligonucleotide
augagugggcccuccucc

SEQ ID NO: 71492 - RNA, 18 nt, Artificial Sequence
  Description of Artificial Sequence: Synthetic oligonucleotide
ucaacaugagugggcccu

SEQ ID NO: 71493 - RNA, 18 nt, Artificial Sequence
  Description of Artificial Sequence: Synthetic oligonucleotide
gucugucaacaugagugg

SEQ ID NO: 71494 - RNA, 18 nt, Artificial Sequence
  Description of Artificial Sequence: Synthetic oligonucleotide
uguaggucugucaacaug

SEQ ID NO: 71495 - RNA, 18 nt, Artificial Sequence
  Description of Artificial Sequence: Synthetic oligonucleotide
uuuccuguaggucuguca

SEQ ID NO: 71496 - RNA, 18 nt, Artificial Sequence
  Description of Artificial Sequence: Synthetic oligonucleotide
ugggauuuccuguagguc

SEQ ID NO: 71497 - RNA, 18 nt, Artificial Sequence
  Description of Artificial Sequence: Synthetic oligonucleotide
aauauugggauuuccugu

SEQ ID NO: 71498 - RNA, 18 nt, Artificial Sequence
  Description of Artificial Sequence: Synthetic oligonucleotide
gauucaauauugggauuu

SEQ ID NO: 71499 - RNA, 18 nt, Artificial Sequence
  Description of Artificial Sequence: Synthetic oligonucleotide
caccugauucaauauugg

SEQ ID NO: 71500 - RNA, 18 nt, Artificial Sequence
  Description of Artificial Sequence: Synthetic oligonucleotide
gcuugcaccugauucaau

SEQ ID NO: 71501 - RNA, 18 nt, Artificial Sequence
  Description of Artificial Sequence: Synthetic oligonucleotide
aagaggcuugcaccugau

SEQ ID NO: 71502 - RNA, 18 nt, Artificial Sequence
  Description of Artificial Sequence: Synthetic oligonucleotide
gugcaaagaggcuugcac

SEQ ID NO: 71503 - RNA, 18 nt, Artificial Sequence
  Description of Artificial Sequence: Synthetic oligonucleotide
aaguugugcaaagaggcu

SEQ ID NO: 71504 - RNA, 18 nt, Artificial Sequence
  Description of Artificial Sequence: Synthetic oligonucleotide
uucacaaguugugcaaag

SEQ ID NO: 71505 - RNA, 18 nt, Artificial Sequence
  Description of Artificial Sequence: Synthetic oligonucleotide
ucuccuuuuugucaggac

SEQ ID NO: 71506 - RNA, 18 nt, Artificial Sequence
  Description of Artificial Sequence: Synthetic oligonucleotide
uggugucuccuuuuuguc

SEQ ID NO: 71507 - RNA, 18 nt, Artificial Sequence
  Description of Artificial Sequence: Synthetic oligonucleotide
gcauauggugucuccuuu

SEQ ID NO: 71508 - RNA, 18 nt, Artificial Sequence
  Description of Artificial Sequence: Synthetic oligonucleotide
agaaagcauauggugucu

SEQ ID NO: 71509 - RNA, 18 nt, Artificial Sequence
  Description of Artificial Sequence: Synthetic oligonucleotide
aagcaagaaagcauaugg

SEQ ID NO: 71510 - RNA, 18 nt, Artificial Sequence
  Description of Artificial Sequence: Synthetic oligonucleotide
aaagaaagcaagaaagca

SEQ ID NO: 71511 - RNA, 18 nt, Artificial Sequence
  Description of Artificial Sequence: Synthetic oligonucleotide
gaaagaaagaaagcaaga

SEQ ID NO: 71512 - RNA, 18 nt, Artificial Sequence
  Description of Artificial Sequence: Synthetic oligonucleotide
agaaagaaagaaagaaag

SEQ ID NO: 71513 - RNA, 18 nt, Artificial Sequence
  Description of Artificial Sequence: Synthetic oligonucleotide
aagaaagaaagaaagaaa

SEQ ID NO: 71514 - RNA, 18 nt, Artificial Sequence
  Description of Artificial Sequence: Synthetic oligonucleotide
aaagaaagaaagaaagaa

SEQ ID NO: 71515 - RNA, 18 nt, Artificial Sequence
  Description of Artificial Sequence: Synthetic oligonucleotide
aaaaaaaagaaagaaaga

SEQ ID NO: 71516 - RNA, 18 nt, Artificial Sequence
  Description of Artificial Sequence: Synthetic oligonucleotide
caaaaaaaaaaaagaaag

SEQ ID NO: 71517 - RNA, 18 nt, Artificial Sequence
  Description of Artificial Sequence: Synthetic oligonucleotide
cgucucaaaaaaaaaaaa

SEQ ID NO: 71518 - RNA, 18 nt, Artificial Sequence
  Description of Artificial Sequence: Synthetic oligonucleotide
aacuccgucucaaaaaaa

SEQ ID NO: 71519 - RNA, 18 nt, Artificial Sequence
  Description of Artificial Sequence: Synthetic oligonucleotide
agugaaacuccgucucaa

SEQ ID NO: 71520 - RNA, 18 nt, Artificial Sequence
  Description of Artificial Sequence: Synthetic oligonucleotide
auaagagugaaacuccgu

SEQ ID NO: 71521 - RNA, 18 nt, Artificial Sequence
  Description of Artificial Sequence: Synthetic oligonucleotide
gggcaauaagagugaaac

SEQ ID NO: 71522 - RNA, 18 nt, Artificial Sequence
  Description of Artificial Sequence: Synthetic oligonucleotide
agccugggcaauaagagu

SEQ ID NO: 71523 - RNA, 18 nt, Artificial Sequence
  Description of Artificial Sequence: Synthetic oligonucleotide
acuccagccugggcaaua

SEQ ID NO: 71524 - RNA, 18 nt, Artificial Sequence
  Description of Artificial Sequence: Synthetic oligonucleotide
auugcacuccagccuggg

SEQ ID NO: 71525 - RNA, 18 nt, Artificial Sequence
  Description of Artificial Sequence: Synthetic oligonucleotide
gcaccauugcacuccagc

SEQ ID NO: 71526 - RNA, 18 nt, Artificial Sequence
  Description of Artificial Sequence: Synthetic oligonucleotide
agaucgcaccauugcacu

SEQ ID NO: 71527 - RNA, 18 nt, Artificial Sequence
  Description of Artificial Sequence: Synthetic oligonucleotide
agccgagaucgcaccauu

SEQ ID NO: 71528 - RNA, 18 nt, Artificial Sequence
  Description of Artificial Sequence: Synthetic oligonucleotide
uggugagccgagaucgca

SEQ ID NO: 71529 - RNA, 18 nt, Artificial Sequence
  Description of Artificial Sequence: Synthetic oligonucleotide
gguuguggugagccgaga

SEQ ID NO: 71530 - RNA, 18 nt, Artificial Sequence
  Description of Artificial Sequence: Synthetic oligonucleotide
gcggagguuguggugagc

SEQ ID NO: 71531 - RNA, 18 nt, Artificial Sequence
  Description of Artificial Sequence: Synthetic oligonucleotide
gggaggcggagguugugg

SEQ ID NO: 71532 - RNA, 18 nt, Artificial Sequence
  Description of Artificial Sequence: Synthetic oligonucleotide
uaccugggaggcggaggu

SEQ ID NO: 71533 - RNA, 18 nt, Artificial Sequence
  Description of Artificial Sequence: Synthetic oligonucleotide
gcuuguaccugggaggcg

SEQ ID NO: 71534 - RNA, 18 nt, Artificial Sequence
  Description of Artificial Sequence: Synthetic oligonucleotide
gaaucgcuuguaccuggg

SEQ ID NO: 71535 - RNA, 18 nt, Artificial Sequence
  Description of Artificial Sequence: Synthetic oligonucleotide
caggagaaucgcuuguac

SEQ ID NO: 71536 - RNA, 18 nt, Artificial Sequence
  Description of Artificial Sequence: Synthetic oligonucleotide
ugagacaggagaaucgcu

SEQ ID NO: 71537 - RNA, 18 nt, Artificial Sequence
  Description of Artificial Sequence: Synthetic oligonucleotide
gaggcugagacaggagaa

SEQ ID NO: 71538 - RNA, 18 nt, Artificial Sequence
  Description of Artificial Sequence: Synthetic oligonucleotide
cuugggaggcugagacag

SEQ ID NO: 71539 - RNA, 18 nt, Artificial Sequence
  Description of Artificial Sequence: Synthetic oligonucleotide
agcuacuugggaggcuga

SEQ ID NO: 71540 - RNA, 18 nt, Artificial Sequence
  Description of Artificial Sequence: Synthetic oligonucleotide
auccaagcuacuugggag

SEQ ID NO: 71541 - RNA, 18 nt, Artificial Sequence
  Description of Artificial Sequence: Synthetic oligonucleotide
cuguaauccaagcuacuu

SEQ ID NO: 71542 - RNA, 18 nt, Artificial Sequence
  Description of Artificial Sequence: Synthetic oligonucleotide
caugccuguaauccaagc

SEQ ID NO: 71543 - RNA, 18 nt, Artificial Sequence
  Description of Artificial Sequence: Synthetic oligonucleotide
ugguucaugccuguaauc

SEQ ID NO: 71544 - RNA, 18 nt, Artificial Sequence
  Description of Artificial Sequence: Synthetic oligonucleotide
uguggugguucaugccug

SEQ ID NO: 71545 - RNA, 18 nt, Artificial Sequence
  Description of Artificial Sequence: Synthetic oligonucleotide
caggguguggugguucau

SEQ ID NO: 71546 - RNA, 18 nt, Artificial Sequence
  Description of Artificial Sequence: Synthetic oligonucleotide
acuagcaggguguggugg

SEQ ID NO: 71547 - RNA, 18 nt, Artificial Sequence
  Description of Artificial Sequence: Synthetic oligonucleotide
aaaaaacuagcagggugu

SEQ ID NO: 71548 - RNA, 18 nt, Artificial Sequence
  Description of Artificial Sequence: Synthetic oligonucleotide
auacaaaaaaacuagcag

SEQ ID NO: 71549 - RNA, 18 nt, Artificial Sequence
  Description of Artificial Sequence: Synthetic oligonucleotide
acgaaauacaaaaaaacu

SEQ ID NO: 71550 - RNA, 18 nt, Artificial Sequence
  Description of Artificial Sequence: Synthetic oligonucleotide
gcucuacgaaauacaaaa

SEQ ID NO: 71551 - RNA, 18 nt, Artificial Sequence
  Description of Artificial Sequence: Synthetic oligonucleotide
ccccggcucuacgaaaua

SEQ ID NO: 71552 - RNA, 18 nt, Artificial Sequence
  Description of Artificial Sequence: Synthetic oligonucleotide
ugaaaccccggcucuacg

SEQ ID NO: 71553 - RNA, 18 nt, Artificial Sequence
  Description of Artificial Sequence: Synthetic oligonucleotide
cauggugaaaccccggcu

SEQ ID NO: 71554 - RNA, 18 nt, Artificial Sequence
  Description of Artificial Sequence: Synthetic oligonucleotide
acuaacauggugaaaccc

SEQ ID NO: 71555 - RNA, 18 nt, Artificial Sequence
  Description of Artificial Sequence: Synthetic oligonucleotide
gccucacuaacaugguga

SEQ ID NO: 71556 - RNA, 18 nt, Artificial Sequence
  Description of Artificial Sequence: Synthetic oligonucleotide
caccagccucacuaacau

SEQ ID NO: 71557 - RNA, 18 nt, Artificial Sequence
  Description of Artificial Sequence: Synthetic oligonucleotide
uucgccaccagccucacu

SEQ ID NO: 71558 - RNA, 18 nt, Artificial Sequence
  Description of Artificial Sequence: Synthetic oligonucleotide
aggaguucgccaccagcc

SEQ ID NO: 71559 - RNA, 18 nt, Artificial Sequence
  Description of Artificial Sequence: Synthetic oligonucleotide
aggucaggaguucgccac

SEQ ID NO: 71560 - RNA, 18 nt, Artificial Sequence
  Description of Artificial Sequence: Synthetic oligonucleotide
accugaggucaggaguuc

SEQ ID NO: 71561 - RNA, 18 nt, Artificial Sequence
  Description of Artificial Sequence: Synthetic oligonucleotide
ggaucaccugaggucagg

SEQ ID NO: 71562 - RNA, 18 nt, Artificial Sequence
  Description of Artificial Sequence: Synthetic oligonucleotide
cggguggaucaccugagg

SEQ ID NO: 71563 - RNA, 18 nt, Artificial Sequence
  Description of Artificial Sequence: Synthetic oligonucleotide
caaggcggguggaucacc

SEQ ID NO: 71564 - RNA, 18 nt, Artificial Sequence
  Description of Artificial Sequence: Synthetic oligonucleotide
gaguccaaggcgggugga

SEQ ID NO: 71565 - RNA, 18 nt, Artificial Sequence
  Description of Artificial Sequence: Synthetic oligonucleotide
uuugggaguccaaggcgg

SEQ ID NO: 71566 - RNA, 18 nt, Artificial Sequence
  Description of Artificial Sequence: Synthetic oligonucleotide
agcacuuugggaguccaa

SEQ ID NO: 71567 - RNA, 18 nt, Artificial Sequence
  Description of Artificial Sequence: Synthetic oligonucleotide
aucccagcacuuugggag

SEQ ID NO: 71568 - RNA, 18 nt, Artificial Sequence
  Description of Artificial Sequence: Synthetic oligonucleotide
cuguaaucccagcacuuu

SEQ ID NO: 71569 - RNA, 18 nt, Artificial Sequence
  Description of Artificial Sequence: Synthetic oligonucleotide
caugccuguaaucccagc

SEQ ID NO: 71570 - RNA, 18 nt, Artificial Sequence
  Description of Artificial Sequence: Synthetic oligonucleotide
uggcucaugccuguaauc

SEQ ID NO: 71571 - RNA, 18 nt, Artificial Sequence
  Description of Artificial Sequence: Synthetic oligonucleotide
ugcaguggcucaugccug

SEQ ID NO: 71572 - RNA, 18 nt, Artificial Sequence
  Description of Artificial Sequence: Synthetic oligonucleotide
ccgggugcaguggcucau

SEQ ID NO: 71573 - RNA, 18 nt, Artificial Sequence
  Description of Artificial Sequence: Synthetic oligonucleotide
gugugccgggugcagugg

SEQ ID NO: 71574 - RNA, 18 nt, Artificial Sequence
  Description of Artificial Sequence: Synthetic oligonucleotide
auauggugugccgggugc

SEQ ID NO: 71575 - RNA, 18 nt, Artificial Sequence
  Description of Artificial Sequence: Synthetic oligonucleotide
aaagcauauggugugccg

SEQ ID NO: 71576 - RNA, 18 nt, Artificial Sequence
  Description of Artificial Sequence: Synthetic oligonucleotide
ugaugaaagcauauggug

SEQ ID NO: 71577 - RNA, 18 nt, Artificial Sequence
  Description of Artificial Sequence: Synthetic oligonucleotide
ucuugugaugaaagcaua

SEQ ID NO: 71578 - RNA, 18 nt, Artificial Sequence
  Description of Artificial Sequence: Synthetic oligonucleotide
cauuuucuugugaugaaa

SEQ ID NO: 71579 - RNA, 18 nt, Artificial Sequence
  Description of Artificial Sequence: Synthetic oligonucleotide
ucucacauuuucuuguga

SEQ ID NO: 71580 - RNA, 18 nt, Artificial Sequence
  Description of Artificial Sequence: Synthetic oligonucleotide
aauucucucacauuuucu

SEQ ID NO: 71581 - RNA, 18 nt, Artificial Sequence
  Description of Artificial Sequence: Synthetic oligonucleotide
cccugaauucucucacau

SEQ ID NO: 71582 - RNA, 18 nt, Artificial Sequence
  Description of Artificial Sequence: Synthetic oligonucleotide
caaagcccugaauucucu

SEQ ID NO: 71583 - RNA, 18 nt, Artificial Sequence
  Description of Artificial Sequence: Synthetic oligonucleotide
acugccaaagcccugaau

SEQ ID NO: 71584 - RNA, 18 nt, Artificial Sequence
  Description of Artificial Sequence: Synthetic oligonucleotide
cuggaacugccaaagccc

SEQ ID NO: 71585 - RNA, 18 nt, Artificial Sequence
  Description of Artificial Sequence: Synthetic oligonucleotide
ccagccuggaacugccaa

SEQ ID NO: 71586 - RNA, 18 nt, Artificial Sequence
  Description of Artificial Sequence: Synthetic oligonucleotide
gcugaccagccuggaacu

SEQ ID NO: 71587 - RNA, 18 nt, Artificial Sequence
  Description of Artificial Sequence: Synthetic oligonucleotide
gagaugcugaccagccug

SEQ ID NO: 71588 - RNA, 18 nt, Artificial Sequence
  Description of Artificial Sequence: Synthetic oligonucleotide
ggcuugagaugcugacca

SEQ ID NO: 71589 - RNA, 18 nt, Artificial Sequence
  Description of Artificial Sequence: Synthetic oligonucleotide
gggagggcuugagaugcu

SEQ ID NO: 71590 - RNA, 18 nt, Artificial Sequence
  Description of Artificial Sequence: Synthetic oligonucleotide
gggugaacagaugcuggg

SEQ ID NO: 71591 - RNA, 18 nt, Artificial Sequence
  Description of Artificial Sequence: Synthetic oligonucleotide
ggcagggugaacagaugc

SEQ ID NO: 71592 - RNA, 18 nt, Artificial Sequence
  Description of Artificial Sequence: Synthetic oligonucleotide
ugccuggcagggugaaca

SEQ ID NO: 71593 - RNA, 18 nt, Artificial Sequence
  Description of Artificial Sequence: Synthetic oligonucleotide
gagacugccuggcagggu

SEQ ID NO: 71594 - RNA, 18 nt, Artificial Sequence
  Description of Artificial Sequence: Synthetic oligonucleotide
aggaagagacugccuggc

SEQ ID NO: 71595 - RNA, 18 nt, Artificial Sequence
  Description of Artificial Sequence: Synthetic oligonucleotide
uuucuaggaagagacugc

SEQ ID NO: 71596 - RNA, 18 nt, Artificial Sequence
  Description of Artificial Sequence: Synthetic oligonucleotide
ccaaguuucuaggaagag

SEQ ID NO: 71597 - RNA, 18 nt, Artificial Sequence
  Description of Artificial Sequence: Synthetic oligonucleotide
uuuaaccaaguuucuagg

SEQ ID NO: 71598 - RNA, 18 nt, Artificial Sequence
  Description of Artificial Sequence: Synthetic oligonucleotide
gaacauuuaaccaaguuu

SEQ ID NO: 71599 - RNA, 18 nt, Artificial Sequence
  Description of Artificial Sequence: Synthetic oligonucleotide
agagugaacauuuaacca

SEQ ID NO: 71600 - RNA, 18 nt, Artificial Sequence
  Description of Artificial Sequence: Synthetic oligonucleotide
caagggugaagaaucuau

SEQ ID NO: 71601 - RNA, 18 nt, Artificial Sequence
  Description of Artificial Sequence: Synthetic oligonucleotide
cgggccaagggugaagaa

SEQ ID NO: 71602 - RNA, 18 nt, Artificial Sequence
  Description of Artificial Sequence: Synthetic oligonucleotide
aaaggcgggccaagggug

SEQ ID NO: 71603 - RNA, 18 nt, Artificial Sequence
  Description of Artificial Sequence: Synthetic oligonucleotide
gggcaaaggcgggccaag

SEQ ID NO: 71604 - RNA, 18 nt, Artificial Sequence
  Description of Artificial Sequence: Synthetic oligonucleotide
ugggcagaguaggguggg

SEQ ID NO: 71605 - RNA, 18 nt, Artificial Sequence
  Description of Artificial Sequence: Synthetic oligonucleotide
acuucugggcagaguagg

SEQ ID NO: 71606 - RNA, 18 nt, Artificial Sequence
  Description of Artificial Sequence: Synthetic oligonucleotide
cuugcacuucugggcaga

SEQ ID NO: 71607 - RNA, 18 nt, Artificial Sequence
  Description of Artificial Sequence: Synthetic oligonucleotide
aggcucuugcacuucugg

SEQ ID NO: 71608 - RNA, 18 nt, Artificial Sequence
  Description of Artificial Sequence: Synthetic oligonucleotide
ggcuuaggcucuugcacu

SEQ ID NO: 71609 - RNA, 18 nt, Artificial Sequence
  Description of Artificial Sequence: Synthetic oligonucleotide
gaggcggcuuaggcucuu

SEQ ID NO: 71610 - RNA, 18 nt, Artificial Sequence
  Description of Artificial Sequence: Synthetic oligonucleotide
ccauggaggcggcuuagg

SEQ ID NO: 71611 - RNA, 18 nt, Artificial Sequence
  Description of Artificial Sequence: Synthetic oligonucleotide
gggccauggaggcggcuu

SEQ ID NO: 71612 - RNA, 18 nt, Artificial Sequence
  Description of Artificial Sequence: Synthetic oligonucleotide
cccugaauccuuccuggg

SEQ ID NO: 71613 - RNA, 18 nt, Artificial Sequence
  Description of Artificial Sequence: Synthetic oligonucleotide
cucuccccugaauccuuc

SEQ ID NO: 71614 - RNA, 18 nt, Artificial Sequence
  Description of Artificial Sequence: Synthetic oligonucleotide
gggccucuccccugaauc

SEQ ID NO: 71615 - RNA, 18 nt, Artificial Sequence
  Description of Artificial Sequence: Synthetic oligonucleotide
cguggcucccuguuuggg

SEQ ID NO: 71616 - RNA, 18 nt, Artificial Sequence
  Description of Artificial Sequence: Synthetic oligonucleotide
gcuggcguggcucccugu

SEQ ID NO: 71617 - RNA, 18 nt, Artificial Sequence
  Description of Artificial Sequence: Synthetic oligonucleotide
gucuggcuggcguggcuc

SEQ ID NO: 71618 - RNA, 18 nt, Artificial Sequence
  Description of Artificial Sequence: Synthetic oligonucleotide
gggugucuggcuggcgug

SEQ ID NO: 71619 - RNA, 18 nt, Artificial Sequence
  Description of Artificial Sequence: Synthetic oligonucleotide
agcuccauucuggccggg

SEQ ID NO: 71620 - RNA, 18 nt, Artificial Sequence
  Description of Artificial Sequence: Synthetic oligonucleotide
cagucagcuccauucugg

SEQ ID NO: 71621 - RNA, 18 nt, Artificial Sequence
  Description of Artificial Sequence: Synthetic oligonucleotide
aagggugaagaaucuauc

SEQ ID NO: 71622 - RNA, 18 nt, Artificial Sequence
  Description of Artificial Sequence: Synthetic oligonucleotide
gggccaagggugaagaau

SEQ ID NO: 71623 - RNA, 18 nt, Artificial Sequence
  Description of Artificial Sequence: Synthetic oligonucleotide
aaggcgggccaaggguga

SEQ ID NO: 71624 - RNA, 18 nt, Artificial Sequence
  Description of Artificial Sequence: Synthetic oligonucleotide
gggcaaaggcgggccaag

SEQ ID NO: 71625 - RNA, 18 nt, Artificial Sequence
  Description of Artificial Sequence: Synthetic oligonucleotide
ugggcagaguaggguggg

SEQ ID NO: 71626 - RNA, 18 nt, Artificial Sequence
  Description of Artificial Sequence: Synthetic oligonucleotide
uucugggcagaguagggu

SEQ ID NO: 71627 - RNA, 18 nt, Artificial Sequence
  Description of Artificial Sequence: Synthetic oligonucleotide
ugcacuucugggcagagu

SEQ ID NO: 71628 - RNA, 18 nt, Artificial Sequence
  Description of Artificial Sequence: Synthetic oligonucleotide
gcucuugcacuucugggc

SEQ ID NO: 71629 - RNA, 18 nt, Artificial Sequence
  Description of Artificial Sequence: Synthetic oligonucleotide
cuuaggcucuugcacuuc

SEQ ID NO: 71630 - RNA, 18 nt, Artificial Sequence
  Description of Artificial Sequence: Synthetic oligonucleotide
ggcggcuuaggcucuugc

SEQ ID NO: 71631 - RNA, 18 nt, Artificial Sequence
  Description of Artificial Sequence: Synthetic oligonucleotide
auggaggcggcuuaggcu

SEQ ID NO: 71632 - RNA, 18 nt, Artificial Sequence
  Description of Artificial Sequence: Synthetic oligonucleotide
gggccauggaggcggcuu

SEQ ID NO: 71633 - RNA, 18 nt, Artificial Sequence
  Description of Artificial Sequence: Synthetic oligonucleotide
cccugaauccuuccuggg

SEQ ID NO: 71634 - RNA, 18 nt, Artificial Sequence
  Description of Artificial Sequence: Synthetic oligonucleotide
ucuccccugaauccuucc

SEQ ID NO: 71635 - RNA, 18 nt, Artificial Sequence
  Description of Artificial Sequence: Synthetic oligonucleotide
gggccucuccccugaauc

SEQ ID NO: 71636 - RNA, 18 nt, Artificial Sequence
  Description of Artificial Sequence: Synthetic oligonucleotide
cguggcucccuguuuggg

SEQ ID NO: 71637 - RNA, 18 nt, Artificial Sequence
  Description of Artificial Sequence: Synthetic oligonucleotide
cuggcguggcucccuguu

SEQ ID NO: 71638 - RNA, 18 nt, Artificial Sequence
  Description of Artificial Sequence: Synthetic oligonucleotide
ucuggcuggcguggcucc

SEQ ID NO: 71639 - RNA, 18 nt, Artificial Sequence
  Description of Artificial Sequence: Synthetic oligonucleotide
gggugucuggcuggcgug

SEQ ID NO: 71640 - RNA, 18 nt, Artificial Sequence
  Description of Artificial Sequence: Synthetic oligonucleotide
agcuccauucuggccggg

SEQ ID NO: 71641 - RNA, 18 nt, Artificial Sequence
  Description of Artificial Sequence: Synthetic oligonucleotide
ucagcuccauucuggccg

SEQ ID NO: 71642 - RNA, 18 nt, Artificial Sequence
  Description of Artificial Sequence: Synthetic oligonucleotide
uagccccucagguguguu

SEQ ID NO: 71643 - RNA, 18 nt, Artificial Sequence
  Description of Artificial Sequence: Synthetic oligonucleotide
ggcccuagccccucaggu

SEQ ID NO: 71644 - RNA, 18 nt, Artificial Sequence
  Description of Artificial Sequence: Synthetic oligonucleotide
cauauggcccuagccccu

SEQ ID NO: 71645 - RNA, 18 nt, Artificial Sequence
  Description of Artificial Sequence: Synthetic oligonucleotide
guuuccauauggcccuag

SEQ ID NO: 71646 - RNA, 18 nt, Artificial Sequence
  Description of Artificial Sequence: Synthetic oligonucleotide
gucauguuuccauauggc

SEQ ID NO: 71647 - RNA, 18 nt, Artificial Sequence
  Description of Artificial Sequence: Synthetic oligonucleotide
cuucugucauguuuccau

SEQ ID NO: 71648 - RNA, 18 nt, Artificial Sequence
  Description of Artificial Sequence: Synthetic oligonucleotide
cuccccuucugucauguu

SEQ ID NO: 71649 - RNA, 18 nt, Artificial Sequence
  Description of Artificial Sequence: Synthetic oligonucleotide
ucucucuccccuucuguc

SEQ ID NO: 71650 - RNA, 18 nt, Artificial Sequence
  Description of Artificial Sequence: Synthetic oligonucleotide
uccuuucucucuccccuu

SEQ ID NO: 71651 - RNA, 18 nt, Artificial Sequence
  Description of Artificial Sequence: Synthetic oligonucleotide
gugucuccuuucucucuc

SEQ ID NO: 71652 - RNA, 18 nt, Artificial Sequence
  Description of Artificial Sequence: Synthetic oligonucleotide
gcagcgugucuccuuucu

SEQ ID NO: 71653 - RNA, 18 nt, Artificial Sequence
  Description of Artificial Sequence: Synthetic oligonucleotide
ccccugcagcgugucucc

SEQ ID NO: 71654 - RNA, 18 nt, Artificial Sequence
  Description of Artificial Sequence: Synthetic oligonucleotide
ccugcccccugcagcgug

SEQ ID NO: 71655 - RNA, 18 nt, Artificial Sequence
  Description of Artificial Sequence: Synthetic oligonucleotide
agcuuccugcccccugca

SEQ ID NO: 71656 - RNA, 18 nt, Artificial Sequence
  Description of Artificial Sequence: Synthetic oligonucleotide
cccccagcuuccugcccc

SEQ ID NO: 71657 - RNA, 18 nt, Artificial Sequence
  Description of Artificial Sequence: Synthetic oligonucleotide
ggguucccccagcuuccu

SEQ ID NO: 71658 - RNA, 18 nt, Artificial Sequence
  Description of Artificial Sequence: Synthetic oligonucleotide
agaauggguucccccagc

SEQ ID NO: 71659 - RNA, 18 nt, Artificial Sequence
  Description of Artificial Sequence: Synthetic oligonucleotide
uugggagaauggguuccc

SEQ ID NO: 71660 - RNA, 18 nt, Artificial Sequence
  Description of Artificial Sequence: Synthetic oligonucleotide
uauuuuugggagaauggg

SEQ ID NO: 71661 - RNA, 18 nt, Artificial Sequence
  Description of Artificial Sequence: Synthetic oligonucleotide
ccccuuauuuuugggaga

SEQ ID NO: 71662 - RNA, 18 nt, Artificial Sequence
  Description of Artificial Sequence: Synthetic oligonucleotide
ucagaccccuuauuuuug

SEQ ID NO: 71663 - RNA, 18 nt, Artificial Sequence
  Description of Artificial Sequence: Synthetic oligonucleotide
accccucagaccccuuau

SEQ ID NO: 71664 - RNA, 18 nt, Artificial Sequence
  Description of Artificial Sequence: Synthetic oligonucleotide
aauccaccccucagaccc

SEQ ID NO: 71665 - RNA, 18 nt, Artificial Sequence
  Description of Artificial Sequence: Synthetic oligonucleotide
cagggaauccaccccuca

SEQ ID NO: 71666 - RNA, 18 nt, Artificial Sequence
  Description of Artificial Sequence: Synthetic oligonucleotide
aaacccagggaauccacc

SEQ ID NO: 71667 - RNA, 18 nt, Artificial Sequence
  Description of Artificial Sequence: Synthetic oligonucleotide
gggagaauggguuccccc

SEQ ID NO: 71668 - RNA, 18 nt, Artificial Sequence
  Description of Artificial Sequence: Synthetic oligonucleotide
uuuuugggagaauggguu

SEQ ID NO: 71669 - RNA, 18 nt, Artificial Sequence
  Description of Artificial Sequence: Synthetic oligonucleotide
ccuuauuuuugggagaau

SEQ ID NO: 71670 - RNA, 18 nt, Artificial Sequence
  Description of Artificial Sequence: Synthetic oligonucleotide
agaccccuuauuuuuggg

SEQ ID NO: 71671 - RNA, 18 nt, Artificial Sequence
  Description of Artificial Sequence: Synthetic oligonucleotide
cccucagaccccuuauuu

SEQ ID NO: 71672 - RNA, 18 nt, Artificial Sequence
  Description of Artificial Sequence: Synthetic oligonucleotide
uccaccccucagaccccu

SEQ ID NO: 71673 - RNA, 18 nt, Artificial Sequence
  Description of Artificial Sequence: Synthetic oligonucleotide
gggaauccaccccucaga

SEQ ID NO: 71674 - RNA, 18 nt, Artificial Sequence
  Description of Artificial Sequence: Synthetic oligonucleotide
acccagggaauccacccc

SEQ ID NO: 71675 - RNA, 18 nt, Artificial Sequence
  Description of Artificial Sequence: Synthetic oligonucleotide
cugaaacccagggaaucc

SEQ ID NO: 71676 - RNA, 18 nt, Artificial Sequence
  Description of Artificial Sequence: Synthetic oligonucleotide
cagaccugaaacccaggg

SEQ ID NO: 71677 - RNA, 18 nt, Artificial Sequence
  Description of Artificial Sequence: Synthetic oligonucleotide
ggacccagaccugaaacc

SEQ ID NO: 71678 - RNA, 18 nt, Artificial Sequence
  Description of Artificial Sequence: Synthetic oligonucleotide
auucaggacccagaccug

SEQ ID NO: 71679 - RNA, 18 nt, Artificial Sequence
  Description of Artificial Sequence: Synthetic oligonucleotide
uucccauucaggacccag

SEQ ID NO: 71680 - RNA, 18 nt, Artificial Sequence
  Description of Artificial Sequence: Synthetic oligonucleotide
aggaauucccauucagga

SEQ ID NO: 71681 - RNA, 18 nt, Artificial Sequence
  Description of Artificial Sequence: Synthetic oligonucleotide
auuccaggaauucccauu

SEQ ID NO: 71682 - RNA, 18 nt, Artificial Sequence
  Description of Artificial Sequence: Synthetic oligonucleotide
cugguauuccaggaauuc

SEQ ID NO: 71683 - RNA, 18 nt, Artificial Sequence
  Description of Artificial Sequence: Synthetic oligonucleotide
gucagcugguauuccagg

SEQ ID NO: 71684 - RNA, 18 nt, Artificial Sequence
  Description of Artificial Sequence: Synthetic oligonucleotide
ucauugucagcugguauu

SEQ ID NO: 71685 - RNA, 18 nt, Artificial Sequence
  Description of Artificial Sequence: Synthetic oligonucleotide
ggaaaucauugucagcug

SEQ ID NO: 71686 - RNA, 18 nt, Artificial Sequence
  Description of Artificial Sequence: Synthetic oligonucleotide
gaggaggaaaucauuguc

SEQ ID NO: 71687 - RNA, 18 nt, Artificial Sequence
  Description of Artificial Sequence: Synthetic oligonucleotide
aagaugaggaggaaauca

SEQ ID NO: 71688 - RNA, 18 nt, Artificial Sequence
  Description of Artificial Sequence: Synthetic oligonucleotide
guugaaagaugaggagga

SEQ ID NO: 71689 - RNA, 18 nt, Artificial Sequence
  Description of Artificial Sequence: Synthetic oligonucleotide
gugagguugaaagaugag

SEQ ID NO: 71690 - RNA, 18 nt, Artificial Sequence
  Description of Artificial Sequence: Synthetic oligonucleotide
augaccacgaggagcaau

SEQ ID NO: 71691 - RNA, 18 nt, Artificial Sequence
  Description of Artificial Sequence: Synthetic oligonucleotide
gaagcaugaccacgagga

SEQ ID NO: 71692 - RNA, 18 nt, Artificial Sequence
  Description of Artificial Sequence: Synthetic oligonucleotide
uaggagaagcaugaccac

SEQ ID NO: 71693 - RNA, 18 nt, Artificial Sequence
  Description of Artificial Sequence: Synthetic oligonucleotide
gcaguuaggagaagcaug

SEQ ID NO: 71694 - RNA, 18 nt, Artificial Sequence
  Description of Artificial Sequence: Synthetic oligonucleotide
gccuugcaguuaggagaa

SEQ ID NO: 71695 - RNA, 18 nt, Artificial Sequence
  Description of Artificial Sequence: Synthetic oligonucleotide
cguuagccuugcaguuag

SEQ ID NO: 71696 - RNA, 18 nt, Artificial Sequence
  Description of Artificial Sequence: Synthetic oligonucleotide
gacagcguuagccuugca

SEQ ID NO: 71697 - RNA, 18 nt, Artificial Sequence
  Description of Artificial Sequence: Synthetic oligonucleotide
ggcuggacagcguuagcc

SEQ ID NO: 71698 - RNA, 18 nt, Artificial Sequence
  Description of Artificial Sequence: Synthetic oligonucleotide
agccgggcuggacagcgu

SEQ ID NO: 71699 - RNA, 18 nt, Artificial Sequence
  Description of Artificial Sequence: Synthetic oligonucleotide
ggaggagccgggcuggac

SEQ ID NO: 71700 - RNA, 18 nt, Artificial Sequence
  Description of Artificial Sequence: Synthetic oligonucleotide
aagcaggaggagccgggc

SEQ ID NO: 71701 - RNA, 18 nt, Artificial Sequence
  Description of Artificial Sequence: Synthetic oligonucleotide
gucacaagcaggaggagc

SEQ ID NO: 71702 - RNA, 18 nt, Artificial Sequence
  Description of Artificial Sequence: Synthetic oligonucleotide
cggaggucacaagcagga

SEQ ID NO: 71703 - RNA, 18 nt, Artificial Sequence
  Description of Artificial Sequence: Synthetic oligonucleotide
ggacucggaggucacaag

SEQ ID NO: 71704 - RNA, 18 nt, Artificial Sequence
  Description of Artificial Sequence: Synthetic oligonucleotide
acugaggacucggagguc

SEQ ID NO: 71705 - RNA, 18 nt, Artificial Sequence
  Description of Artificial Sequence: Synthetic oligonucleotide
aguuuacugaggacucgg

SEQ ID NO: 71706 - RNA, 18 nt, Artificial Sequence
  Description of Artificial Sequence: Synthetic oligonucleotide
gaagcaguuuacugagga

SEQ ID NO: 71707 - RNA, 18 nt, Artificial Sequence
  Description of Artificial Sequence: Synthetic oligonucleotide
gucacgaagcaguuuacu

SEQ ID NO: 71708 - RNA, 18 nt, Artificial Sequence
  Description of Artificial Sequence: Synthetic oligonucleotide
ugggagucacgaagcagu

SEQ ID NO: 71709 - RNA, 18 nt, Artificial Sequence
  Description of Artificial Sequence: Synthetic oligonucleotide
ggacaugggagucacgaa

SEQ ID NO: 71710 - RNA, 18 nt, Artificial Sequence
  Description of Artificial Sequence: Synthetic oligonucleotide
gugaaggacaugggaguc

SEQ ID NO: 71711 - RNA, 18 nt, Artificial Sequence
  Description of Artificial Sequence: Synthetic oligonucleotide
cugcugugaaggacaugg

SEQ ID NO: 71712 - RNA, 18 nt, Artificial Sequence
  Description of Artificial Sequence: Synthetic oligonucleotide
caugaccacgaggagcaa

SEQ ID NO: 71713 - RNA, 18 nt, Artificial Sequence
  Description of Artificial Sequence: Synthetic oligonucleotide
agaagcaugaccacgagg

SEQ ID NO: 71714 - RNA, 18 nt, Artificial Sequence
  Description of Artificial Sequence: Synthetic oligonucleotide
uuaggagaagcaugacca

SEQ ID NO: 71715 - RNA, 18 nt, Artificial Sequence
  Description of Artificial Sequence: Synthetic oligonucleotide
ugcaguuaggagaagcau

SEQ ID NO: 71716 - RNA, 18 nt, Artificial Sequence
  Description of Artificial Sequence: Synthetic oligonucleotide
agccuugcaguuaggaga

SEQ ID NO: 71717 - RNA, 18 nt, Artificial Sequence
  Description of Artificial Sequence: Synthetic oligonucleotide
gcguuagccuugcaguua

SEQ ID NO: 71718 - RNA, 18 nt, Artificial Sequence
  Description of Artificial Sequence: Synthetic oligonucleotide
ggacagcguuagccuugc

SEQ ID NO: 71719 - RNA, 18 nt, Artificial Sequence
  Description of Artificial Sequence: Synthetic oligonucleotide
gggcuggacagcguuagc

SEQ ID NO: 71720 - RNA, 18 nt, Artificial Sequence
  Description of Artificial Sequence: Synthetic oligonucleotide
gagccgggcuggacagcg

SEQ ID NO: 71721 - RNA, 18 nt, Artificial Sequence
  Description of Artificial Sequence: Synthetic oligonucleotide
aggaggagccgggcugga

SEQ ID NO: 71722 - RNA, 18 nt, Artificial Sequence
  Description of Artificial Sequence: Synthetic oligonucleotide
caagcaggaggagccggg

SEQ ID NO: 71723 - RNA, 18 nt, Artificial Sequence
  Description of Artificial Sequence: Synthetic oligonucleotide
ggucacaagcaggaggag

SEQ ID NO: 71724 - RNA, 18 nt, Artificial Sequence
  Description of Artificial Sequence: Synthetic oligonucleotide
ucggaggucacaagcagg

SEQ ID NO: 71725 - RNA, 18 nt, Artificial Sequence
  Description of Artificial Sequence: Synthetic oligonucleotide
aggacucggaggucacaa

SEQ ID NO: 71726 - RNA, 18 nt, Artificial Sequence
  Description of Artificial Sequence: Synthetic oligonucleotide
uacugaggacucggaggu

SEQ ID NO: 71727 - RNA, 18 nt, Artificial Sequence
  Description of Artificial Sequence: Synthetic oligonucleotide
caguuuacugaggacucg

SEQ ID NO: 71728 - RNA, 18 nt, Artificial Sequence
  Description of Artificial Sequence: Synthetic oligonucleotide
cgaagcaguuuacugagg

SEQ ID NO: 71729 - RNA, 18 nt, Artificial Sequence
  Description of Artificial Sequence: Synthetic oligonucleotide
agucacgaagcaguuuac

SEQ ID NO: 71730 - RNA, 18 nt, Artificial Sequence
  Description of Artificial Sequence: Synthetic oligonucleotide
augggagucacgaagcag

SEQ ID NO: 71731 - RNA, 18 nt, Artificial Sequence
  Description of Artificial Sequence: Synthetic oligonucleotide
aggacaugggagucacga

SEQ ID NO: 71732 - RNA, 18 nt, Artificial Sequence
  Description of Artificial Sequence: Synthetic oligonucleotide
ugugaaggacaugggagu

SEQ ID NO: 71733 - RNA, 18 nt, Artificial Sequence
  Description of Artificial Sequence: Synthetic oligonucleotide
ucugcugugaaggacaug

SEQ ID NO: 71734 - RNA, 18 nt, Artificial Sequence
  Description of Artificial Sequence: Synthetic oligonucleotide
gggauaauguugggaguu

SEQ ID NO: 71735 - RNA, 18 nt, Artificial Sequence
  Description of Artificial Sequence: Synthetic oligonucleotide
uaccaguuacgcggauaa

SEQ ID NO: 71736 - RNA, 18 nt, Artificial Sequence
  Description of Artificial Sequence: Synthetic oligonucleotide
ugucuuaccaguuacgcg

SEQ ID NO: 71737 - RNA, 18 nt, Artificial Sequence
  Description of Artificial Sequence: Synthetic oligonucleotide
augggugucuuaccaguu

SEQ ID NO: 71738 - RNA, 18 nt, Artificial Sequence
  Description of Artificial Sequence: Synthetic oligonucleotide
ggaguaugggugucuuac

SEQ ID NO: 71739 - RNA, 18 nt, Artificial Sequence
  Description of Artificial Sequence: Synthetic oligonucleotide
uccugggaguaugggugu

SEQ ID NO: 71740 - RNA, 18 nt, Artificial Sequence
  Description of Artificial Sequence: Synthetic oligonucleotide
ugucuuccugggaguaug

SEQ ID NO: 71741 - RNA, 18 nt, Artificial Sequence
  Description of Artificial Sequence: Synthetic oligonucleotide
gauggugucuuccuggga

SEQ ID NO: 71742 - RNA, 18 nt, Artificial Sequence
  Description of Artificial Sequence: Synthetic oligonucleotide
gaagugauggugucuucc

SEQ ID NO: 71743 - RNA, 18 nt, Artificial Sequence
  Description of Artificial Sequence: Synthetic oligonucleotide
uagaggaagugauggugu

SEQ ID NO: 71744 - RNA, 18 nt, Artificial Sequence
  Description of Artificial Sequence: Synthetic oligonucleotide
ggaguuagaggaagugau

SEQ ID NO: 71745 - RNA, 18 nt, Artificial Sequence
  Description of Artificial Sequence: Synthetic oligonucleotide
gucaaggaguuagaggaa

SEQ ID NO: 71746 - RNA, 18 nt, Artificial Sequence
  Description of Artificial Sequence: Synthetic oligonucleotide
auugggucaaggaguuag

SEQ ID NO: 71747 - RNA, 18 nt, Artificial Sequence
  Description of Artificial Sequence: Synthetic oligonucleotide
uagucauugggucaagga

SEQ ID NO: 71748 - RNA, 18 nt, Artificial Sequence
  Description of Artificial Sequence: Synthetic oligonucleotide
aagaauagucauuggguc

SEQ ID NO: 71749 - RNA, 18 nt, Artificial Sequence
  Description of Artificial Sequence: Synthetic oligonucleotide
augggaagaauagucauu

SEQ ID NO: 71750 - RNA, 18 nt, Artificial Sequence
  Description of Artificial Sequence: Synthetic oligonucleotide
acaauaugggaagaauag

SEQ ID NO: 71751 - RNA, 18 nt, Artificial Sequence
  Description of Artificial Sequence: Synthetic oligonucleotide
gggacaauaugggaagaa

SEQ ID NO: 71752 - RNA, 18 nt, Artificial Sequence
  Description of Artificial Sequence: Synthetic oligonucleotide
gugugaucaguagguggg

SEQ ID NO: 71753 - RNA, 18 nt, Artificial Sequence
  Description of Artificial Sequence: Synthetic oligonucleotide
agagagugugaucaguag

SEQ ID NO: 71754 - RNA, 18 nt, Artificial Sequence
  Description of Artificial Sequence: Synthetic oligonucleotide
uugucagagagugugauc

SEQ ID NO: 71755 - RNA, 18 nt, Artificial Sequence
  Description of Artificial Sequence: Synthetic oligonucleotide
aauccuugucagagagug

SEQ ID NO: 71756 - RNA, 18 nt, Artificial Sequence
  Description of Artificial Sequence: Synthetic oligonucleotide
agaauaauccuugucaga

SEQ ID NO: 71757 - RNA, 18 nt, Artificial Sequence
  Description of Artificial Sequence: Synthetic oligonucleotide
ugugaagaauaauccuug

SEQ ID NO: 71758 - RNA, 18 nt, Artificial Sequence
  Description of Artificial Sequence: Synthetic oligonucleotide
uguauugugaagaauaau

SEQ ID NO: 71759 - RNA, 18 nt, Artificial Sequence
  Description of Artificial Sequence: Synthetic oligonucleotide
cgggcuguauugugaaga

SEQ ID NO: 71760 - RNA, 18 nt, Artificial Sequence
  Description of Artificial Sequence: Synthetic oligonucleotide
gugugaucaguagguggg

SEQ ID NO: 71761 - RNA, 18 nt, Artificial Sequence
  Description of Artificial Sequence: Synthetic oligonucleotide
gagagugugaucaguagg

SEQ ID NO: 71762 - RNA, 18 nt, Artificial Sequence
  Description of Artificial Sequence: Synthetic oligonucleotide
ugucagagagugugauca

SEQ ID NO: 71763 - RNA, 18 nt, Artificial Sequence
  Description of Artificial Sequence: Synthetic oligonucleotide
auccuugucagagagugu

SEQ ID NO: 71764 - RNA, 18 nt, Artificial Sequence
  Description of Artificial Sequence: Synthetic oligonucleotide
gaauaauccuugucagag

SEQ ID NO: 71765 - RNA, 18 nt, Artificial Sequence
  Description of Artificial Sequence: Synthetic oligonucleotide
gugaagaauaauccuugu

SEQ ID NO: 71766 - RNA, 18 nt, Artificial Sequence
  Description of Artificial Sequence: Synthetic oligonucleotide
guauugugaagaauaauc

SEQ ID NO: 71767 - RNA, 18 nt, Artificial Sequence
  Description of Artificial Sequence: Synthetic oligonucleotide
gggcuguauugugaagaa

SEQ ID NO: 71768 - RNA, 18 nt, Artificial Sequence
  Description of Artificial Sequence: Synthetic oligonucleotide
aaugcgggcuguauugug

SEQ ID NO: 71769 - RNA, 18 nt, Artificial Sequence
  Description of Artificial Sequence: Synthetic oligonucleotide
uuuuaaaugcgggcugua

SEQ ID NO: 71770 - RNA, 18 nt, Artificial Sequence
  Description of Artificial Sequence: Synthetic oligonucleotide
agagcuuuuaaaugcggg

SEQ ID NO: 71771 - RNA, 18 nt, Artificial Sequence
  Description of Artificial Sequence: Synthetic oligonucleotide
agacgagagcuuuuaaau

SEQ ID NO: 71772 - RNA, 18 nt, Artificial Sequence
  Description of Artificial Sequence: Synthetic oligonucleotide
ucucuagacgagagcuuu

SEQ ID NO: 71773 - RNA, 18 nt, Artificial Sequence
  Description of Artificial Sequence: Synthetic oligonucleotide
uacuaucucuagacgaga

SEQ ID NO: 71774 - RNA, 18 nt, Artificial Sequence
  Description of Artificial Sequence: Synthetic oligonucleotide
augaguacuaucucuaga

SEQ ID NO: 71775 - RNA, 18 nt, Artificial Sequence
  Description of Artificial Sequence: Synthetic oligonucleotide
ccuccaugaguacuaucu

SEQ ID NO: 71776 - RNA, 18 nt, Artificial Sequence
  Description of Artificial Sequence: Synthetic oligonucleotide
cuaguccuccaugaguac

SEQ ID NO: 71777 - RNA, 18 nt, Artificial Sequence
  Description of Artificial Sequence: Synthetic oligonucleotide
gcaggcuaguccuccaug

SEQ ID NO: 71778 - RNA, 18 nt, Artificial Sequence
  Description of Artificial Sequence: Synthetic oligonucleotide
aauaagcaggcuaguccu

SEQ ID NO: 71779 - RNA, 18 nt, Artificial Sequence
  Description of Artificial Sequence: Synthetic oligonucleotide
agccuaauaagcaggcua

SEQ ID NO: 71780 - RNA, 18 nt, Artificial Sequence
  Description of Artificial Sequence: Synthetic oligonucleotide
augguagccuaauaagca

SEQ ID NO: 71781 - RNA, 18 nt, Artificial Sequence
  Description of Artificial Sequence: Synthetic oligonucleotide
gagcuaugguagccuaau

SEQ ID NO: 71782 - RNA, 18 nt, Artificial Sequence
  Description of Artificial Sequence: Synthetic oligonucleotide
agagagagcuaugguagc

SEQ ID NO: 71783 - RNA, 18 nt, Artificial Sequence
  Description of Artificial Sequence: Synthetic oligonucleotide
gaaauagagagagcuaug

SEQ ID NO: 71784 - RNA, 18 nt, Artificial Sequence
  Description of Artificial Sequence: Synthetic oligonucleotide
gagcugaaauagagagag

SEQ ID NO: 71785 - RNA, 18 nt, Artificial Sequence
  Description of Artificial Sequence: Synthetic oligonucleotide
gaagggagcugaaauaga

SEQ ID NO: 71786 - RNA, 18 nt, Artificial Sequence
  Description of Artificial Sequence: Synthetic oligonucleotide
gaaccucugggcacuggc

SEQ ID NO: 71787 - RNA, 18 nt, Artificial Sequence
  Description of Artificial Sequence: Synthetic oligonucleotide
agggugaaccucugggca

SEQ ID NO: 71788 - RNA, 18 nt, Artificial Sequence
  Description of Artificial Sequence: Synthetic oligonucleotide
ggcaaagggugaaccucu

SEQ ID NO: 71789 - RNA, 18 nt, Artificial Sequence
  Description of Artificial Sequence: Synthetic oligonucleotide
guguaggcaaagggugaa

SEQ ID NO: 71790 - RNA, 18 nt, Artificial Sequence
  Description of Artificial Sequence: Synthetic oligonucleotide
gacagguguaggcaaagg

SEQ ID NO: 71791 - RNA, 18 nt, Artificial Sequence
  Description of Artificial Sequence: Synthetic oligonucleotide
agcaggacagguguaggc

SEQ ID NO: 71792 - RNA, 18 nt, Artificial Sequence
  Description of Artificial Sequence: Synthetic oligonucleotide
caggcagcaggacaggug

SEQ ID NO: 71793 - RNA, 18 nt, Artificial Sequence
  Description of Artificial Sequence: Synthetic oligonucleotide
cacagcaggcagcaggac

SEQ ID NO: 71794 - RNA, 18 nt, Artificial Sequence
  Description of Artificial Sequence: Synthetic oligonucleotide
aaguccacagcaggcagc

SEQ ID NO: 71795 - RNA, 18 nt, Artificial Sequence
  Description of Artificial Sequence: Synthetic oligonucleotide
agcuaaaguccacagcag

SEQ ID NO: 71796 - RNA, 18 nt, Artificial Sequence
  Description of Artificial Sequence: Synthetic oligonucleotide
ucccaagcuaaaguccac

SEQ ID NO: 71797 - RNA, 18 nt, Artificial Sequence
  Description of Artificial Sequence: Synthetic oligonucleotide
cauucucccaagcuaaag

SEQ ID NO: 71798 - RNA, 18 nt, Artificial Sequence
  Description of Artificial Sequence: Synthetic oligonucleotide
uuuuccauucucccaagc

SEQ ID NO: 71799 - RNA, 18 nt, Artificial Sequence
  Description of Artificial Sequence: Synthetic oligonucleotide
cuggguuuuccauucucc

SEQ ID NO: 71800 - RNA, 18 nt, Artificial Sequence
  Description of Artificial Sequence: Synthetic oligonucleotide
gaaccucugggcacuggc

SEQ ID NO: 71801 - RNA, 18 nt, Artificial Sequence
  Description of Artificial Sequence: Synthetic oligonucleotide
agggugaaccucugggca

SEQ ID NO: 71802 - RNA, 18 nt, Artificial Sequence
  Description of Artificial Sequence: Synthetic oligonucleotide
ggcaaagggugaaccucu

SEQ ID NO: 71803 - RNA, 18 nt, Artificial Sequence
  Description of Artificial Sequence: Synthetic oligonucleotide
guguaggcaaagggugaa

SEQ ID NO: 71804 - RNA, 18 nt, Artificial Sequence
  Description of Artificial Sequence: Synthetic oligonucleotide
gacagguguaggcaaagg

SEQ ID NO: 71805 - RNA, 18 nt, Artificial Sequence
  Description of Artificial Sequence: Synthetic oligonucleotide
agcaggacagguguaggc

SEQ ID NO: 71806 - RNA, 18 nt, Artificial Sequence
  Description of Artificial Sequence: Synthetic oligonucleotide
caggcagcaggacaggug

SEQ ID NO: 71807 - RNA, 18 nt, Artificial Sequence
  Description of Artificial Sequence: Synthetic oligonucleotide
cacagcaggcagcaggac

SEQ ID NO: 71808 - RNA, 18 nt, Artificial Sequence
  Description of Artificial Sequence: Synthetic oligonucleotide
aaguccacagcaggcagc

SEQ ID NO: 71809 - RNA, 18 nt, Artificial Sequence
  Description of Artificial Sequence: Synthetic oligonucleotide
agcuaaaguccacagcag

SEQ ID NO: 71810 - RNA, 18 nt, Artificial Sequence
  Description of Artificial Sequence: Synthetic oligonucleotide
ucccaagcuaaaguccac

SEQ ID NO: 71811 - RNA, 18 nt, Artificial Sequence
  Description of Artificial Sequence: Synthetic oligonucleotide
cauucucccaagcuaaag

SEQ ID NO: 71812 - RNA, 18 nt, Artificial Sequence
  Description of Artificial Sequence: Synthetic oligonucleotide
uuuuccauucucccaagc

SEQ ID NO: 71813 - RNA, 18 nt, Artificial Sequence
  Description of Artificial Sequence: Synthetic oligonucleotide
cuggguuuuccauucucc

SEQ ID NO: 71814 - RNA, 18 nt, Artificial Sequence
  Description of Artificial Sequence: Synthetic oligonucleotide
aagguuagggauggcuuu

SEQ ID NO: 71815 - RNA, 18 nt, Artificial Sequence
  Description of Artificial Sequence: Synthetic oligonucleotide
aagccaagguuagggaug

SEQ ID NO: 71816 - RNA, 18 nt, Artificial Sequence
  Description of Artificial Sequence: Synthetic oligonucleotide
uagggaagccaagguuag

SEQ ID NO: 71817 - RNA, 18 nt, Artificial Sequence
  Description of Artificial Sequence: Synthetic oligonucleotide
ggacuuagggaagccaag

SEQ ID NO: 71818 - RNA, 18 nt, Artificial Sequence
  Description of Artificial Sequence: Synthetic oligonucleotide
agacaggacuuagggaag

SEQ ID NO: 71819 - RNA, 18 nt, Artificial Sequence
  Description of Artificial Sequence: Synthetic oligonucleotide
acugaagacaggacuuag

SEQ ID NO: 71820 - RNA, 18 nt, Artificial Sequence
  Description of Artificial Sequence: Synthetic oligonucleotide
gggaaacugaagacagga

SEQ ID NO: 71821 - RNA, 18 nt, Artificial Sequence
  Description of Artificial Sequence: Synthetic oligonucleotide
gcagugggaaacugaaga

SEQ ID NO: 71822 - RNA, 18 nt, Artificial Sequence
  Description of Artificial Sequence: Synthetic oligonucleotide
gggaagcagugggaaacu

SEQ ID NO: 71823 - RNA, 18 nt, Artificial Sequence
  Description of Artificial Sequence: Synthetic oligonucleotide
uccaugggaagcaguggg

SEQ ID NO: 71824 - RNA, 18 nt, Artificial Sequence
  Description of Artificial Sequence: Synthetic oligonucleotide
gagaauccaugggaagca

SEQ ID NO: 71825 - RNA, 18 nt, Artificial Sequence
  Description of Artificial Sequence: Synthetic oligonucleotide
uguuggagaauccauggg

SEQ ID NO: 71826 - RNA, 18 nt, Artificial Sequence
  Description of Artificial Sequence: Synthetic oligonucleotide
aagaauguuggagaaucc

SEQ ID NO: 71827 - RNA, 18 nt, Artificial Sequence
  Description of Artificial Sequence: Synthetic oligonucleotide
agcucaagaauguuggag

SEQ ID NO: 71828 - RNA, 18 nt, Artificial Sequence
  Description of Artificial Sequence: Synthetic oligonucleotide
uaaaaagcucaagaaugu

SEQ ID NO: 71829 - RNA, 18 nt, Artificial Sequence
  Description of Artificial Sequence: Synthetic oligonucleotide
auuuuuaaaaagcucaag

SEQ ID NO: 71830 - RNA, 18 nt, Artificial Sequence
  Description of Artificial Sequence: Synthetic oligonucleotide
gagauauuuuuaaaaagc

SEQ ID NO: 71831 - RNA, 18 nt, Artificial Sequence
  Description of Artificial Sequence: Synthetic oligonucleotide
aaggugagauauuuuuaa

SEQ ID NO: 71832 - RNA, 18 nt, Artificial Sequence
  Description of Artificial Sequence: Synthetic oligonucleotide
agcugaaggugagauauu

SEQ ID NO: 71833 - RNA, 18 nt, Artificial Sequence
  Description of Artificial Sequence: Synthetic oligonucleotide
ggccaagcugaaggugag

SEQ ID NO: 71834 - RNA, 18 nt, Artificial Sequence
  Description of Artificial Sequence: Synthetic oligonucleotide
aggguggccaagcugaag

SEQ ID NO: 71835 - RNA, 18 nt, Artificial Sequence
  Description of Artificial Sequence: Synthetic oligonucleotide
ggguuaggguggccaagc

SEQ ID NO: 71836 - RNA, 18 nt, Artificial Sequence
  Description of Artificial Sequence: Synthetic oligonucleotide
agauuggguuaggguggc

SEQ ID NO: 71837 - RNA, 18 nt, Artificial Sequence
  Description of Artificial Sequence: Synthetic oligonucleotide
aauguagauuggguuagg

SEQ ID NO: 71838 - RNA, 18 nt, Artificial Sequence
  Description of Artificial Sequence: Synthetic oligonucleotide
aggugaauguagauuggg

SEQ ID NO: 71839 - RNA, 18 nt, Artificial Sequence
  Description of Artificial Sequence: Synthetic oligonucleotide
aucauaggugaauguaga

SEQ ID NO: 71840 - RNA, 18 nt, Artificial Sequence
  Description of Artificial Sequence: Synthetic oligonucleotide
cuaucaucauaggugaau

SEQ ID NO: 71841 - RNA, 18 nt, Artificial Sequence
  Description of Artificial Sequence: Synthetic oligonucleotide
acaggcuaucaucauagg

SEQ ID NO: 71842 - RNA, 18 nt, Artificial Sequence
  Description of Artificial Sequence: Synthetic oligonucleotide
uauccacaggcuaucauc

SEQ ID NO: 71843 - RNA, 18 nt, Artificial Sequence
  Description of Artificial Sequence: Synthetic oligonucleotide
caucuuauccacaggcua

SEQ ID NO: 71844 - RNA, 18 nt, Artificial Sequence
  Description of Artificial Sequence: Synthetic oligonucleotide
gccaucaucuuauccaca

SEQ ID NO: 71845 - RNA, 18 nt, Artificial Sequence
  Description of Artificial Sequence: Synthetic oligonucleotide
ugcaagccaucaucuuau

SEQ ID NO: 71846 - RNA, 18 nt, Artificial Sequence
  Description of Artificial Sequence: Synthetic oligonucleotide
ggaccugcaagccaucau

SEQ ID NO: 71847 - RNA, 18 nt, Artificial Sequence
  Description of Artificial Sequence: Synthetic oligonucleotide
auauuggaccugcaagcc

SEQ ID NO: 71848 - RNA, 18 nt, Artificial Sequence
  Description of Artificial Sequence: Synthetic oligonucleotide
uucacauauuggaccugc

SEQ ID NO: 71849 - RNA, 18 nt, Artificial Sequence
  Description of Artificial Sequence: Synthetic oligonucleotide
aucuauucacauauugga

SEQ ID NO: 71850 - RNA, 18 nt, Artificial Sequence
  Description of Artificial Sequence: Synthetic oligonucleotide
uucaaaucuauucacaua

SEQ ID NO: 71851 - RNA, 18 nt, Artificial Sequence
  Description of Artificial Sequence: Synthetic oligonucleotide
ucagcuucaaaucuauuc

SEQ ID NO: 71852 - RNA, 18 nt, Artificial Sequence
  Description of Artificial Sequence: Synthetic oligonucleotide
gguguucagcuucaaauc

SEQ ID NO: 71853 - RNA, 18 nt, Artificial Sequence
  Description of Artificial Sequence: Synthetic oligonucleotide
uucaugguguucagcuuc

SEQ ID NO: 71854 - RNA, 18 nt, Artificial Sequence
  Description of Artificial Sequence: Synthetic oligonucleotide
agcuuuucaugguguuca

SEQ ID NO: 71855 - RNA, 18 nt, Artificial Sequence
  Description of Artificial Sequence: Synthetic oligonucleotide
ucuccagcuuuucauggu

SEQ ID NO: 71856 - RNA, 18 nt, Artificial Sequence
  Description of Artificial Sequence: Synthetic oligonucleotide
auuucucuccagcuuuuc

SEQ ID NO: 71857 - RNA, 18 nt, Artificial Sequence
  Description of Artificial Sequence: Synthetic oligonucleotide
gagcgauuucucuccagc

SEQ ID NO: 71858 - RNA, 18 nt, Artificial Sequence
  Description of Artificial Sequence: Synthetic oligonucleotide
gccaugagcgauuucucu

SEQ ID NO: 71859 - RNA, 18 nt, Artificial Sequence
  Description of Artificial Sequence: Synthetic oligonucleotide
gcauggccaugagcgauu

SEQ ID NO: 71860 - RNA, 18 nt, Artificial Sequence
  Description of Artificial Sequence: Synthetic oligonucleotide
caaaggcauggccaugag

SEQ ID NO: 71861 - RNA, 18 nt, Artificial Sequence
  Description of Artificial Sequence: Synthetic oligonucleotide
uaggucaaaggcauggcc

SEQ ID NO: 71862 - RNA, 18 nt, Artificial Sequence
  Description of Artificial Sequence: Synthetic oligonucleotide
gggaauaggucaaaggca

SEQ ID NO: 71863 - RNA, 18 nt, Artificial Sequence
  Description of Artificial Sequence: Synthetic oligonucleotide
ugaacgggaauaggucaa

SEQ ID NO: 71864 - RNA, 18 nt, Artificial Sequence
  Description of Artificial Sequence: Synthetic oligonucleotide
aagacugaacgggaauag

SEQ ID NO: 71865 - RNA, 18 nt, Artificial Sequence
  Description of Artificial Sequence: Synthetic oligonucleotide
uuaagaagacugaacggg

SEQ ID NO: 71866 - RNA, 18 nt, Artificial Sequence
  Description of Artificial Sequence: Synthetic oligonucleotide
ccaauuuaagaagacuga

SEQ ID NO: 71867 - RNA, 18 nt, Artificial Sequence
  Description of Artificial Sequence: Synthetic oligonucleotide
ucaugccaauuuaagaag

SEQ ID NO: 71868 - RNA, 18 nt, Artificial Sequence
  Description of Artificial Sequence: Synthetic oligonucleotide
cuucuucaugccaauuua

SEQ ID NO: 71869 - RNA, 18 nt, Artificial Sequence
  Description of Artificial Sequence: Synthetic oligonucleotide
ucuugcuucuucaugcca

SEQ ID NO: 71870 - RNA, 18 nt, Artificial Sequence
  Description of Artificial Sequence: Synthetic oligonucleotide
augagucuugcuucuuca

SEQ ID NO: 71871 - RNA, 18 nt, Artificial Sequence
  Description of Artificial Sequence: Synthetic oligonucleotide
gacauaugagucuugcuu

SEQ ID NO: 71872 - RNA, 18 nt, Artificial Sequence
  Description of Artificial Sequence: Synthetic oligonucleotide
uggaugacauaugagucu

SEQ ID NO: 71873 - RNA, 18 nt, Artificial Sequence
  Description of Artificial Sequence: Synthetic oligonucleotide
aucuguggaugacauaug

SEQ ID NO: 71874 - RNA, 18 nt, Artificial Sequence
  Description of Artificial Sequence: Synthetic oligonucleotide
gugucaucuguggaugac

SEQ ID NO: 71875 - RNA, 18 nt, Artificial Sequence
  Description of Artificial Sequence: Synthetic oligonucleotide
gcuuugugucaucugugg

SEQ ID NO: 71876 - RNA, 18 nt, Artificial Sequence
  Description of Artificial Sequence: Synthetic oligonucleotide
ucccagcuuugugucauc

SEQ ID NO: 71877 - RNA, 18 nt, Artificial Sequence
  Description of Artificial Sequence: Synthetic oligonucleotide
guacuucccagcuuugug

SEQ ID NO: 71878 - RNA, 18 nt, Artificial Sequence
  Description of Artificial Sequence: Synthetic oligonucleotide
uagugguacuucccagcu

SEQ ID NO: 71879 - RNA, 18 nt, Artificial Sequence
  Description of Artificial Sequence: Synthetic oligonucleotide
uauuuuagugguacuucc

SEQ ID NO: 71880 - RNA, 18 nt, Artificial Sequence
  Description of Artificial Sequence: Synthetic oligonucleotide
uuuguuauuuuaguggua

SEQ ID NO: 71881 - RNA, 18 nt, Artificial Sequence
  Description of Artificial Sequence: Synthetic oligonucleotide
agucuuuuguuauuuuag

SEQ ID NO: 71882 - RNA, 18 nt, Artificial Sequence
  Description of Artificial Sequence: Synthetic oligonucleotide
gauucagucuuuuguuau

SEQ ID NO: 71883 - RNA, 18 nt, Artificial Sequence
  Description of Artificial Sequence: Synthetic oligonucleotide
aucuugauucagucuuuu

SEQ ID NO: 71884 - RNA, 18 nt, Artificial Sequence
  Description of Artificial Sequence: Synthetic oligonucleotide
uuugaaucuugauucagu

SEQ ID NO: 71885 - RNA, 18 nt, Artificial Sequence
  Description of Artificial Sequence: Synthetic oligonucleotide
agugauuugaaucuugau

SEQ ID NO: 71886 - RNA, 18 nt, Artificial Sequence
  Description of Artificial Sequence: Synthetic oligonucleotide
cuuucagugauuugaauc

SEQ ID NO: 71887 - RNA, 18 nt, Artificial Sequence
  Description of Artificial Sequence: Synthetic oligonucleotide
cuagucuuucagugauuu

SEQ ID NO: 71888 - RNA, 18 nt, Artificial Sequence
  Description of Artificial Sequence: Synthetic oligonucleotide
uugaccuagucuuucagu

SEQ ID NO: 71889 - RNA, 18 nt, Artificial Sequence
  Description of Artificial Sequence: Synthetic oligonucleotide
uguuuuugaccuagucuu

SEQ ID NO: 71890 - RNA, 18 nt, Artificial Sequence
  Description of Artificial Sequence: Synthetic oligonucleotide
caccuuguuuuugaccua

SEQ ID NO: 71891 - RNA, 18 nt, Artificial Sequence
  Description of Artificial Sequence: Synthetic oligonucleotide
uguuucaccuuguuuuug

SEQ ID NO: 71892 - RNA, 18 nt, Artificial Sequence
  Description of Artificial Sequence: Synthetic oligonucleotide
ucuguuguuucaccuugu

SEQ ID NO: 71893 - RNA, 18 nt, Artificial Sequence
  Description of Artificial Sequence: Synthetic oligonucleotide
auaucucuguuguuucac

SEQ ID NO: 71894 - RNA, 18 nt, Artificial Sequence
  Description of Artificial Sequence: Synthetic oligonucleotide
aguuuauaucucuguugu

SEQ ID NO: 71895 - RNA, 18 nt, Artificial Sequence
  Description of Artificial Sequence: Synthetic oligonucleotide
guagaaguuuauaucucu

SEQ ID NO: 71896 - RNA, 18 nt, Artificial Sequence
  Description of Artificial Sequence: Synthetic oligonucleotide
cacauguagaaguuuaua

SEQ ID NO: 71897 - RNA, 18 nt, Artificial Sequence
  Description of Artificial Sequence: Synthetic oligonucleotide
cggcccacauguagaagu

SEQ ID NO: 71898 - RNA, 18 nt, Artificial Sequence
  Description of Artificial Sequence: Synthetic oligonucleotide
gcccccggcccacaugua

SEQ ID NO: 71899 - RNA, 18 nt, Artificial Sequence
  Description of Artificial Sequence: Synthetic oligonucleotide
cgugagcccccggcccac

SEQ ID NO: 71900 - RNA, 18 nt, Artificial Sequence
  Description of Artificial Sequence: Synthetic oligonucleotide
acaggcgugagcccccgg

SEQ ID NO: 71901 - RNA, 18 nt, Artificial Sequence
  Description of Artificial Sequence: Synthetic oligonucleotide
ggauuacaggcgugagcc

SEQ ID NO: 71902 - RNA, 18 nt, Artificial Sequence
  Description of Artificial Sequence: Synthetic oligonucleotide
ugcugggauuacaggcgu

SEQ ID NO: 71903 - RNA, 18 nt, Artificial Sequence
  Description of Artificial Sequence: Synthetic oligonucleotide
caaagugcugggauuaca

SEQ ID NO: 71904 - RNA, 18 nt, Artificial Sequence
  Description of Artificial Sequence: Synthetic oligonucleotide
ccucccaaagugcuggga

SEQ ID NO: 71905 - RNA, 18 nt, Artificial Sequence
  Description of Artificial Sequence: Synthetic oligonucleotide
cucggccucccaaagugc

SEQ ID NO: 71906 - RNA, 18 nt, Artificial Sequence
  Description of Artificial Sequence: Synthetic oligonucleotide
ccugccucggccucccaa

SEQ ID NO: 71907 - RNA, 18 nt, Artificial Sequence
  Description of Artificial Sequence: Synthetic oligonucleotide
aucugccugccucggccu

SEQ ID NO: 71908 - RNA, 18 nt, Artificial Sequence
  Description of Artificial Sequence: Synthetic oligonucleotide
aggugaucugccugccuc

SEQ ID NO: 71909 - RNA, 18 nt, Artificial Sequence
  Description of Artificial Sequence: Synthetic oligonucleotide
cccucaggugaucugccu

SEQ ID NO: 71910 - RNA, 18 nt, Artificial Sequence
  Description of Artificial Sequence: Synthetic oligonucleotide
uccugcccucaggugauc

SEQ ID NO: 71911 - RNA, 18 nt, Artificial Sequence
  Description of Artificial Sequence: Synthetic oligonucleotide
caaacuccugcccucagg

SEQ ID NO: 71912 - RNA, 18 nt, Artificial Sequence
  Description of Artificial Sequence: Synthetic oligonucleotide
gcucucaaacuccugccc

SEQ ID NO: 71913 - RNA, 18 nt, Artificial Sequence
  Description of Artificial Sequence: Synthetic oligonucleotide
gcugggcauggugguggg

SEQ ID NO: 71914 - RNA, 18 nt, Artificial Sequence
  Description of Artificial Sequence: Synthetic oligonucleotide
aauuagcugggcauggug

SEQ ID NO: 71915 - RNA, 18 nt, Artificial Sequence
  Description of Artificial Sequence: Synthetic oligonucleotide
acaaaaauuagcugggca

SEQ ID NO: 71916 - RNA, 18 nt, Artificial Sequence
  Description of Artificial Sequence: Synthetic oligonucleotide
aaaauacaaaaauuagcu

SEQ ID NO: 71917 - RNA, 18 nt, Artificial Sequence
  Description of Artificial Sequence: Synthetic oligonucleotide
uaccaaaaauacaaaaau

SEQ ID NO: 71918 - RNA, 18 nt, Artificial Sequence
  Description of Artificial Sequence: Synthetic oligonucleotide
aucucuaccaaaaauaca

SEQ ID NO: 71919 - RNA, 18 nt, Artificial Sequence
  Description of Artificial Sequence: Synthetic oligonucleotide
accccaucucuaccaaaa

SEQ ID NO: 71920 - RNA, 18 nt, Artificial Sequence
  Description of Artificial Sequence: Synthetic oligonucleotide
gugaaaccccaucucuac

SEQ ID NO: 71921 - RNA, 18 nt, Artificial Sequence
  Description of Artificial Sequence: Synthetic oligonucleotide
acauggugaaaccccauc

SEQ ID NO: 71922 - RNA, 18 nt, Artificial Sequence
  Description of Artificial Sequence: Synthetic oligonucleotide
ggccaacauggugaaacc

SEQ ID NO: 71923 - RNA, 18 nt, Artificial Sequence
  Description of Artificial Sequence: Synthetic oligonucleotide
agccuggccaacauggug

SEQ ID NO: 71924 - RNA, 18 nt, Artificial Sequence
  Description of Artificial Sequence: Synthetic oligonucleotide
agaucagccuggccaaca

SEQ ID NO: 71925 - RNA, 18 nt, Artificial Sequence
  Description of Artificial Sequence: Synthetic oligonucleotide
guucaagaucagccuggc

SEQ ID NO: 71926 - RNA, 18 nt, Artificial Sequence
  Description of Artificial Sequence: Synthetic oligonucleotide
caggaguucaagaucagc

SEQ ID NO: 71927 - RNA, 18 nt, Artificial Sequence
  Description of Artificial Sequence: Synthetic oligonucleotide
gaggucaggaguucaaga

SEQ ID NO: 71928 - RNA, 18 nt, Artificial Sequence
  Description of Artificial Sequence: Synthetic oligonucleotide
caccugaggucaggaguu

SEQ ID NO: 71929 - RNA, 18 nt, Artificial Sequence
  Description of Artificial Sequence: Synthetic oligonucleotide
uggaucaccugaggucag

SEQ ID NO: 71930 - RNA, 18 nt, Artificial Sequence
  Description of Artificial Sequence: Synthetic oligonucleotide
gcagguggaucaccugag

SEQ ID NO: 71931 - RNA, 18 nt, Artificial Sequence
  Description of Artificial Sequence: Synthetic oligonucleotide
cugaggcagguggaucac

SEQ ID NO: 71932 - RNA, 18 nt, Artificial Sequence
  Description of Artificial Sequence: Synthetic oligonucleotide
ggaggcugaggcaggugg

SEQ ID NO: 71933 - RNA, 18 nt, Artificial Sequence
  Description of Artificial Sequence: Synthetic oligonucleotide
cuuugggaggcugaggca

SEQ ID NO: 71934 - RNA, 18 nt, Artificial Sequence
  Description of Artificial Sequence: Synthetic oligonucleotide
cagcacuuugggaggcug

SEQ ID NO: 71935 - RNA, 18 nt, Artificial Sequence
  Description of Artificial Sequence: Synthetic oligonucleotide
aaucccagcacuuuggga

SEQ ID NO: 71936 - RNA, 18 nt, Artificial Sequence
  Description of Artificial Sequence: Synthetic oligonucleotide
ccuguaaucccagcacuu

SEQ ID NO: 71937 - RNA, 18 nt, Artificial Sequence
  Description of Artificial Sequence: Synthetic oligonucleotide
ucacgccuguaaucccag

SEQ ID NO: 71938 - RNA, 18 nt, Artificial Sequence
  Description of Artificial Sequence: Synthetic oligonucleotide
guggcucacgccuguaau

SEQ ID NO: 71939 - RNA, 18 nt, Artificial Sequence
  Description of Artificial Sequence: Synthetic oligonucleotide
gugcaguggcucacgccu

SEQ ID NO: 71940 - RNA, 18 nt, Artificial Sequence
  Description of Artificial Sequence: Synthetic oligonucleotide
gcugggugcaguggcuca

SEQ ID NO: 71941 - RNA, 18 nt, Artificial Sequence
  Description of Artificial Sequence: Synthetic oligonucleotide
ugaaggcugggugcagug

SEQ ID NO: 71942 - RNA, 18 nt, Artificial Sequence
  Description of Artificial Sequence: Synthetic oligonucleotide
cugaaugaaggcugggug

SEQ ID NO: 71943 - RNA, 18 nt, Artificial Sequence
  Description of Artificial Sequence: Synthetic oligonucleotide
uuaaacugaaugaaggcu

SEQ ID NO: 71944 - RNA, 18 nt, Artificial Sequence
  Description of Artificial Sequence: Synthetic oligonucleotide
gauuuuuaaacugaauga

SEQ ID NO: 71945 - RNA, 18 nt, Artificial Sequence
  Description of Artificial Sequence: Synthetic oligonucleotide
cauuugauuuuuaaacug

SEQ ID NO: 71946 - RNA, 18 nt, Artificial Sequence
  Description of Artificial Sequence: Synthetic oligonucleotide
aggaucauuugauuuuua

SEQ ID NO: 71947 - RNA, 18 nt, Artificial Sequence
  Description of Artificial Sequence: Synthetic oligonucleotide
accuuaggaucauuugau

SEQ ID NO: 71948 - RNA, 18 nt, Artificial Sequence
  Description of Artificial Sequence: Synthetic oligonucleotide
gcaaaaccuuaggaucau

SEQ ID NO: 71949 - RNA, 18 nt, Artificial Sequence
  Description of Artificial Sequence: Synthetic oligonucleotide
cugcugcaaaaccuuagg

SEQ ID NO: 71950 - RNA, 18 nt, Artificial Sequence
  Description of Artificial Sequence: Synthetic oligonucleotide
ucuuucugcugcaaaacc

SEQ ID NO: 71951 - RNA, 18 nt, Artificial Sequence
  Description of Artificial Sequence: Synthetic oligonucleotide
uuuacucuuucugcugca

SEQ ID NO: 71952 - RNA, 18 nt, Artificial Sequence
  Description of Artificial Sequence: Synthetic oligonucleotide
gcaaauuuacucuuucug

SEQ ID NO: 71953 - RNA, 18 nt, Artificial Sequence
  Description of Artificial Sequence: Synthetic oligonucleotide
gugcugcaaauuuacucu

SEQ ID NO: 71954 - RNA, 18 nt, Artificial Sequence
  Description of Artificial Sequence: Synthetic oligonucleotide
uucuagugcugcaaauuu

SEQ ID NO: 71955 - RNA, 18 nt, Artificial Sequence
  Description of Artificial Sequence: Synthetic oligonucleotide
cuugguucuagugcugca

SEQ ID NO: 71956 - RNA, 18 nt, Artificial Sequence
  Description of Artificial Sequence: Synthetic oligonucleotide
uaccucuugguucuagug

SEQ ID NO: 71957 - RNA, 18 nt, Artificial Sequence
  Description of Artificial Sequence: Synthetic oligonucleotide
gcuuuuaccucuugguuc

SEQ ID NO: 71958 - RNA, 18 nt, Artificial Sequence
  Description of Artificial Sequence: Synthetic oligonucleotide
uuacagcuuuuaccucuu

SEQ ID NO: 71959 - RNA, 18 nt, Artificial Sequence
  Description of Artificial Sequence: Synthetic oligonucleotide
cccuguuacagcuuuuac

SEQ ID NO: 71960 - RNA, 18 nt, Artificial Sequence
  Description of Artificial Sequence: Synthetic oligonucleotide
aucugcccuguuacagcu

SEQ ID NO: 71961 - RNA, 18 nt, Artificial Sequence
  Description of Artificial Sequence: Synthetic oligonucleotide
cugaaaucugcccuguua

SEQ ID NO: 71962 - RNA, 18 nt, Artificial Sequence
  Description of Artificial Sequence: Synthetic oligonucleotide
cguugcugaaaucugccc

SEQ ID NO: 71963 - RNA, 18 nt, Artificial Sequence
  Description of Artificial Sequence: Synthetic oligonucleotide
ucuuacguugcugaaauc

SEQ ID NO: 71964 - RNA, 18 nt, Artificial Sequence
  Description of Artificial Sequence: Synthetic oligonucleotide
uuuuuucuuacguugcug

SEQ ID NO: 71965 - RNA, 18 nt, Artificial Sequence
  Description of Artificial Sequence: Synthetic oligonucleotide
gcuccuuuuuucuuacgu

SEQ ID NO: 71966 - RNA, 18 nt, Artificial Sequence
  Description of Artificial Sequence: Synthetic oligonucleotide
gaagagcuccuuuuuucu

SEQ ID NO: 71967 - RNA, 18 nt, Artificial Sequence
  Description of Artificial Sequence: Synthetic oligonucleotide
agugagaagagcuccuuu

SEQ ID NO: 71968 - RNA, 18 nt, Artificial Sequence
  Description of Artificial Sequence: Synthetic oligonucleotide
guuucagugagaagagcu

SEQ ID NO: 71969 - RNA, 18 nt, Artificial Sequence
  Description of Artificial Sequence: Synthetic oligonucleotide
acuugguuucagugagaa

SEQ ID NO: 71970 - RNA, 18 nt, Artificial Sequence
  Description of Artificial Sequence: Synthetic oligonucleotide
cuuacacuugguuucagu

SEQ ID NO: 71971 - RNA, 18 nt, Artificial Sequence
  Description of Artificial Sequence: Synthetic oligonucleotide
cuggucuuacacuugguu

SEQ ID NO: 71972 - RNA, 18 nt, Artificial Sequence
  Description of Artificial Sequence: Synthetic oligonucleotide
ccagccuggucuuacacu

SEQ ID NO: 71973 - RNA, 18 nt, Artificial Sequence
  Description of Artificial Sequence: Synthetic oligonucleotide
cuaguccagccuggucuu

SEQ ID NO: 71974 - RNA, 18 nt, Artificial Sequence
  Description of Artificial Sequence: Synthetic oligonucleotide
guccucuaguccagccug

SEQ ID NO: 71975 - RNA, 18 nt, Artificial Sequence
  Description of Artificial Sequence: Synthetic oligonucleotide
cccguguccucuagucca

SEQ ID NO: 71976 - RNA, 18 nt, Artificial Sequence
  Description of Artificial Sequence: Synthetic oligonucleotide
aaacucccguguccucua

SEQ ID NO: 71977 - RNA, 18 nt, Artificial Sequence
  Description of Artificial Sequence: Synthetic oligonucleotide
uucaaaaacucccguguc

SEQ ID NO: 71978 - RNA, 18 nt, Artificial Sequence
  Description of Artificial Sequence: Synthetic oligonucleotide
ucugcuucaaaaacuccc

SEQ ID NO: 71979 - RNA, 18 nt, Artificial Sequence
  Description of Artificial Sequence: Synthetic oligonucleotide
cagccucugcuucaaaaa

SEQ ID NO: 71980 - RNA, 18 nt, Artificial Sequence
  Description of Artificial Sequence: Synthetic oligonucleotide
gucaucagccucugcuuc

SEQ ID NO: 71981 - RNA, 18 nt, Artificial Sequence
  Description of Artificial Sequence: Synthetic oligonucleotide
agcuggucaucagccucu

SEQ ID NO: 71982 - RNA, 18 nt, Artificial Sequence
  Description of Artificial Sequence: Synthetic oligonucleotide
ccgacagcuggucaucag

SEQ ID NO: 71983 - RNA, 18 nt, Artificial Sequence
  Description of Artificial Sequence: Synthetic oligonucleotide
gucucccgacagcugguc

SEQ ID NO: 71984 - RNA, 18 nt, Artificial Sequence
  Description of Artificial Sequence: Synthetic oligonucleotide
ucacagucucccgacagc

SEQ ID NO: 71985 - RNA, 18 nt, Artificial Sequence
  Description of Artificial Sequence: Synthetic oligonucleotide
uuccuucacagucucccg

SEQ ID NO: 71986 - RNA, 18 nt, Artificial Sequence
  Description of Artificial Sequence: Synthetic oligonucleotide
aggaauuccuucacaguc

SEQ ID NO: 71987 - RNA, 18 nt, Artificial Sequence
  Description of Artificial Sequence: Synthetic oligonucleotide
agggcaggaauuccuuca

SEQ ID NO: 71988 - RNA, 18 nt, Artificial Sequence
  Description of Artificial Sequence: Synthetic oligonucleotide
cacccagggcaggaauuc

SEQ ID NO: 71989 - RNA, 18 nt, Artificial Sequence
  Description of Artificial Sequence: Synthetic oligonucleotide
ggucccacccagggcagg

SEQ ID NO: 71990 - RNA, 18 nt, Artificial Sequence
  Description of Artificial Sequence: Synthetic oligonucleotide
accaaggucccacccagg

SEQ ID NO: 71991 - RNA, 18 nt, Artificial Sequence
  Description of Artificial Sequence: Synthetic oligonucleotide
acaggaccaaggucccac

SEQ ID NO: 71992 - RNA, 18 nt, Artificial Sequence
  Description of Artificial Sequence: Synthetic oligonucleotide
acuggacaggaccaaggu

SEQ ID NO: 71993 - RNA, 18 nt, Artificial Sequence
  Description of Artificial Sequence: Synthetic oligonucleotide
ugagaacuggacaggacc

SEQ ID NO: 71994 - RNA, 18 nt, Artificial Sequence
  Description of Artificial Sequence: Synthetic oligonucleotide
caggcugagaacuggaca

SEQ ID NO: 71995 - RNA, 18 nt, Artificial Sequence
  Description of Artificial Sequence: Synthetic oligonucleotide
ucauacaggcugagaacu

SEQ ID NO: 71996 - RNA, 18 nt, Artificial Sequence
  Description of Artificial Sequence: Synthetic oligonucleotide
gugaaucauacaggcuga

SEQ ID NO: 71997 - RNA, 18 nt, Artificial Sequence
  Description of Artificial Sequence: Synthetic oligonucleotide
gcagagugaaucauacag

SEQ ID NO: 71998 - RNA, 18 nt, Artificial Sequence
  Description of Artificial Sequence: Synthetic oligonucleotide
agccagcagagugaauca

SEQ ID NO: 71999 - RNA, 18 nt, Artificial Sequence
  Description of Artificial Sequence: Synthetic oligonucleotide
ggaguagccagcagagug

SEQ ID NO: 72000 - RNA, 18 nt, Artificial Sequence
  Description of Artificial Sequence: Synthetic oligonucleotide
ccuuaggaguagccagca

SEQ ID NO: 72001 - RNA, 18 nt, Artificial Sequence
  Description of Artificial Sequence: Synthetic oligonucleotide
gggagccuuaggaguagc

SEQ ID NO: 72002 - RNA, 18 nt, Artificial Sequence
  Description of Artificial Sequence: Synthetic oligonucleotide
acacuaaaagcggguggg

SEQ ID NO: 72003 - RNA, 18 nt, Artificial Sequence
  Description of Artificial Sequence: Synthetic oligonucleotide
ggcacacuaaaagcgggu

SEQ ID NO: 72004 - RNA, 18 nt, Artificial Sequence
  Description of Artificial Sequence: Synthetic oligonucleotide
caaagggcacacuaaaag

SEQ ID NO: 72005 - RNA, 18 nt, Artificial Sequence
  Description of Artificial Sequence: Synthetic oligonucleotide
ugccucaaagggcacacu

SEQ ID NO: 72006 - RNA, 18 nt, Artificial Sequence
  Description of Artificial Sequence: Synthetic oligonucleotide
cgcacugccucaaagggc

SEQ ID NO: 72007 - RNA, 18 nt, Artificial Sequence
  Description of Artificial Sequence: Synthetic oligonucleotide
agaagcgcacugccucaa

SEQ ID NO: 72008 - RNA, 18 nt, Artificial Sequence
  Description of Artificial Sequence: Synthetic oligonucleotide
aagagagaagcgcacugc

SEQ ID NO: 72009 - RNA, 18 nt, Artificial Sequence
  Description of Artificial Sequence: Synthetic oligonucleotide
ccugugccuuggucuccu

SEQ ID NO: 72010 - RNA, 18 nt, Artificial Sequence
  Description of Artificial Sequence: Synthetic oligonucleotide
aauguccugugccuuggu

SEQ ID NO: 72011 - RNA, 18 nt, Artificial Sequence
  Description of Artificial Sequence: Synthetic oligonucleotide
cccagaauguccugugcc

SEQ ID NO: 72012 - RNA, 18 nt, Artificial Sequence
  Description of Artificial Sequence: Synthetic oligonucleotide
cugcucccagaauguccu

SEQ ID NO: 72013 - RNA, 18 nt, Artificial Sequence
  Description of Artificial Sequence: Synthetic oligonucleotide
ggucacugcucccagaau

SEQ ID NO: 72014 - RNA, 18 nt, Artificial Sequence
  Description of Artificial Sequence: Synthetic oligonucleotide
agaagggucacugcuccc

SEQ ID NO: 72015 - RNA, 18 nt, Artificial Sequence
  Description of Artificial Sequence: Synthetic oligonucleotide
ccagcagaagggucacug

SEQ ID NO: 72016 - RNA, 18 nt, Artificial Sequence
  Description of Artificial Sequence: Synthetic oligonucleotide
ucccuccagcagaagggu

SEQ ID NO: 72017 - RNA, 18 nt, Artificial Sequence
  Description of Artificial Sequence: Synthetic oligonucleotide
aucacucccuccagcaga

SEQ ID NO: 72018 - RNA, 18 nt, Artificial Sequence
  Description of Artificial Sequence: Synthetic oligonucleotide
cugccaucacucccucca

SEQ ID NO: 72019 - RNA, 18 nt, Artificial Sequence
  Description of Artificial Sequence: Synthetic oligonucleotide
ccgugcugccaucacucc

SEQ ID NO: 72020 - RNA, 18 nt, Artificial Sequence
  Description of Artificial Sequence: Synthetic oligonucleotide
uguccccgugcugccauc

SEQ ID NO: 72021 - RNA, 18 nt, Artificial Sequence
  Description of Artificial Sequence: Synthetic oligonucleotide
ccaguuguccccgugcug

SEQ ID NO: 72022 - RNA, 18 nt, Artificial Sequence
  Description of Artificial Sequence: Synthetic oligonucleotide
gggucccaguuguccccg

SEQ ID NO: 72023 - RNA, 18 nt, Artificial Sequence
  Description of Artificial Sequence: Synthetic oligonucleotide
caagugggucccaguugu

SEQ ID NO: 72024 - RNA, 18 nt, Artificial Sequence
  Description of Artificial Sequence: Synthetic oligonucleotide
agaggcaaguggguccca

SEQ ID NO: 72025 - RNA, 18 nt, Artificial Sequence
  Description of Artificial Sequence: Synthetic oligonucleotide
ggaugagaggcaaguggg

SEQ ID NO: 72026 - RNA, 18 nt, Artificial Sequence
  Description of Artificial Sequence: Synthetic oligonucleotide
aggagggaugagaggcaa

SEQ ID NO: 72027 - RNA, 18 nt, Artificial Sequence
  Description of Artificial Sequence: Synthetic oligonucleotide
gccccaggagggaugaga

SEQ ID NO: 72028 - RNA, 18 nt, Artificial Sequence
  Description of Artificial Sequence: Synthetic oligonucleotide
aagcugccccaggaggga

SEQ ID NO: 72029 - RNA, 18 nt, Artificial Sequence
  Description of Artificial Sequence: Synthetic oligonucleotide
ccagaaagcugccccagg

SEQ ID NO: 72030 - RNA, 18 nt, Artificial Sequence
  Description of Artificial Sequence: Synthetic oligonucleotide
ccuguccagaaagcugcc

SEQ ID NO: 72031 - RNA, 18 nt, Artificial Sequence
  Description of Artificial Sequence: Synthetic oligonucleotide
acggaccuguccagaaag

SEQ ID NO: 72032 - RNA, 18 nt, Artificial Sequence
  Description of Artificial Sequence: Synthetic oligonucleotide
aggagacggaccugucca

SEQ ID NO: 72033 - RNA, 18 nt, Artificial Sequence
  Description of Artificial Sequence: Synthetic oligonucleotide
caaggaggagacggaccu

SEQ ID NO: 72034 - RNA, 18 nt, Artificial Sequence
  Description of Artificial Sequence: Synthetic oligonucleotide
ggccccaaggaggagacg

SEQ ID NO: 72035 - RNA, 18 nt, Artificial Sequence
  Description of Artificial Sequence: Synthetic oligonucleotide
ugcagggccccaaggagg

SEQ ID NO: 72036 - RNA, 18 nt, Artificial Sequence
  Description of Artificial Sequence: Synthetic oligonucleotide
ggcucugcagggccccaa

SEQ ID NO: 72037 - RNA, 18 nt, Artificial Sequence
  Description of Artificial Sequence: Synthetic oligonucleotide
aaggaggcucugcagggc

SEQ ID NO: 72038 - RNA, 18 nt, Artificial Sequence
  Description of Artificial Sequence: Synthetic oligonucleotide
guuccaaggaggcucugc

SEQ ID NO: 72039 - RNA, 18 nt, Artificial Sequence
  Description of Artificial Sequence: Synthetic oligonucleotide
uccugugccuuggucucc

SEQ ID NO: 72040 - RNA, 18 nt, Artificial Sequence
  Description of Artificial Sequence: Synthetic oligonucleotide
gaauguccugugccuugg

SEQ ID NO: 72041 - RNA, 18 nt, Artificial Sequence
  Description of Artificial Sequence: Synthetic oligonucleotide
ucccagaauguccugugc

SEQ ID NO: 72042 - RNA, 18 nt, Artificial Sequence
  Description of Artificial Sequence: Synthetic oligonucleotide
acugcucccagaaugucc

SEQ ID NO: 72043 - RNA, 18 nt, Artificial Sequence
  Description of Artificial Sequence: Synthetic oligonucleotide
gggucacugcucccagaa

SEQ ID NO: 72044 - RNA, 18 nt, Artificial Sequence
  Description of Artificial Sequence: Synthetic oligonucleotide
cagaagggucacugcucc

SEQ ID NO: 72045 - RNA, 18 nt, Artificial Sequence
  Description of Artificial Sequence: Synthetic oligonucleotide
uccagcagaagggucacu

SEQ ID NO: 72046 - RNA, 18 nt, Artificial Sequence
  Description of Artificial Sequence: Synthetic oligonucleotide
cucccuccagcagaaggg

SEQ ID NO: 72047 - RNA, 18 nt, Artificial Sequence
  Description of Artificial Sequence: Synthetic oligonucleotide
caucacucccuccagcag

SEQ ID NO: 72048 - RNA, 18 nt, Artificial Sequence
  Description of Artificial Sequence: Synthetic oligonucleotide
gcugccaucacucccucc

SEQ ID NO: 72049 - RNA, 18 nt, Artificial Sequence
  Description of Artificial Sequence: Synthetic oligonucleotide
cccgugcugccaucacuc

SEQ ID NO: 72050 - RNA, 18 nt, Artificial Sequence
  Description of Artificial Sequence: Synthetic oligonucleotide
uuguccccgugcugccau

SEQ ID NO: 72051 - RNA, 18 nt, Artificial Sequence
  Description of Artificial Sequence: Synthetic oligonucleotide
cccaguuguccccgugcu

SEQ ID NO: 72052 - RNA, 18 nt, Artificial Sequence
  Description of Artificial Sequence: Synthetic oligonucleotide
ugggucccaguugucccc

SEQ ID NO: 72053 - RNA, 18 nt, Artificial Sequence
  Description of Artificial Sequence: Synthetic oligonucleotide
gcaagugggucccaguug

SEQ ID NO: 72054 - RNA, 18 nt, Artificial Sequence
  Description of Artificial Sequence: Synthetic oligonucleotide
gagaggcaaguggguccc

SEQ ID NO: 72055 - RNA, 18 nt, Artificial Sequence
  Description of Artificial Sequence: Synthetic oligonucleotide
gggaugagaggcaagugg

SEQ ID NO: 72056 - RNA, 18 nt, Artificial Sequence
  Description of Artificial Sequence: Synthetic oligonucleotide
caggagggaugagaggca

SEQ ID NO: 72057 - RNA, 18 nt, Artificial Sequence
  Description of Artificial Sequence: Synthetic oligonucleotide
ugccccaggagggaugag

SEQ ID NO: 72058 - RNA, 18 nt, Artificial Sequence
  Description of Artificial Sequence: Synthetic oligonucleotide
aaagcugccccaggaggg

SEQ ID NO: 72059 - RNA, 18 nt, Artificial Sequence
  Description of Artificial Sequence: Synthetic oligonucleotide
uccagaaagcugccccag

SEQ ID NO: 72060 - RNA, 18 nt, Artificial Sequence
  Description of Artificial Sequence: Synthetic oligonucleotide
accuguccagaaagcugc

SEQ ID NO: 72061 - RNA, 18 nt, Artificial Sequence
  Description of Artificial Sequence: Synthetic oligonucleotide
gacggaccuguccagaaa

SEQ ID NO: 72062 - RNA, 18 nt, Artificial Sequence
  Description of Artificial Sequence: Synthetic oligonucleotide
gaggagacggaccugucc

SEQ ID NO: 72063 - RNA, 18 nt, Artificial Sequence
  Description of Artificial Sequence: Synthetic oligonucleotide
ccaaggaggagacggacc

SEQ ID NO: 72064 - RNA, 18 nt, Artificial Sequence
  Description of Artificial Sequence: Synthetic oligonucleotide
gggccccaaggaggagac

SEQ ID NO: 72065 - RNA, 18 nt, Artificial Sequence
  Description of Artificial Sequence: Synthetic oligonucleotide
cugcagggccccaaggag

SEQ ID NO: 72066 - RNA, 18 nt, Artificial Sequence
  Description of Artificial Sequence: Synthetic oligonucleotide
aggcucugcagggcccca

SEQ ID NO: 72067 - RNA, 18 nt, Artificial Sequence
  Description of Artificial Sequence: Synthetic oligonucleotide
caaggaggcucugcaggg

SEQ ID NO: 72068 - RNA, 18 nt, Artificial Sequence
  Description of Artificial Sequence: Synthetic oligonucleotide
gguuccaaggaggcucug

SEQ ID NO: 72069 - RNA, 18 nt, Artificial Sequence
  Description of Artificial Sequence: Synthetic oligonucleotide
ucuacagaucccuugacu

SEQ ID NO: 72070 - RNA, 18 nt, Artificial Sequence
  Description of Artificial Sequence: Synthetic oligonucleotide
caguuucuacagaucccu

SEQ ID NO: 72071 - RNA, 18 nt, Artificial Sequence
  Description of Artificial Sequence: Synthetic oligonucleotide
aagaacaguuucuacaga

SEQ ID NO: 72072 - RNA, 18 nt, Artificial Sequence
  Description of Artificial Sequence: Synthetic oligonucleotide
cagaaaagaacaguuucu

SEQ ID NO: 72073 - RNA, 18 nt, Artificial Sequence
  Description of Artificial Sequence: Synthetic oligonucleotide
ugagucagaaaagaacag

SEQ ID NO: 72074 - RNA, 18 nt, Artificial Sequence
  Description of Artificial Sequence: Synthetic oligonucleotide
gggacugagucagaaaag

SEQ ID NO: 72075 - RNA, 18 nt, Artificial Sequence
  Description of Artificial Sequence: Synthetic oligonucleotide
cuucccucaggucuucua

SEQ ID NO: 72076 - RNA, 18 nt, Artificial Sequence
  Description of Artificial Sequence: Synthetic oligonucleotide
cccuucuucccucagguc

SEQ ID NO: 72077 - RNA, 18 nt, Artificial Sequence
  Description of Artificial Sequence: Synthetic oligonucleotide
aagagcccuucuucccuc

SEQ ID NO: 72078 - RNA, 18 nt, Artificial Sequence
  Description of Artificial Sequence: Synthetic oligonucleotide
ccuggaagagcccuucuu

SEQ ID NO: 72079 - RNA, 18 nt, Artificial Sequence
  Description of Artificial Sequence: Synthetic oligonucleotide
agcucccuggaagagccc

SEQ ID NO: 72080 - RNA, 18 nt, Artificial Sequence
  Description of Artificial Sequence: Synthetic oligonucleotide
ccuugagcucccuggaag

SEQ ID NO: 72081 - RNA, 18 nt, Artificial Sequence
  Description of Artificial Sequence: Synthetic oligonucleotide
ucugcccuugagcucccu

SEQ ID NO: 72082 - RNA, 18 nt, Artificial Sequence
  Description of Artificial Sequence: Synthetic oligonucleotide
gcucuucugcccuugagc

SEQ ID NO: 72083 - RNA, 18 nt, Artificial Sequence
  Description of Artificial Sequence: Synthetic oligonucleotide
gaucagcucuucugcccu

SEQ ID NO: 72084 - RNA, 18 nt, Artificial Sequence
  Description of Artificial Sequence: Synthetic oligonucleotide
uaguagaucagcucuucu

SEQ ID NO: 72085 - RNA, 18 nt, Artificial Sequence
  Description of Artificial Sequence: Synthetic oligonucleotide
acucuuaguagaucagcu

SEQ ID NO: 72086 - RNA, 18 nt, Artificial Sequence
  Description of Artificial Sequence: Synthetic oligonucleotide
ggagcacucuuaguagau

SEQ ID NO: 72087 - RNA, 18 nt, Artificial Sequence
  Description of Artificial Sequence: Synthetic oligonucleotide
ggcagggagcacucuuag

SEQ ID NO: 72088 - RNA, 18 nt, Artificial Sequence
  Description of Artificial Sequence: Synthetic oligonucleotide
uggcuggcagggagcacu

SEQ ID NO: 72089 - RNA, 18 nt, Artificial Sequence
  Description of Artificial Sequence: Synthetic oligonucleotide
cauuguggcuggcaggga

SEQ ID NO: 72090 - RNA, 18 nt, Artificial Sequence
  Description of Artificial Sequence: Synthetic oligonucleotide
ccaggcauuguggcuggc

SEQ ID NO: 72091 - RNA, 18 nt, Artificial Sequence
  Description of Artificial Sequence: Synthetic oligonucleotide
ucuucugcccuugagcuc

SEQ ID NO: 72092 - RNA, 18 nt, Artificial Sequence
  Description of Artificial Sequence: Synthetic oligonucleotide
ucagcucuucugcccuug

SEQ ID NO: 72093 - RNA, 18 nt, Artificial Sequence
  Description of Artificial Sequence: Synthetic oligonucleotide
guagaucagcucuucugc

SEQ ID NO: 72094 - RNA, 18 nt, Artificial Sequence
  Description of Artificial Sequence: Synthetic oligonucleotide
ucuuaguagaucagcucu

SEQ ID NO: 72095 - RNA, 18 nt, Artificial Sequence
  Description of Artificial Sequence: Synthetic oligonucleotide
agcacucuuaguagauca

SEQ ID NO: 72096 - RNA, 18 nt, Artificial Sequence
  Description of Artificial Sequence: Synthetic oligonucleotide
cagggagcacucuuagua

SEQ ID NO: 72097 - RNA, 18 nt, Artificial Sequence
  Description of Artificial Sequence: Synthetic oligonucleotide
gcuggcagggagcacucu

SEQ ID NO: 72098 - RNA, 18 nt, Artificial Sequence
  Description of Artificial Sequence: Synthetic oligonucleotide
uuguggcuggcagggagc

SEQ ID NO: 72099 - RNA, 18 nt, Artificial Sequence
  Description of Artificial Sequence: Synthetic oligonucleotide
aggcauuguggcuggcag

SEQ ID NO: 72100 - RNA, 18 nt, Artificial Sequence
  Description of Artificial Sequence: Synthetic oligonucleotide
uacccaggcauuguggcu

SEQ ID NO: 72101 - RNA, 18 nt, Artificial Sequence
  Description of Artificial Sequence: Synthetic oligonucleotide
gccaguacccaggcauug

SEQ ID NO: 72102 - RNA, 18 nt, Artificial Sequence
  Description of Artificial Sequence: Synthetic oligonucleotide
aggaugccaguacccagg

SEQ ID NO: 72103 - RNA, 18 nt, Artificial Sequence
  Description of Artificial Sequence: Synthetic oligonucleotide
aagacaggaugccaguac

SEQ ID NO: 72104 - RNA, 18 nt, Artificial Sequence
  Description of Artificial Sequence: Synthetic oligonucleotide
uaggaaagacaggaugcc

SEQ ID NO: 72105 - RNA, 18 nt, Artificial Sequence
  Description of Artificial Sequence: Synthetic oligonucleotide
cuaaguaggaaagacagg

SEQ ID NO: 72106 - RNA, 18 nt, Artificial Sequence
  Description of Artificial Sequence: Synthetic oligonucleotide
cuugucuaaguaggaaag

SEQ ID NO: 72107 - RNA, 18 nt, Artificial Sequence
  Description of Artificial Sequence: Synthetic oligonucleotide
ccucccuugucuaaguag

SEQ ID NO: 72108 - RNA, 18 nt, Artificial Sequence
  Description of Artificial Sequence: Synthetic oligonucleotide
ucaggccucccuugucua

SEQ ID NO: 72109 - RNA, 18 nt, Artificial Sequence
  Description of Artificial Sequence: Synthetic oligonucleotide
agaucucaggccucccuu

SEQ ID NO: 72110 - RNA, 18 nt, Artificial Sequence
  Description of Artificial Sequence: Synthetic oligonucleotide
gggccagaucucaggccu

SEQ ID NO: 72111 - RNA, 18 nt, Artificial Sequence
  Description of Artificial Sequence: Synthetic oligonucleotide
caccagggccagaucuca

SEQ ID NO: 72112 - RNA, 18 nt, Artificial Sequence
  Description of Artificial Sequence: Synthetic oligonucleotide
ccaaacaccagggccaga

SEQ ID NO: 72113 - RNA, 18 nt, Artificial Sequence
  Description of Artificial Sequence: Synthetic oligonucleotide
ugaggccaaacaccaggg

SEQ ID NO: 72114 - RNA, 18 nt, Artificial Sequence
  Description of Artificial Sequence: Synthetic oligonucleotide
gguccugaggccaaacac

SEQ ID NO: 72115 - RNA, 18 nt, Artificial Sequence
  Description of Artificial Sequence: Synthetic oligonucleotide
uccugcccuguggaggaa

SEQ ID NO: 72116 - RNA, 18 nt, Artificial Sequence
  Description of Artificial Sequence: Synthetic oligonucleotide
ugugguccugcccugugg

SEQ ID NO: 72117 - RNA, 18 nt, Artificial Sequence
  Description of Artificial Sequence: Synthetic oligonucleotide
ugagcugugguccugccc

SEQ ID NO: 72118 - RNA, 18 nt, Artificial Sequence
  Description of Artificial Sequence: Synthetic oligonucleotide
ccuugugagcuguggucc

SEQ ID NO: 72119 - RNA, 18 nt, Artificial Sequence
  Description of Artificial Sequence: Synthetic oligonucleotide
gggauccuugugagcugu

SEQ ID NO: 72120 - RNA, 18 nt, Artificial Sequence
  Description of Artificial Sequence: Synthetic oligonucleotide
gcauugggauccuuguga

SEQ ID NO: 72121 - RNA, 18 nt, Artificial Sequence
  Description of Artificial Sequence: Synthetic oligonucleotide
agauggcauugggauccu

SEQ ID NO: 72122 - RNA, 18 nt, Artificial Sequence
  Description of Artificial Sequence: Synthetic oligonucleotide
caggaagauggcauuggg

SEQ ID NO: 72123 - RNA, 18 nt, Artificial Sequence
  Description of Artificial Sequence: Synthetic oligonucleotide
aagcucaggaagauggca

SEQ ID NO: 72124 - RNA, 18 nt, Artificial Sequence
  Description of Artificial Sequence: Synthetic oligonucleotide
guuggaagcucaggaaga

SEQ ID NO: 72125 - RNA, 18 nt, Artificial Sequence
  Description of Artificial Sequence: Synthetic oligonucleotide
cagguguuggaagcucag

SEQ ID NO: 72126 - RNA, 18 nt, Artificial Sequence
  Description of Artificial Sequence: Synthetic oligonucleotide
cggagcagguguuggaag

SEQ ID NO: 72127 - RNA, 18 nt, Artificial Sequence
  Description of Artificial Sequence: Synthetic oligonucleotide
uuccucggagcagguguu

SEQ ID NO: 72128 - RNA, 18 nt, Artificial Sequence
  Description of Artificial Sequence: Synthetic oligonucleotide
caccuuuccucggagcag

SEQ ID NO: 72129 - RNA, 18 nt, Artificial Sequence
  Description of Artificial Sequence: Synthetic oligonucleotide
aaacgcaccuuuccucgg

SEQ ID NO: 72130 - RNA, 18 nt, Artificial Sequence
  Description of Artificial Sequence: Synthetic oligonucleotide
ucaggaaacgcaccuuuc

SEQ ID NO: 72131 - RNA, 18 nt, Artificial Sequence
  Description of Artificial Sequence: Synthetic oligonucleotide
aagcaucaggaaacgcac

SEQ ID NO: 72132 - RNA, 18 nt, Artificial Sequence
  Description of Artificial Sequence: Synthetic oligonucleotide
ccuacaagcaucaggaaa

SEQ ID NO: 72133 - RNA, 18 nt, Artificial Sequence
  Description of Artificial Sequence: Synthetic oligonucleotide
acccuccuacaagcauca

SEQ ID NO: 72134 - RNA, 18 nt, Artificial Sequence
  Description of Artificial Sequence: Synthetic oligonucleotide
gguggacccuccuacaag

SEQ ID NO: 72135 - RNA, 18 nt, Artificial Sequence
  Description of Artificial Sequence: Synthetic oligonucleotide
cagaggguggacccuccu

SEQ ID NO: 72136 - RNA, 18 nt, Artificial Sequence
  Description of Artificial Sequence: Synthetic oligonucleotide
ugacgcagaggguggacc

SEQ ID NO: 72137 - RNA, 18 nt, Artificial Sequence
  Description of Artificial Sequence: Synthetic oligonucleotide
ccgccugacgcagagggu

SEQ ID NO: 72138 - RNA, 18 nt, Artificial Sequence
  Description of Artificial Sequence: Synthetic oligonucleotide
gggcccgccugacgcaga

SEQ ID NO: 72139 - RNA, 18 nt, Artificial Sequence
  Description of Artificial Sequence: Synthetic oligonucleotide
acagcugugguggguggg

SEQ ID NO: 72140 - RNA, 18 nt, Artificial Sequence
  Description of Artificial Sequence: Synthetic oligonucleotide
gggacagcuguggugggu

SEQ ID NO: 72141 - RNA, 18 nt, Artificial Sequence
  Description of Artificial Sequence: Synthetic oligonucleotide
uagagagguucugcuggg

SEQ ID NO: 72142 - RNA, 18 nt, Artificial Sequence
  Description of Artificial Sequence: Synthetic oligonucleotide
aggacuagagagguucug

SEQ ID NO: 72143 - RNA, 18 nt, Artificial Sequence
  Description of Artificial Sequence: Synthetic oligonucleotide
gugugaggacuagagagg

SEQ ID NO: 72144 - RNA, 18 nt, Artificial Sequence
  Description of Artificial Sequence: Synthetic oligonucleotide
guucagugugaggacuag

SEQ ID NO: 72145 - RNA, 18 nt, Artificial Sequence
  Description of Artificial Sequence: Synthetic oligonucleotide
agcucguucagugugagg

SEQ ID NO: 72146 - RNA, 18 nt, Artificial Sequence
  Description of Artificial Sequence: Synthetic oligonucleotide
uugggagcucguucagug

SEQ ID NO: 72147 - RNA, 18 nt, Artificial Sequence
  Description of Artificial Sequence: Synthetic oligonucleotide
ccuguuugggagcucguu

SEQ ID NO: 72148 - RNA, 18 nt, Artificial Sequence
  Description of Artificial Sequence: Synthetic oligonucleotide
gaaguccuguuugggagc

SEQ ID NO: 72149 - RNA, 18 nt, Artificial Sequence
  Description of Artificial Sequence: Synthetic oligonucleotide
auccagaaguccuguuug

SEQ ID NO: 72150 - RNA, 18 nt, Artificial Sequence
  Description of Artificial Sequence: Synthetic oligonucleotide
caacaauccagaaguccu

SEQ ID NO: 72151 - RNA, 18 nt, Artificial Sequence
  Description of Artificial Sequence: Synthetic oligonucleotide
gucuccaacaauccagaa

SEQ ID NO: 72152 - RNA, 18 nt, Artificial Sequence
  Description of Artificial Sequence: Synthetic oligonucleotide
aguuugucuccaacaauc

SEQ ID NO: 72153 - RNA, 18 nt, Artificial Sequence
  Description of Artificial Sequence: Synthetic oligonucleotide
agugaaguuugucuccaa

SEQ ID NO: 72154 - RNA, 18 nt, Artificial Sequence
  Description of Artificial Sequence: Synthetic oligonucleotide
gaggcagugaaguuuguc

SEQ ID NO: 72155 - RNA, 18 nt, Artificial Sequence
  Description of Artificial Sequence: Synthetic oligonucleotide
uggcugaggcagugaagu

SEQ ID NO: 72156 - RNA, 18 nt, Artificial Sequence
  Description of Artificial Sequence: Synthetic oligonucleotide
aguucuggcugaggcagu

SEQ ID NO: 72157 - RNA, 18 nt, Artificial Sequence
  Description of Artificial Sequence: Synthetic oligonucleotide
ccaguaguucuggcugag

SEQ ID NO: 72158 - RNA, 18 nt, Artificial Sequence
  Description of Artificial Sequence: Synthetic oligonucleotide
cagagccaguaguucugg

SEQ ID NO: 72159 - RNA, 18 nt, Artificial Sequence
  Description of Artificial Sequence: Synthetic oligonucleotide
aagcccagagccaguagu

SEQ ID NO: 72160 - RNA, 18 nt, Artificial Sequence
  Description of Artificial Sequence: Synthetic oligonucleotide
uucagaagcccagagcca

SEQ ID NO: 72161 - RNA, 18 nt, Artificial Sequence
  Description of Artificial Sequence: Synthetic oligonucleotide
gccacuucagaagcccag

SEQ ID NO: 72162 - RNA, 18 nt, Artificial Sequence
  Description of Artificial Sequence: Synthetic oligonucleotide
cugcugccacuucagaag

SEQ ID NO: 72163 - RNA, 18 nt, Artificial Sequence
  Description of Artificial Sequence: Synthetic oligonucleotide
aaucccugcugccacuuc

SEQ ID NO: 72164 - RNA, 18 nt, Artificial Sequence
  Description of Artificial Sequence: Synthetic oligonucleotide
cucugaaucccugcugcc

SEQ ID NO: 72165 - RNA, 18 nt, Artificial Sequence
  Description of Artificial Sequence: Synthetic oligonucleotide
cuuggcucugaaucccug

SEQ ID NO: 72166 - RNA, 18 nt, Artificial Sequence
  Description of Artificial Sequence: Synthetic oligonucleotide
ggaaucuuggcucugaau

SEQ ID NO: 72167 - RNA, 18 nt, Artificial Sequence
  Description of Artificial Sequence: Synthetic oligonucleotide
gaccaggaaucuuggcuc

SEQ ID NO: 72168 - RNA, 18 nt, Artificial Sequence
  Description of Artificial Sequence: Synthetic oligonucleotide
cagcagaccaggaaucuu

SEQ ID NO: 72169 - RNA, 18 nt, Artificial Sequence
  Description of Artificial Sequence: Synthetic oligonucleotide
ugguucagcagaccagga

SEQ ID NO: 72170 - RNA, 18 nt, Artificial Sequence
  Description of Artificial Sequence: Synthetic oligonucleotide
agguuugguucagcagac

SEQ ID NO: 72171 - RNA, 18 nt, Artificial Sequence
  Description of Artificial Sequence: Synthetic oligonucleotide
ccuggagguuugguucag

SEQ ID NO: 72172 - RNA, 18 nt, Artificial Sequence
  Description of Artificial Sequence: Synthetic oligonucleotide
agggaccuggagguuugg

SEQ ID NO: 72173 - RNA, 18 nt, Artificial Sequence
  Description of Artificial Sequence: Synthetic oligonucleotide
gguccagggaccuggagg

SEQ ID NO: 72174 - RNA, 18 nt, Artificial Sequence
  Description of Artificial Sequence: Synthetic oligonucleotide
gauuugguccagggaccu

SEQ ID NO: 72175 - RNA, 18 nt, Artificial Sequence
  Description of Artificial Sequence: Synthetic oligonucleotide
gggauuugguccagggac

SEQ ID NO: 72176 - RNA, 18 nt, Artificial Sequence
  Description of Artificial Sequence: Synthetic oligonucleotide
ccuguucagguauccggg

SEQ ID NO: 72177 - RNA, 18 nt, Artificial Sequence
  Description of Artificial Sequence: Synthetic oligonucleotide
uguauccuguucagguau

SEQ ID NO: 72178 - RNA, 18 nt, Artificial Sequence
  Description of Artificial Sequence: Synthetic oligonucleotide
guucguguauccuguuca

SEQ ID NO: 72179 - RNA, 18 nt, Artificial Sequence
  Description of Artificial Sequence: Synthetic oligonucleotide
caagaguucguguauccu

SEQ ID NO: 72180 - RNA, 18 nt, Artificial Sequence
  Description of Artificial Sequence: Synthetic oligonucleotide
ccauucaagaguucgugu

SEQ ID NO: 72181 - RNA, 18 nt, Artificial Sequence
  Description of Artificial Sequence: Synthetic oligonucleotide
gaguuccauucaagaguu

SEQ ID NO: 72182 - RNA, 18 nt, Artificial Sequence
  Description of Artificial Sequence: Synthetic oligonucleotide
uccacgaguuccauucaa

SEQ ID NO: 72183 - RNA, 18 nt, Artificial Sequence
  Description of Artificial Sequence: Synthetic oligonucleotide
aagaguccacgaguucca

SEQ ID NO: 72184 - RNA, 18 nt, Artificial Sequence
  Description of Artificial Sequence: Synthetic oligonucleotide
caggaaagaguccacgag

SEQ ID NO: 72185 - RNA, 18 nt, Artificial Sequence
  Description of Artificial Sequence: Synthetic oligonucleotide
ggguccaggaaagagucc

SEQ ID NO: 72186 - RNA, 18 nt, Artificial Sequence
  Description of Artificial Sequence: Synthetic oligonucleotide
cgugaggguccaggaaag

SEQ ID NO: 72187 - RNA, 18 nt, Artificial Sequence
  Description of Artificial Sequence: Synthetic oligonucleotide
uccugcgugaggguccag

SEQ ID NO: 72188 - RNA, 18 nt, Artificial Sequence
  Description of Artificial Sequence: Synthetic oligonucleotide
uaggguccugcgugaggg

SEQ ID NO: 72189 - RNA, 18 nt, Artificial Sequence
  Description of Artificial Sequence: Synthetic oligonucleotide
gcuccuaggguccugcgu

SEQ ID NO: 72190 - RNA, 18 nt, Artificial Sequence
  Description of Artificial Sequence: Synthetic oligonucleotide
gggcuccuaggguccugc

SEQ ID NO: 72191 - RNA, 18 nt, Artificial Sequence
  Description of Artificial Sequence: Synthetic oligonucleotide
ccugaggaaauguccggg

SEQ ID NO: 72192 - RNA, 18 nt, Artificial Sequence
  Description of Artificial Sequence: Synthetic oligonucleotide
auguuccugaggaaaugu

SEQ ID NO: 72193 - RNA, 18 nt, Artificial Sequence
  Description of Artificial Sequence: Synthetic oligonucleotide
gucugauguuccugagga

SEQ ID NO: 72194 - RNA, 18 nt, Artificial Sequence
  Description of Artificial Sequence: Synthetic oligonucleotide
ccugugucugauguuccu

SEQ ID NO: 72195 - RNA, 18 nt, Artificial Sequence
  Description of Artificial Sequence: Synthetic oligonucleotide
gggagccugugucugaug

SEQ ID NO: 72196 - RNA, 18 nt, Artificial Sequence
  Description of Artificial Sequence: Synthetic oligonucleotide
uggcagggagccuguguc

SEQ ID NO: 72197 - RNA, 18 nt, Artificial Sequence
  Description of Artificial Sequence: Synthetic oligonucleotide
uuggguggcagggagccu

SEQ ID NO: 72198 - RNA, 18 nt, Artificial Sequence
  Description of Artificial Sequence: Synthetic oligonucleotide
ggagguuggguggcaggg

SEQ ID NO: 72199 - RNA, 18 nt, Artificial Sequence
  Description of Artificial Sequence: Synthetic oligonucleotide
aggcuggagguugggugg

SEQ ID NO: 72200 - RNA, 18 nt, Artificial Sequence
  Description of Artificial Sequence: Synthetic oligonucleotide
uauccaggcuggagguug

SEQ ID NO: 72201 - RNA, 18 nt, Artificial Sequence
  Description of Artificial Sequence: Synthetic oligonucleotide
gagaauauccaggcugga

SEQ ID NO: 72202 - RNA, 18 nt, Artificial Sequence
  Description of Artificial Sequence: Synthetic oligonucleotide
ggaaggagaauauccagg

SEQ ID NO: 72203 - RNA, 18 nt, Artificial Sequence
  Description of Artificial Sequence: Synthetic oligonucleotide
gggaaggagaauauccag

SEQ ID NO: 72204 - RNA, 18 nt, Artificial Sequence
  Description of Artificial Sequence: Synthetic oligonucleotide
guaggaggauggguuggg

SEQ ID NO: 72205 - RNA, 18 nt, Artificial Sequence
  Description of Artificial Sequence: Synthetic oligonucleotide
guccaguaggaggauggg

SEQ ID NO: 72206 - RNA, 18 nt, Artificial Sequence
  Description of Artificial Sequence: Synthetic oligonucleotide
auacuguccaguaggagg

SEQ ID NO: 72207 - RNA, 18 nt, Artificial Sequence
  Description of Artificial Sequence: Synthetic oligonucleotide
agcguauacuguccagua

SEQ ID NO: 72208 - RNA, 18 nt, Artificial Sequence
  Description of Artificial Sequence: Synthetic oligonucleotide
ggaagagcguauacuguc

SEQ ID NO: 72209 - RNA, 18 nt, Artificial Sequence
  Description of Artificial Sequence: Synthetic oligonucleotide
aagagggaagagcguaua

SEQ ID NO: 72210 - RNA, 18 nt, Artificial Sequence
  Description of Artificial Sequence: Synthetic oligonucleotide
gguggaagagggaagagc

SEQ ID NO: 72211 - RNA, 18 nt, Artificial Sequence
  Description of Artificial Sequence: Synthetic oligonucleotide
agguggguggaagaggga

SEQ ID NO: 72212 - RNA, 18 nt, Artificial Sequence
  Description of Artificial Sequence: Synthetic oligonucleotide
gggcaagguggguggaag

SEQ ID NO: 72213 - RNA, 18 nt, Artificial Sequence
  Description of Artificial Sequence: Synthetic oligonucleotide
gggugggcaaggugggug

SEQ ID NO: 72214 - RNA, 18 nt, Artificial Sequence
  Description of Artificial Sequence: Synthetic oligonucleotide
uggagcuggaccacaggg

SEQ ID NO: 72215 - RNA, 18 nt, Artificial Sequence
  Description of Artificial Sequence: Synthetic oligonucleotide
ggguggagcuggaccaca

SEQ ID NO: 72216 - RNA, 18 nt, Artificial Sequence
  Description of Artificial Sequence: Synthetic oligonucleotide
aagggucaggaagcaggg

SEQ ID NO: 72217 - RNA, 18 nt, Artificial Sequence
  Description of Artificial Sequence: Synthetic oligonucleotide
agcagaagggucaggaag

SEQ ID NO: 72218 - RNA, 18 nt, Artificial Sequence
  Description of Artificial Sequence: Synthetic oligonucleotide
guuggagcagaaggguca

SEQ ID NO: 72219 - RNA, 18 nt, Artificial Sequence
  Description of Artificial Sequence: Synthetic oligonucleotide
ugggcguuggagcagaag

SEQ ID NO: 72220 - RNA, 18 nt, Artificial Sequence
  Description of Artificial Sequence: Synthetic oligonucleotide
gggugggcguuggagcag

SEQ ID NO: 72221 - RNA, 18 nt, Artificial Sequence
  Description of Artificial Sequence: Synthetic oligonucleotide
agaagagggcugguaggg

SEQ ID NO: 72222 - RNA, 18 nt, Artificial Sequence
  Description of Artificial Sequence: Synthetic oligonucleotide
uguuuagaagagggcugg

SEQ ID NO: 72223 - RNA, 18 nt, Artificial Sequence
  Description of Artificial Sequence: Synthetic oligonucleotide
ggauguguuuagaagagg

SEQ ID NO: 72224 - RNA, 18 nt, Artificial Sequence
  Description of Artificial Sequence: Synthetic oligonucleotide
guguaggauguguuuaga

SEQ ID NO: 72225 - RNA, 18 nt, Artificial Sequence
  Description of Artificial Sequence: Synthetic oligonucleotide
aguggguguaggaugugu

SEQ ID NO: 72226 - RNA, 18 nt, Artificial Sequence
  Description of Artificial Sequence: Synthetic oligonucleotide
cugggaguggguguagga

SEQ ID NO: 72227 - RNA, 18 nt, Artificial Sequence
  Description of Artificial Sequence: Synthetic oligonucleotide
agauucugggagugggug

SEQ ID NO: 72228 - RNA, 18 nt, Artificial Sequence
  Description of Artificial Sequence: Synthetic oligonucleotide
gagacagauucugggagu

SEQ ID NO: 72229 - RNA, 18 nt, Artificial Sequence
  Description of Artificial Sequence: Synthetic oligonucleotide
uuccugagacagauucug

SEQ ID NO: 72230 - RNA, 18 nt, Artificial Sequence
  Description of Artificial Sequence: Synthetic oligonucleotide
uacccuuccugagacaga

SEQ ID NO: 72231 - RNA, 18 nt, Artificial Sequence
  Description of Artificial Sequence: Synthetic oligonucleotide
aaccuuacccuuccugag

SEQ ID NO: 72232 - RNA, 18 nt, Artificial Sequence
  Description of Artificial Sequence: Synthetic oligonucleotide
cugagaaccuuacccuuc

SEQ ID NO: 72233 - RNA, 18 nt, Artificial Sequence
  Description of Artificial Sequence: Synthetic oligonucleotide
agugucugagaaccuuac

SEQ ID NO: 72234 - RNA, 18 nt, Artificial Sequence
  Description of Artificial Sequence: Synthetic oligonucleotide
ucggcagugucugagaac

SEQ ID NO: 72235 - RNA, 18 nt, Artificial Sequence
  Description of Artificial Sequence: Synthetic oligonucleotide
ugaugucggcagugucug

SEQ ID NO: 72236 - RNA, 18 nt, Artificial Sequence
  Description of Artificial Sequence: Synthetic oligonucleotide
aaugcugaugucggcagu

SEQ ID NO: 72237 - RNA, 18 nt, Artificial Sequence
  Description of Artificial Sequence: Synthetic oligonucleotide
gagacaaugcugaugucg

SEQ ID NO: 72238 - RNA, 18 nt, Artificial Sequence
  Description of Artificial Sequence: Synthetic oligonucleotide
uacacgagacaaugcuga

SEQ ID NO: 72239 - RNA, 18 nt, Artificial Sequence
  Description of Artificial Sequence: Synthetic oligonucleotide
agcuguacacgagacaau

SEQ ID NO: 72240 - RNA, 18 nt, Artificial Sequence
  Description of Artificial Sequence: Synthetic oligonucleotide
aagggagcuguacacgag

SEQ ID NO: 72241 - RNA, 18 nt, Artificial Sequence
  Description of Artificial Sequence: Synthetic oligonucleotide
cagggaagggagcuguac

SEQ ID NO: 72242 - RNA, 18 nt, Artificial Sequence
  Description of Artificial Sequence: Synthetic oligonucleotide
cccugcagggaagggagc

SEQ ID NO: 72243 - RNA, 18 nt, Artificial Sequence
  Description of Artificial Sequence: Synthetic oligonucleotide
gggcgcccugcagggaag

SEQ ID NO: 72244 - RNA, 18 nt, Artificial Sequence
  Description of Artificial Sequence: Synthetic oligonucleotide
cuuguccaguugucuccc

SEQ ID NO: 72245 - RNA, 18 nt, Artificial Sequence
  Description of Artificial Sequence: Synthetic oligonucleotide
gaaaucuuguccaguugu

SEQ ID NO: 72246 - RNA, 18 nt, Artificial Sequence
  Description of Artificial Sequence: Synthetic oligonucleotide
aguaggaaaucuugucca

SEQ ID NO: 72247 - RNA, 18 nt, Artificial Sequence
  Description of Artificial Sequence: Synthetic oligonucleotide
gagaaaguaggaaaucuu

SEQ ID NO: 72248 - RNA, 18 nt, Artificial Sequence
  Description of Artificial Sequence: Synthetic oligonucleotide
uucaggagaaaguaggaa

SEQ ID NO: 72249 - RNA, 18 nt, Artificial Sequence
  Description of Artificial Sequence: Synthetic oligonucleotide
uggguuucaggagaaagu

SEQ ID NO: 72250 - RNA, 18 nt, Artificial Sequence
  Description of Artificial Sequence: Synthetic oligonucleotide
ggcuuuggguuucaggag

SEQ ID NO: 72251 - RNA, 18 nt, Artificial Sequence
  Description of Artificial Sequence: Synthetic oligonucleotide
accagggcuuuggguuuc

SEQ ID NO: 72252 - RNA, 18 nt, Artificial Sequence
  Description of Artificial Sequence: Synthetic oligonucleotide
cuuuuaccagggcuuugg

SEQ ID NO: 72253 - RNA, 18 nt, Artificial Sequence
  Description of Artificial Sequence: Synthetic oligonucleotide
uaucccuuuuaccagggc

SEQ ID NO: 72254 - RNA, 18 nt, Artificial Sequence
  Description of Artificial Sequence: Synthetic oligonucleotide
cuguguaucccuuuuacc

SEQ ID NO: 72255 - RNA, 18 nt, Artificial Sequence
  Description of Artificial Sequence: Synthetic oligonucleotide
caguccuguguaucccuu

SEQ ID NO: 72256 - RNA, 18 nt, Artificial Sequence
  Description of Artificial Sequence: Synthetic oligonucleotide
cuuuucaguccuguguau

SEQ ID NO: 72257 - RNA, 18 nt, Artificial Sequence
  Description of Artificial Sequence: Synthetic oligonucleotide
auucccuuuucaguccug

SEQ ID NO: 72258 - RNA, 18 nt, Artificial Sequence
  Description of Artificial Sequence: Synthetic oligonucleotide
aaaugauucccuuuucag

SEQ ID NO: 72259 - RNA, 18 nt, Artificial Sequence
  Description of Artificial Sequence: Synthetic oligonucleotide
gugaaaaaugauucccuu

SEQ ID NO: 72260 - RNA, 18 nt, Artificial Sequence
  Description of Artificial Sequence: Synthetic oligonucleotide
guacagugaaaaaugauu

SEQ ID NO: 72261 - RNA, 18 nt, Artificial Sequence
  Description of Artificial Sequence: Synthetic oligonucleotide
auaauguacagugaaaaa

SEQ ID NO: 72262 - RNA, 18 nt, Artificial Sequence
  Description of Artificial Sequence: Synthetic oligonucleotide
gguuuauaauguacagug

SEQ ID NO: 72263 - RNA, 18 nt, Artificial Sequence
  Description of Artificial Sequence: Synthetic oligonucleotide
cugaagguuuauaaugua

SEQ ID NO: 72264 - RNA, 18 nt, Artificial Sequence
  Description of Artificial Sequence: Synthetic oligonucleotide
agcuucugaagguuuaua

SEQ ID NO: 72265 - RNA, 18 nt, Artificial Sequence
  Description of Artificial Sequence: Synthetic oligonucleotide
aaaauagcuucugaaggu

SEQ ID NO: 72266 - RNA, 18 nt, Artificial Sequence
  Description of Artificial Sequence: Synthetic oligonucleotide
uuaaaaaaauagcuucug

SEQ ID NO: 72267 - RNA, 18 nt, Artificial Sequence
  Description of Artificial Sequence: Synthetic oligonucleotide
auagcuuaaaaaaauagc

SEQ ID NO: 72268 - RNA, 18 nt, Artificial Sequence
  Description of Artificial Sequence: Synthetic oligonucleotide
ugcugauagcuuaaaaaa

SEQ ID NO: 72269 - RNA, 18 nt, Artificial Sequence
  Description of Artificial Sequence: Synthetic oligonucleotide
aguauugcugauagcuua

SEQ ID NO: 72270 - RNA, 18 nt, Artificial Sequence
  Description of Artificial Sequence: Synthetic oligonucleotide
ugaugaguauugcugaua

SEQ ID NO: 72271 - RNA, 18 nt, Artificial Sequence
  Description of Artificial Sequence: Synthetic oligonucleotide
ugcucugaugaguauugc

SEQ ID NO: 72272 - RNA, 18 nt, Artificial Sequence
  Description of Artificial Sequence: Synthetic oligonucleotide
cuagcugcucugaugagu

SEQ ID NO: 72273 - RNA, 18 nt, Artificial Sequence
  Description of Artificial Sequence: Synthetic oligonucleotide
aagagcuagcugcucuga

SEQ ID NO: 72274 - RNA, 18 nt, Artificial Sequence
  Description of Artificial Sequence: Synthetic oligonucleotide
gaccaaagagcuagcugc

SEQ ID NO: 72275 - RNA, 18 nt, Artificial Sequence
  Description of Artificial Sequence: Synthetic oligonucleotide
aaauagaccaaagagcua

SEQ ID NO: 72276 - RNA, 18 nt, Artificial Sequence
  Description of Artificial Sequence: Synthetic oligonucleotide
gcagaaaauagaccaaag

SEQ ID NO: 72277 - RNA, 18 nt, Artificial Sequence
  Description of Artificial Sequence: Synthetic oligonucleotide
uuucugcagaaaauagac

SEQ ID NO: 72278 - RNA, 18 nt, Artificial Sequence
  Description of Artificial Sequence: Synthetic oligonucleotide
gcaaauuucugcagaaaa

SEQ ID NO: 72279 - RNA, 18 nt, Artificial Sequence
  Description of Artificial Sequence: Synthetic oligonucleotide
gaguugcaaauuucugca

SEQ ID NO: 72280 - RNA, 18 nt, Artificial Sequence
  Description of Artificial Sequence: Synthetic oligonucleotide
ucagugaguugcaaauuu

SEQ ID NO: 72281 - RNA, 18 nt, Artificial Sequence
  Description of Artificial Sequence: Synthetic oligonucleotide
gagaaucagugaguugca

SEQ ID NO: 72282 - RNA, 18 nt, Artificial Sequence
  Description of Artificial Sequence: Synthetic oligonucleotide
auguagagaaucagugag

SEQ ID NO: 72283 - RNA, 18 nt, Artificial Sequence
  Description of Artificial Sequence: Synthetic oligonucleotide
agagcauguagagaauca

SEQ ID NO: 72284 - RNA, 18 nt, Artificial Sequence
  Description of Artificial Sequence: Synthetic oligonucleotide
gaaaaagagcauguagag

SEQ ID NO: 72285 - RNA, 18 nt, Artificial Sequence
  Description of Artificial Sequence: Synthetic oligonucleotide
ucacagaaaaagagcaug

SEQ ID NO: 72286 - RNA, 18 nt, Artificial Sequence
  Description of Artificial Sequence: Synthetic oligonucleotide
aguuaucacagaaaaaga

SEQ ID NO: 72287 - RNA, 18 nt, Artificial Sequence
  Description of Artificial Sequence: Synthetic oligonucleotide
ugcagaguuaucacagaa

SEQ ID NO: 72288 - RNA, 18 nt, Artificial Sequence
  Description of Artificial Sequence: Synthetic oligonucleotide
gccuuugcagaguuauca

SEQ ID NO: 72289 - RNA, 18 nt, Artificial Sequence
  Description of Artificial Sequence: Synthetic oligonucleotide
cccaggccuuugcagagu

SEQ ID NO: 72290 - RNA, 18 nt, Artificial Sequence
  Description of Artificial Sequence: Synthetic oligonucleotide
gccagcccaggccuuugc

SEQ ID NO: 72291 - RNA, 18 nt, Artificial Sequence
  Description of Artificial Sequence: Synthetic oligonucleotide
gccaggccagcccaggcc

SEQ ID NO: 72292 - RNA, 18 nt, Artificial Sequence
  Description of Artificial Sequence: Synthetic oligonucleotide
caacugccaggccagccc

SEQ ID NO: 72293 - RNA, 18 nt, Artificial Sequence
  Description of Artificial Sequence: Synthetic oligonucleotide
cuguucaacugccaggcc

SEQ ID NO: 72294 - RNA, 18 nt, Artificial Sequence
  Description of Artificial Sequence: Synthetic oligonucleotide
ucccucuguucaacugcc

SEQ ID NO: 72295 - RNA, 18 nt, Artificial Sequence
  Description of Artificial Sequence: Synthetic oligonucleotide
gucucucccucuguucaa

SEQ ID NO: 72296 - RNA, 18 nt, Artificial Sequence
  Description of Artificial Sequence: Synthetic oligonucleotide
gguuagucucucccucug

SEQ ID NO: 72297 - RNA, 18 nt, Artificial Sequence
  Description of Artificial Sequence: Synthetic oligonucleotide
cucaagguuagucucucc

SEQ ID NO: 72298 - RNA, 18 nt, Artificial Sequence
  Description of Artificial Sequence: Synthetic oligonucleotide
ucugacucaagguuaguc

SEQ ID NO: 72299 - RNA, 18 nt, Artificial Sequence
  Description of Artificial Sequence: Synthetic oligonucleotide
uguuuucugacucaaggu

SEQ ID NO: 72300 - RNA, 18 nt, Artificial Sequence
  Description of Artificial Sequence: Synthetic oligonucleotide
uucucuguuuucugacuc

SEQ ID NO: 72301 - RNA, 18 nt, Artificial Sequence
  Description of Artificial Sequence: Synthetic oligonucleotide
acccuuucucuguuuucu

SEQ ID NO: 72302 - RNA, 18 nt, Artificial Sequence
  Description of Artificial Sequence: Synthetic oligonucleotide
aaauuacccuuucucugu

SEQ ID NO: 72303 - RNA, 18 nt, Artificial Sequence
  Description of Artificial Sequence: Synthetic oligonucleotide
aaaggaaauuacccuuuc

SEQ ID NO: 72304 - RNA, 18 nt, Artificial Sequence
  Description of Artificial Sequence: Synthetic oligonucleotide
gaagcaaaggaaauuacc

SEQ ID NO: 72305 - RNA, 18 nt, Artificial Sequence
  Description of Artificial Sequence: Synthetic oligonucleotide
aauuugaagcaaaggaaa

SEQ ID NO: 72306 - RNA, 18 nt, Artificial Sequence
  Description of Artificial Sequence: Synthetic oligonucleotide
ccuugaauuugaagcaaa

SEQ ID NO: 72307 - RNA, 18 nt, Artificial Sequence
  Description of Artificial Sequence: Synthetic oligonucleotide
gaaggccuugaauuugaa

SEQ ID NO: 72308 - RNA, 18 nt, Artificial Sequence
  Description of Artificial Sequence: Synthetic oligonucleotide
cguuggaaggccuugaau

SEQ ID NO: 72309 - RNA, 18 nt, Artificial Sequence
  Description of Artificial Sequence: Synthetic oligonucleotide
gggcguuggaaggccuug

SEQ ID NO: 72310 - RNA, 18 nt, Artificial Sequence
  Description of Artificial Sequence: Synthetic oligonucleotide
gagaaugauaguaaaggg

SEQ ID NO: 72311 - RNA, 18 nt, Artificial Sequence
  Description of Artificial Sequence: Synthetic oligonucleotide
ccacugagaaugauagua

SEQ ID NO: 72312 - RNA, 18 nt, Artificial Sequence
  Description of Artificial Sequence: Synthetic oligonucleotide
gagucccacugagaauga

SEQ ID NO: 72313 - RNA, 18 nt, Artificial Sequence
  Description of Artificial Sequence: Synthetic oligonucleotide
gaucagagucccacugag

SEQ ID NO: 72314 - RNA, 18 nt, Artificial Sequence
  Description of Artificial Sequence: Synthetic oligonucleotide
uaugggaucagaguccca

SEQ ID NO: 72315 - RNA, 18 nt, Artificial Sequence
  Description of Artificial Sequence: Synthetic oligonucleotide
aagaauaugggaucagag

SEQ ID NO: 72316 - RNA, 18 nt, Artificial Sequence
  Description of Artificial Sequence: Synthetic oligonucleotide
cuguuaagaauaugggau

SEQ ID NO: 72317 - RNA, 18 nt, Artificial Sequence
  Description of Artificial Sequence: Synthetic oligonucleotide
aagaucuguuaagaauau

SEQ ID NO: 72318 - RNA, 18 nt, Artificial Sequence
  Description of Artificial Sequence: Synthetic oligonucleotide
gaguaaagaucuguuaag

SEQ ID NO: 72319 - RNA, 18 nt, Artificial Sequence
  Description of Artificial Sequence: Synthetic oligonucleotide
cucaagaguaaagaucug

SEQ ID NO: 72320 - RNA, 18 nt, Artificial Sequence
  Description of Artificial Sequence: Synthetic oligonucleotide
cauuucucaagaguaaag

SEQ ID NO: 72321 - RNA, 18 nt, Artificial Sequence
  Description of Artificial Sequence: Synthetic oligonucleotide
uuauucauuucucaagag

SEQ ID NO: 72322 - RNA, 18 nt, Artificial Sequence
  Description of Artificial Sequence: Synthetic oligonucleotide
aaagcuuauucauuucuc

SEQ ID NO: 72323 - RNA, 18 nt, Artificial Sequence
  Description of Artificial Sequence: Synthetic oligonucleotide
gagagaaagcuuauucau

SEQ ID NO: 72324 - RNA, 18 nt, Artificial Sequence
  Description of Artificial Sequence: Synthetic oligonucleotide
uuucugagagaaagcuua

SEQ ID NO: 72325 - RNA, 18 nt, Artificial Sequence
  Description of Artificial Sequence: Synthetic oligonucleotide
cagcauuucugagagaaa

SEQ ID NO: 72326 - RNA, 18 nt, Artificial Sequence
  Description of Artificial Sequence: Synthetic oligonucleotide
agggacagcauuucugag

SEQ ID NO: 72327 - RNA, 18 nt, Artificial Sequence
  Description of Artificial Sequence: Synthetic oligonucleotide
uguauagggacagcauuu

SEQ ID NO: 72328 - RNA, 18 nt, Artificial Sequence
  Description of Artificial Sequence: Synthetic oligonucleotide
ucuaguguauagggacag

SEQ ID NO: 72329 - RNA, 18 nt, Artificial Sequence
  Description of Artificial Sequence: Synthetic oligonucleotide
uuuugucuaguguauagg

SEQ ID NO: 72330 - RNA, 18 nt, Artificial Sequence
  Description of Artificial Sequence: Synthetic oligonucleotide
cucaguuuugucuagugu

SEQ ID NO: 72331 - RNA, 18 nt, Artificial Sequence
  Description of Artificial Sequence: Synthetic oligonucleotide
acaggcucaguuuugucu

SEQ ID NO: 72332 - RNA, 18 nt, Artificial Sequence
  Description of Artificial Sequence: Synthetic oligonucleotide
cuuauacaggcucaguuu

SEQ ID NO: 72333 - RNA, 18 nt, Artificial Sequence
  Description of Artificial Sequence: Synthetic oligonucleotide
uauuccuuauacaggcuc

SEQ ID NO: 72334 - RNA, 18 nt, Artificial Sequence
  Description of Artificial Sequence: Synthetic oligonucleotide
ccauuuauuccuuauaca

SEQ ID NO: 72335 - RNA, 18 nt, Artificial Sequence
  Description of Artificial Sequence: Synthetic oligonucleotide
cgcucccauuuauuccuu

SEQ ID NO: 72336 - RNA, 18 nt, Artificial Sequence
  Description of Artificial Sequence: Synthetic oligonucleotide
uucggcgcucccauuuau

SEQ ID NO: 72337 - RNA, 18 nt, Artificial Sequence
  Description of Artificial Sequence: Synthetic oligonucleotide
agcuuuucggcgcuccca

SEQ ID NO: 72338 - RNA, 18 nt, Artificial Sequence
  Description of Artificial Sequence: Synthetic oligonucleotide
uagggagcuuuucggcgc

SEQ ID NO: 72339 - RNA, 18 nt, Artificial Sequence
  Description of Artificial Sequence: Synthetic oligonucleotide
cuuuuuagggagcuuuuc

SEQ ID NO: 72340 - RNA, 18 nt, Artificial Sequence
  Description of Artificial Sequence: Synthetic oligonucleotide
acgccugccugggccacu

SEQ ID NO: 72341 - RNA, 18 nt, Artificial Sequence
  Description of Artificial Sequence: Synthetic oligonucleotide
gucauacgccugccuggg

SEQ ID NO: 72342 - RNA, 18 nt, Artificial Sequence
  Description of Artificial Sequence: Synthetic oligonucleotide
agcaggucauacgccugc

SEQ ID NO: 72343 - RNA, 18 nt, Artificial Sequence
  Description of Artificial Sequence: Synthetic oligonucleotide
acagcagcaggucauacg

SEQ ID NO: 72344 - RNA, 18 nt, Artificial Sequence
  Description of Artificial Sequence: Synthetic oligonucleotide
ccuccacagcagcagguc

SEQ ID NO: 72345 - RNA, 18 nt, Artificial Sequence
  Description of Artificial Sequence: Synthetic oligonucleotide
cagccccuccacagcagc

SEQ ID NO: 72346 - RNA, 18 nt, Artificial Sequence
  Description of Artificial Sequence: Synthetic oligonucleotide
gggcacagccccuccaca

SEQ ID NO: 72347 - RNA, 18 nt, Artificial Sequence
  Description of Artificial Sequence: Synthetic oligonucleotide
aagacauguggcgguggg

SEQ ID NO: 72348 - RNA, 18 nt, Artificial Sequence
  Description of Artificial Sequence: Synthetic oligonucleotide
aggaagacauguggcggu

SEQ ID NO: 72349 - RNA, 18 nt, Artificial Sequence
  Description of Artificial Sequence: Synthetic oligonucleotide
uggguaggaagacaugug

SEQ ID NO: 72350 - RNA, 18 nt, Artificial Sequence
  Description of Artificial Sequence: Synthetic oligonucleotide
gcagauggguaggaagac

SEQ ID NO: 72351 - RNA, 18 nt, Artificial Sequence
  Description of Artificial Sequence: Synthetic oligonucleotide
agcaggcagcccucuggg

SEQ ID NO: 72352 - RNA, 18 nt, Artificial Sequence
  Description of Artificial Sequence: Synthetic oligonucleotide
ugcacagcaggcagcccu

SEQ ID NO: 72353 - RNA, 18 nt, Artificial Sequence
  Description of Artificial Sequence: Synthetic oligonucleotide
ccaagugcacagcaggca

SEQ ID NO: 72354 - RNA, 18 nt, Artificial Sequence
  Description of Artificial Sequence: Synthetic oligonucleotide
aggacccaagugcacagc

SEQ ID NO: 72355 - RNA, 18 nt, Artificial Sequence
  Description of Artificial Sequence: Synthetic oligonucleotide
gcuccaggacccaagugc

SEQ ID NO: 72356 - RNA, 18 nt, Artificial Sequence
  Description of Artificial Sequence: Synthetic oligonucleotide
gaagggcuccaggaccca

SEQ ID NO: 72357 - RNA, 18 nt, Artificial Sequence
  Description of Artificial Sequence: Synthetic oligonucleotide
guggagaagggcuccagg

SEQ ID NO: 72358 - RNA, 18 nt, Artificial Sequence
  Description of Artificial Sequence: Synthetic oligonucleotide
cccacacccugcuggcca

SEQ ID NO: 72359 - RNA, 18 nt, Artificial Sequence
  Description of Artificial Sequence: Synthetic oligonucleotide
auaaccccacacccugcu

SEQ ID NO: 72360 - RNA, 18 nt, Artificial Sequence
  Description of Artificial Sequence: Synthetic oligonucleotide
cucacauaaccccacacc

SEQ ID NO: 72361 - RNA, 18 nt, Artificial Sequence
  Description of Artificial Sequence: Synthetic oligonucleotide
cuacccucacauaacccc

SEQ ID NO: 72362 - RNA, 18 nt, Artificial Sequence
  Description of Artificial Sequence: Synthetic oligonucleotide
ccuuucuacccucacaua

SEQ ID NO: 72363 - RNA, 18 nt, Artificial Sequence
  Description of Artificial Sequence: Synthetic oligonucleotide
gcuguccuuucuacccuc

SEQ ID NO: 72364 - RNA, 18 nt, Artificial Sequence
  Description of Artificial Sequence: Synthetic oligonucleotide
ucuuugcuguccuuucua

SEQ ID NO: 72365 - RNA, 18 nt, Artificial Sequence
  Description of Artificial Sequence: Synthetic oligonucleotide
auuucucuuugcuguccu

SEQ ID NO: 72366 - RNA, 18 nt, Artificial Sequence
  Description of Artificial Sequence: Synthetic oligonucleotide
agcccauuucucuuugcu

SEQ ID NO: 72367 - RNA, 18 nt, Artificial Sequence
  Description of Artificial Sequence: Synthetic oligonucleotide
cugggagcccauuucucu

SEQ ID NO: 72368 - RNA, 18 nt, Artificial Sequence
  Description of Artificial Sequence: Synthetic oligonucleotide
cccagcugggagcccauu

SEQ ID NO: 72369 - RNA, 18 nt, Artificial Sequence
  Description of Artificial Sequence: Synthetic oligonucleotide
ccucccccagcugggagc

SEQ ID NO: 72370 - RNA, 18 nt, Artificial Sequence
  Description of Artificial Sequence: Synthetic oligonucleotide
cugccccucccccagcug

SEQ ID NO: 72371 - RNA, 18 nt, Artificial Sequence
  Description of Artificial Sequence: Synthetic oligonucleotide
uuugccugccccuccccc

SEQ ID NO: 72372 - RNA, 18 nt, Artificial Sequence
  Description of Artificial Sequence: Synthetic oligonucleotide
uccaguuugccugccccu

SEQ ID NO: 72373 - RNA, 18 nt, Artificial Sequence
  Description of Artificial Sequence: Synthetic oligonucleotide
uagguuccaguuugccug

SEQ ID NO: 72374 - RNA, 18 nt, Artificial Sequence
  Description of Artificial Sequence: Synthetic oligonucleotide
gccuguagguuccaguuu

SEQ ID NO: 72375 - RNA, 18 nt, Artificial Sequence
  Description of Artificial Sequence: Synthetic oligonucleotide
ucagugccuguagguucc

SEQ ID NO: 72376 - RNA, 18 nt, Artificial Sequence
  Description of Artificial Sequence: Synthetic oligonucleotide
aaaggucagugccuguag

SEQ ID NO: 72377 - RNA, 18 nt, Artificial Sequence
  Description of Artificial Sequence: Synthetic oligonucleotide
ucgacaaaggucagugcc

SEQ ID NO: 72378 - RNA, 18 nt, Artificial Sequence
  Description of Artificial Sequence: Synthetic oligonucleotide
ucuucucgacaaagguca

SEQ ID NO: 72379 - RNA, 18 nt, Artificial Sequence
  Description of Artificial Sequence: Synthetic oligonucleotide
uacacucuucucgacaaa

SEQ ID NO: 72380 - RNA, 18 nt, Artificial Sequence
  Description of Artificial Sequence: Synthetic oligonucleotide
aaggcuacacucuucucg

SEQ ID NO: 72381 - RNA, 18 nt, Artificial Sequence
  Description of Artificial Sequence: Synthetic oligonucleotide
cugggaaggcuacacucu

SEQ ID NO: 72382 - RNA, 18 nt, Artificial Sequence
  Description of Artificial Sequence: Synthetic oligonucleotide
ccauucugggaaggcuac

SEQ ID NO: 72383 - RNA, 18 nt, Artificial Sequence
  Description of Artificial Sequence: Synthetic oligonucleotide
uccucccauucugggaag

SEQ ID NO: 72384 - RNA, 18 nt, Artificial Sequence
  Description of Artificial Sequence: Synthetic oligonucleotide
ccugcuccucccauucug

SEQ ID NO: 72385 - RNA, 18 nt, Artificial Sequence
  Description of Artificial Sequence: Synthetic oligonucleotide
ucugcccugcuccuccca

SEQ ID NO: 72386 - RNA, 18 nt, Artificial Sequence
  Description of Artificial Sequence: Synthetic oligonucleotide
ccugcucugcccugcucc

SEQ ID NO: 72387 - RNA, 18 nt, Artificial Sequence
  Description of Artificial Sequence: Synthetic oligonucleotide
cuaccccugcucugcccu

SEQ ID NO: 72388 - RNA, 18 nt, Artificial Sequence
  Description of Artificial Sequence: Synthetic oligonucleotide
acccccuaccccugcucu

SEQ ID NO: 72389 - RNA, 18 nt, Artificial Sequence
  Description of Artificial Sequence: Synthetic oligonucleotide
accccacccccuaccccu

SEQ ID NO: 72390 - RNA, 18 nt, Artificial Sequence
  Description of Artificial Sequence: Synthetic oligonucleotide
ccagcaccccacccccua

SEQ ID NO: 72391 - RNA, 18 nt, Artificial Sequence
  Description of Artificial Sequence: Synthetic oligonucleotide
agaaaccagcaccccacc

SEQ ID NO: 72392 - RNA, 18 nt, Artificial Sequence
  Description of Artificial Sequence: Synthetic oligonucleotide
cccucagaaaccagcacc

SEQ ID NO: 72393 - RNA, 18 nt, Artificial Sequence
  Description of Artificial Sequence: Synthetic oligonucleotide
ucagucccucagaaacca

SEQ ID NO: 72394 - RNA, 18 nt, Artificial Sequence
  Description of Artificial Sequence: Synthetic oligonucleotide
agugaucagucccucaga

SEQ ID NO: 72395 - RNA, 18 nt, Artificial Sequence
  Description of Artificial Sequence: Synthetic oligonucleotide
aaguaagugaucaguccc

SEQ ID NO: 72396 - RNA, 18 nt, Artificial Sequence
  Description of Artificial Sequence: Synthetic oligonucleotide
ccaccaaguaagugauca

SEQ ID NO: 72397 - RNA, 18 nt, Artificial Sequence
  Description of Artificial Sequence: Synthetic oligonucleotide
guauuccaccaaguaagu

SEQ ID NO: 72398 - RNA, 18 nt, Artificial Sequence
  Description of Artificial Sequence: Synthetic oligonucleotide
gugcuguauuccaccaag

SEQ ID NO: 72399 - RNA, 18 nt, Artificial Sequence
  Description of Artificial Sequence: Synthetic oligonucleotide
gggcugugcuguauucca

SEQ ID NO: 72400 - RNA, 18 nt, Artificial Sequence
  Description of Artificial Sequence: Synthetic oligonucleotide
agccagggcugugcugua

SEQ ID NO: 72401 - RNA, 18 nt, Artificial Sequence
  Description of Artificial Sequence: Synthetic oligonucleotide
gggccagccagggcugug

SEQ ID NO: 72402 - RNA, 18 nt, Artificial Sequence
  Description of Artificial Sequence: Synthetic oligonucleotide
ccuuagggccagccaggg

SEQ ID NO: 72403 - RNA, 18 nt, Artificial Sequence
  Description of Artificial Sequence: Synthetic oligonucleotide
ccuuuccuuagggccagc

SEQ ID NO: 72404 - RNA, 18 nt, Artificial Sequence
  Description of Artificial Sequence: Synthetic oligonucleotide
uguccccuuuccuuaggg

SEQ ID NO: 72405 - RNA, 18 nt, Artificial Sequence
  Description of Artificial Sequence: Synthetic oligonucleotide
gcucauguccccuuuccu

SEQ ID NO: 72406 - RNA, 18 nt, Artificial Sequence
  Description of Artificial Sequence: Synthetic oligonucleotide
ccugggcucauguccccu

SEQ ID NO: 72407 - RNA, 18 nt, Artificial Sequence
  Description of Artificial Sequence: Synthetic oligonucleotide
uucucccugggcucaugu

SEQ ID NO: 72408 - RNA, 18 nt, Artificial Sequence
  Description of Artificial Sequence: Synthetic oligonucleotide
uuauuuucucccugggcu

SEQ ID NO: 72409 - RNA, 18 nt, Artificial Sequence
  Description of Artificial Sequence: Synthetic oligonucleotide
cucucuuauuuucucccu

SEQ ID NO: 72410 - RNA, 18 nt, Artificial Sequence
  Description of Artificial Sequence: Synthetic oligonucleotide
gcucccucucuuauuuuc

SEQ ID NO: 72411 - RNA, 18 nt, Artificial Sequence
  Description of Artificial Sequence: Synthetic oligonucleotide
gugcagcucccucucuua

SEQ ID NO: 72412 - RNA, 18 nt, Artificial Sequence
  Description of Artificial Sequence: Synthetic oligonucleotide
ccuaagugcagcucccuc

SEQ ID NO: 72413 - RNA, 18 nt, Artificial Sequence
  Description of Artificial Sequence: Synthetic oligonucleotide
uaagcccuaagugcagcu

SEQ ID NO: 72414 - RNA, 18 nt, Artificial Sequence
  Description of Artificial Sequence: Synthetic oligonucleotide
uuugcuaagcccuaagug

SEQ ID NO: 72415 - RNA, 18 nt, Artificial Sequence
  Description of Artificial Sequence: Synthetic oligonucleotide
cuguguuugcuaagcccu

SEQ ID NO: 72416 - RNA, 18 nt, Artificial Sequence
  Description of Artificial Sequence: Synthetic oligonucleotide
uacuacuguguuugcuaa

SEQ ID NO: 72417 - RNA, 18 nt, Artificial Sequence
  Description of Artificial Sequence: Synthetic oligonucleotide
caucuuacuacuguguuu

SEQ ID NO: 72418 - RNA, 18 nt, Artificial Sequence
  Description of Artificial Sequence: Synthetic oligonucleotide
guguccaucuuacuacug

SEQ ID NO: 72419 - RNA, 18 nt, Artificial Sequence
  Description of Artificial Sequence: Synthetic oligonucleotide
gggcuguguccaucuuac

SEQ ID NO: 72420 - RNA, 18 nt, Artificial Sequence
  Description of Artificial Sequence: Synthetic oligonucleotide
aaugaccagcuaagaaug

SEQ ID NO: 72421 - RNA, 18 nt, Artificial Sequence
  Description of Artificial Sequence: Synthetic oligonucleotide
cgaggaaugaccagcuaa

SEQ ID NO: 72422 - RNA, 18 nt, Artificial Sequence
  Description of Artificial Sequence: Synthetic oligonucleotide
gcuaacgaggaaugacca

SEQ ID NO: 72423 - RNA, 18 nt, Artificial Sequence
  Description of Artificial Sequence: Synthetic oligonucleotide
cuuaagcuaacgaggaau

SEQ ID NO: 72424 - RNA, 18 nt, Artificial Sequence
  Description of Artificial Sequence: Synthetic oligonucleotide
agaaccuuaagcuaacga

SEQ ID NO: 72425 - RNA, 18 nt, Artificial Sequence
  Description of Artificial Sequence: Synthetic oligonucleotide
gauucagaaccuuaagcu

SEQ ID NO: 72426 - RNA, 18 nt, Artificial Sequence
  Description of Artificial Sequence: Synthetic oligonucleotide
caccagauucagaaccuu

SEQ ID NO: 72427 - RNA, 18 nt, Artificial Sequence
  Description of Artificial Sequence: Synthetic oligonucleotide
cccagcaccagauucaga

SEQ ID NO: 72428 - RNA, 18 nt, Artificial Sequence
  Description of Artificial Sequence: Synthetic oligonucleotide
gcuuccccagcaccagau

SEQ ID NO: 72429 - RNA, 18 nt, Artificial Sequence
  Description of Artificial Sequence: Synthetic oligonucleotide
gcccagcuuccccagcac

SEQ ID NO: 72430 - RNA, 18 nt, Artificial Sequence
  Description of Artificial Sequence: Synthetic oligonucleotide
gccuggcccagcuucccc

SEQ ID NO: 72431 - RNA, 18 nt, Artificial Sequence
  Description of Artificial Sequence: Synthetic oligonucleotide
ggcuugccuggcccagcu

SEQ ID NO: 72432 - RNA, 18 nt, Artificial Sequence
  Description of Artificial Sequence: Synthetic oligonucleotide
gcccuggcuugccuggcc

SEQ ID NO: 72433 - RNA, 18 nt, Artificial Sequence
  Description of Artificial Sequence: Synthetic oligonucleotide
cuugcgcccuggcuugcc

SEQ ID NO: 72434 - RNA, 18 nt, Artificial Sequence
  Description of Artificial Sequence: Synthetic oligonucleotide
cucuccuugcgcccuggc

SEQ ID NO: 72435 - RNA, 18 nt, Artificial Sequence
  Description of Artificial Sequence: Synthetic oligonucleotide
uuacccucuccuugcgcc

SEQ ID NO: 72436 - RNA, 18 nt, Artificial Sequence
  Description of Artificial Sequence: Synthetic oligonucleotide
ucccauuacccucuccuu

SEQ ID NO: 72437 - RNA, 18 nt, Artificial Sequence
  Description of Artificial Sequence: Synthetic oligonucleotide
ccuccucccauuacccuc

SEQ ID NO: 72438 - RNA, 18 nt, Artificial Sequence
  Description of Artificial Sequence: Synthetic oligonucleotide
ugggcccuccucccauua

SEQ ID NO: 72439 - RNA, 18 nt, Artificial Sequence
  Description of Artificial Sequence: Synthetic oligonucleotide
augagugggcccuccucc

SEQ ID NO: 72440 - RNA, 18 nt, Artificial Sequence
  Description of Artificial Sequence: Synthetic oligonucleotide
ucaacaugagugggcccu

SEQ ID NO: 72441 - RNA, 18 nt, Artificial Sequence
  Description of Artificial Sequence: Synthetic oligonucleotide
gucugucaacaugagugg

SEQ ID NO: 72442 - RNA, 18 nt, Artificial Sequence
  Description of Artificial Sequence: Synthetic oligonucleotide
uguaggucugucaacaug

SEQ ID NO: 72443 - RNA, 18 nt, Artificial Sequence
  Description of Artificial Sequence: Synthetic oligonucleotide
uuuccuguaggucuguca

SEQ ID NO: 72444 - RNA, 18 nt, Artificial Sequence
  Description of Artificial Sequence: Synthetic oligonucleotide
ugggauuuccuguagguc

SEQ ID NO: 72445 - RNA, 18 nt, Artificial Sequence
  Description of Artificial Sequence: Synthetic oligonucleotide
aauauugggauuuccugu

SEQ ID NO: 72446 - RNA, 18 nt, Artificial Sequence
  Description of Artificial Sequence: Synthetic oligonucleotide
gauucaauauugggauuu

SEQ ID NO: 72447 - RNA, 18 nt, Artificial Sequence
  Description of Artificial Sequence: Synthetic oligonucleotide
caccugauucaauauugg

SEQ ID NO: 72448 - RNA, 18 nt, Artificial Sequence
  Description of Artificial Sequence: Synthetic oligonucleotide
gcuugcaccugauucaau

SEQ ID NO: 72449 - RNA, 18 nt, Artificial Sequence
  Description of Artificial Sequence: Synthetic oligonucleotide
aagaggcuugcaccugau

SEQ ID NO: 72450 - RNA, 18 nt, Artificial Sequence
  Description of Artificial Sequence: Synthetic oligonucleotide
gugcaaagaggcuugcac

SEQ ID NO: 72451 - RNA, 18 nt, Artificial Sequence
  Description of Artificial Sequence: Synthetic oligonucleotide
aaguugugcaaagaggcu

SEQ ID NO: 72452 - RNA, 18 nt, Artificial Sequence
  Description of Artificial Sequence: Synthetic oligonucleotide
uucacaaguugugcaaag

SEQ ID NO: 72453 - RNA, 18 nt, Artificial Sequence
  Description of Artificial Sequence: Synthetic oligonucleotide
ucuccuuuuugucaggac

SEQ ID NO: 72454 - RNA, 18 nt, Artificial Sequence
  Description of Artificial Sequence: Synthetic oligonucleotide
uggugucuccuuuuuguc

SEQ ID NO: 72455 - RNA, 18 nt, Artificial Sequence
  Description of Artificial Sequence: Synthetic oligonucleotide
gcauauggugucuccuuu

SEQ ID NO: 72456 - RNA, 18 nt, Artificial Sequence
  Description of Artificial Sequence: Synthetic oligonucleotide
agaaagcauauggugucu

SEQ ID NO: 72457 - RNA, 18 nt, Artificial Sequence
  Description of Artificial Sequence: Synthetic oligonucleotide
aagcaagaaagcauaugg

SEQ ID NO: 72458 - RNA, 18 nt, Artificial Sequence
  Description of Artificial Sequence: Synthetic oligonucleotide
aaagaaagcaagaaagca

SEQ ID NO: 72459 - RNA, 18 nt, Artificial Sequence
  Description of Artificial Sequence: Synthetic oligonucleotide
gaaagaaagaaagcaaga

SEQ ID NO: 72460 - RNA, 18 nt, Artificial Sequence
  Description of Artificial Sequence: Synthetic oligonucleotide
agaaagaaagaaagaaag

SEQ ID NO: 72461 - RNA, 18 nt, Artificial Sequence
  Description of Artificial Sequence: Synthetic oligonucleotide
aagaaagaaagaaagaaa

SEQ ID NO: 72462 - RNA, 18 nt, Artificial Sequence
  Description of Artificial Sequence: Synthetic oligonucleotide
aaagaaagaaagaaagaa

SEQ ID NO: 72463 - RNA, 18 nt, Artificial Sequence
  Description of Artificial Sequence: Synthetic oligonucleotide
aaaaaaaagaaagaaaga

SEQ ID NO: 72464 - RNA, 18 nt, Artificial Sequence
  Description of Artificial Sequence: Synthetic oligonucleotide
caaaaaaaaaaaagaaag

SEQ ID NO: 72465 - RNA, 18 nt, Artificial Sequence
  Description of Artificial Sequence: Synthetic oligonucleotide
cgucucaaaaaaaaaaaa

SEQ ID NO: 72466 - RNA, 18 nt, Artificial Sequence
  Description of Artificial Sequence: Synthetic oligonucleotide
aacuccgucucaaaaaaa

SEQ ID NO: 72467 - RNA, 18 nt, Artificial Sequence
  Description of Artificial Sequence: Synthetic oligonucleotide
agugaaacuccgucucaa

SEQ ID NO: 72468 - RNA, 18 nt, Artificial Sequence
  Description of Artificial Sequence: Synthetic oligonucleotide
auaagagugaaacuccgu

SEQ ID NO: 72469 - RNA, 18 nt, Artificial Sequence
  Description of Artificial Sequence: Synthetic oligonucleotide
gggcaauaagagugaaac

SEQ ID NO: 72470 - RNA, 18 nt, Artificial Sequence
  Description of Artificial Sequence: Synthetic oligonucleotide
agccugggcaauaagagu

SEQ ID NO: 72471 - RNA, 18 nt, Artificial Sequence
  Description of Artificial Sequence: Synthetic oligonucleotide
acuccagccugggcaaua

SEQ ID NO: 72472 - RNA, 18 nt, Artificial Sequence
  Description of Artificial Sequence: Synthetic oligonucleotide
auugcacuccagccuggg

SEQ ID NO: 72473 - RNA, 18 nt, Artificial Sequence
  Description of Artificial Sequence: Synthetic oligonucleotide
gcaccauugcacuccagc

SEQ ID NO: 72474 - RNA, 18 nt, Artificial Sequence
  Description of Artificial Sequence: Synthetic oligonucleotide
agaucgcaccauugcacu

SEQ ID NO: 72475 - RNA, 18 nt, Artificial Sequence
  Description of Artificial Sequence: Synthetic oligonucleotide
agccgagaucgcaccauu

SEQ ID NO: 72476 - RNA, 18 nt, Artificial Sequence
  Description of Artificial Sequence: Synthetic oligonucleotide
uggugagccgagaucgca

SEQ ID NO: 72477 - RNA, 18 nt, Artificial Sequence
  Description of Artificial Sequence: Synthetic oligonucleotide
gguuguggugagccgaga

SEQ ID NO: 72478 - RNA, 18 nt, Artificial Sequence
  Description of Artificial Sequence: Synthetic oligonucleotide
gcggagguuguggugagc

SEQ ID NO: 72479 - RNA, 18 nt, Artificial Sequence
  Description of Artificial Sequence: Synthetic oligonucleotide
gggaggcggagguugugg

SEQ ID NO: 72480 - RNA, 18 nt, Artificial Sequence
  Description of Artificial Sequence: Synthetic oligonucleotide
uaccugggaggcggaggu

SEQ ID NO: 72481 - RNA, 18 nt, Artificial Sequence
  Description of Artificial Sequence: Synthetic oligonucleotide
gcuuguaccugggaggcg

SEQ ID NO: 72482 - RNA, 18 nt, Artificial Sequence
  Description of Artificial Sequence: Synthetic oligonucleotide
gaaucgcuuguaccuggg

SEQ ID NO: 72483 - RNA, 18 nt, Artificial Sequence
  Description of Artificial Sequence: Synthetic oligonucleotide
caggagaaucgcuuguac

SEQ ID NO: 72484 - RNA, 18 nt, Artificial Sequence
  Description of Artificial Sequence: Synthetic oligonucleotide
ugagacaggagaaucgcu

SEQ ID NO: 72485 - RNA, 18 nt, Artificial Sequence
  Description of Artificial Sequence: Synthetic oligonucleotide
gaggcugagacaggagaa

SEQ ID NO: 72486 - RNA, 18 nt, Artificial Sequence
  Description of Artificial Sequence: Synthetic oligonucleotide
cuugggaggcugagacag

SEQ ID NO: 72487 - RNA, 18 nt, Artificial Sequence
  Description of Artificial Sequence: Synthetic oligonucleotide
agcuacuugggaggcuga

SEQ ID NO: 72488 - RNA, 18 nt, Artificial Sequence
  Description of Artificial Sequence: Synthetic oligonucleotide
auccaagcuacuugggag

SEQ ID NO: 72489 - RNA, 18 nt, Artificial Sequence
  Description of Artificial Sequence: Synthetic oligonucleotide
cuguaauccaagcuacuu

SEQ ID NO: 72490 - RNA, 18 nt, Artificial Sequence
  Description of Artificial Sequence: Synthetic oligonucleotide
caugccuguaauccaagc

SEQ ID NO: 72491 - RNA, 18 nt, Artificial Sequence
  Description of Artificial Sequence: Synthetic oligonucleotide
ugguucaugccuguaauc

SEQ ID NO: 72492 - RNA, 18 nt, Artificial Sequence
  Description of Artificial Sequence: Synthetic oligonucleotide
uguggugguucaugccug

SEQ ID NO: 72493 - RNA, 18 nt, Artificial Sequence
  Description of Artificial Sequence: Synthetic oligonucleotide
caggguguggugguucau

SEQ ID NO: 72494 - RNA, 18 nt, Artificial Sequence
  Description of Artificial Sequence: Synthetic oligonucleotide
acuagcaggguguggugg

SEQ ID NO: 72495 - RNA, 18 nt, Artificial Sequence
  Description of Artificial Sequence: Synthetic oligonucleotide
aaaaaacuagcagggugu

SEQ ID NO: 72496 - RNA, 18 nt, Artificial Sequence
  Description of Artificial Sequence: Synthetic oligonucleotide
auacaaaaaaacuagcag

SEQ ID NO: 72497 - RNA, 18 nt, Artificial Sequence
  Description of Artificial Sequence: Synthetic oligonucleotide
acgaaauacaaaaaaacu

SEQ ID NO: 72498 - RNA, 18 nt, Artificial Sequence
  Description of Artificial Sequence: Synthetic oligonucleotide
gcucuacgaaauacaaaa

SEQ ID NO: 72499 - RNA, 18 nt, Artificial Sequence
  Description of Artificial Sequence: Synthetic oligonucleotide
ccccggcucuacgaaaua

SEQ ID NO: 72500 - RNA, 18 nt, Artificial Sequence
  Description of Artificial Sequence: Synthetic oligonucleotide
ugaaaccccggcucuacg

SEQ ID NO: 72501 - RNA, 18 nt, Artificial Sequence
  Description of Artificial Sequence: Synthetic oligonucleotide
cauggugaaaccccggcu

SEQ ID NO: 72502 - RNA, 18 nt, Artificial Sequence
  Description of Artificial Sequence: Synthetic oligonucleotide
acuaacauggugaaaccc

SEQ ID NO: 72503 - RNA, 18 nt, Artificial Sequence
  Description of Artificial Sequence: Synthetic oligonucleotide
gccucacuaacaugguga

SEQ ID NO: 72504 - RNA, 18 nt, Artificial Sequence
  Description of Artificial Sequence: Synthetic oligonucleotide
caccagccucacuaacau

SEQ ID NO: 72505 - RNA, 18 nt, Artificial Sequence
  Description of Artificial Sequence: Synthetic oligonucleotide
uucgccaccagccucacu

SEQ ID NO: 72506 - RNA, 18 nt, Artificial Sequence
  Description of Artificial Sequence: Synthetic oligonucleotide
aggaguucgccaccagcc

SEQ ID NO: 72507 - RNA, 18 nt, Artificial Sequence
  Description of Artificial Sequence: Synthetic oligonucleotide
aggucaggaguucgccac

SEQ ID NO: 72508 - RNA, 18 nt, Artificial Sequence
  Description of Artificial Sequence: Synthetic oligonucleotide
accugaggucaggaguuc

SEQ ID NO: 72509 - RNA, 18 nt, Artificial Sequence
  Description of Artificial Sequence: Synthetic oligonucleotide
ggaucaccugaggucagg

SEQ ID NO: 72510 - RNA, 18 nt, Artificial Sequence
  Description of Artificial Sequence: Synthetic oligonucleotide
cggguggaucaccugagg

SEQ ID NO: 72511 - RNA, 18 nt, Artificial Sequence
  Description of Artificial Sequence: Synthetic oligonucleotide
caaggcggguggaucacc

SEQ ID NO: 72512 - RNA, 18 nt, Artificial Sequence
  Description of Artificial Sequence: Synthetic oligonucleotide
gaguccaaggcgggugga

SEQ ID NO: 72513 - RNA, 18 nt, Artificial Sequence
  Description of Artificial Sequence: Synthetic oligonucleotide
uuugggaguccaaggcgg

SEQ ID NO: 72514 - RNA, 18 nt, Artificial Sequence
  Description of Artificial Sequence: Synthetic oligonucleotide
agcacuuugggaguccaa

SEQ ID NO: 72515 - RNA, 18 nt, Artificial Sequence
  Description of Artificial Sequence: Synthetic oligonucleotide
aucccagcacuuugggag

SEQ ID NO: 72516 - RNA, 18 nt, Artificial Sequence
  Description of Artificial Sequence: Synthetic oligonucleotide
cuguaaucccagcacuuu

SEQ ID NO: 72517 - RNA, 18 nt, Artificial Sequence
  Description of Artificial Sequence: Synthetic oligonucleotide
caugccuguaaucccagc

SEQ ID NO: 72518 - RNA, 18 nt, Artificial Sequence
  Description of Artificial Sequence: Synthetic oligonucleotide
uggcucaugccuguaauc

SEQ ID NO: 72519 - RNA, 18 nt, Artificial Sequence
  Description of Artificial Sequence: Synthetic oligonucleotide
ugcaguggcucaugccug

SEQ ID NO: 72520 - RNA, 18 nt, Artificial Sequence
  Description of Artificial Sequence: Synthetic oligonucleotide
ccgggugcaguggcucau

SEQ ID NO: 72521 - RNA, 18 nt, Artificial Sequence
  Description of Artificial Sequence: Synthetic oligonucleotide
gugugccgggugcagugg

SEQ ID NO: 72522 - RNA, 18 nt, Artificial Sequence
  Description of Artificial Sequence: Synthetic oligonucleotide
auauggugugccgggugc

SEQ ID NO: 72523 - RNA, 18 nt, Artificial Sequence
  Description of Artificial Sequence: Synthetic oligonucleotide
aaagcauauggugugccg

SEQ ID NO: 72524 - RNA, 18 nt, Artificial Sequence
  Description of Artificial Sequence: Synthetic oligonucleotide
ugaugaaagcauauggug

SEQ ID NO: 72525 - RNA, 18 nt, Artificial Sequence
  Description of Artificial Sequence: Synthetic oligonucleotide
ucuugugaugaaagcaua

SEQ ID NO: 72526 - RNA, 18 nt, Artificial Sequence
  Description of Artificial Sequence: Synthetic oligonucleotide
cauuuucuugugaugaaa

SEQ ID NO: 72527 - RNA, 18 nt, Artificial Sequence
  Description of Artificial Sequence: Synthetic oligonucleotide
ucucacauuuucuuguga

SEQ ID NO: 72528 - RNA, 18 nt, Artificial Sequence
  Description of Artificial Sequence: Synthetic oligonucleotide
aauucucucacauuuucu

SEQ ID NO: 72529 - RNA, 18 nt, Artificial Sequence
  Description of Artificial Sequence: Synthetic oligonucleotide
cccugaauucucucacau

SEQ ID NO: 72530 - RNA, 18 nt, Artificial Sequence
  Description of Artificial Sequence: Synthetic oligonucleotide
caaagcccugaauucucu

SEQ ID NO: 72531 - RNA, 18 nt, Artificial Sequence
  Description of Artificial Sequence: Synthetic oligonucleotide
acugccaaagcccugaau

SEQ ID NO: 72532 - RNA, 18 nt, Artificial Sequence
  Description of Artificial Sequence: Synthetic oligonucleotide
cuggaacugccaaagccc

SEQ ID NO: 72533 - RNA, 18 nt, Artificial Sequence
  Description of Artificial Sequence: Synthetic oligonucleotide
ccagccuggaacugccaa

SEQ ID NO: 72534 - RNA, 18 nt, Artificial Sequence
  Description of Artificial Sequence: Synthetic oligonucleotide
gcugaccagccuggaacu

SEQ ID NO: 72535 - RNA, 18 nt, Artificial Sequence
  Description of Artificial Sequence: Synthetic oligonucleotide
gagaugcugaccagccug

SEQ ID NO: 72536 - RNA, 18 nt, Artificial Sequence
  Description of Artificial Sequence: Synthetic oligonucleotide
ggcuugagaugcugacca

SEQ ID NO: 72537 - RNA, 18 nt, Artificial Sequence
  Description of Artificial Sequence: Synthetic oligonucleotide
gggagggcuugagaugcu

SEQ ID NO: 72538 - RNA, 18 nt, Artificial Sequence
  Description of Artificial Sequence: Synthetic oligonucleotide
gggugaacagaugcuggg

SEQ ID NO: 72539 - RNA, 18 nt, Artificial Sequence
  Description of Artificial Sequence: Synthetic oligonucleotide
ggcagggugaacagaugc

SEQ ID NO: 72540 - RNA, 18 nt, Artificial Sequence
  Description of Artificial Sequence: Synthetic oligonucleotide
ugccuggcagggugaaca

SEQ ID NO: 72541 - RNA, 18 nt, Artificial Sequence
  Description of Artificial Sequence: Synthetic oligonucleotide
gagacugccuggcagggu

SEQ ID NO: 72542 - RNA, 18 nt, Artificial Sequence
  Description of Artificial Sequence: Synthetic oligonucleotide
aggaagagacugccuggc

SEQ ID NO: 72543 - RNA, 18 nt, Artificial Sequence
  Description of Artificial Sequence: Synthetic oligonucleotide
uuucuaggaagagacugc

SEQ ID NO: 72544 - RNA, 18 nt, Artificial Sequence
  Description of Artificial Sequence: Synthetic oligonucleotide
ccaaguuucuaggaagag

SEQ ID NO: 72545 - RNA, 18 nt, Artificial Sequence
  Description of Artificial Sequence: Synthetic oligonucleotide
uuuaaccaaguuucuagg

SEQ ID NO: 72546 - RNA, 18 nt, Artificial Sequence
  Description of Artificial Sequence: Synthetic oligonucleotide
gaacauuuaaccaaguuu

SEQ ID NO: 72547 - RNA, 18 nt, Artificial Sequence
  Description of Artificial Sequence: Synthetic oligonucleotide
agagugaacauuuaacca

SEQ ID NO: 72548 - RNA, 18 nt, Artificial Sequence
  Description of Artificial Sequence: Synthetic oligonucleotide
caagggugaagaaucuau

SEQ ID NO: 72549 - RNA, 18 nt, Artificial Sequence
  Description of Artificial Sequence: Synthetic oligonucleotide
cgggccaagggugaagaa

SEQ ID NO: 72550 - RNA, 18 nt, Artificial Sequence
  Description of Artificial Sequence: Synthetic oligonucleotide
aaaggcgggccaagggug

SEQ ID NO: 72551 - RNA, 18 nt, Artificial Sequence
  Description of Artificial Sequence: Synthetic oligonucleotide
gggcaaaggcgggccaag

SEQ ID NO: 72552 - RNA, 18 nt, Artificial Sequence
  Description of Artificial Sequence: Synthetic oligonucleotide
ugggcagaguaggguggg

SEQ ID NO: 72553 - RNA, 18 nt, Artificial Sequence
  Description of Artificial Sequence: Synthetic oligonucleotide
acuucugggcagaguagg

SEQ ID NO: 72554 - RNA, 18 nt, Artificial Sequence
  Description of Artificial Sequence: Synthetic oligonucleotide
cuugcacuucugggcaga

SEQ ID NO: 72555 - RNA, 18 nt, Artificial Sequence
  Description of Artificial Sequence: Synthetic oligonucleotide
aggcucuugcacuucugg

SEQ ID NO: 72556 - RNA, 18 nt, Artificial Sequence
  Description of Artificial Sequence: Synthetic oligonucleotide
ggcuuaggcucuugcacu

SEQ ID NO: 72557 - RNA, 18 nt, Artificial Sequence
  Description of Artificial Sequence: Synthetic oligonucleotide
gaggcggcuuaggcucuu

SEQ ID NO: 72558 - RNA, 18 nt, Artificial Sequence
  Description of Artificial Sequence: Synthetic oligonucleotide
ccauggaggcggcuuagg

SEQ ID NO: 72559 - RNA, 18 nt, Artificial Sequence
  Description of Artificial Sequence: Synthetic oligonucleotide
gggccauggaggcggcuu

SEQ ID NO: 72560 - RNA, 18 nt, Artificial Sequence
  Description of Artificial Sequence: Synthetic oligonucleotide
cccugaauccuuccuggg

SEQ ID NO: 72561 - RNA, 18 nt, Artificial Sequence
  Description of Artificial Sequence: Synthetic oligonucleotide
cucuccccugaauccuuc

SEQ ID NO: 72562 - RNA, 18 nt, Artificial Sequence
  Description of Artificial Sequence: Synthetic oligonucleotide
gggccucuccccugaauc

SEQ ID NO: 72563 - RNA, 18 nt, Artificial Sequence
  Description of Artificial Sequence: Synthetic oligonucleotide
cguggcucccuguuuggg

SEQ ID NO: 72564 - RNA, 18 nt, Artificial Sequence
  Description of Artificial Sequence: Synthetic oligonucleotide
gcuggcguggcucccugu

SEQ ID NO: 72565 - RNA, 18 nt, Artificial Sequence
  Description of Artificial Sequence: Synthetic oligonucleotide
gucuggcuggcguggcuc

SEQ ID NO: 72566 - RNA, 18 nt, Artificial Sequence
  Description of Artificial Sequence: Synthetic oligonucleotide
gggugucuggcuggcgug

SEQ ID NO: 72567 - RNA, 18 nt, Artificial Sequence
  Description of Artificial Sequence: Synthetic oligonucleotide
agcuccauucuggccggg

SEQ ID NO: 72568 - RNA, 18 nt, Artificial Sequence
  Description of Artificial Sequence: Synthetic oligonucleotide
cagucagcuccauucugg

SEQ ID NO: 72569 - RNA, 18 nt, Artificial Sequence
  Description of Artificial Sequence: Synthetic oligonucleotide
aagggugaagaaucuauc

SEQ ID NO: 72570 - RNA, 18 nt, Artificial Sequence
  Description of Artificial Sequence: Synthetic oligonucleotide
gggccaagggugaagaau

SEQ ID NO: 72571 - RNA, 18 nt, Artificial Sequence
  Description of Artificial Sequence: Synthetic oligonucleotide
aaggcgggccaaggguga

SEQ ID NO: 72572 - RNA, 18 nt, Artificial Sequence
  Description of Artificial Sequence: Synthetic oligonucleotide
gggcaaaggcgggccaag

SEQ ID NO: 72573 - RNA, 18 nt, Artificial Sequence
  Description of Artificial Sequence: Synthetic oligonucleotide
ugggcagaguaggguggg

SEQ ID NO: 72574 - RNA, 18 nt, Artificial Sequence
  Description of Artificial Sequence: Synthetic oligonucleotide
uucugggcagaguagggu

SEQ ID NO: 72575 - RNA, 18 nt, Artificial Sequence
  Description of Artificial Sequence: Synthetic oligonucleotide
ugcacuucugggcagagu

SEQ ID NO: 72576 - RNA, 18 nt, Artificial Sequence
  Description of Artificial Sequence: Synthetic oligonucleotide
gcucuugcacuucugggc

SEQ ID NO: 72577 - RNA, 18 nt, Artificial Sequence
  Description of Artificial Sequence: Synthetic oligonucleotide
cuuaggcucuugcacuuc

SEQ ID NO: 72578 - RNA, 18 nt, Artificial Sequence
  Description of Artificial Sequence: Synthetic oligonucleotide
ggcggcuuaggcucuugc

SEQ ID NO: 72579 - RNA, 18 nt, Artificial Sequence
  Description of Artificial Sequence: Synthetic oligonucleotide
auggaggcggcuuaggcu

SEQ ID NO: 72580 - RNA, 18 nt, Artificial Sequence
  Description of Artificial Sequence: Synthetic oligonucleotide
gggccauggaggcggcuu

SEQ ID NO: 72581 - RNA, 18 nt, Artificial Sequence
  Description of Artificial Sequence: Synthetic oligonucleotide
cccugaauccuuccuggg

SEQ ID NO: 72582 - RNA, 18 nt, Artificial Sequence
  Description of Artificial Sequence: Synthetic oligonucleotide
ucuccccugaauccuucc

SEQ ID NO: 72583 - RNA, 18 nt, Artificial Sequence
  Description of Artificial Sequence: Synthetic oligonucleotide
gggccucuccccugaauc

SEQ ID NO: 72584 - RNA, 18 nt, Artificial Sequence
  Description of Artificial Sequence: Synthetic oligonucleotide
cguggcucccuguuuggg

SEQ ID NO: 72585 - RNA, 18 nt, Artificial Sequence
  Description of Artificial Sequence: Synthetic oligonucleotide
cuggcguggcucccuguu

SEQ ID NO: 72586 - RNA, 18 nt, Artificial Sequence
  Description of Artificial Sequence: Synthetic oligonucleotide
ucuggcuggcguggcucc

SEQ ID NO: 72587 - RNA, 18 nt, Artificial Sequence
  Description of Artificial Sequence: Synthetic oligonucleotide
gggugucuggcuggcgug

SEQ ID NO: 72588 - RNA, 18 nt, Artificial Sequence
  Description of Artificial Sequence: Synthetic oligonucleotide
agcuccauucuggccggg

SEQ ID NO: 72589 - RNA, 18 nt, Artificial Sequence
  Description of Artificial Sequence: Synthetic oligonucleotide
ucagcuccauucuggccg

SEQ ID NO: 72590 - RNA, 18 nt, Artificial Sequence
  Description of Artificial Sequence: Synthetic oligonucleotide
uagccccucagguguguu

SEQ ID NO: 72591 - RNA, 18 nt, Artificial Sequence
  Description of Artificial Sequence: Synthetic oligonucleotide
ggcccuagccccucaggu

SEQ ID NO: 72592 - RNA, 18 nt, Artificial Sequence
  Description of Artificial Sequence: Synthetic oligonucleotide
cauauggcccuagccccu

SEQ ID NO: 72593 - RNA, 18 nt, Artificial Sequence
  Description of Artificial Sequence: Synthetic oligonucleotide
guuuccauauggcccuag

SEQ ID NO: 72594 - RNA, 18 nt, Artificial Sequence
  Description of Artificial Sequence: Synthetic oligonucleotide
gucauguuuccauauggc

SEQ ID NO: 72595 - RNA, 18 nt, Artificial Sequence
  Description of Artificial Sequence: Synthetic oligonucleotide
cuucugucauguuuccau

SEQ ID NO: 72596 - RNA, 18 nt, Artificial Sequence
  Description of Artificial Sequence: Synthetic oligonucleotide
cuccccuucugucauguu

SEQ ID NO: 72597 - RNA, 18 nt, Artificial Sequence
  Description of Artificial Sequence: Synthetic oligonucleotide
ucucucuccccuucuguc

SEQ ID NO: 72598 - RNA, 18 nt, Artificial Sequence
  Description of Artificial Sequence: Synthetic oligonucleotide
uccuuucucucuccccuu

SEQ ID NO: 72599 - RNA, 18 nt, Artificial Sequence
  Description of Artificial Sequence: Synthetic oligonucleotide
gugucuccuuucucucuc

SEQ ID NO: 72600 - RNA, 18 nt, Artificial Sequence
  Description of Artificial Sequence: Synthetic oligonucleotide
gcagcgugucuccuuucu

SEQ ID NO: 72601 - RNA, 18 nt, Artificial Sequence
  Description of Artificial Sequence: Synthetic oligonucleotide
ccccugcagcgugucucc

SEQ ID NO: 72602 - RNA, 18 nt, Artificial Sequence
  Description of Artificial Sequence: Synthetic oligonucleotide
ccugcccccugcagcgug

SEQ ID NO: 72603 - RNA, 18 nt, Artificial Sequence
  Description of Artificial Sequence: Synthetic oligonucleotide
agcuuccugcccccugca

SEQ ID NO: 72604 - RNA, 18 nt, Artificial Sequence
  Description of Artificial Sequence: Synthetic oligonucleotide
cccccagcuuccugcccc

SEQ ID NO: 72605 - RNA, 18 nt, Artificial Sequence
  Description of Artificial Sequence: Synthetic oligonucleotide
ggguucccccagcuuccu

SEQ ID NO: 72606 - RNA, 18 nt, Artificial Sequence
  Description of Artificial Sequence: Synthetic oligonucleotide
agaauggguucccccagc

SEQ ID NO: 72607 - RNA, 18 nt, Artificial Sequence
  Description of Artificial Sequence: Synthetic oligonucleotide
uugggagaauggguuccc

SEQ ID NO: 72608 - RNA, 18 nt, Artificial Sequence
  Description of Artificial Sequence: Synthetic oligonucleotide
uauuuuugggagaauggg

SEQ ID NO: 72609 - RNA, 18 nt, Artificial Sequence
  Description of Artificial Sequence: Synthetic oligonucleotide
ccccuuauuuuugggaga

SEQ ID NO: 72610 - RNA, 18 nt, Artificial Sequence
  Description of Artificial Sequence: Synthetic oligonucleotide
ucagaccccuuauuuuug

SEQ ID NO: 72611 - RNA, 18 nt, Artificial Sequence
  Description of Artificial Sequence: Synthetic oligonucleotide
accccucagaccccuuau

SEQ ID NO: 72612 - RNA, 18 nt, Artificial Sequence
  Description of Artificial Sequence: Synthetic oligonucleotide
aauccaccccucagaccc

SEQ ID NO: 72613 - RNA, 18 nt, Artificial Sequence
  Description of Artificial Sequence: Synthetic oligonucleotide
cagggaauccaccccuca

SEQ ID NO: 72614 - RNA, 18 nt, Artificial Sequence
  Description of Artificial Sequence: Synthetic oligonucleotide
aaacccagggaauccacc

SEQ ID NO: 72615 - RNA, 18 nt, Artificial Sequence
  Description of Artificial Sequence: Synthetic oligonucleotide
gggagaauggguuccccc

SEQ ID NO: 72616 - RNA, 18 nt, Artificial Sequence
  Description of Artificial Sequence: Synthetic oligonucleotide
uuuuugggagaauggguu

SEQ ID NO: 72617 - RNA, 18 nt, Artificial Sequence
  Description of Artificial Sequence: Synthetic oligonucleotide
ccuuauuuuugggagaau

SEQ ID NO: 72618 - RNA, 18 nt, Artificial Sequence
  Description of Artificial Sequence: Synthetic oligonucleotide
agaccccuuauuuuuggg

SEQ ID NO: 72619 - RNA, 18 nt, Artificial Sequence
  Description of Artificial Sequence: Synthetic oligonucleotide
cccucagaccccuuauuu

SEQ ID NO: 72620 - RNA, 18 nt, Artificial Sequence
  Description of Artificial Sequence: Synthetic oligonucleotide
uccaccccucagaccccu

SEQ ID NO: 72621 - RNA, 18 nt, Artificial Sequence
  Description of Artificial Sequence: Synthetic oligonucleotide
gggaauccaccccucaga

SEQ ID NO: 72622 - RNA, 18 nt, Artificial Sequence
  Description of Artificial Sequence: Synthetic oligonucleotide
acccagggaauccacccc

SEQ ID NO: 72623 - RNA, 18 nt, Artificial Sequence
  Description of Artificial Sequence: Synthetic oligonucleotide
cugaaacccagggaaucc

SEQ ID NO: 72624 - RNA, 18 nt, Artificial Sequence
  Description of Artificial Sequence: Synthetic oligonucleotide
cagaccugaaacccaggg

SEQ ID NO: 72625 - RNA, 18 nt, Artificial Sequence
  Description of Artificial Sequence: Synthetic oligonucleotide
ggacccagaccugaaacc

SEQ ID NO: 72626 - RNA, 18 nt, Artificial Sequence
  Description of Artificial Sequence: Synthetic oligonucleotide
auucaggacccagaccug

SEQ ID NO: 72627 - RNA, 18 nt, Artificial Sequence
  Description of Artificial Sequence: Synthetic oligonucleotide
uucccauucaggacccag

SEQ ID NO: 72628 - RNA, 18 nt, Artificial Sequence
  Description of Artificial Sequence: Synthetic oligonucleotide
aggaauucccauucagga

SEQ ID NO: 72629 - RNA, 18 nt, Artificial Sequence
  Description of Artificial Sequence: Synthetic oligonucleotide
auuccaggaauucccauu

SEQ ID NO: 72630 - RNA, 18 nt, Artificial Sequence
  Description of Artificial Sequence: Synthetic oligonucleotide
cugguauuccaggaauuc

SEQ ID NO: 72631 - RNA, 18 nt, Artificial Sequence
  Description of Artificial Sequence: Synthetic oligonucleotide
gucagcugguauuccagg

SEQ ID NO: 72632 - RNA, 18 nt, Artificial Sequence
  Description of Artificial Sequence: Synthetic oligonucleotide
ucauugucagcugguauu

SEQ ID NO: 72633 - RNA, 18 nt, Artificial Sequence
  Description of Artificial Sequence: Synthetic oligonucleotide
ggaaaucauugucagcug

SEQ ID NO: 72634 - RNA, 18 nt, Artificial Sequence
  Description of Artificial Sequence: Synthetic oligonucleotide
gaggaggaaaucauuguc

SEQ ID NO: 72635 - RNA, 18 nt, Artificial Sequence
  Description of Artificial Sequence: Synthetic oligonucleotide
aagaugaggaggaaauca

SEQ ID NO: 72636 - RNA, 18 nt, Artificial Sequence
  Description of Artificial Sequence: Synthetic oligonucleotide
guugaaagaugaggagga

SEQ ID NO: 72637 - RNA, 18 nt, Artificial Sequence
  Description of Artificial Sequence: Synthetic oligonucleotide
gugagguugaaagaugag

SEQ ID NO: 72638 - RNA, 18 nt, Artificial Sequence
  Description of Artificial Sequence: Synthetic oligonucleotide
augaccacgaggagcaau

SEQ ID NO: 72639 - RNA, 18 nt, Artificial Sequence
  Description of Artificial Sequence: Synthetic oligonucleotide
gaagcaugaccacgagga

SEQ ID NO: 72640 - RNA, 18 nt, Artificial Sequence
  Description of Artificial Sequence: Synthetic oligonucleotide
uaggagaagcaugaccac

SEQ ID NO: 72641 - RNA, 18 nt, Artificial Sequence
  Description of Artificial Sequence: Synthetic oligonucleotide
gcaguuaggagaagcaug

SEQ ID NO: 72642 - RNA, 18 nt, Artificial Sequence
  Description of Artificial Sequence: Synthetic oligonucleotide
gccuugcaguuaggagaa

SEQ ID NO: 72643 - RNA, 18 nt, Artificial Sequence
  Description of Artificial Sequence: Synthetic oligonucleotide
cguuagccuugcaguuag

SEQ ID NO: 72644 - RNA, 18 nt, Artificial Sequence
  Description of Artificial Sequence: Synthetic oligonucleotide
gacagcguuagccuugca

SEQ ID NO: 72645 - RNA, 18 nt, Artificial Sequence
  Description of Artificial Sequence: Synthetic oligonucleotide
ggcuggacagcguuagcc

SEQ ID NO: 72646 - RNA, 18 nt, Artificial Sequence
  Description of Artificial Sequence: Synthetic oligonucleotide
agccgggcuggacagcgu

SEQ ID NO: 72647 - RNA, 18 nt, Artificial Sequence
  Description of Artificial Sequence: Synthetic oligonucleotide
ggaggagccgggcuggac

SEQ ID NO: 72648 - RNA, 18 nt, Artificial Sequence
  Description of Artificial Sequence: Synthetic oligonucleotide
aagcaggaggagccgggc

SEQ ID NO: 72649 - RNA, 18 nt, Artificial Sequence
  Description of Artificial Sequence: Synthetic oligonucleotide
gucacaagcaggaggagc

SEQ ID NO: 72650 - RNA, 18 nt, Artificial Sequence
  Description of Artificial Sequence: Synthetic oligonucleotide
cggaggucacaagcagga

SEQ ID NO: 72651 - RNA, 18 nt, Artificial Sequence
  Description of Artificial Sequence: Synthetic oligonucleotide
ggacucggaggucacaag

SEQ ID NO: 72652 - RNA, 18 nt, Artificial Sequence
  Description of Artificial Sequence: Synthetic oligonucleotide
acugaggacucggagguc

SEQ ID NO: 72653 - RNA, 18 nt, Artificial Sequence
  Description of Artificial Sequence: Synthetic oligonucleotide
aguuuacugaggacucgg

SEQ ID NO: 72654 - RNA, 18 nt, Artificial Sequence
  Description of Artificial Sequence: Synthetic oligonucleotide
gaagcaguuuacugagga

SEQ ID NO: 72655 - RNA, 18 nt, Artificial Sequence
  Description of Artificial Sequence: Synthetic oligonucleotide
gucacgaagcaguuuacu

SEQ ID NO: 72656 - RNA, 18 nt, Artificial Sequence
  Description of Artificial Sequence: Synthetic oligonucleotide
ugggagucacgaagcagu

SEQ ID NO: 72657 - RNA, 18 nt, Artificial Sequence
  Description of Artificial Sequence: Synthetic oligonucleotide
ggacaugggagucacgaa

SEQ ID NO: 72658 - RNA, 18 nt, Artificial Sequence
  Description of Artificial Sequence: Synthetic oligonucleotide
gugaaggacaugggaguc

SEQ ID NO: 72659 - RNA, 18 nt, Artificial Sequence
  Description of Artificial Sequence: Synthetic oligonucleotide
cugcugugaaggacaugg

SEQ ID NO: 72660 - RNA, 18 nt, Artificial Sequence
  Description of Artificial Sequence: Synthetic oligonucleotide
caugaccacgaggagcaa

SEQ ID NO: 72661 - RNA, 18 nt, Artificial Sequence
  Description of Artificial Sequence: Synthetic oligonucleotide
agaagcaugaccacgagg

SEQ ID NO: 72662 - RNA, 18 nt, Artificial Sequence
  Description of Artificial Sequence: Synthetic oligonucleotide
uuaggagaagcaugacca

SEQ ID NO: 72663 - RNA, 18 nt, Artificial Sequence
  Description of Artificial Sequence: Synthetic oligonucleotide
ugcaguuaggagaagcau

SEQ ID NO: 72664 - RNA, 18 nt, Artificial Sequence
  Description of Artificial Sequence: Synthetic oligonucleotide
agccuugcaguuaggaga

SEQ ID NO: 72665 - RNA, 18 nt, Artificial Sequence
  Description of Artificial Sequence: Synthetic oligonucleotide
gcguuagccuugcaguua

SEQ ID NO: 72666 - RNA, 18 nt, Artificial Sequence
  Description of Artificial Sequence: Synthetic oligonucleotide
ggacagcguuagccuugc

SEQ ID NO: 72667 - RNA, 18 nt, Artificial Sequence
  Description of Artificial Sequence: Synthetic oligonucleotide
gggcuggacagcguuagc

SEQ ID NO: 72668 - RNA, 18 nt, Artificial Sequence
  Description of Artificial Sequence: Synthetic oligonucleotide
gagccgggcuggacagcg

SEQ ID NO: 72669 - RNA, 18 nt, Artificial Sequence
  Description of Artificial Sequence: Synthetic oligonucleotide
aggaggagccgggcugga

SEQ ID NO: 72670 - RNA, 18 nt, Artificial Sequence
  Description of Artificial Sequence: Synthetic oligonucleotide
caagcaggaggagccggg

SEQ ID NO: 72671 - RNA, 18 nt, Artificial Sequence
  Description of Artificial Sequence: Synthetic oligonucleotide
ggucacaagcaggaggag

SEQ ID NO: 72672 - RNA, 18 nt, Artificial Sequence
  Description of Artificial Sequence: Synthetic oligonucleotide
ucggaggucacaagcagg

SEQ ID NO: 72673 - RNA, 18 nt, Artificial Sequence
  Description of Artificial Sequence: Synthetic oligonucleotide
aggacucggaggucacaa

SEQ ID NO: 72674 - RNA, 18 nt, Artificial Sequence
  Description of Artificial Sequence: Synthetic oligonucleotide
uacugaggacucggaggu

SEQ ID NO: 72675 - RNA, 18 nt, Artificial Sequence
  Description of Artificial Sequence: Synthetic oligonucleotide
caguuuacugaggacucg

SEQ ID NO: 72676 - RNA, 18 nt, Artificial Sequence
  Description of Artificial Sequence: Synthetic oligonucleotide
cgaagcaguuuacugagg

SEQ ID NO: 72677 - RNA, 18 nt, Artificial Sequence
  Description of Artificial Sequence: Synthetic oligonucleotide
agucacgaagcaguuuac

SEQ ID NO: 72678 - RNA, 18 nt, Artificial Sequence
  Description of Artificial Sequence: Synthetic oligonucleotide
augggagucacgaagcag

SEQ ID NO: 72679 - RNA, 18 nt, Artificial Sequence
  Description of Artificial Sequence: Synthetic oligonucleotide
aggacaugggagucacga

SEQ ID NO: 72680 - RNA, 18 nt, Artificial Sequence
  Description of Artificial Sequence: Synthetic oligonucleotide
ugugaaggacaugggagu

SEQ ID NO: 72681 - RNA, 18 nt, Artificial Sequence
  Description of Artificial Sequence: Synthetic oligonucleotide
ucugcugugaaggacaug

SEQ ID NO: 72682 - RNA, 18 nt, Artificial Sequence
  Description of Artificial Sequence: Synthetic oligonucleotide
gggauaauguugggaguu

SEQ ID NO: 72683 - RNA, 18 nt, Artificial Sequence
  Description of Artificial Sequence: Synthetic oligonucleotide
uaccaguuacgcggauaa

SEQ ID NO: 72684 - RNA, 18 nt, Artificial Sequence
  Description of Artificial Sequence: Synthetic oligonucleotide
ugucuuaccaguuacgcg

SEQ ID NO: 72685 - RNA, 18 nt, Artificial Sequence
  Description of Artificial Sequence: Synthetic oligonucleotide
augggugucuuaccaguu

SEQ ID NO: 72686 - RNA, 18 nt, Artificial Sequence
  Description of Artificial Sequence: Synthetic oligonucleotide
ggaguaugggugucuuac

SEQ ID NO: 72687 - RNA, 18 nt, Artificial Sequence
  Description of Artificial Sequence: Synthetic oligonucleotide
uccugggaguaugggugu

SEQ ID NO: 72688 - RNA, 18 nt, Artificial Sequence
  Description of Artificial Sequence: Synthetic oligonucleotide
ugucuuccugggaguaug

SEQ ID NO: 72689 - RNA, 18 nt, Artificial Sequence
  Description of Artificial Sequence: Synthetic oligonucleotide
gauggugucuuccuggga

SEQ ID NO: 72690 - RNA, 18 nt, Artificial Sequence
  Description of Artificial Sequence: Synthetic oligonucleotide
gaagugauggugucuucc

SEQ ID NO: 72691 - RNA, 18 nt, Artificial Sequence
  Description of Artificial Sequence: Synthetic oligonucleotide
uagaggaagugauggugu

SEQ ID NO: 72692 - RNA, 18 nt, Artificial Sequence
  Description of Artificial Sequence: Synthetic oligonucleotide
ggaguuagaggaagugau

SEQ ID NO: 72693 - RNA, 18 nt, Artificial Sequence
  Description of Artificial Sequence: Synthetic oligonucleotide
gucaaggaguuagaggaa

SEQ ID NO: 72694 - RNA, 18 nt, Artificial Sequence
  Description of Artificial Sequence: Synthetic oligonucleotide
auugggucaaggaguuag

SEQ ID NO: 72695 - RNA, 18 nt, Artificial Sequence
  Description of Artificial Sequence: Synthetic oligonucleotide
uagucauugggucaagga

SEQ ID NO: 72696 - RNA, 18 nt, Artificial Sequence
  Description of Artificial Sequence: Synthetic oligonucleotide
aagaauagucauuggguc

SEQ ID NO: 72697 - RNA, 18 nt, Artificial Sequence
  Description of Artificial Sequence: Synthetic oligonucleotide
augggaagaauagucauu

SEQ ID NO: 72698 - RNA, 18 nt, Artificial Sequence
  Description of Artificial Sequence: Synthetic oligonucleotide
acaauaugggaagaauag

SEQ ID NO: 72699 - RNA, 18 nt, Artificial Sequence
  Description of Artificial Sequence: Synthetic oligonucleotide
gggacaauaugggaagaa

SEQ ID NO: 72700 - RNA, 18 nt, Artificial Sequence
  Description of Artificial Sequence: Synthetic oligonucleotide
gugugaucaguagguggg

SEQ ID NO: 72701 - RNA, 18 nt, Artificial Sequence
  Description of Artificial Sequence: Synthetic oligonucleotide
agagagugugaucaguag

SEQ ID NO: 72702 - RNA, 18 nt, Artificial Sequence
  Description of Artificial Sequence: Synthetic oligonucleotide
uugucagagagugugauc

SEQ ID NO: 72703 - RNA, 18 nt, Artificial Sequence
  Description of Artificial Sequence: Synthetic oligonucleotide
aauccuugucagagagug

SEQ ID NO: 72704 - RNA, 18 nt, Artificial Sequence
  Description of Artificial Sequence: Synthetic oligonucleotide
agaauaauccuugucaga

SEQ ID NO: 72705 - RNA, 18 nt, Artificial Sequence
  Description of Artificial Sequence: Synthetic oligonucleotide
ugugaagaauaauccuug

SEQ ID NO: 72706 - RNA, 18 nt, Artificial Sequence
  Description of Artificial Sequence: Synthetic oligonucleotide
uguauugugaagaauaau

SEQ ID NO: 72707 - RNA, 18 nt, Artificial Sequence
  Description of Artificial Sequence: Synthetic oligonucleotide
cgggcuguauugugaaga

SEQ ID NO: 72708 - RNA, 18 nt, Artificial Sequence
  Description of Artificial Sequence: Synthetic oligonucleotide
gugugaucaguagguggg

SEQ ID NO: 72709 - RNA, 18 nt, Artificial Sequence
  Description of Artificial Sequence: Synthetic oligonucleotide
gagagugugaucaguagg

SEQ ID NO: 72710 - RNA, 18 nt, Artificial Sequence
  Description of Artificial Sequence: Synthetic oligonucleotide
ugucagagagugugauca

SEQ ID NO: 72711 - RNA, 18 nt, Artificial Sequence
  Description of Artificial Sequence: Synthetic oligonucleotide
auccuugucagagagugu

SEQ ID NO: 72712 - RNA, 18 nt, Artificial Sequence
  Description of Artificial Sequence: Synthetic oligonucleotide
gaauaauccuugucagag

SEQ ID NO: 72713 - RNA, 18 nt, Artificial Sequence
  Description of Artificial Sequence: Synthetic oligonucleotide
gugaagaauaauccuugu

SEQ ID NO: 72714 - RNA, 18 nt, Artificial Sequence
  Description of Artificial Sequence: Synthetic oligonucleotide
guauugugaagaauaauc

SEQ ID NO: 72715 - RNA, 18 nt, Artificial Sequence
  Description of Artificial Sequence: Synthetic oligonucleotide
gggcuguauugugaagaa

SEQ ID NO: 72716 - RNA, 18 nt, Artificial Sequence
  Description of Artificial Sequence: Synthetic oligonucleotide
aaugcgggcuguauugug

SEQ ID NO: 72717 - RNA, 18 nt, Artificial Sequence
  Description of Artificial Sequence: Synthetic oligonucleotide
uuuuaaaugcgggcugua

SEQ ID NO: 72718 - RNA, 18 nt, Artificial Sequence
  Description of Artificial Sequence: Synthetic oligonucleotide
agagcuuuuaaaugcggg

SEQ ID NO: 72719 - RNA, 18 nt, Artificial Sequence
  Description of Artificial Sequence: Synthetic oligonucleotide
agacgagagcuuuuaaau

SEQ ID NO: 72720 - RNA, 18 nt, Artificial Sequence
  Description of Artificial Sequence: Synthetic oligonucleotide
ucucuagacgagagcuuu

SEQ ID NO: 72721 - RNA, 18 nt, Artificial Sequence
  Description of Artificial Sequence: Synthetic oligonucleotide
uacuaucucuagacgaga

SEQ ID NO: 72722 - RNA, 18 nt, Artificial Sequence
  Description of Artificial Sequence: Synthetic oligonucleotide
augaguacuaucucuaga

SEQ ID NO: 72723 - RNA, 18 nt, Artificial Sequence
  Description of Artificial Sequence: Synthetic oligonucleotide
ccuccaugaguacuaucu

SEQ ID NO: 72724 - RNA, 18 nt, Artificial Sequence
  Description of Artificial Sequence: Synthetic oligonucleotide
cuaguccuccaugaguac

SEQ ID NO: 72725 - RNA, 18 nt, Artificial Sequence
  Description of Artificial Sequence: Synthetic oligonucleotide
gcaggcuaguccuccaug

SEQ ID NO: 72726 - RNA, 18 nt, Artificial Sequence
  Description of Artificial Sequence: Synthetic oligonucleotide
aauaagcaggcuaguccu

SEQ ID NO: 72727 - RNA, 18 nt, Artificial Sequence
  Description of Artificial Sequence: Synthetic oligonucleotide
agccuaauaagcaggcua

SEQ ID NO: 72728 - RNA, 18 nt, Artificial Sequence
  Description of Artificial Sequence: Synthetic oligonucleotide
augguagccuaauaagca

SEQ ID NO: 72729 - RNA, 18 nt, Artificial Sequence
  Description of Artificial Sequence: Synthetic oligonucleotide
gagcuaugguagccuaau

SEQ ID NO: 72730 - RNA, 18 nt, Artificial Sequence
  Description of Artificial Sequence: Synthetic oligonucleotide
agagagagcuaugguagc

SEQ ID NO: 72731 - RNA, 18 nt, Artificial Sequence
  Description of Artificial Sequence: Synthetic oligonucleotide
gaaauagagagagcuaug

SEQ ID NO: 72732 - RNA, 18 nt, Artificial Sequence
  Description of Artificial Sequence: Synthetic oligonucleotide
gagcugaaauagagagag

SEQ ID NO: 72733 - RNA, 18 nt, Artificial Sequence
  Description of Artificial Sequence: Synthetic oligonucleotide
gaagggagcugaaauaga

SEQ ID NO: 72734 - RNA, 18 nt, Artificial Sequence
  Description of Artificial Sequence: Synthetic oligonucleotide
gaaccucugggcacuggc

SEQ ID NO: 72735 - RNA, 18 nt, Artificial Sequence
  Description of Artificial Sequence: Synthetic oligonucleotide
agggugaaccucugggca

SEQ ID NO: 72736 - RNA, 18 nt, Artificial Sequence
  Description of Artificial Sequence: Synthetic oligonucleotide
ggcaaagggugaaccucu

SEQ ID NO: 72737 - RNA, 18 nt, Artificial Sequence
  Description of Artificial Sequence: Synthetic oligonucleotide
guguaggcaaagggugaa

SEQ ID NO: 72738 - RNA, 18 nt, Artificial Sequence
  Description of Artificial Sequence: Synthetic oligonucleotide
gacagguguaggcaaagg

SEQ ID NO: 72739 - RNA, 18 nt, Artificial Sequence
  Description of Artificial Sequence: Synthetic oligonucleotide
agcaggacagguguaggc

SEQ ID NO: 72740 - RNA, 18 nt, Artificial Sequence
  Description of Artificial Sequence: Synthetic oligonucleotide
caggcagcaggacaggug

SEQ ID NO: 72741 - RNA, 18 nt, Artificial Sequence
  Description of Artificial Sequence: Synthetic oligonucleotide
cacagcaggcagcaggac

SEQ ID NO: 72742 - RNA, 18 nt, Artificial Sequence
  Description of Artificial Sequence: Synthetic oligonucleotide
aaguccacagcaggcagc

SEQ ID NO: 72743 - RNA, 18 nt, Artificial Sequence
  Description of Artificial Sequence: Synthetic oligonucleotide
agcuaaaguccacagcag

SEQ ID NO: 72744 - RNA, 18 nt, Artificial Sequence
  Description of Artificial Sequence: Synthetic oligonucleotide
ucccaagcuaaaguccac

SEQ ID NO: 72745 - RNA, 18 nt, Artificial Sequence
  Description of Artificial Sequence: Synthetic oligonucleotide
cauucucccaagcuaaag

SEQ ID NO: 72746 - RNA, 18 nt, Artificial Sequence
  Description of Artificial Sequence: Synthetic oligonucleotide
uuuuccauucucccaagc

SEQ ID NO: 72747 - RNA, 18 nt, Artificial Sequence
  Description of Artificial Sequence: Synthetic oligonucleotide
cuggguuuuccauucucc

SEQ ID NO: 72748 - RNA, 18 nt, Artificial Sequence
  Description of Artificial Sequence: Synthetic oligonucleotide
gaaccucugggcacuggc

SEQ ID NO: 72749 - RNA, 18 nt, Artificial Sequence
  Description of Artificial Sequence: Synthetic oligonucleotide
agggugaaccucugggca

SEQ ID NO: 72750 - RNA, 18 nt, Artificial Sequence
  Description of Artificial Sequence: Synthetic oligonucleotide
ggcaaagggugaaccucu

SEQ ID NO: 72751 - RNA, 18 nt, Artificial Sequence
  Description of Artificial Sequence: Synthetic oligonucleotide
guguaggcaaagggugaa

SEQ ID NO: 72752 - RNA, 18 nt, Artificial Sequence
  Description of Artificial Sequence: Synthetic oligonucleotide
gacagguguaggcaaagg

SEQ ID NO: 72753 - RNA, 18 nt, Artificial Sequence
  Description of Artificial Sequence: Synthetic oligonucleotide
agcaggacagguguaggc

SEQ ID NO: 72754 - RNA, 18 nt, Artificial Sequence
  Description of Artificial Sequence: Synthetic oligonucleotide
caggcagcaggacaggug

SEQ ID NO: 72755 - RNA, 18 nt, Artificial Sequence
  Description of Artificial Sequence: Synthetic oligonucleotide
cacagcaggcagcaggac

SEQ ID NO: 72756 - RNA, 18 nt, Artificial Sequence
  Description of Artificial Sequence: Synthetic oligonucleotide
aaguccacagcaggcagc

SEQ ID NO: 72757 - RNA, 18 nt, Artificial Sequence
  Description of Artificial Sequence: Synthetic oligonucleotide
agcuaaaguccacagcag

SEQ ID NO: 72758 - RNA, 18 nt, Artificial Sequence
  Description of Artificial Sequence: Synthetic oligonucleotide
ucccaagcuaaaguccac

SEQ ID NO: 72759 - RNA, 18 nt, Artificial Sequence
  Description of Artificial Sequence: Synthetic oligonucleotide
cauucucccaagcuaaag

SEQ ID NO: 72760 - RNA, 18 nt, Artificial Sequence
  Description of Artificial Sequence: Synthetic oligonucleotide
uuuuccauucucccaagc

SEQ ID NO: 72761 - RNA, 18 nt, Artificial Sequence
  Description of Artificial Sequence: Synthetic oligonucleotide
cuggguuuuccauucucc

SEQ ID NO: 72762 - RNA, 18 nt, Artificial Sequence
  Description of Artificial Sequence: Synthetic oligonucleotide
aagguuagggauggcuuu

SEQ ID NO: 72763 - RNA, 18 nt, Artificial Sequence
  Description of Artificial Sequence: Synthetic oligonucleotide
aagccaagguuagggaug

SEQ ID NO: 72764 - RNA, 18 nt, Artificial Sequence
  Description of Artificial Sequence: Synthetic oligonucleotide
uagggaagccaagguuag

SEQ ID NO: 72765 - RNA, 18 nt, Artificial Sequence
  Description of Artificial Sequence: Synthetic oligonucleotide
ggacuuagggaagccaag

SEQ ID NO: 72766 - RNA, 18 nt, Artificial Sequence
  Description of Artificial Sequence: Synthetic oligonucleotide
agacaggacuuagggaag

SEQ ID NO: 72767 - RNA, 18 nt, Artificial Sequence
  Description of Artificial Sequence: Synthetic oligonucleotide
acugaagacaggacuuag

SEQ ID NO: 72768 - RNA, 18 nt, Artificial Sequence
  Description of Artificial Sequence: Synthetic oligonucleotide
gggaaacugaagacagga

SEQ ID NO: 72769 - RNA, 18 nt, Artificial Sequence
  Description of Artificial Sequence: Synthetic oligonucleotide
gcagugggaaacugaaga

SEQ ID NO: 72770 - RNA, 18 nt, Artificial Sequence
  Description of Artificial Sequence: Synthetic oligonucleotide
gggaagcagugggaaacu

SEQ ID NO: 72771 - RNA, 18 nt, Artificial Sequence
  Description of Artificial Sequence: Synthetic oligonucleotide
uccaugggaagcaguggg

SEQ ID NO: 72772 - RNA, 18 nt, Artificial Sequence
  Description of Artificial Sequence: Synthetic oligonucleotide
gagaauccaugggaagca

SEQ ID NO: 72773 - RNA, 18 nt, Artificial Sequence
  Description of Artificial Sequence: Synthetic oligonucleotide
uguuggagaauccauggg

SEQ ID NO: 72774 - RNA, 18 nt, Artificial Sequence
  Description of Artificial Sequence: Synthetic oligonucleotide
aagaauguuggagaaucc

SEQ ID NO: 72775 - RNA, 18 nt, Artificial Sequence
  Description of Artificial Sequence: Synthetic oligonucleotide
agcucaagaauguuggag

SEQ ID NO: 72776 - RNA, 18 nt, Artificial Sequence
  Description of Artificial Sequence: Synthetic oligonucleotide
uaaaaagcucaagaaugu

SEQ ID NO: 72777 - RNA, 18 nt, Artificial Sequence
  Description of Artificial Sequence: Synthetic oligonucleotide
auuuuuaaaaagcucaag

SEQ ID NO: 72778 - RNA, 18 nt, Artificial Sequence
  Description of Artificial Sequence: Synthetic oligonucleotide
gagauauuuuuaaaaagc

SEQ ID NO: 72779 - RNA, 18 nt, Artificial Sequence
  Description of Artificial Sequence: Synthetic oligonucleotide
aaggugagauauuuuuaa

SEQ ID NO: 72780 - RNA, 18 nt, Artificial Sequence
  Description of Artificial Sequence: Synthetic oligonucleotide
agcugaaggugagauauu

SEQ ID NO: 72781 - RNA, 18 nt, Artificial Sequence
  Description of Artificial Sequence: Synthetic oligonucleotide
ggccaagcugaaggugag

SEQ ID NO: 72782 - RNA, 18 nt, Artificial Sequence
  Description of Artificial Sequence: Synthetic oligonucleotide
aggguggccaagcugaag

SEQ ID NO: 72783 - RNA, 18 nt, Artificial Sequence
  Description of Artificial Sequence: Synthetic oligonucleotide
ggguuaggguggccaagc

SEQ ID NO: 72784 - RNA, 18 nt, Artificial Sequence
  Description of Artificial Sequence: Synthetic oligonucleotide
agauuggguuaggguggc

SEQ ID NO: 72785 - RNA, 18 nt, Artificial Sequence
  Description of Artificial Sequence: Synthetic oligonucleotide
aauguagauuggguuagg

SEQ ID NO: 72786 - RNA, 18 nt, Artificial Sequence
  Description of Artificial Sequence: Synthetic oligonucleotide
aggugaauguagauuggg

SEQ ID NO: 72787 - RNA, 18 nt, Artificial Sequence
  Description of Artificial Sequence: Synthetic oligonucleotide
aucauaggugaauguaga

SEQ ID NO: 72788 - RNA, 18 nt, Artificial Sequence
  Description of Artificial Sequence: Synthetic oligonucleotide
cuaucaucauaggugaau

SEQ ID NO: 72789 - RNA, 18 nt, Artificial Sequence
  Description of Artificial Sequence: Synthetic oligonucleotide
acaggcuaucaucauagg

SEQ ID NO: 72790 - RNA, 18 nt, Artificial Sequence
  Description of Artificial Sequence: Synthetic oligonucleotide
uauccacaggcuaucauc

SEQ ID NO: 72791 - RNA, 18 nt, Artificial Sequence
  Description of Artificial Sequence: Synthetic oligonucleotide
caucuuauccacaggcua

SEQ ID NO: 72792 - RNA, 18 nt, Artificial Sequence
  Description of Artificial Sequence: Synthetic oligonucleotide
gccaucaucuuauccaca

SEQ ID NO: 72793 - RNA, 18 nt, Artificial Sequence
  Description of Artificial Sequence: Synthetic oligonucleotide
ugcaagccaucaucuuau

SEQ ID NO: 72794 - RNA, 18 nt, Artificial Sequence
  Description of Artificial Sequence: Synthetic oligonucleotide
ggaccugcaagccaucau

SEQ ID NO: 72795 - RNA, 18 nt, Artificial Sequence
  Description of Artificial Sequence: Synthetic oligonucleotide
auauuggaccugcaagcc

SEQ ID NO: 72796 - RNA, 18 nt, Artificial Sequence
  Description of Artificial Sequence: Synthetic oligonucleotide
uucacauauuggaccugc

SEQ ID NO: 72797 - RNA, 18 nt, Artificial Sequence
  Description of Artificial Sequence: Synthetic oligonucleotide
aucuauucacauauugga

SEQ ID NO: 72798 - RNA, 18 nt, Artificial Sequence
  Description of Artificial Sequence: Synthetic oligonucleotide
uucaaaucuauucacaua

SEQ ID NO: 72799 - RNA, 18 nt, Artificial Sequence
  Description of Artificial Sequence: Synthetic oligonucleotide
ucagcuucaaaucuauuc

SEQ ID NO: 72800 - RNA, 18 nt, Artificial Sequence
  Description of Artificial Sequence: Synthetic oligonucleotide
gguguucagcuucaaauc

SEQ ID NO: 72801 - RNA, 18 nt, Artificial Sequence
  Description of Artificial Sequence: Synthetic oligonucleotide
uucaugguguucagcuuc

SEQ ID NO: 72802 - RNA, 18 nt, Artificial Sequence
  Description of Artificial Sequence: Synthetic oligonucleotide
agcuuuucaugguguuca

SEQ ID NO: 72803 - RNA, 18 nt, Artificial Sequence
  Description of Artificial Sequence: Synthetic oligonucleotide
ucuccagcuuuucauggu

SEQ ID NO: 72804 - RNA, 18 nt, Artificial Sequence
  Description of Artificial Sequence: Synthetic oligonucleotide
auuucucuccagcuuuuc

SEQ ID NO: 72805 - RNA, 18 nt, Artificial Sequence
  Description of Artificial Sequence: Synthetic oligonucleotide
gagcgauuucucuccagc

SEQ ID NO: 72806 - RNA, 18 nt, Artificial Sequence
  Description of Artificial Sequence: Synthetic oligonucleotide
gccaugagcgauuucucu

SEQ ID NO: 72807 - RNA, 18 nt, Artificial Sequence
  Description of Artificial Sequence: Synthetic oligonucleotide
gcauggccaugagcgauu

SEQ ID NO: 72808 - RNA, 18 nt, Artificial Sequence
  Description of Artificial Sequence: Synthetic oligonucleotide
caaaggcauggccaugag

SEQ ID NO: 72809 - RNA, 18 nt, Artificial Sequence
  Description of Artificial Sequence: Synthetic oligonucleotide
uaggucaaaggcauggcc

SEQ ID NO: 72810 - RNA, 18 nt, Artificial Sequence
  Description of Artificial Sequence: Synthetic oligonucleotide
gggaauaggucaaaggca

SEQ ID NO: 72811 - RNA, 18 nt, Artificial Sequence
  Description of Artificial Sequence: Synthetic oligonucleotide
ugaacgggaauaggucaa

SEQ ID NO: 72812 - RNA, 18 nt, Artificial Sequence
  Description of Artificial Sequence: Synthetic oligonucleotide
aagacugaacgggaauag

SEQ ID NO: 72813 - RNA, 18 nt, Artificial Sequence
  Description of Artificial Sequence: Synthetic oligonucleotide
uuaagaagacugaacggg

SEQ ID NO: 72814 - RNA, 18 nt, Artificial Sequence
  Description of Artificial Sequence: Synthetic oligonucleotide
ccaauuuaagaagacuga

SEQ ID NO: 72815 - RNA, 18 nt, Artificial Sequence
  Description of Artificial Sequence: Synthetic oligonucleotide
ucaugccaauuuaagaag

SEQ ID NO: 72816 - RNA, 18 nt, Artificial Sequence
  Description of Artificial Sequence: Synthetic oligonucleotide
cuucuucaugccaauuua

SEQ ID NO: 72817 - RNA, 18 nt, Artificial Sequence
  Description of Artificial Sequence: Synthetic oligonucleotide
ucuugcuucuucaugcca

SEQ ID NO: 72818 - RNA, 18 nt, Artificial Sequence
  Description of Artificial Sequence: Synthetic oligonucleotide
augagucuugcuucuuca

SEQ ID NO: 72819 - RNA, 18 nt, Artificial Sequence
  Description of Artificial Sequence: Synthetic oligonucleotide
gacauaugagucuugcuu

SEQ ID NO: 72820 - RNA, 18 nt, Artificial Sequence
  Description of Artificial Sequence: Synthetic oligonucleotide
uggaugacauaugagucu

SEQ ID NO: 72821 - RNA, 18 nt, Artificial Sequence
  Description of Artificial Sequence: Synthetic oligonucleotide
aucuguggaugacauaug

SEQ ID NO: 72822 - RNA, 18 nt, Artificial Sequence
  Description of Artificial Sequence: Synthetic oligonucleotide
gugucaucuguggaugac

SEQ ID NO: 72823 - RNA, 18 nt, Artificial Sequence
  Description of Artificial Sequence: Synthetic oligonucleotide
gcuuugugucaucugugg

SEQ ID NO: 72824 - RNA, 18 nt, Artificial Sequence
  Description of Artificial Sequence: Synthetic oligonucleotide
ucccagcuuugugucauc

SEQ ID NO: 72825 - RNA, 18 nt, Artificial Sequence
  Description of Artificial Sequence: Synthetic oligonucleotide
guacuucccagcuuugug

SEQ ID NO: 72826 - RNA, 18 nt, Artificial Sequence
  Description of Artificial Sequence: Synthetic oligonucleotide
uagugguacuucccagcu

SEQ ID NO: 72827 - RNA, 18 nt, Artificial Sequence
  Description of Artificial Sequence: Synthetic oligonucleotide
uauuuuagugguacuucc

SEQ ID NO: 72828 - RNA, 18 nt, Artificial Sequence
  Description of Artificial Sequence: Synthetic oligonucleotide
uuuguuauuuuaguggua

SEQ ID NO: 72829 - RNA, 18 nt, Artificial Sequence
  Description of Artificial Sequence: Synthetic oligonucleotide
agucuuuuguuauuuuag

SEQ ID NO: 72830 - RNA, 18 nt, Artificial Sequence
  Description of Artificial Sequence: Synthetic oligonucleotide
gauucagucuuuuguuau

SEQ ID NO: 72831 - RNA, 18 nt, Artificial Sequence
  Description of Artificial Sequence: Synthetic oligonucleotide
aucuugauucagucuuuu

SEQ ID NO: 72832 - RNA, 18 nt, Artificial Sequence
  Description of Artificial Sequence: Synthetic oligonucleotide
uuugaaucuugauucagu

SEQ ID NO: 72833 - RNA, 18 nt, Artificial Sequence
  Description of Artificial Sequence: Synthetic oligonucleotide
agugauuugaaucuugau

SEQ ID NO: 72834 - RNA, 18 nt, Artificial Sequence
  Description of Artificial Sequence: Synthetic oligonucleotide
cuuucagugauuugaauc

SEQ ID NO: 72835 - RNA, 18 nt, Artificial Sequence
  Description of Artificial Sequence: Synthetic oligonucleotide
cuagucuuucagugauuu

SEQ ID NO: 72836 - RNA, 18 nt, Artificial Sequence
  Description of Artificial Sequence: Synthetic oligonucleotide
uugaccuagucuuucagu

SEQ ID NO: 72837 - RNA, 18 nt, Artificial Sequence
  Description of Artificial Sequence: Synthetic oligonucleotide
uguuuuugaccuagucuu

SEQ ID NO: 72838 - RNA, 18 nt, Artificial Sequence
  Description of Artificial Sequence: Synthetic oligonucleotide
caccuuguuuuugaccua

SEQ ID NO: 72839 - RNA, 18 nt, Artificial Sequence
  Description of Artificial Sequence: Synthetic oligonucleotide
uguuucaccuuguuuuug

SEQ ID NO: 72840 - RNA, 18 nt, Artificial Sequence
  Description of Artificial Sequence: Synthetic oligonucleotide
ucuguuguuucaccuugu

SEQ ID NO: 72841 - RNA, 18 nt, Artificial Sequence
  Description of Artificial Sequence: Synthetic oligonucleotide
auaucucuguuguuucac

SEQ ID NO: 72842 - RNA, 18 nt, Artificial Sequence
  Description of Artificial Sequence: Synthetic oligonucleotide
aguuuauaucucuguugu

SEQ ID NO: 72843 - RNA, 18 nt, Artificial Sequence
  Description of Artificial Sequence: Synthetic oligonucleotide
guagaaguuuauaucucu

SEQ ID NO: 72844 - RNA, 18 nt, Artificial Sequence
  Description of Artificial Sequence: Synthetic oligonucleotide
cacauguagaaguuuaua

SEQ ID NO: 72845 - RNA, 18 nt, Artificial Sequence
  Description of Artificial Sequence: Synthetic oligonucleotide
cggcccacauguagaagu

SEQ ID NO: 72846 - RNA, 18 nt, Artificial Sequence
  Description of Artificial Sequence: Synthetic oligonucleotide
gcccccggcccacaugua

SEQ ID NO: 72847 - RNA, 18 nt, Artificial Sequence
  Description of Artificial Sequence: Synthetic oligonucleotide
cgugagcccccggcccac

SEQ ID NO: 72848 - RNA, 18 nt, Artificial Sequence
  Description of Artificial Sequence: Synthetic oligonucleotide
acaggcgugagcccccgg

SEQ ID NO: 72849 - RNA, 18 nt, Artificial Sequence
  Description of Artificial Sequence: Synthetic oligonucleotide
ggauuacaggcgugagcc

SEQ ID NO: 72850 - RNA, 18 nt, Artificial Sequence
  Description of Artificial Sequence: Synthetic oligonucleotide
ugcugggauuacaggcgu

SEQ ID NO: 72851 - RNA, 18 nt, Artificial Sequence
  Description of Artificial Sequence: Synthetic oligonucleotide
caaagugcugggauuaca

SEQ ID NO: 72852 - RNA, 18 nt, Artificial Sequence
  Description of Artificial Sequence: Synthetic oligonucleotide
ccucccaaagugcuggga

SEQ ID NO: 72853 - RNA, 18 nt, Artificial Sequence
  Description of Artificial Sequence: Synthetic oligonucleotide
cucggccucccaaagugc

SEQ ID NO: 72854 - RNA, 18 nt, Artificial Sequence
  Description of Artificial Sequence: Synthetic oligonucleotide
ccugccucggccucccaa

SEQ ID NO: 72855 - RNA, 18 nt, Artificial Sequence
  Description of Artificial Sequence: Synthetic oligonucleotide
aucugccugccucggccu

SEQ ID NO: 72856 - RNA, 18 nt, Artificial Sequence
  Description of Artificial Sequence: Synthetic oligonucleotide
aggugaucugccugccuc

SEQ ID NO: 72857 - RNA, 18 nt, Artificial Sequence
  Description of Artificial Sequence: Synthetic oligonucleotide
cccucaggugaucugccu

SEQ ID NO: 72858 - RNA, 18 nt, Artificial Sequence
  Description of Artificial Sequence: Synthetic oligonucleotide
uccugcccucaggugauc

SEQ ID NO: 72859 - RNA, 18 nt, Artificial Sequence
  Description of Artificial Sequence: Synthetic oligonucleotide
caaacuccugcccucagg

SEQ ID NO: 72860 - RNA, 18 nt, Artificial Sequence
  Description of Artificial Sequence: Synthetic oligonucleotide
gcucucaaacuccugccc

SEQ ID NO: 72861 - RNA, 18 nt, Artificial Sequence
  Description of Artificial Sequence: Synthetic oligonucleotide
gcugggcauggugguggg

SEQ ID NO: 72862 - RNA, 18 nt, Artificial Sequence
  Description of Artificial Sequence: Synthetic oligonucleotide
aauuagcugggcauggug

SEQ ID NO: 72863 - RNA, 18 nt, Artificial Sequence
  Description of Artificial Sequence: Synthetic oligonucleotide
acaaaaauuagcugggca

SEQ ID NO: 72864 - RNA, 18 nt, Artificial Sequence
  Description of Artificial Sequence: Synthetic oligonucleotide
aaaauacaaaaauuagcu

SEQ ID NO: 72865 - RNA, 18 nt, Artificial Sequence
  Description of Artificial Sequence: Synthetic oligonucleotide
uaccaaaaauacaaaaau

SEQ ID NO: 72866 - RNA, 18 nt, Artificial Sequence
  Description of Artificial Sequence: Synthetic oligonucleotide
aucucuaccaaaaauaca

SEQ ID NO: 72867 - RNA, 18 nt, Artificial Sequence
  Description of Artificial Sequence: Synthetic oligonucleotide
accccaucucuaccaaaa

SEQ ID NO: 72868 - RNA, 18 nt, Artificial Sequence
  Description of Artificial Sequence: Synthetic oligonucleotide
gugaaaccccaucucuac

SEQ ID NO: 72869 - RNA, 18 nt, Artificial Sequence
  Description of Artificial Sequence: Synthetic oligonucleotide
acauggugaaaccccauc

SEQ ID NO: 72870 - RNA, 18 nt, Artificial Sequence
  Description of Artificial Sequence: Synthetic oligonucleotide
ggccaacauggugaaacc

SEQ ID NO: 72871 - RNA, 18 nt, Artificial Sequence
  Description of Artificial Sequence: Synthetic oligonucleotide
agccuggccaacauggug

SEQ ID NO: 72872 - RNA, 18 nt, Artificial Sequence
  Description of Artificial Sequence: Synthetic oligonucleotide
agaucagccuggccaaca

SEQ ID NO: 72873 - RNA, 18 nt, Artificial Sequence
  Description of Artificial Sequence: Synthetic oligonucleotide
guucaagaucagccuggc

SEQ ID NO: 72874 - RNA, 18 nt, Artificial Sequence
  Description of Artificial Sequence: Synthetic oligonucleotide
caggaguucaagaucagc

SEQ ID NO: 72875 - RNA, 18 nt, Artificial Sequence
  Description of Artificial Sequence: Synthetic oligonucleotide
gaggucaggaguucaaga

SEQ ID NO: 72876 - RNA, 18 nt, Artificial Sequence
  Description of Artificial Sequence: Synthetic oligonucleotide
caccugaggucaggaguu

SEQ ID NO: 72877 - RNA, 18 nt, Artificial Sequence
  Description of Artificial Sequence: Synthetic oligonucleotide
uggaucaccugaggucag

SEQ ID NO: 72878 - RNA, 18 nt, Artificial Sequence
  Description of Artificial Sequence: Synthetic oligonucleotide
gcagguggaucaccugag

SEQ ID NO: 72879 - RNA, 18 nt, Artificial Sequence
  Description of Artificial Sequence: Synthetic oligonucleotide
cugaggcagguggaucac

SEQ ID NO: 72880 - RNA, 18 nt, Artificial Sequence
  Description of Artificial Sequence: Synthetic oligonucleotide
ggaggcugaggcaggugg

SEQ ID NO: 72881 - RNA, 18 nt, Artificial Sequence
  Description of Artificial Sequence: Synthetic oligonucleotide
cuuugggaggcugaggca

SEQ ID NO: 72882 - RNA, 18 nt, Artificial Sequence
  Description of Artificial Sequence: Synthetic oligonucleotide
cagcacuuugggaggcug

SEQ ID NO: 72883 - RNA, 18 nt, Artificial Sequence
  Description of Artificial Sequence: Synthetic oligonucleotide
aaucccagcacuuuggga

SEQ ID NO: 72884 - RNA, 18 nt, Artificial Sequence
  Description of Artificial Sequence: Synthetic oligonucleotide
ccuguaaucccagcacuu

SEQ ID NO: 72885 - RNA, 18 nt, Artificial Sequence
  Description of Artificial Sequence: Synthetic oligonucleotide
ucacgccuguaaucccag

SEQ ID NO: 72886 - RNA, 18 nt, Artificial Sequence
  Description of Artificial Sequence: Synthetic oligonucleotide
guggcucacgccuguaau

SEQ ID NO: 72887 - RNA, 18 nt, Artificial Sequence
  Description of Artificial Sequence: Synthetic oligonucleotide
gugcaguggcucacgccu

SEQ ID NO: 72888 - RNA, 18 nt, Artificial Sequence
  Description of Artificial Sequence: Synthetic oligonucleotide
gcugggugcaguggcuca

SEQ ID NO: 72889 - RNA, 18 nt, Artificial Sequence
  Description of Artificial Sequence: Synthetic oligonucleotide
ugaaggcugggugcagug

SEQ ID NO: 72890 - RNA, 18 nt, Artificial Sequence
  Description of Artificial Sequence: Synthetic oligonucleotide
cugaaugaaggcugggug

SEQ ID NO: 72891 - RNA, 18 nt, Artificial Sequence
  Description of Artificial Sequence: Synthetic oligonucleotide
uuaaacugaaugaaggcu

SEQ ID NO: 72892 - RNA, 18 nt, Artificial Sequence
  Description of Artificial Sequence: Synthetic oligonucleotide
gauuuuuaaacugaauga

SEQ ID NO: 72893 - RNA, 18 nt, Artificial Sequence
  Description of Artificial Sequence: Synthetic oligonucleotide
cauuugauuuuuaaacug

SEQ ID NO: 72894 - RNA, 18 nt, Artificial Sequence
  Description of Artificial Sequence: Synthetic oligonucleotide
aggaucauuugauuuuua

SEQ ID NO: 72895 - RNA, 18 nt, Artificial Sequence
  Description of Artificial Sequence: Synthetic oligonucleotide
accuuaggaucauuugau

SEQ ID NO: 72896 - RNA, 18 nt, Artificial Sequence
  Description of Artificial Sequence: Synthetic oligonucleotide
gcaaaaccuuaggaucau

SEQ ID NO: 72897 - RNA, 18 nt, Artificial Sequence
  Description of Artificial Sequence: Synthetic oligonucleotide
cugcugcaaaaccuuagg

SEQ ID NO: 72898 - RNA, 18 nt, Artificial Sequence
  Description of Artificial Sequence: Synthetic oligonucleotide
ucuuucugcugcaaaacc

SEQ ID NO: 72899 - RNA, 18 nt, Artificial Sequence
  Description of Artificial Sequence: Synthetic oligonucleotide
uuuacucuuucugcugca

SEQ ID NO: 72900 - RNA, 18 nt, Artificial Sequence
  Description of Artificial Sequence: Synthetic oligonucleotide
gcaaauuuacucuuucug

SEQ ID NO: 72901 - RNA, 18 nt, Artificial Sequence
  Description of Artificial Sequence: Synthetic oligonucleotide
gugcugcaaauuuacucu

SEQ ID NO: 72902 - RNA, 18 nt, Artificial Sequence
  Description of Artificial Sequence: Synthetic oligonucleotide
uucuagugcugcaaauuu

SEQ ID NO: 72903 - RNA, 18 nt, Artificial Sequence
  Description of Artificial Sequence: Synthetic oligonucleotide
cuugguucuagugcugca

SEQ ID NO: 72904 - RNA, 18 nt, Artificial Sequence
  Description of Artificial Sequence: Synthetic oligonucleotide
uaccucuugguucuagug

SEQ ID NO: 72905 - RNA, 18 nt, Artificial Sequence
  Description of Artificial Sequence: Synthetic oligonucleotide
gcuuuuaccucuugguuc

SEQ ID NO: 72906 - RNA, 18 nt, Artificial Sequence
  Description of Artificial Sequence: Synthetic oligonucleotide
uuacagcuuuuaccucuu

SEQ ID NO: 72907 - RNA, 18 nt, Artificial Sequence
  Description of Artificial Sequence: Synthetic oligonucleotide
cccuguuacagcuuuuac

SEQ ID NO: 72908 - RNA, 18 nt, Artificial Sequence
  Description of Artificial Sequence: Synthetic oligonucleotide
aucugcccuguuacagcu

SEQ ID NO: 72909 - RNA, 18 nt, Artificial Sequence
  Description of Artificial Sequence: Synthetic oligonucleotide
cugaaaucugcccuguua

SEQ ID NO: 72910 - RNA, 18 nt, Artificial Sequence
  Description of Artificial Sequence: Synthetic oligonucleotide
cguugcugaaaucugccc

SEQ ID NO: 72911 - RNA, 18 nt, Artificial Sequence
  Description of Artificial Sequence: Synthetic oligonucleotide
ucuuacguugcugaaauc

SEQ ID NO: 72912 - RNA, 18 nt, Artificial Sequence
  Description of Artificial Sequence: Synthetic oligonucleotide
uuuuuucuuacguugcug

SEQ ID NO: 72913 - RNA, 18 nt, Artificial Sequence
  Description of Artificial Sequence: Synthetic oligonucleotide
gcuccuuuuuucuuacgu

SEQ ID NO: 72914 - RNA, 18 nt, Artificial Sequence
  Description of Artificial Sequence: Synthetic oligonucleotide
gaagagcuccuuuuuucu

SEQ ID NO: 72915 - RNA, 18 nt, Artificial Sequence
  Description of Artificial Sequence: Synthetic oligonucleotide
agugagaagagcuccuuu

SEQ ID NO: 72916 - RNA, 18 nt, Artificial Sequence
  Description of Artificial Sequence: Synthetic oligonucleotide
guuucagugagaagagcu

SEQ ID NO: 72917 - RNA, 18 nt, Artificial Sequence
  Description of Artificial Sequence: Synthetic oligonucleotide
acuugguuucagugagaa

SEQ ID NO: 72918 - RNA, 18 nt, Artificial Sequence
  Description of Artificial Sequence: Synthetic oligonucleotide
cuuacacuugguuucagu

SEQ ID NO: 72919 - RNA, 18 nt, Artificial Sequence
  Description of Artificial Sequence: Synthetic oligonucleotide
cuggucuuacacuugguu

SEQ ID NO: 72920 - RNA, 18 nt, Artificial Sequence
  Description of Artificial Sequence: Synthetic oligonucleotide
ccagccuggucuuacacu

SEQ ID NO: 72921 - RNA, 18 nt, Artificial Sequence
  Description of Artificial Sequence: Synthetic oligonucleotide
cuaguccagccuggucuu

SEQ ID NO: 72922 - RNA, 18 nt, Artificial Sequence
  Description of Artificial Sequence: Synthetic oligonucleotide
guccucuaguccagccug

SEQ ID NO: 72923 - RNA, 18 nt, Artificial Sequence
  Description of Artificial Sequence: Synthetic oligonucleotide
cccguguccucuagucca

SEQ ID NO: 72924 - RNA, 18 nt, Artificial Sequence
  Description of Artificial Sequence: Synthetic oligonucleotide
aaacucccguguccucua

SEQ ID NO: 72925 - RNA, 18 nt, Artificial Sequence
  Description of Artificial Sequence: Synthetic oligonucleotide
uucaaaaacucccguguc

SEQ ID NO: 72926 - RNA, 18 nt, Artificial Sequence
  Description of Artificial Sequence: Synthetic oligonucleotide
ucugcuucaaaaacuccc

SEQ ID NO: 72927 - RNA, 18 nt, Artificial Sequence
  Description of Artificial Sequence: Synthetic oligonucleotide
cagccucugcuucaaaaa

SEQ ID NO: 72928 - RNA, 18 nt, Artificial Sequence
  Description of Artificial Sequence: Synthetic oligonucleotide
gucaucagccucugcuuc

SEQ ID NO: 72929 - RNA, 18 nt, Artificial Sequence
  Description of Artificial Sequence: Synthetic oligonucleotide
agcuggucaucagccucu

SEQ ID NO: 72930 - RNA, 18 nt, Artificial Sequence
  Description of Artificial Sequence: Synthetic oligonucleotide
ccgacagcuggucaucag

SEQ ID NO: 72931 - RNA, 18 nt, Artificial Sequence
  Description of Artificial Sequence: Synthetic oligonucleotide
gucucccgacagcugguc

SEQ ID NO: 72932 - RNA, 18 nt, Artificial Sequence
  Description of Artificial Sequence: Synthetic oligonucleotide
ucacagucucccgacagc

SEQ ID NO: 72933 - RNA, 18 nt, Artificial Sequence
  Description of Artificial Sequence: Synthetic oligonucleotide
uuccuucacagucucccg

SEQ ID NO: 72934 - RNA, 18 nt, Artificial Sequence
  Description of Artificial Sequence: Synthetic oligonucleotide
aggaauuccuucacaguc

SEQ ID NO: 72935 - RNA, 18 nt, Artificial Sequence
  Description of Artificial Sequence: Synthetic oligonucleotide
agggcaggaauuccuuca

SEQ ID NO: 72936 - RNA, 18 nt, Artificial Sequence
  Description of Artificial Sequence: Synthetic oligonucleotide
cacccagggcaggaauuc

SEQ ID NO: 72937 - RNA, 18 nt, Artificial Sequence
  Description of Artificial Sequence: Synthetic oligonucleotide
ggucccacccagggcagg

SEQ ID NO: 72938 - RNA, 18 nt, Artificial Sequence
  Description of Artificial Sequence: Synthetic oligonucleotide
accaaggucccacccagg

SEQ ID NO: 72939 - RNA, 18 nt, Artificial Sequence
  Description of Artificial Sequence: Synthetic oligonucleotide
acaggaccaaggucccac

SEQ ID NO: 72940 - RNA, 18 nt, Artificial Sequence
  Description of Artificial Sequence: Synthetic oligonucleotide
acuggacaggaccaaggu

SEQ ID NO: 72941 - RNA, 18 nt, Artificial Sequence
  Description of Artificial Sequence: Synthetic oligonucleotide
ugagaacuggacaggacc

SEQ ID NO: 72942 - RNA, 18 nt, Artificial Sequence
  Description of Artificial Sequence: Synthetic oligonucleotide
caggcugagaacuggaca

SEQ ID NO: 72943 - RNA, 18 nt, Artificial Sequence
  Description of Artificial Sequence: Synthetic oligonucleotide
ucauacaggcugagaacu

SEQ ID NO: 72944 - RNA, 18 nt, Artificial Sequence
  Description of Artificial Sequence: Synthetic oligonucleotide
gugaaucauacaggcuga

SEQ ID NO: 72945 - RNA, 18 nt, Artificial Sequence
  Description of Artificial Sequence: Synthetic oligonucleotide
gcagagugaaucauacag

SEQ ID NO: 72946 - RNA, 18 nt, Artificial Sequence
  Description of Artificial Sequence: Synthetic oligonucleotide
agccagcagagugaauca

SEQ ID NO: 72947 - RNA, 18 nt, Artificial Sequence
  Description of Artificial Sequence: Synthetic oligonucleotide
ggaguagccagcagagug

SEQ ID NO: 72948 - RNA, 18 nt, Artificial Sequence
  Description of Artificial Sequence: Synthetic oligonucleotide
ccuuaggaguagccagca

SEQ ID NO: 72949 - RNA, 18 nt, Artificial Sequence
  Description of Artificial Sequence: Synthetic oligonucleotide
gggagccuuaggaguagc

SEQ ID NO: 72950 - RNA, 18 nt, Artificial Sequence
  Description of Artificial Sequence: Synthetic oligonucleotide
acacuaaaagcggguggg

SEQ ID NO: 72951 - RNA, 18 nt, Artificial Sequence
  Description of Artificial Sequence: Synthetic oligonucleotide
ggcacacuaaaagcgggu

SEQ ID NO: 72952 - RNA, 18 nt, Artificial Sequence
  Description of Artificial Sequence: Synthetic oligonucleotide
caaagggcacacuaaaag

SEQ ID NO: 72953 - RNA, 18 nt, Artificial Sequence
  Description of Artificial Sequence: Synthetic oligonucleotide
ugccucaaagggcacacu

SEQ ID NO: 72954 - RNA, 18 nt, Artificial Sequence
  Description of Artificial Sequence: Synthetic oligonucleotide
cgcacugccucaaagggc

SEQ ID NO: 72955 - RNA, 18 nt, Artificial Sequence
  Description of Artificial Sequence: Synthetic oligonucleotide
agaagcgcacugccucaa

SEQ ID NO: 72956 - RNA, 18 nt, Artificial Sequence
  Description of Artificial Sequence: Synthetic oligonucleotide
aagagagaagcgcacugc

SEQ ID NO: 72957 - RNA, 18 nt, Artificial Sequence
  Description of Artificial Sequence: Synthetic oligonucleotide
ccugugccuuggucuccu

SEQ ID NO: 72958 - RNA, 18 nt, Artificial Sequence
  Description of Artificial Sequence: Synthetic oligonucleotide
aauguccugugccuuggu

SEQ ID NO: 72959 - RNA, 18 nt, Artificial Sequence
  Description of Artificial Sequence: Synthetic oligonucleotide
cccagaauguccugugcc

SEQ ID NO: 72960 - RNA, 18 nt, Artificial Sequence
  Description of Artificial Sequence: Synthetic oligonucleotide
cugcucccagaauguccu

SEQ ID NO: 72961 - RNA, 18 nt, Artificial Sequence
  Description of Artificial Sequence: Synthetic oligonucleotide
ggucacugcucccagaau

SEQ ID NO: 72962 - RNA, 18 nt, Artificial Sequence
  Description of Artificial Sequence: Synthetic oligonucleotide
agaagggucacugcuccc

SEQ ID NO: 72963 - RNA, 18 nt, Artificial Sequence
  Description of Artificial Sequence: Synthetic oligonucleotide
ccagcagaagggucacug

SEQ ID NO: 72964 - RNA, 18 nt, Artificial Sequence
  Description of Artificial Sequence: Synthetic oligonucleotide
ucccuccagcagaagggu

SEQ ID NO: 72965 - RNA, 18 nt, Artificial Sequence
  Description of Artificial Sequence: Synthetic oligonucleotide
aucacucccuccagcaga

SEQ ID NO: 72966 - RNA, 18 nt, Artificial Sequence
  Description of Artificial Sequence: Synthetic oligonucleotide
cugccaucacucccucca

SEQ ID NO: 72967 - RNA, 18 nt, Artificial Sequence
  Description of Artificial Sequence: Synthetic oligonucleotide
ccgugcugccaucacucc

SEQ ID NO: 72968 - RNA, 18 nt, Artificial Sequence
  Description of Artificial Sequence: Synthetic oligonucleotide
uguccccgugcugccauc

SEQ ID NO: 72969 - RNA, 18 nt, Artificial Sequence
  Description of Artificial Sequence: Synthetic oligonucleotide
ccaguuguccccgugcug

SEQ ID NO: 72970 - RNA, 18 nt, Artificial Sequence
  Description of Artificial Sequence: Synthetic oligonucleotide
gggucccaguuguccccg

SEQ ID NO: 72971 - RNA, 18 nt, Artificial Sequence
  Description of Artificial Sequence: Synthetic oligonucleotide
caagugggucccaguugu

SEQ ID NO: 72972 - RNA, 18 nt, Artificial Sequence
  Description of Artificial Sequence: Synthetic oligonucleotide
agaggcaaguggguccca

SEQ ID NO: 72973 - RNA, 18 nt, Artificial Sequence
  Description of Artificial Sequence: Synthetic oligonucleotide
ggaugagaggcaaguggg

SEQ ID NO: 72974 - RNA, 18 nt, Artificial Sequence
  Description of Artificial Sequence: Synthetic oligonucleotide
aggagggaugagaggcaa

SEQ ID NO: 72975 - RNA, 18 nt, Artificial Sequence
  Description of Artificial Sequence: Synthetic oligonucleotide
gccccaggagggaugaga

SEQ ID NO: 72976 - RNA, 18 nt, Artificial Sequence
  Description of Artificial Sequence: Synthetic oligonucleotide
aagcugccccaggaggga

SEQ ID NO: 72977 - RNA, 18 nt, Artificial Sequence
  Description of Artificial Sequence: Synthetic oligonucleotide
ccagaaagcugccccagg

SEQ ID NO: 72978 - RNA, 18 nt, Artificial Sequence
  Description of Artificial Sequence: Synthetic oligonucleotide
ccuguccagaaagcugcc

SEQ ID NO: 72979 - RNA, 18 nt, Artificial Sequence
  Description of Artificial Sequence: Synthetic oligonucleotide
acggaccuguccagaaag

SEQ ID NO: 72980 - RNA, 18 nt, Artificial Sequence
  Description of Artificial Sequence: Synthetic oligonucleotide
aggagacggaccugucca

SEQ ID NO: 72981 - RNA, 18 nt, Artificial Sequence
  Description of Artificial Sequence: Synthetic oligonucleotide
caaggaggagacggaccu

SEQ ID NO: 72982 - RNA, 18 nt, Artificial Sequence
  Description of Artificial Sequence: Synthetic oligonucleotide
ggccccaaggaggagacg

SEQ ID NO: 72983 - RNA, 18 nt, Artificial Sequence
  Description of Artificial Sequence: Synthetic oligonucleotide
ugcagggccccaaggagg

SEQ ID NO: 72984 - RNA, 18 nt, Artificial Sequence
  Description of Artificial Sequence: Synthetic oligonucleotide
ggcucugcagggccccaa

SEQ ID NO: 72985 - RNA, 18 nt, Artificial Sequence
  Description of Artificial Sequence: Synthetic oligonucleotide
aaggaggcucugcagggc

SEQ ID NO: 72986 - RNA, 18 nt, Artificial Sequence
  Description of Artificial Sequence: Synthetic oligonucleotide
guuccaaggaggcucugc

SEQ ID NO: 72987 - RNA, 18 nt, Artificial Sequence
  Description of Artificial Sequence: Synthetic oligonucleotide
uccugugccuuggucucc

SEQ ID NO: 72988 - RNA, 18 nt, Artificial Sequence
  Description of Artificial Sequence: Synthetic oligonucleotide
gaauguccugugccuugg

SEQ ID NO: 72989 - RNA, 18 nt, Artificial Sequence
  Description of Artificial Sequence: Synthetic oligonucleotide
ucccagaauguccugugc

SEQ ID NO: 72990 - RNA, 18 nt, Artificial Sequence
  Description of Artificial Sequence: Synthetic oligonucleotide
acugcucccagaaugucc

SEQ ID NO: 72991 - RNA, 18 nt, Artificial Sequence
  Description of Artificial Sequence: Synthetic oligonucleotide
gggucacugcucccagaa

SEQ ID NO: 72992 - RNA, 18 nt, Artificial Sequence
  Description of Artificial Sequence: Synthetic oligonucleotide
cagaagggucacugcucc

SEQ ID NO: 72993 - RNA, 18 nt, Artificial Sequence
  Description of Artificial Sequence: Synthetic oligonucleotide
uccagcagaagggucacu

SEQ ID NO: 72994 - RNA, 18 nt, Artificial Sequence
  Description of Artificial Sequence: Synthetic oligonucleotide
cucccuccagcagaaggg

SEQ ID NO: 72995 - RNA, 18 nt, Artificial Sequence
  Description of Artificial Sequence: Synthetic oligonucleotide
caucacucccuccagcag

SEQ ID NO: 72996 - RNA, 18 nt, Artificial Sequence
  Description of Artificial Sequence: Synthetic oligonucleotide
gcugccaucacucccucc

SEQ ID NO: 72997 - RNA, 18 nt, Artificial Sequence
  Description of Artificial Sequence: Synthetic oligonucleotide
cccgugcugccaucacuc

SEQ ID NO: 72998 - RNA, 18 nt, Artificial Sequence
  Description of Artificial Sequence: Synthetic oligonucleotide
uuguccccgugcugccau

SEQ ID NO: 72999 - RNA, 18 nt, Artificial Sequence
  Description of Artificial Sequence: Synthetic oligonucleotide
cccaguuguccccgugcu

SEQ ID NO: 73000 - RNA, 18 nt, Artificial Sequence
  Description of Artificial Sequence: Synthetic oligonucleotide
ugggucccaguugucccc

SEQ ID NO: 73001 - RNA, 18 nt, Artificial Sequence
  Description of Artificial Sequence: Synthetic oligonucleotide
gcaagugggucccaguug

SEQ ID NO: 73002 - RNA, 18 nt, Artificial Sequence
  Description of Artificial Sequence: Synthetic oligonucleotide
gagaggcaaguggguccc

SEQ ID NO: 73003 - RNA, 18 nt, Artificial Sequence
  Description of Artificial Sequence: Synthetic oligonucleotide
gggaugagaggcaagugg

SEQ ID NO: 73004 - RNA, 18 nt, Artificial Sequence
  Description of Artificial Sequence: Synthetic oligonucleotide
caggagggaugagaggca

SEQ ID NO: 73005 - RNA, 18 nt, Artificial Sequence
  Description of Artificial Sequence: Synthetic oligonucleotide
ugccccaggagggaugag

SEQ ID NO: 73006 - RNA, 18 nt, Artificial Sequence
  Description of Artificial Sequence: Synthetic oligonucleotide
aaagcugccccaggaggg

SEQ ID NO: 73007 - RNA, 18 nt, Artificial Sequence
  Description of Artificial Sequence: Synthetic oligonucleotide
uccagaaagcugccccag

SEQ ID NO: 73008 - RNA, 18 nt, Artificial Sequence
  Description of Artificial Sequence: Synthetic oligonucleotide
accuguccagaaagcugc

SEQ ID NO: 73009 - RNA, 18 nt, Artificial Sequence
  Description of Artificial Sequence: Synthetic oligonucleotide
gacggaccuguccagaaa

SEQ ID NO: 73010 - RNA, 18 nt, Artificial Sequence
  Description of Artificial Sequence: Synthetic oligonucleotide
gaggagacggaccugucc

SEQ ID NO: 73011 - RNA, 18 nt, Artificial Sequence
  Description of Artificial Sequence: Synthetic oligonucleotide
ccaaggaggagacggacc

SEQ ID NO: 73012 - RNA, 18 nt, Artificial Sequence
  Description of Artificial Sequence: Synthetic oligonucleotide
gggccccaaggaggagac

SEQ ID NO: 73013 - RNA, 18 nt, Artificial Sequence
  Description of Artificial Sequence: Synthetic oligonucleotide
cugcagggccccaaggag

SEQ ID NO: 73014 - RNA, 18 nt, Artificial Sequence
  Description of Artificial Sequence: Synthetic oligonucleotide
aggcucugcagggcccca

SEQ ID NO: 73015 - RNA, 18 nt, Artificial Sequence
  Description of Artificial Sequence: Synthetic oligonucleotide
caaggaggcucugcaggg

SEQ ID NO: 73016 - RNA, 18 nt, Artificial Sequence
  Description of Artificial Sequence: Synthetic oligonucleotide
gguuccaaggaggcucug

SEQ ID NO: 73017 - RNA, 18 nt, Artificial Sequence
  Description of Artificial Sequence: Synthetic oligonucleotide
ucuacagaucccuugacu

SEQ ID NO: 73018 - RNA, 18 nt, Artificial Sequence
  Description of Artificial Sequence: Synthetic oligonucleotide
caguuucuacagaucccu

SEQ ID NO: 73019 - RNA, 18 nt, Artificial Sequence
  Description of Artificial Sequence: Synthetic oligonucleotide
aagaacaguuucuacaga

SEQ ID NO: 73020 - RNA, 18 nt, Artificial Sequence
  Description of Artificial Sequence: Synthetic oligonucleotide
cagaaaagaacaguuucu

SEQ ID NO: 73021 - RNA, 18 nt, Artificial Sequence
  Description of Artificial Sequence: Synthetic oligonucleotide
ugagucagaaaagaacag

SEQ ID NO: 73022 - RNA, 18 nt, Artificial Sequence
  Description of Artificial Sequence: Synthetic oligonucleotide
gggacugagucagaaaag

SEQ ID NO: 73023 - RNA, 18 nt, Artificial Sequence
  Description of Artificial Sequence: Synthetic oligonucleotide
cuucccucaggucuucua

SEQ ID NO: 73024 - RNA, 18 nt, Artificial Sequence
  Description of Artificial Sequence: Synthetic oligonucleotide
cccuucuucccucagguc

SEQ ID NO: 73025 - RNA, 18 nt, Artificial Sequence
  Description of Artificial Sequence: Synthetic oligonucleotide
aagagcccuucuucccuc

SEQ ID NO: 73026 - RNA, 18 nt, Artificial Sequence
  Description of Artificial Sequence: Synthetic oligonucleotide
ccuggaagagcccuucuu

SEQ ID NO: 73027 - RNA, 18 nt, Artificial Sequence
  Description of Artificial Sequence: Synthetic oligonucleotide
agcucccuggaagagccc

SEQ ID NO: 73028 - RNA, 18 nt, Artificial Sequence
  Description of Artificial Sequence: Synthetic oligonucleotide
ccuugagcucccuggaag

SEQ ID NO: 73029 - RNA, 18 nt, Artificial Sequence
  Description of Artificial Sequence: Synthetic oligonucleotide
ucugcccuugagcucccu

SEQ ID NO: 73030 - RNA, 18 nt, Artificial Sequence
  Description of Artificial Sequence: Synthetic oligonucleotide
gcucuucugcccuugagc

SEQ ID NO: 73031 - RNA, 18 nt, Artificial Sequence
  Description of Artificial Sequence: Synthetic oligonucleotide
gaucagcucuucugcccu

SEQ ID NO: 73032 - RNA, 18 nt, Artificial Sequence
  Description of Artificial Sequence: Synthetic oligonucleotide
uaguagaucagcucuucu

SEQ ID NO: 73033 - RNA, 18 nt, Artificial Sequence
  Description of Artificial Sequence: Synthetic oligonucleotide
acucuuaguagaucagcu

SEQ ID NO: 73034 - RNA, 18 nt, Artificial Sequence
  Description of Artificial Sequence: Synthetic oligonucleotide
ggagcacucuuaguagau

SEQ ID NO: 73035 - RNA, 18 nt, Artificial Sequence
  Description of Artificial Sequence: Synthetic oligonucleotide
ggcagggagcacucuuag

SEQ ID NO: 73036 - RNA, 18 nt, Artificial Sequence
  Description of Artificial Sequence: Synthetic oligonucleotide
uggcuggcagggagcacu

SEQ ID NO: 73037 - RNA, 18 nt, Artificial Sequence
  Description of Artificial Sequence: Synthetic oligonucleotide
cauuguggcuggcaggga

SEQ ID NO: 73038 - RNA, 18 nt, Artificial Sequence
  Description of Artificial Sequence: Synthetic oligonucleotide
ccaggcauuguggcuggc

SEQ ID NO: 73039 - RNA, 18 nt, Artificial Sequence
  Description of Artificial Sequence: Synthetic oligonucleotide
aguacccaggcauugugg

SEQ ID NO: 73040 - RNA, 18 nt, Artificial Sequence
  Description of Artificial Sequence: Synthetic oligonucleotide
gaucagcucuucugcccu

SEQ ID NO: 73041 - RNA, 18 nt, Artificial Sequence
  Description of Artificial Sequence: Synthetic oligonucleotide
uaguagaucagcucuucu

SEQ ID NO: 73042 - RNA, 18 nt, Artificial Sequence
  Description of Artificial Sequence: Synthetic oligonucleotide
acucuuaguagaucagcu

SEQ ID NO: 73043 - RNA, 18 nt, Artificial Sequence
  Description of Artificial Sequence: Synthetic oligonucleotide
ggagcacucuuaguagau

SEQ ID NO: 73044 - RNA, 18 nt, Artificial Sequence
  Description of Artificial Sequence: Synthetic oligonucleotide
ggcagggagcacucuuag

SEQ ID NO: 73045 - RNA, 18 nt, Artificial Sequence
  Description of Artificial Sequence: Synthetic oligonucleotide
uggcuggcagggagcacu

SEQ ID NO: 73046 - RNA, 18 nt, Artificial Sequence
  Description of Artificial Sequence: Synthetic oligonucleotide
cauuguggcuggcaggga

SEQ ID NO: 73047 - RNA, 18 nt, Artificial Sequence
  Description of Artificial Sequence: Synthetic oligonucleotide
ccaggcauuguggcuggc

SEQ ID NO: 73048 - RNA, 18 nt, Artificial Sequence
  Description of Artificial Sequence: Synthetic oligonucleotide
aguacccaggcauugugg

SEQ ID NO: 73049 - RNA, 18 nt, Artificial Sequence
  Description of Artificial Sequence: Synthetic oligonucleotide
augccaguacccaggcau

SEQ ID NO: 73050 - RNA, 18 nt, Artificial Sequence
  Description of Artificial Sequence: Synthetic oligonucleotide
acaggaugccaguaccca

SEQ ID NO: 73051 - RNA, 18 nt, Artificial Sequence
  Description of Artificial Sequence: Synthetic oligonucleotide
gaaagacaggaugccagu

SEQ ID NO: 73052 - RNA, 18 nt, Artificial Sequence
  Description of Artificial Sequence: Synthetic oligonucleotide
aguaggaaagacaggaug

SEQ ID NO: 73053 - RNA, 18 nt, Artificial Sequence
  Description of Artificial Sequence: Synthetic oligonucleotide
gucuaaguaggaaagaca

SEQ ID NO: 73054 - RNA, 18 nt, Artificial Sequence
  Description of Artificial Sequence: Synthetic oligonucleotide
cccuugucuaaguaggaa

SEQ ID NO: 73055 - RNA, 18 nt, Artificial Sequence
  Description of Artificial Sequence: Synthetic oligonucleotide
ggccucccuugucuaagu

SEQ ID NO: 73056 - RNA, 18 nt, Artificial Sequence
  Description of Artificial Sequence: Synthetic oligonucleotide
ucucaggccucccuuguc

SEQ ID NO: 73057 - RNA, 18 nt, Artificial Sequence
  Description of Artificial Sequence: Synthetic oligonucleotide
ccagaucucaggccuccc

SEQ ID NO: 73058 - RNA, 18 nt, Artificial Sequence
  Description of Artificial Sequence: Synthetic oligonucleotide
cagggccagaucucaggc

SEQ ID NO: 73059 - RNA, 18 nt, Artificial Sequence
  Description of Artificial Sequence: Synthetic oligonucleotide
aacaccagggccagaucu

SEQ ID NO: 73060 - RNA, 18 nt, Artificial Sequence
  Description of Artificial Sequence: Synthetic oligonucleotide
ggccaaacaccagggcca

SEQ ID NO: 73061 - RNA, 18 nt, Artificial Sequence
  Description of Artificial Sequence: Synthetic oligonucleotide
ccugaggccaaacaccag

SEQ ID NO: 73062 - RNA, 18 nt, Artificial Sequence
  Description of Artificial Sequence: Synthetic oligonucleotide
augguccugaggccaaac

SEQ ID NO: 73063 - RNA, 18 nt, Artificial Sequence
  Description of Artificial Sequence: Synthetic oligonucleotide
agaggaugguccugaggc

SEQ ID NO: 73064 - RNA, 18 nt, Artificial Sequence
  Description of Artificial Sequence: Synthetic oligonucleotide
agggcagaggaugguccu

SEQ ID NO: 73065 - RNA, 18 nt, Artificial Sequence
  Description of Artificial Sequence: Synthetic oligonucleotide
ugugagcugugguccugc

SEQ ID NO: 73066 - RNA, 18 nt, Artificial Sequence
  Description of Artificial Sequence: Synthetic oligonucleotide
auccuugugagcuguggu

SEQ ID NO: 73067 - RNA, 18 nt, Artificial Sequence
  Description of Artificial Sequence: Synthetic oligonucleotide
uugggauccuugugagcu

SEQ ID NO: 73068 - RNA, 18 nt, Artificial Sequence
  Description of Artificial Sequence: Synthetic oligonucleotide
uggcauugggauccuugu

SEQ ID NO: 73069 - RNA, 18 nt, Artificial Sequence
  Description of Artificial Sequence: Synthetic oligonucleotide
gaagauggcauugggauc

SEQ ID NO: 73070 - RNA, 18 nt, Artificial Sequence
  Description of Artificial Sequence: Synthetic oligonucleotide
cucaggaagauggcauug

SEQ ID NO: 73071 - RNA, 18 nt, Artificial Sequence
  Description of Artificial Sequence: Synthetic oligonucleotide
ggaagcucaggaagaugg

SEQ ID NO: 73072 - RNA, 18 nt, Artificial Sequence
  Description of Artificial Sequence: Synthetic oligonucleotide
guguuggaagcucaggaa

SEQ ID NO: 73073 - RNA, 18 nt, Artificial Sequence
  Description of Artificial Sequence: Synthetic oligonucleotide
agcagguguuggaagcuc

SEQ ID NO: 73074 - RNA, 18 nt, Artificial Sequence
  Description of Artificial Sequence: Synthetic oligonucleotide
cucggagcagguguugga

SEQ ID NO: 73075 - RNA, 18 nt, Artificial Sequence
  Description of Artificial Sequence: Synthetic oligonucleotide
cuuuccucggagcaggug

SEQ ID NO: 73076 - RNA, 18 nt, Artificial Sequence
  Description of Artificial Sequence: Synthetic oligonucleotide
cgcaccuuuccucggagc

SEQ ID NO: 73077 - RNA, 18 nt, Artificial Sequence
  Description of Artificial Sequence: Synthetic oligonucleotide
ggaaacgcaccuuuccuc

SEQ ID NO: 73078 - RNA, 18 nt, Artificial Sequence
  Description of Artificial Sequence: Synthetic oligonucleotide
caucaggaaacgcaccuu

SEQ ID NO: 73079 - RNA, 18 nt, Artificial Sequence
  Description of Artificial Sequence: Synthetic oligonucleotide
acaagcaucaggaaacgc

SEQ ID NO: 73080 - RNA, 18 nt, Artificial Sequence
  Description of Artificial Sequence: Synthetic oligonucleotide
cuccuacaagcaucagga

SEQ ID NO: 73081 - RNA, 18 nt, Artificial Sequence
  Description of Artificial Sequence: Synthetic oligonucleotide
ggacccuccuacaagcau

SEQ ID NO: 73082 - RNA, 18 nt, Artificial Sequence
  Description of Artificial Sequence: Synthetic oligonucleotide
aggguggacccuccuaca

SEQ ID NO: 73083 - RNA, 18 nt, Artificial Sequence
  Description of Artificial Sequence: Synthetic oligonucleotide
cgcagaggguggacccuc

SEQ ID NO: 73084 - RNA, 18 nt, Artificial Sequence
  Description of Artificial Sequence: Synthetic oligonucleotide
ccugacgcagagggugga

SEQ ID NO: 73085 - RNA, 18 nt, Artificial Sequence
  Description of Artificial Sequence: Synthetic oligonucleotide
gcccgccugacgcagagg

SEQ ID NO: 73086 - RNA, 18 nt, Artificial Sequence
  Description of Artificial Sequence: Synthetic oligonucleotide
gggcccgccugacgcaga

SEQ ID NO: 73087 - RNA, 18 nt, Artificial Sequence
  Description of Artificial Sequence: Synthetic oligonucleotide
acagcugugguggguggg

SEQ ID NO: 73088 - RNA, 18 nt, Artificial Sequence
  Description of Artificial Sequence: Synthetic oligonucleotide
gggacagcuguggugggu

SEQ ID NO: 73089 - RNA, 18 nt, Artificial Sequence
  Description of Artificial Sequence: Synthetic oligonucleotide
uagagagguucugcuggg

SEQ ID NO: 73090 - RNA, 18 nt, Artificial Sequence
  Description of Artificial Sequence: Synthetic oligonucleotide
aggacuagagagguucug

SEQ ID NO: 73091 - RNA, 18 nt, Artificial Sequence
  Description of Artificial Sequence: Synthetic oligonucleotide
gugugaggacuagagagg

SEQ ID NO: 73092 - RNA, 18 nt, Artificial Sequence
  Description of Artificial Sequence: Synthetic oligonucleotide
guucagugugaggacuag

SEQ ID NO: 73093 - RNA, 18 nt, Artificial Sequence
  Description of Artificial Sequence: Synthetic oligonucleotide
agcucguucagugugagg

SEQ ID NO: 73094 - RNA, 18 nt, Artificial Sequence
  Description of Artificial Sequence: Synthetic oligonucleotide
uugggagcucguucagug

SEQ ID NO: 73095 - RNA, 18 nt, Artificial Sequence
  Description of Artificial Sequence: Synthetic oligonucleotide
ccuguuugggagcucguu

SEQ ID NO: 73096 - RNA, 18 nt, Artificial Sequence
  Description of Artificial Sequence: Synthetic oligonucleotide
gaaguccuguuugggagc

SEQ ID NO: 73097 - RNA, 18 nt, Artificial Sequence
  Description of Artificial Sequence: Synthetic oligonucleotide
auccagaaguccuguuug

SEQ ID NO: 73098 - RNA, 18 nt, Artificial Sequence
  Description of Artificial Sequence: Synthetic oligonucleotide
caacaauccagaaguccu

SEQ ID NO: 73099 - RNA, 18 nt, Artificial Sequence
  Description of Artificial Sequence: Synthetic oligonucleotide
gucuccaacaauccagaa

SEQ ID NO: 73100 - RNA, 18 nt, Artificial Sequence
  Description of Artificial Sequence: Synthetic oligonucleotide
aguuugucuccaacaauc

SEQ ID NO: 73101 - RNA, 18 nt, Artificial Sequence
  Description of Artificial Sequence: Synthetic oligonucleotide
agugaaguuugucuccaa

SEQ ID NO: 73102 - RNA, 18 nt, Artificial Sequence
  Description of Artificial Sequence: Synthetic oligonucleotide
gaggcagugaaguuuguc

SEQ ID NO: 73103 - RNA, 18 nt, Artificial Sequence
  Description of Artificial Sequence: Synthetic oligonucleotide
uggcugaggcagugaagu

SEQ ID NO: 73104 - RNA, 18 nt, Artificial Sequence
  Description of Artificial Sequence: Synthetic oligonucleotide
aguucuggcugaggcagu

SEQ ID NO: 73105 - RNA, 18 nt, Artificial Sequence
  Description of Artificial Sequence: Synthetic oligonucleotide
ccaguaguucuggcugag

SEQ ID NO: 73106 - RNA, 18 nt, Artificial Sequence
  Description of Artificial Sequence: Synthetic oligonucleotide
cagagccaguaguucugg

SEQ ID NO: 73107 - RNA, 18 nt, Artificial Sequence
  Description of Artificial Sequence: Synthetic oligonucleotide
aagcccagagccaguagu

SEQ ID NO: 73108 - RNA, 18 nt, Artificial Sequence
  Description of Artificial Sequence: Synthetic oligonucleotide
uucagaagcccagagcca

SEQ ID NO: 73109 - RNA, 18 nt, Artificial Sequence
  Description of Artificial Sequence: Synthetic oligonucleotide
gccacuucagaagcccag

SEQ ID NO: 73110 - RNA, 18 nt, Artificial Sequence
  Description of Artificial Sequence: Synthetic oligonucleotide
cugcugccacuucagaag

SEQ ID NO: 73111 - RNA, 18 nt, Artificial Sequence
  Description of Artificial Sequence: Synthetic oligonucleotide
aaucccugcugccacuuc

SEQ ID NO: 73112 - RNA, 18 nt, Artificial Sequence
  Description of Artificial Sequence: Synthetic oligonucleotide
cucugaaucccugcugcc

SEQ ID NO: 73113 - RNA, 18 nt, Artificial Sequence
  Description of Artificial Sequence: Synthetic oligonucleotide
cuuggcucugaaucccug

SEQ ID NO: 73114 - RNA, 18 nt, Artificial Sequence
  Description of Artificial Sequence: Synthetic oligonucleotide
ggaaucuuggcucugaau

SEQ ID NO: 73115 - RNA, 18 nt, Artificial Sequence
  Description of Artificial Sequence: Synthetic oligonucleotide
gaccaggaaucuuggcuc

SEQ ID NO: 73116 - RNA, 18 nt, Artificial Sequence
  Description of Artificial Sequence: Synthetic oligonucleotide
cagcagaccaggaaucuu

SEQ ID NO: 73117 - RNA, 18 nt, Artificial Sequence
  Description of Artificial Sequence: Synthetic oligonucleotide
ugguucagcagaccagga

SEQ ID NO: 73118 - RNA, 18 nt, Artificial Sequence
  Description of Artificial Sequence: Synthetic oligonucleotide
agguuugguucagcagac

SEQ ID NO: 73119 - RNA, 18 nt, Artificial Sequence
  Description of Artificial Sequence: Synthetic oligonucleotide
ccuggagguuugguucag

SEQ ID NO: 73120 - RNA, 18 nt, Artificial Sequence
  Description of Artificial Sequence: Synthetic oligonucleotide
agggaccuggagguuugg

SEQ ID NO: 73121 - RNA, 18 nt, Artificial Sequence
  Description of Artificial Sequence: Synthetic oligonucleotide
gguccagggaccuggagg

SEQ ID NO: 73122 - RNA, 18 nt, Artificial Sequence
  Description of Artificial Sequence: Synthetic oligonucleotide
gauuugguccagggaccu

SEQ ID NO: 73123 - RNA, 18 nt, Artificial Sequence
  Description of Artificial Sequence: Synthetic oligonucleotide
gggauuugguccagggac

SEQ ID NO: 73124 - RNA, 18 nt, Artificial Sequence
  Description of Artificial Sequence: Synthetic oligonucleotide
ccuguucagguauccggg

SEQ ID NO: 73125 - RNA, 18 nt, Artificial Sequence
  Description of Artificial Sequence: Synthetic oligonucleotide
uguauccuguucagguau

SEQ ID NO: 73126 - RNA, 18 nt, Artificial Sequence
  Description of Artificial Sequence: Synthetic oligonucleotide
guucguguauccuguuca

SEQ ID NO: 73127 - RNA, 18 nt, Artificial Sequence
  Description of Artificial Sequence: Synthetic oligonucleotide
caagaguucguguauccu

SEQ ID NO: 73128 - RNA, 18 nt, Artificial Sequence
  Description of Artificial Sequence: Synthetic oligonucleotide
ccauucaagaguucgugu

SEQ ID NO: 73129 - RNA, 18 nt, Artificial Sequence
  Description of Artificial Sequence: Synthetic oligonucleotide
gaguuccauucaagaguu

SEQ ID NO: 73130 - RNA, 18 nt, Artificial Sequence
  Description of Artificial Sequence: Synthetic oligonucleotide
uccacgaguuccauucaa

SEQ ID NO: 73131 - RNA, 18 nt, Artificial Sequence
  Description of Artificial Sequence: Synthetic oligonucleotide
aagaguccacgaguucca

SEQ ID NO: 73132 - RNA, 18 nt, Artificial Sequence
  Description of Artificial Sequence: Synthetic oligonucleotide
caggaaagaguccacgag

SEQ ID NO: 73133 - RNA, 18 nt, Artificial Sequence
  Description of Artificial Sequence: Synthetic oligonucleotide
ggguccaggaaagagucc

SEQ ID NO: 73134 - RNA, 18 nt, Artificial Sequence
  Description of Artificial Sequence: Synthetic oligonucleotide
cgugaggguccaggaaag

SEQ ID NO: 73135 - RNA, 18 nt, Artificial Sequence
  Description of Artificial Sequence: Synthetic oligonucleotide
uccugcgugaggguccag

SEQ ID NO: 73136 - RNA, 18 nt, Artificial Sequence
  Description of Artificial Sequence: Synthetic oligonucleotide
uaggguccugcgugaggg

SEQ ID NO: 73137 - RNA, 18 nt, Artificial Sequence
  Description of Artificial Sequence: Synthetic oligonucleotide
gcuccuaggguccugcgu

SEQ ID NO: 73138 - RNA, 18 nt, Artificial Sequence
  Description of Artificial Sequence: Synthetic oligonucleotide
gggcuccuaggguccugc

SEQ ID NO: 73139 - RNA, 18 nt, Artificial Sequence
  Description of Artificial Sequence: Synthetic oligonucleotide
ccugaggaaauguccggg

SEQ ID NO: 73140 - RNA, 18 nt, Artificial Sequence
  Description of Artificial Sequence: Synthetic oligonucleotide
auguuccugaggaaaugu

SEQ ID NO: 73141 - RNA, 18 nt, Artificial Sequence
  Description of Artificial Sequence: Synthetic oligonucleotide
gucugauguuccugagga

SEQ ID NO: 73142 - RNA, 18 nt, Artificial Sequence
  Description of Artificial Sequence: Synthetic oligonucleotide
ccugugucugauguuccu

SEQ ID NO: 73143 - RNA, 18 nt, Artificial Sequence
  Description of Artificial Sequence: Synthetic oligonucleotide
gggagccugugucugaug

SEQ ID NO: 73144 - RNA, 18 nt, Artificial Sequence
  Description of Artificial Sequence: Synthetic oligonucleotide
uggcagggagccuguguc

SEQ ID NO: 73145 - RNA, 18 nt, Artificial Sequence
  Description of Artificial Sequence: Synthetic oligonucleotide
uuggguggcagggagccu

SEQ ID NO: 73146 - RNA, 18 nt, Artificial Sequence
  Description of Artificial Sequence: Synthetic oligonucleotide
ggagguuggguggcaggg

SEQ ID NO: 73147 - RNA, 18 nt, Artificial Sequence
  Description of Artificial Sequence: Synthetic oligonucleotide
aggcuggagguugggugg

SEQ ID NO: 73148 - RNA, 18 nt, Artificial Sequence
  Description of Artificial Sequence: Synthetic oligonucleotide
uauccaggcuggagguug

SEQ ID NO: 73149 - RNA, 18 nt, Artificial Sequence
  Description of Artificial Sequence: Synthetic oligonucleotide
gagaauauccaggcugga

SEQ ID NO: 73150 - RNA, 18 nt, Artificial Sequence
  Description of Artificial Sequence: Synthetic oligonucleotide
ggaaggagaauauccagg

SEQ ID NO: 73151 - RNA, 18 nt, Artificial Sequence
  Description of Artificial Sequence: Synthetic oligonucleotide
gggaaggagaauauccag

SEQ ID NO: 73152 - RNA, 18 nt, Artificial Sequence
  Description of Artificial Sequence: Synthetic oligonucleotide
guaggaggauggguuggg

SEQ ID NO: 73153 - RNA, 18 nt, Artificial Sequence
  Description of Artificial Sequence: Synthetic oligonucleotide
guccaguaggaggauggg

SEQ ID NO: 73154 - RNA, 18 nt, Artificial Sequence
  Description of Artificial Sequence: Synthetic oligonucleotide
auacuguccaguaggagg

SEQ ID NO: 73155 - RNA, 18 nt, Artificial Sequence
  Description of Artificial Sequence: Synthetic oligonucleotide
agcguauacuguccagua

SEQ ID NO: 73156 - RNA, 18 nt, Artificial Sequence
  Description of Artificial Sequence: Synthetic oligonucleotide
ggaagagcguauacuguc

SEQ ID NO: 73157 - RNA, 18 nt, Artificial Sequence
  Description of Artificial Sequence: Synthetic oligonucleotide
aagagggaagagcguaua

SEQ ID NO: 73158 - RNA, 18 nt, Artificial Sequence
  Description of Artificial Sequence: Synthetic oligonucleotide
gguggaagagggaagagc

SEQ ID NO: 73159 - RNA, 18 nt, Artificial Sequence
  Description of Artificial Sequence: Synthetic oligonucleotide
agguggguggaagaggga

SEQ ID NO: 73160 - RNA, 18 nt, Artificial Sequence
  Description of Artificial Sequence: Synthetic oligonucleotide
gggcaagguggguggaag

SEQ ID NO: 73161 - RNA, 18 nt, Artificial Sequence
  Description of Artificial Sequence: Synthetic oligonucleotide
gggugggcaaggugggug

SEQ ID NO: 73162 - RNA, 18 nt, Artificial Sequence
  Description of Artificial Sequence: Synthetic oligonucleotide
uggagcuggaccacaggg

SEQ ID NO: 73163 - RNA, 18 nt, Artificial Sequence
  Description of Artificial Sequence: Synthetic oligonucleotide
ggguggagcuggaccaca

SEQ ID NO: 73164 - RNA, 18 nt, Artificial Sequence
  Description of Artificial Sequence: Synthetic oligonucleotide
aagggucaggaagcaggg

SEQ ID NO: 73165 - RNA, 18 nt, Artificial Sequence
  Description of Artificial Sequence: Synthetic oligonucleotide
agcagaagggucaggaag

SEQ ID NO: 73166 - RNA, 18 nt, Artificial Sequence
  Description of Artificial Sequence: Synthetic oligonucleotide
guuggagcagaaggguca

SEQ ID NO: 73167 - RNA, 18 nt, Artificial Sequence
  Description of Artificial Sequence: Synthetic oligonucleotide
ugggcguuggagcagaag

SEQ ID NO: 73168 - RNA, 18 nt, Artificial Sequence
  Description of Artificial Sequence: Synthetic oligonucleotide
gggugggcguuggagcag

SEQ ID NO: 73169 - RNA, 18 nt, Artificial Sequence
  Description of Artificial Sequence: Synthetic oligonucleotide
agaagagggcugguaggg

SEQ ID NO: 73170 - RNA, 18 nt, Artificial Sequence
  Description of Artificial Sequence: Synthetic oligonucleotide
uguuuagaagagggcugg

SEQ ID NO: 73171 - RNA, 18 nt, Artificial Sequence
  Description of Artificial Sequence: Synthetic oligonucleotide
ggauguguuuagaagagg

SEQ ID NO: 73172 - RNA, 18 nt, Artificial Sequence
  Description of Artificial Sequence: Synthetic oligonucleotide
guguaggauguguuuaga

SEQ ID NO: 73173 - RNA, 18 nt, Artificial Sequence
  Description of Artificial Sequence: Synthetic oligonucleotide
aguggguguaggaugugu

SEQ ID NO: 73174 - RNA, 18 nt, Artificial Sequence
  Description of Artificial Sequence: Synthetic oligonucleotide
cugggaguggguguagga

SEQ ID NO: 73175 - RNA, 18 nt, Artificial Sequence
  Description of Artificial Sequence: Synthetic oligonucleotide
agauucugggagugggug

SEQ ID NO: 73176 - RNA, 18 nt, Artificial Sequence
  Description of Artificial Sequence: Synthetic oligonucleotide
gagacagauucugggagu

SEQ ID NO: 73177 - RNA, 18 nt, Artificial Sequence
  Description of Artificial Sequence: Synthetic oligonucleotide
uuccugagacagauucug

SEQ ID NO: 73178 - RNA, 18 nt, Artificial Sequence
  Description of Artificial Sequence: Synthetic oligonucleotide
uacccuuccugagacaga

SEQ ID NO: 73179 - RNA, 18 nt, Artificial Sequence
  Description of Artificial Sequence: Synthetic oligonucleotide
aaccuuacccuuccugag

SEQ ID NO: 73180 - RNA, 18 nt, Artificial Sequence
  Description of Artificial Sequence: Synthetic oligonucleotide
cugagaaccuuacccuuc

SEQ ID NO: 73181 - RNA, 18 nt, Artificial Sequence
  Description of Artificial Sequence: Synthetic oligonucleotide
agugucugagaaccuuac

SEQ ID NO: 73182 - RNA, 18 nt, Artificial Sequence
  Description of Artificial Sequence: Synthetic oligonucleotide
ucggcagugucugagaac

SEQ ID NO: 73183 - RNA, 18 nt, Artificial Sequence
  Description of Artificial Sequence: Synthetic oligonucleotide
ugaugucggcagugucug

SEQ ID NO: 73184 - RNA, 18 nt, Artificial Sequence
  Description of Artificial Sequence: Synthetic oligonucleotide
aaugcugaugucggcagu

SEQ ID NO: 73185 - RNA, 18 nt, Artificial Sequence
  Description of Artificial Sequence: Synthetic oligonucleotide
gagacaaugcugaugucg

SEQ ID NO: 73186 - RNA, 18 nt, Artificial Sequence
  Description of Artificial Sequence: Synthetic oligonucleotide
uacacgagacaaugcuga

SEQ ID NO: 73187 - RNA, 18 nt, Artificial Sequence
  Description of Artificial Sequence: Synthetic oligonucleotide
agcuguacacgagacaau

SEQ ID NO: 73188 - RNA, 18 nt, Artificial Sequence
  Description of Artificial Sequence: Synthetic oligonucleotide
aagggagcuguacacgag

SEQ ID NO: 73189 - RNA, 18 nt, Artificial Sequence
  Description of Artificial Sequence: Synthetic oligonucleotide
cagggaagggagcuguac

SEQ ID NO: 73190 - RNA, 18 nt, Artificial Sequence
  Description of Artificial Sequence: Synthetic oligonucleotide
cccugcagggaagggagc

SEQ ID NO: 73191 - RNA, 18 nt, Artificial Sequence
  Description of Artificial Sequence: Synthetic oligonucleotide
gggcgcccugcagggaag

SEQ ID NO: 73192 - RNA, 18 nt, Artificial Sequence
  Description of Artificial Sequence: Synthetic oligonucleotide
cuuguccaguugucuccc

SEQ ID NO: 73193 - RNA, 18 nt, Artificial Sequence
  Description of Artificial Sequence: Synthetic oligonucleotide
gaaaucuuguccaguugu

SEQ ID NO: 73194 - RNA, 18 nt, Artificial Sequence
  Description of Artificial Sequence: Synthetic oligonucleotide
aguaggaaaucuugucca

SEQ ID NO: 73195 - RNA, 18 nt, Artificial Sequence
  Description of Artificial Sequence: Synthetic oligonucleotide
gagaaaguaggaaaucuu

SEQ ID NO: 73196 - RNA, 18 nt, Artificial Sequence
  Description of Artificial Sequence: Synthetic oligonucleotide
uucaggagaaaguaggaa

SEQ ID NO: 73197 - RNA, 18 nt, Artificial Sequence
  Description of Artificial Sequence: Synthetic oligonucleotide
uggguuucaggagaaagu

SEQ ID NO: 73198 - RNA, 18 nt, Artificial Sequence
  Description of Artificial Sequence: Synthetic oligonucleotide
ggcuuuggguuucaggag

SEQ ID NO: 73199 - RNA, 18 nt, Artificial Sequence
  Description of Artificial Sequence: Synthetic oligonucleotide
accagggcuuuggguuuc

SEQ ID NO: 73200 - RNA, 18 nt, Artificial Sequence
  Description of Artificial Sequence: Synthetic oligonucleotide
cuuuuaccagggcuuugg

SEQ ID NO: 73201 - RNA, 18 nt, Artificial Sequence
  Description of Artificial Sequence: Synthetic oligonucleotide
uaucccuuuuaccagggc

SEQ ID NO: 73202 - RNA, 18 nt, Artificial Sequence
  Description of Artificial Sequence: Synthetic oligonucleotide
cuguguaucccuuuuacc

SEQ ID NO: 73203 - RNA, 18 nt, Artificial Sequence
  Description of Artificial Sequence: Synthetic oligonucleotide
caguccuguguaucccuu

SEQ ID NO: 73204 - RNA, 18 nt, Artificial Sequence
  Description of Artificial Sequence: Synthetic oligonucleotide
cuuuucaguccuguguau

SEQ ID NO: 73205 - RNA, 18 nt, Artificial Sequence
  Description of Artificial Sequence: Synthetic oligonucleotide
auucccuuuucaguccug

SEQ ID NO: 73206 - RNA, 18 nt, Artificial Sequence
  Description of Artificial Sequence: Synthetic oligonucleotide
aaaugauucccuuuucag

SEQ ID NO: 73207 - RNA, 18 nt, Artificial Sequence
  Description of Artificial Sequence: Synthetic oligonucleotide
gugaaaaaugauucccuu

SEQ ID NO: 73208 - RNA, 18 nt, Artificial Sequence
  Description of Artificial Sequence: Synthetic oligonucleotide
guacagugaaaaaugauu

SEQ ID NO: 73209 - RNA, 18 nt, Artificial Sequence
  Description of Artificial Sequence: Synthetic oligonucleotide
auaauguacagugaaaaa

SEQ ID NO: 73210 - RNA, 18 nt, Artificial Sequence
  Description of Artificial Sequence: Synthetic oligonucleotide
gguuuauaauguacagug

SEQ ID NO: 73211 - RNA, 18 nt, Artificial Sequence
  Description of Artificial Sequence: Synthetic oligonucleotide
cugaagguuuauaaugua

SEQ ID NO: 73212 - RNA, 18 nt, Artificial Sequence
  Description of Artificial Sequence: Synthetic oligonucleotide
agcuucugaagguuuaua

SEQ ID NO: 73213 - RNA, 18 nt, Artificial Sequence
  Description of Artificial Sequence: Synthetic oligonucleotide
aaaauagcuucugaaggu

SEQ ID NO: 73214 - RNA, 18 nt, Artificial Sequence
  Description of Artificial Sequence: Synthetic oligonucleotide
uuaaaaaaauagcuucug

SEQ ID NO: 73215 - RNA, 18 nt, Artificial Sequence
  Description of Artificial Sequence: Synthetic oligonucleotide
auagcuuaaaaaaauagc

SEQ ID NO: 73216 - RNA, 18 nt, Artificial Sequence
  Description of Artificial Sequence: Synthetic oligonucleotide
ugcugauagcuuaaaaaa

SEQ ID NO: 73217 - RNA, 18 nt, Artificial Sequence
  Description of Artificial Sequence: Synthetic oligonucleotide
aguauugcugauagcuua

SEQ ID NO: 73218 - RNA, 18 nt, Artificial Sequence
  Description of Artificial Sequence: Synthetic oligonucleotide
ugaugaguauugcugaua

SEQ ID NO: 73219 - RNA, 18 nt, Artificial Sequence
  Description of Artificial Sequence: Synthetic oligonucleotide
ugcucugaugaguauugc

SEQ ID NO: 73220 - RNA, 18 nt, Artificial Sequence
  Description of Artificial Sequence: Synthetic oligonucleotide
cuagcugcucugaugagu

SEQ ID NO: 73221 - RNA, 18 nt, Artificial Sequence
  Description of Artificial Sequence: Synthetic oligonucleotide
aagagcuagcugcucuga

SEQ ID NO: 73222 - RNA, 18 nt, Artificial Sequence
  Description of Artificial Sequence: Synthetic oligonucleotide
gaccaaagagcuagcugc

SEQ ID NO: 73223 - RNA, 18 nt, Artificial Sequence
  Description of Artificial Sequence: Synthetic oligonucleotide
aaauagaccaaagagcua

SEQ ID NO: 73224 - RNA, 18 nt, Artificial Sequence
  Description of Artificial Sequence: Synthetic oligonucleotide
gcagaaaauagaccaaag

SEQ ID NO: 73225 - RNA, 18 nt, Artificial Sequence
  Description of Artificial Sequence: Synthetic oligonucleotide
uuucugcagaaaauagac

SEQ ID NO: 73226 - RNA, 18 nt, Artificial Sequence
  Description of Artificial Sequence: Synthetic oligonucleotide
gcaaauuucugcagaaaa

SEQ ID NO: 73227 - RNA, 18 nt, Artificial Sequence
  Description of Artificial Sequence: Synthetic oligonucleotide
gaguugcaaauuucugca

SEQ ID NO: 73228 - RNA, 18 nt, Artificial Sequence
  Description of Artificial Sequence: Synthetic oligonucleotide
ucagugaguugcaaauuu

SEQ ID NO: 73229 - RNA, 18 nt, Artificial Sequence
  Description of Artificial Sequence: Synthetic oligonucleotide
gagaaucagugaguugca

SEQ ID NO: 73230 - RNA, 18 nt, Artificial Sequence
  Description of Artificial Sequence: Synthetic oligonucleotide
auguagagaaucagugag

SEQ ID NO: 73231 - RNA, 18 nt, Artificial Sequence
  Description of Artificial Sequence: Synthetic oligonucleotide
agagcauguagagaauca

SEQ ID NO: 73232 - RNA, 18 nt, Artificial Sequence
  Description of Artificial Sequence: Synthetic oligonucleotide
gaaaaagagcauguagag

SEQ ID NO: 73233 - RNA, 18 nt, Artificial Sequence
  Description of Artificial Sequence: Synthetic oligonucleotide
ucacagaaaaagagcaug

SEQ ID NO: 73234 - RNA, 18 nt, Artificial Sequence
  Description of Artificial Sequence: Synthetic oligonucleotide
aguuaucacagaaaaaga

SEQ ID NO: 73235 - RNA, 18 nt, Artificial Sequence
  Description of Artificial Sequence: Synthetic oligonucleotide
ugcagaguuaucacagaa

SEQ ID NO: 73236 - RNA, 18 nt, Artificial Sequence
  Description of Artificial Sequence: Synthetic oligonucleotide
gccuuugcagaguuauca

SEQ ID NO: 73237 - RNA, 18 nt, Artificial Sequence
  Description of Artificial Sequence: Synthetic oligonucleotide
cccaggccuuugcagagu

SEQ ID NO: 73238 - RNA, 18 nt, Artificial Sequence
  Description of Artificial Sequence: Synthetic oligonucleotide
gccagcccaggccuuugc

SEQ ID NO: 73239 - RNA, 18 nt, Artificial Sequence
  Description of Artificial Sequence: Synthetic oligonucleotide
gccaggccagcccaggcc

SEQ ID NO: 73240 - RNA, 18 nt, Artificial Sequence
  Description of Artificial Sequence: Synthetic oligonucleotide
caacugccaggccagccc

SEQ ID NO: 73241 - RNA, 18 nt, Artificial Sequence
  Description of Artificial Sequence: Synthetic oligonucleotide
cuguucaacugccaggcc

SEQ ID NO: 73242 - RNA, 18 nt, Artificial Sequence
  Description of Artificial Sequence: Synthetic oligonucleotide
ucccucuguucaacugcc

SEQ ID NO: 73243 - RNA, 18 nt, Artificial Sequence
  Description of Artificial Sequence: Synthetic oligonucleotide
gucucucccucuguucaa

SEQ ID NO: 73244 - RNA, 18 nt, Artificial Sequence
  Description of Artificial Sequence: Synthetic oligonucleotide
gguuagucucucccucug

SEQ ID NO: 73245 - RNA, 18 nt, Artificial Sequence
  Description of Artificial Sequence: Synthetic oligonucleotide
cucaagguuagucucucc

SEQ ID NO: 73246 - RNA, 18 nt, Artificial Sequence
  Description of Artificial Sequence: Synthetic oligonucleotide
ucugacucaagguuaguc

SEQ ID NO: 73247 - RNA, 18 nt, Artificial Sequence
  Description of Artificial Sequence: Synthetic oligonucleotide
uguuuucugacucaaggu

SEQ ID NO: 73248 - RNA, 18 nt, Artificial Sequence
  Description of Artificial Sequence: Synthetic oligonucleotide
uucucuguuuucugacuc

SEQ ID NO: 73249 - RNA, 18 nt, Artificial Sequence
  Description of Artificial Sequence: Synthetic oligonucleotide
acccuuucucuguuuucu

SEQ ID NO: 73250 - RNA, 18 nt, Artificial Sequence
  Description of Artificial Sequence: Synthetic oligonucleotide
aaauuacccuuucucugu

SEQ ID NO: 73251 - RNA, 18 nt, Artificial Sequence
  Description of Artificial Sequence: Synthetic oligonucleotide
aaaggaaauuacccuuuc

SEQ ID NO: 73252 - RNA, 18 nt, Artificial Sequence
  Description of Artificial Sequence: Synthetic oligonucleotide
gaagcaaaggaaauuacc

SEQ ID NO: 73253 - RNA, 18 nt, Artificial Sequence
  Description of Artificial Sequence: Synthetic oligonucleotide
aauuugaagcaaaggaaa

SEQ ID NO: 73254 - RNA, 18 nt, Artificial Sequence
  Description of Artificial Sequence: Synthetic oligonucleotide
ccuugaauuugaagcaaa

SEQ ID NO: 73255 - RNA, 18 nt, Artificial Sequence
  Description of Artificial Sequence: Synthetic oligonucleotide
gaaggccuugaauuugaa

SEQ ID NO: 73256 - RNA, 18 nt, Artificial Sequence
  Description of Artificial Sequence: Synthetic oligonucleotide
cguuggaaggccuugaau

SEQ ID NO: 73257 - RNA, 18 nt, Artificial Sequence
  Description of Artificial Sequence: Synthetic oligonucleotide
gggcguuggaaggccuug

SEQ ID NO: 73258 - RNA, 18 nt, Artificial Sequence
  Description of Artificial Sequence: Synthetic oligonucleotide
gagaaugauaguaaaggg

SEQ ID NO: 73259 - RNA, 18 nt, Artificial Sequence
  Description of Artificial Sequence: Synthetic oligonucleotide
ccacugagaaugauagua

SEQ ID NO: 73260 - RNA, 18 nt, Artificial Sequence
  Description of Artificial Sequence: Synthetic oligonucleotide
gagucccacugagaauga

SEQ ID NO: 73261 - RNA, 18 nt, Artificial Sequence
  Description of Artificial Sequence: Synthetic oligonucleotide
gaucagagucccacugag

SEQ ID NO: 73262 - RNA, 18 nt, Artificial Sequence
  Description of Artificial Sequence: Synthetic oligonucleotide
uaugggaucagaguccca

SEQ ID NO: 73263 - RNA, 18 nt, Artificial Sequence
  Description of Artificial Sequence: Synthetic oligonucleotide
aagaauaugggaucagag

SEQ ID NO: 73264 - RNA, 18 nt, Artificial Sequence
  Description of Artificial Sequence: Synthetic oligonucleotide
cuguuaagaauaugggau

SEQ ID NO: 73265 - RNA, 18 nt, Artificial Sequence
  Description of Artificial Sequence: Synthetic oligonucleotide
aagaucuguuaagaauau

SEQ ID NO: 73266 - RNA, 18 nt, Artificial Sequence
  Description of Artificial Sequence: Synthetic oligonucleotide
gaguaaagaucuguuaag

SEQ ID NO: 73267 - RNA, 18 nt, Artificial Sequence
  Description of Artificial Sequence: Synthetic oligonucleotide
cucaagaguaaagaucug

SEQ ID NO: 73268 - RNA, 18 nt, Artificial Sequence
  Description of Artificial Sequence: Synthetic oligonucleotide
cauuucucaagaguaaag

SEQ ID NO: 73269 - RNA, 18 nt, Artificial Sequence
  Description of Artificial Sequence: Synthetic oligonucleotide
uuauucauuucucaagag

SEQ ID NO: 73270 - RNA, 18 nt, Artificial Sequence
  Description of Artificial Sequence: Synthetic oligonucleotide
aaagcuuauucauuucuc

SEQ ID NO: 73271 - RNA, 18 nt, Artificial Sequence
  Description of Artificial Sequence: Synthetic oligonucleotide
gagagaaagcuuauucau

SEQ ID NO: 73272 - RNA, 18 nt, Artificial Sequence
  Description of Artificial Sequence: Synthetic oligonucleotide
uuucugagagaaagcuua

SEQ ID NO: 73273 - RNA, 18 nt, Artificial Sequence
  Description of Artificial Sequence: Synthetic oligonucleotide
cagcauuucugagagaaa

SEQ ID NO: 73274 - RNA, 18 nt, Artificial Sequence
  Description of Artificial Sequence: Synthetic oligonucleotide
agggacagcauuucugag

SEQ ID NO: 73275 - RNA, 18 nt, Artificial Sequence
  Description of Artificial Sequence: Synthetic oligonucleotide
uguauagggacagcauuu

SEQ ID NO: 73276 - RNA, 18 nt, Artificial Sequence
  Description of Artificial Sequence: Synthetic oligonucleotide
ucuaguguauagggacag

SEQ ID NO: 73277 - RNA, 18 nt, Artificial Sequence
  Description of Artificial Sequence: Synthetic oligonucleotide
uuuugucuaguguauagg

SEQ ID NO: 73278 - RNA, 18 nt, Artificial Sequence
  Description of Artificial Sequence: Synthetic oligonucleotide
cucaguuuugucuagugu

SEQ ID NO: 73279 - RNA, 18 nt, Artificial Sequence
  Description of Artificial Sequence: Synthetic oligonucleotide
acaggcucaguuuugucu

SEQ ID NO: 73280 - RNA, 18 nt, Artificial Sequence
  Description of Artificial Sequence: Synthetic oligonucleotide
cuuauacaggcucaguuu

SEQ ID NO: 73281 - RNA, 18 nt, Artificial Sequence
  Description of Artificial Sequence: Synthetic oligonucleotide
uauuccuuauacaggcuc

SEQ ID NO: 73282 - RNA, 18 nt, Artificial Sequence
  Description of Artificial Sequence: Synthetic oligonucleotide
ccauuuauuccuuauaca

SEQ ID NO: 73283 - RNA, 18 nt, Artificial Sequence
  Description of Artificial Sequence: Synthetic oligonucleotide
cgcucccauuuauuccuu

SEQ ID NO: 73284 - RNA, 18 nt, Artificial Sequence
  Description of Artificial Sequence: Synthetic oligonucleotide
uucggcgcucccauuuau

SEQ ID NO: 73285 - RNA, 18 nt, Artificial Sequence
  Description of Artificial Sequence: Synthetic oligonucleotide
agcuuuucggcgcuccca

SEQ ID NO: 73286 - RNA, 18 nt, Artificial Sequence
  Description of Artificial Sequence: Synthetic oligonucleotide
uagggagcuuuucggcgc

SEQ ID NO: 73287 - RNA, 18 nt, Artificial Sequence
  Description of Artificial Sequence: Synthetic oligonucleotide
cuuuuuagggagcuuuuc

SEQ ID NO: 73288 - RNA, 18 nt, Artificial Sequence
  Description of Artificial Sequence: Synthetic oligonucleotide
aggccucaggccuagccu

SEQ ID NO: 73289 - RNA, 18 nt, Artificial Sequence
  Description of Artificial Sequence: Synthetic oligonucleotide
gguccaggccucaggccu

SEQ ID NO: 73290 - RNA, 18 nt, Artificial Sequence
  Description of Artificial Sequence: Synthetic oligonucleotide
agagcgguccaggccuca

SEQ ID NO: 73291 - RNA, 18 nt, Artificial Sequence
  Description of Artificial Sequence: Synthetic oligonucleotide
cucacagagcgguccagg

SEQ ID NO: 73292 - RNA, 18 nt, Artificial Sequence
  Description of Artificial Sequence: Synthetic oligonucleotide
ccucgcucacagagcggu

SEQ ID NO: 73293 - RNA, 18 nt, Artificial Sequence
  Description of Artificial Sequence: Synthetic oligonucleotide
cggguccucgcucacaga

SEQ ID NO: 73294 - RNA, 18 nt, Artificial Sequence
  Description of Artificial Sequence: Synthetic oligonucleotide
ggaaccggguccucgcuc

SEQ ID NO: 73295 - RNA, 18 nt, Artificial Sequence
  Description of Artificial Sequence: Synthetic oligonucleotide
cgggcggaaccggguccu

SEQ ID NO: 73296 - RNA, 18 nt, Artificial Sequence
  Description of Artificial Sequence: Synthetic oligonucleotide
uccuucgggcggaaccgg

SEQ ID NO: 73297 - RNA, 18 nt, Artificial Sequence
  Description of Artificial Sequence: Synthetic oligonucleotide
cuucauccuucgggcgga

SEQ ID NO: 73298 - RNA, 18 nt, Artificial Sequence
  Description of Artificial Sequence: Synthetic oligonucleotide
caagucuucauccuucgg

SEQ ID NO: 73299 - RNA, 18 nt, Artificial Sequence
  Description of Artificial Sequence: Synthetic oligonucleotide
aaagacaagucuucaucc

SEQ ID NO: 73300 - RNA, 18 nt, Artificial Sequence
  Description of Artificial Sequence: Synthetic oligonucleotide
ucuuuaaagacaagucuu

SEQ ID NO: 73301 - RNA, 18 nt, Artificial Sequence
  Description of Artificial Sequence: Synthetic oligonucleotide
ugucaucuuuaaagacaa

SEQ ID NO: 73302 - RNA, 18 nt, Artificial Sequence
  Description of Artificial Sequence: Synthetic oligonucleotide
uacguugucaucuuuaaa

SEQ ID NO: 73303 - RNA, 18 nt, Artificial Sequence
  Description of Artificial Sequence: Synthetic oligonucleotide
uccuguacguugucaucu

SEQ ID NO: 73304 - RNA, 18 nt, Artificial Sequence
  Description of Artificial Sequence: Synthetic oligonucleotide
gggagaucggcugaugga

SEQ ID NO: 73305 - RNA, 18 nt, Artificial Sequence
  Description of Artificial Sequence: Synthetic oligonucleotide
cugugggcccaggcaggg

SEQ ID NO: 73306 - RNA, 18 nt, Artificial Sequence
  Description of Artificial Sequence: Synthetic oligonucleotide
gggcgcugugggcccagg

SEQ ID NO: 73307 - RNA, 18 nt, Artificial Sequence
  Description of Artificial Sequence: Synthetic oligonucleotide
gaggguggugaggguuug

SEQ ID NO: 73308 - RNA, 18 nt, Artificial Sequence
  Description of Artificial Sequence: Synthetic oligonucleotide
ugagagaggguggugagg

SEQ ID NO: 73309 - RNA, 18 nt, Artificial Sequence
  Description of Artificial Sequence: Synthetic oligonucleotide
ggcagugagagagggugg

SEQ ID NO: 73310 - RNA, 18 nt, Artificial Sequence
  Description of Artificial Sequence: Synthetic oligonucleotide
ggcuaggcagugagagag

SEQ ID NO: 73311 - RNA, 18 nt, Artificial Sequence
  Description of Artificial Sequence: Synthetic oligonucleotide
aggcaggcuaggcaguga

SEQ ID NO: 73312 - RNA, 18 nt, Artificial Sequence
  Description of Artificial Sequence: Synthetic oligonucleotide
uagggaggcaggcuaggc

SEQ ID NO: 73313 - RNA, 18 nt, Artificial Sequence
  Description of Artificial Sequence: Synthetic oligonucleotide
gaagguagggaggcaggc

SEQ ID NO: 73314 - RNA, 18 nt, Artificial Sequence
  Description of Artificial Sequence: Synthetic oligonucleotide
agagagaagguagggagg

SEQ ID NO: 73315 - RNA, 18 nt, Artificial Sequence
  Description of Artificial Sequence: Synthetic oligonucleotide
accucagagagaagguag

SEQ ID NO: 73316 - RNA, 18 nt, Artificial Sequence
  Description of Artificial Sequence: Synthetic oligonucleotide
gagcgaccucagagagaa

SEQ ID NO: 73317 - RNA, 18 nt, Artificial Sequence
  Description of Artificial Sequence: Synthetic oligonucleotide
augaggagcgaccucaga

SEQ ID NO: 73318 - RNA, 18 nt, Artificial Sequence
  Description of Artificial Sequence: Synthetic oligonucleotide
caagaaugaggagcgacc

SEQ ID NO: 73319 - RNA, 18 nt, Artificial Sequence
  Description of Artificial Sequence: Synthetic oligonucleotide
uaacacaagaaugaggag

SEQ ID NO: 73320 - RNA, 18 nt, Artificial Sequence
  Description of Artificial Sequence: Synthetic oligonucleotide
cuggguaacacaagaaug

SEQ ID NO: 73321 - RNA, 18 nt, Artificial Sequence
  Description of Artificial Sequence: Synthetic oligonucleotide
cuguccuggguaacacaa

SEQ ID NO: 73322 - RNA, 18 nt, Artificial Sequence
  Description of Artificial Sequence: Synthetic oligonucleotide
ggucccuguccuggguaa

SEQ ID NO: 73323 - RNA, 18 nt, Artificial Sequence
  Description of Artificial Sequence: Synthetic oligonucleotide
ggcuaggucccuguccug

SEQ ID NO: 73324 - RNA, 18 nt, Artificial Sequence
  Description of Artificial Sequence: Synthetic oligonucleotide
uuucuggcuaggucccug

SEQ ID NO: 73325 - RNA, 18 nt, Artificial Sequence
  Description of Artificial Sequence: Synthetic oligonucleotide
gccgguuucuggcuaggu

SEQ ID NO: 73326 - RNA, 18 nt, Artificial Sequence
  Description of Artificial Sequence: Synthetic oligonucleotide
augcugccgguuucuggc

SEQ ID NO: 73327 - RNA, 18 nt, Artificial Sequence
  Description of Artificial Sequence: Synthetic oligonucleotide
gggaaugcugccgguuuc

SEQ ID NO: 73328 - RNA, 18 nt, Artificial Sequence
  Description of Artificial Sequence: Synthetic oligonucleotide
ugucacuccacagaaggg

SEQ ID NO: 73329 - RNA, 18 nt, Artificial Sequence
  Description of Artificial Sequence: Synthetic oligonucleotide
gauacugucacuccacag

SEQ ID NO: 73330 - RNA, 18 nt, Artificial Sequence
  Description of Artificial Sequence: Synthetic oligonucleotide
agggagauacugucacuc

SEQ ID NO: 73331 - RNA, 18 nt, Artificial Sequence
  Description of Artificial Sequence: Synthetic oligonucleotide
augagagggagauacugu

SEQ ID NO: 73332 - RNA, 18 nt, Artificial Sequence
  Description of Artificial Sequence: Synthetic oligonucleotide
uuacaaugagagggagau

SEQ ID NO: 73333 - RNA, 18 nt, Artificial Sequence
  Description of Artificial Sequence: Synthetic oligonucleotide
auaaguuacaaugagagg

SEQ ID NO: 73334 - RNA, 18 nt, Artificial Sequence
  Description of Artificial Sequence: Synthetic oligonucleotide
ugaggauaaguuacaaug

SEQ ID NO: 73335 - RNA, 18 nt, Artificial Sequence
  Description of Artificial Sequence: Synthetic oligonucleotide
gcgccugaggauaaguua

SEQ ID NO: 73336 - RNA, 18 nt, Artificial Sequence
  Description of Artificial Sequence: Synthetic oligonucleotide
cgaaugcgccugaggaua

SEQ ID NO: 73337 - RNA, 18 nt, Artificial Sequence
  Description of Artificial Sequence: Synthetic oligonucleotide
acugucgaaugcgccuga

SEQ ID NO: 73338 - RNA, 18 nt, Artificial Sequence
  Description of Artificial Sequence: Synthetic oligonucleotide
gggacugucgaaugcgcc

SEQ ID NO: 73339 - RNA, 18 nt, Artificial Sequence
  Description of Artificial Sequence: Synthetic oligonucleotide
ggugagaaagcaagaggg

SEQ ID NO: 73340 - RNA, 18 nt, Artificial Sequence
  Description of Artificial Sequence: Synthetic oligonucleotide
gggugagaaagcaagagg

SEQ ID NO: 73341 - RNA, 18 nt, Artificial Sequence
  Description of Artificial Sequence: Synthetic oligonucleotide
ccuugggugaaggaaggg

SEQ ID NO: 73342 - RNA, 18 nt, Artificial Sequence
  Description of Artificial Sequence: Synthetic oligonucleotide
gggucccuugggugaagg

SEQ ID NO: 73343 - RNA, 18 nt, Artificial Sequence
  Description of Artificial Sequence: Synthetic oligonucleotide
gcagagggucccuugggu

SEQ ID NO: 73344 - RNA, 18 nt, Artificial Sequence
  Description of Artificial Sequence: Synthetic oligonucleotide
gagaggcagagggucccu

SEQ ID NO: 73345 - RNA, 18 nt, Artificial Sequence
  Description of Artificial Sequence: Synthetic oligonucleotide
ggcuggagaggcagaggg

SEQ ID NO: 73346 - RNA, 18 nt, Artificial Sequence
  Description of Artificial Sequence: Synthetic oligonucleotide
gagugggcuggagaggca

SEQ ID NO: 73347 - RNA, 18 nt, Artificial Sequence
  Description of Artificial Sequence: Synthetic oligonucleotide
gcugggagugggcuggag

SEQ ID NO: 73348 - RNA, 18 nt, Artificial Sequence
  Description of Artificial Sequence: Synthetic oligonucleotide
aggaggcugggagugggc

SEQ ID NO: 73349 - RNA, 18 nt, Artificial Sequence
  Description of Artificial Sequence: Synthetic oligonucleotide
gagaaaggaggcugggag

SEQ ID NO: 73350 - RNA, 18 nt, Artificial Sequence
  Description of Artificial Sequence: Synthetic oligonucleotide
accaagagaaaggaggcu

SEQ ID NO: 73351 - RNA, 18 nt, Artificial Sequence
  Description of Artificial Sequence: Synthetic oligonucleotide
agggaaccaagagaaagg

SEQ ID NO: 73352 - RNA, 18 nt, Artificial Sequence
  Description of Artificial Sequence: Synthetic oligonucleotide
ugaccagggaaccaagag

SEQ ID NO: 73353 - RNA, 18 nt, Artificial Sequence
  Description of Artificial Sequence: Synthetic oligonucleotide
aggcaugaccagggaacc

SEQ ID NO: 73354 - RNA, 18 nt, Artificial Sequence
  Description of Artificial Sequence: Synthetic oligonucleotide
gaggcaggcaugaccagg

SEQ ID NO: 73355 - RNA, 18 nt, Artificial Sequence
  Description of Artificial Sequence: Synthetic oligonucleotide
acagggaggcaggcauga

SEQ ID NO: 73356 - RNA, 18 nt, Artificial Sequence
  Description of Artificial Sequence: Synthetic oligonucleotide
aggagacagggaggcagg

SEQ ID NO: 73357 - RNA, 18 nt, Artificial Sequence
  Description of Artificial Sequence: Synthetic oligonucleotide
gagacaggagacagggag

SEQ ID NO: 73358 - RNA, 18 nt, Artificial Sequence
  Description of Artificial Sequence: Synthetic oligonucleotide
agggagagacaggagaca

SEQ ID NO: 73359 - RNA, 18 nt, Artificial Sequence
  Description of Artificial Sequence: Synthetic oligonucleotide
gugggagggagagacagg

SEQ ID NO: 73360 - RNA, 18 nt, Artificial Sequence
  Description of Artificial Sequence: Synthetic oligonucleotide
ugugugugggagggagag

SEQ ID NO: 73361 - RNA, 18 nt, Artificial Sequence
  Description of Artificial Sequence: Synthetic oligonucleotide
gugggugugugugggagg

SEQ ID NO: 73362 - RNA, 18 nt, Artificial Sequence
  Description of Artificial Sequence: Synthetic oligonucleotide
ggauagugggugugugug

SEQ ID NO: 73363 - RNA, 18 nt, Artificial Sequence
  Description of Artificial Sequence: Synthetic oligonucleotide
ugggaggauagugggugu

SEQ ID NO: 73364 - RNA, 18 nt, Artificial Sequence
  Description of Artificial Sequence: Synthetic oligonucleotide
auagcugggaggauagug

SEQ ID NO: 73365 - RNA, 18 nt, Artificial Sequence
  Description of Artificial Sequence: Synthetic oligonucleotide
cugggauagcugggagga

SEQ ID NO: 73366 - RNA, 18 nt, Artificial Sequence
  Description of Artificial Sequence: Synthetic oligonucleotide
gggugcugggauagcugg

SEQ ID NO: 73367 - RNA, 18 nt, Artificial Sequence
  Description of Artificial Sequence: Synthetic oligonucleotide
aaggagggugcugggaua

SEQ ID NO: 73368 - RNA, 18 nt, Artificial Sequence
  Description of Artificial Sequence: Synthetic oligonucleotide
uuaggaaggagggugcug

SEQ ID NO: 73369 - RNA, 18 nt, Artificial Sequence
  Description of Artificial Sequence: Synthetic oligonucleotide
caagauuaggaaggaggg

SEQ ID NO: 73370 - RNA, 18 nt, Artificial Sequence
  Description of Artificial Sequence: Synthetic oligonucleotide
ucucccaagauuaggaag

SEQ ID NO: 73371 - RNA, 18 nt, Artificial Sequence
  Description of Artificial Sequence: Synthetic oligonucleotide
agaugucucccaagauua

SEQ ID NO: 73372 - RNA, 18 nt, Artificial Sequence
  Description of Artificial Sequence: Synthetic oligonucleotide
agacgagaugucucccaa

SEQ ID NO: 73373 - RNA, 18 nt, Artificial Sequence
  Description of Artificial Sequence: Synthetic oligonucleotide
cagccagacgagaugucu

SEQ ID NO: 73374 - RNA, 18 nt, Artificial Sequence
  Description of Artificial Sequence: Synthetic oligonucleotide
ccguccagccagacgaga

SEQ ID NO: 73375 - RNA, 18 nt, Artificial Sequence
  Description of Artificial Sequence: Synthetic oligonucleotide
uuuucccguccagccaga

SEQ ID NO: 73376 - RNA, 18 nt, Artificial Sequence
  Description of Artificial Sequence: Synthetic oligonucleotide
uggaauuuucccguccag

SEQ ID NO: 73377 - RNA, 18 nt, Artificial Sequence
  Description of Artificial Sequence: Synthetic oligonucleotide
gauccuggaauuuucccg

SEQ ID NO: 73378 - RNA, 18 nt, Artificial Sequence
  Description of Artificial Sequence: Synthetic oligonucleotide
gccuagauccuggaauuu

SEQ ID NO: 73379 - RNA, 18 nt, Artificial Sequence
  Description of Artificial Sequence: Synthetic oligonucleotide
guguggccuagauccugg

SEQ ID NO: 73380 - RNA, 18 nt, Artificial Sequence
  Description of Artificial Sequence: Synthetic oligonucleotide
gagaaguguggccuagau

SEQ ID NO: 73381 - RNA, 18 nt, Artificial Sequence
  Description of Artificial Sequence: Synthetic oligonucleotide
cugcugagaaguguggcc

SEQ ID NO: 73382 - RNA, 18 nt, Artificial Sequence
  Description of Artificial Sequence: Synthetic oligonucleotide
caugucugcugagaagug

SEQ ID NO: 73383 - RNA, 18 nt, Artificial Sequence
  Description of Artificial Sequence: Synthetic oligonucleotide
augggcaugucugcugag

SEQ ID NO: 73384 - RNA, 18 nt, Artificial Sequence
  Description of Artificial Sequence: Synthetic oligonucleotide
caaggaugggcaugucug

SEQ ID NO: 73385 - RNA, 18 nt, Artificial Sequence
  Description of Artificial Sequence: Synthetic oligonucleotide
cuccccaaggaugggcau

SEQ ID NO: 73386 - RNA, 18 nt, Artificial Sequence
  Description of Artificial Sequence: Synthetic oligonucleotide
uccuccuccccaaggaug

SEQ ID NO: 73387 - RNA, 18 nt, Artificial Sequence
  Description of Artificial Sequence: Synthetic oligonucleotide
ccuguuccuccuccccaa

SEQ ID NO: 73388 - RNA, 18 nt, Artificial Sequence
  Description of Artificial Sequence: Synthetic oligonucleotide
ucucuccuguuccuccuc

SEQ ID NO: 73389 - RNA, 18 nt, Artificial Sequence
  Description of Artificial Sequence: Synthetic oligonucleotide
caggcucucuccuguucc

SEQ ID NO: 73390 - RNA, 18 nt, Artificial Sequence
  Description of Artificial Sequence: Synthetic oligonucleotide
uuccucaggcucucuccu

SEQ ID NO: 73391 - RNA, 18 nt, Artificial Sequence
  Description of Artificial Sequence: Synthetic oligonucleotide
agaacuuccucaggcucu

SEQ ID NO: 73392 - RNA, 18 nt, Artificial Sequence
  Description of Artificial Sequence: Synthetic oligonucleotide
cccccagaacuuccucag

SEQ ID NO: 73393 - RNA, 18 nt, Artificial Sequence
  Description of Artificial Sequence: Synthetic oligonucleotide
ucuccuuuuugucaggac

SEQ ID NO: 73394 - RNA, 18 nt, Artificial Sequence
  Description of Artificial Sequence: Synthetic oligonucleotide
uggugucuccuuuuuguc

SEQ ID NO: 73395 - RNA, 18 nt, Artificial Sequence
  Description of Artificial Sequence: Synthetic oligonucleotide
gcauauggugucuccuuu

SEQ ID NO: 73396 - RNA, 18 nt, Artificial Sequence
  Description of Artificial Sequence: Synthetic oligonucleotide
agaaagcauauggugucu

SEQ ID NO: 73397 - RNA, 18 nt, Artificial Sequence
  Description of Artificial Sequence: Synthetic oligonucleotide
aagcaagaaagcauaugg

SEQ ID NO: 73398 - RNA, 18 nt, Artificial Sequence
  Description of Artificial Sequence: Synthetic oligonucleotide
aaagaaagcaagaaagca

SEQ ID NO: 73399 - RNA, 18 nt, Artificial Sequence
  Description of Artificial Sequence: Synthetic oligonucleotide
gaaagaaagaaagcaaga

SEQ ID NO: 73400 - RNA, 18 nt, Artificial Sequence
  Description of Artificial Sequence: Synthetic oligonucleotide
agaaagaaagaaagaaag

SEQ ID NO: 73401 - RNA, 18 nt, Artificial Sequence
  Description of Artificial Sequence: Synthetic oligonucleotide
aagaaagaaagaaagaaa

SEQ ID NO: 73402 - RNA, 18 nt, Artificial Sequence
  Description of Artificial Sequence: Synthetic oligonucleotide
aaagaaagaaagaaagaa

SEQ ID NO: 73403 - RNA, 18 nt, Artificial Sequence
  Description of Artificial Sequence: Synthetic oligonucleotide
aaaaaaaagaaagaaaga

SEQ ID NO: 73404 - RNA, 18 nt, Artificial Sequence
  Description of Artificial Sequence: Synthetic oligonucleotide
caaaaaaaaaaaagaaag

SEQ ID NO: 73405 - RNA, 18 nt, Artificial Sequence
  Description of Artificial Sequence: Synthetic oligonucleotide
cgucucaaaaaaaaaaaa

SEQ ID NO: 73406 - RNA, 18 nt, Artificial Sequence
  Description of Artificial Sequence: Synthetic oligonucleotide
aacuccgucucaaaaaaa

SEQ ID NO: 73407 - RNA, 18 nt, Artificial Sequence
  Description of Artificial Sequence: Synthetic oligonucleotide
agugaaacuccgucucaa

SEQ ID NO: 73408 - RNA, 18 nt, Artificial Sequence
  Description of Artificial Sequence: Synthetic oligonucleotide
auaagagugaaacuccgu

SEQ ID NO: 73409 - RNA, 18 nt, Artificial Sequence
  Description of Artificial Sequence: Synthetic oligonucleotide
gggcaauaagagugaaac

SEQ ID NO: 73410 - RNA, 18 nt, Artificial Sequence
  Description of Artificial Sequence: Synthetic oligonucleotide
agccugggcaauaagagu

SEQ ID NO: 73411 - RNA, 18 nt, Artificial Sequence
  Description of Artificial Sequence: Synthetic oligonucleotide
acuccagccugggcaaua

SEQ ID NO: 73412 - RNA, 18 nt, Artificial Sequence
  Description of Artificial Sequence: Synthetic oligonucleotide
auugcacuccagccuggg

SEQ ID NO: 73413 - RNA, 18 nt, Artificial Sequence
  Description of Artificial Sequence: Synthetic oligonucleotide
gcaccauugcacuccagc

SEQ ID NO: 73414 - RNA, 18 nt, Artificial Sequence
  Description of Artificial Sequence: Synthetic oligonucleotide
agaucgcaccauugcacu

SEQ ID NO: 73415 - RNA, 18 nt, Artificial Sequence
  Description of Artificial Sequence: Synthetic oligonucleotide
agccgagaucgcaccauu

SEQ ID NO: 73416 - RNA, 18 nt, Artificial Sequence
  Description of Artificial Sequence: Synthetic oligonucleotide
uggugagccgagaucgca

SEQ ID NO: 73417 - RNA, 18 nt, Artificial Sequence
  Description of Artificial Sequence: Synthetic oligonucleotide
gguuguggugagccgaga

SEQ ID NO: 73418 - RNA, 18 nt, Artificial Sequence
  Description of Artificial Sequence: Synthetic oligonucleotide
gcggagguuguggugagc

SEQ ID NO: 73419 - RNA, 18 nt, Artificial Sequence
  Description of Artificial Sequence: Synthetic oligonucleotide
gggaggcggagguugugg

SEQ ID NO: 73420 - RNA, 18 nt, Artificial Sequence
  Description of Artificial Sequence: Synthetic oligonucleotide
uaccugggaggcggaggu

SEQ ID NO: 73421 - RNA, 18 nt, Artificial Sequence
  Description of Artificial Sequence: Synthetic oligonucleotide
gcuuguaccugggaggcg

SEQ ID NO: 73422 - RNA, 18 nt, Artificial Sequence
  Description of Artificial Sequence: Synthetic oligonucleotide
gaaucgcuuguaccuggg

SEQ ID NO: 73423 - RNA, 18 nt, Artificial Sequence
  Description of Artificial Sequence: Synthetic oligonucleotide
caggagaaucgcuuguac

SEQ ID NO: 73424 - RNA, 18 nt, Artificial Sequence
  Description of Artificial Sequence: Synthetic oligonucleotide
ugagacaggagaaucgcu

SEQ ID NO: 73425 - RNA, 18 nt, Artificial Sequence
  Description of Artificial Sequence: Synthetic oligonucleotide
gaggcugagacaggagaa

SEQ ID NO: 73426 - RNA, 18 nt, Artificial Sequence
  Description of Artificial Sequence: Synthetic oligonucleotide
cuugggaggcugagacag

SEQ ID NO: 73427 - RNA, 18 nt, Artificial Sequence
  Description of Artificial Sequence: Synthetic oligonucleotide
agcuacuugggaggcuga

SEQ ID NO: 73428 - RNA, 18 nt, Artificial Sequence
  Description of Artificial Sequence: Synthetic oligonucleotide
auccaagcuacuugggag

SEQ ID NO: 73429 - RNA, 18 nt, Artificial Sequence
  Description of Artificial Sequence: Synthetic oligonucleotide
cuguaauccaagcuacuu

SEQ ID NO: 73430 - RNA, 18 nt, Artificial Sequence
  Description of Artificial Sequence: Synthetic oligonucleotide
caugccuguaauccaagc

SEQ ID NO: 73431 - RNA, 18 nt, Artificial Sequence
  Description of Artificial Sequence: Synthetic oligonucleotide
ugguucaugccuguaauc

SEQ ID NO: 73432 - RNA, 18 nt, Artificial Sequence
  Description of Artificial Sequence: Synthetic oligonucleotide
uguggugguucaugccug

SEQ ID NO: 73433 - RNA, 18 nt, Artificial Sequence
  Description of Artificial Sequence: Synthetic oligonucleotide
caggguguggugguucau

SEQ ID NO: 73434 - RNA, 18 nt, Artificial Sequence
  Description of Artificial Sequence: Synthetic oligonucleotide
acuagcaggguguggugg

SEQ ID NO: 73435 - RNA, 18 nt, Artificial Sequence
  Description of Artificial Sequence: Synthetic oligonucleotide
aaaaaacuagcagggugu

SEQ ID NO: 73436 - RNA, 18 nt, Artificial Sequence
  Description of Artificial Sequence: Synthetic oligonucleotide
auacaaaaaaacuagcag

SEQ ID NO: 73437 - RNA, 18 nt, Artificial Sequence
  Description of Artificial Sequence: Synthetic oligonucleotide
acgaaauacaaaaaaacu

SEQ ID NO: 73438 - RNA, 18 nt, Artificial Sequence
  Description of Artificial Sequence: Synthetic oligonucleotide
gcucuacgaaauacaaaa

SEQ ID NO: 73439 - RNA, 18 nt, Artificial Sequence
  Description of Artificial Sequence: Synthetic oligonucleotide
ccccggcucuacgaaaua

SEQ ID NO: 73440 - RNA, 18 nt, Artificial Sequence
  Description of Artificial Sequence: Synthetic oligonucleotide
ugaaaccccggcucuacg

SEQ ID NO: 73441 - RNA, 18 nt, Artificial Sequence
  Description of Artificial Sequence: Synthetic oligonucleotide
cauggugaaaccccggcu

SEQ ID NO: 73442 - RNA, 18 nt, Artificial Sequence
  Description of Artificial Sequence: Synthetic oligonucleotide
acuaacauggugaaaccc

SEQ ID NO: 73443 - RNA, 18 nt, Artificial Sequence
  Description of Artificial Sequence: Synthetic oligonucleotide
gccucacuaacaugguga

SEQ ID NO: 73444 - RNA, 18 nt, Artificial Sequence
  Description of Artificial Sequence: Synthetic oligonucleotide
caccagccucacuaacau

SEQ ID NO: 73445 - RNA, 18 nt, Artificial Sequence
  Description of Artificial Sequence: Synthetic oligonucleotide
uucgccaccagccucacu

SEQ ID NO: 73446 - RNA, 18 nt, Artificial Sequence
  Description of Artificial Sequence: Synthetic oligonucleotide
aggaguucgccaccagcc

SEQ ID NO: 73447 - RNA, 18 nt, Artificial Sequence
  Description of Artificial Sequence: Synthetic oligonucleotide
aggucaggaguucgccac

SEQ ID NO: 73448 - RNA, 18 nt, Artificial Sequence
  Description of Artificial Sequence: Synthetic oligonucleotide
accugaggucaggaguuc

SEQ ID NO: 73449 - RNA, 18 nt, Artificial Sequence
  Description of Artificial Sequence: Synthetic oligonucleotide
ggaucaccugaggucagg

SEQ ID NO: 73450 - RNA, 18 nt, Artificial Sequence
  Description of Artificial Sequence: Synthetic oligonucleotide
cggguggaucaccugagg

SEQ ID NO: 73451 - RNA, 18 nt, Artificial Sequence
  Description of Artificial Sequence: Synthetic oligonucleotide
caaggcggguggaucacc

SEQ ID NO: 73452 - RNA, 18 nt, Artificial Sequence
  Description of Artificial Sequence: Synthetic oligonucleotide
gaguccaaggcgggugga

SEQ ID NO: 73453 - RNA, 18 nt, Artificial Sequence
  Description of Artificial Sequence: Synthetic oligonucleotide
uuugggaguccaaggcgg

SEQ ID NO: 73454 - RNA, 18 nt, Artificial Sequence
  Description of Artificial Sequence: Synthetic oligonucleotide
agcacuuugggaguccaa

SEQ ID NO: 73455 - RNA, 18 nt, Artificial Sequence
  Description of Artificial Sequence: Synthetic oligonucleotide
aucccagcacuuugggag

SEQ ID NO: 73456 - RNA, 18 nt, Artificial Sequence
  Description of Artificial Sequence: Synthetic oligonucleotide
cuguaaucccagcacuuu

SEQ ID NO: 73457 - RNA, 18 nt, Artificial Sequence
  Description of Artificial Sequence: Synthetic oligonucleotide
caugccuguaaucccagc

SEQ ID NO: 73458 - RNA, 18 nt, Artificial Sequence
  Description of Artificial Sequence: Synthetic oligonucleotide
uggcucaugccuguaauc

SEQ ID NO: 73459 - RNA, 18 nt, Artificial Sequence
  Description of Artificial Sequence: Synthetic oligonucleotide
ugcaguggcucaugccug

SEQ ID NO: 73460 - RNA, 18 nt, Artificial Sequence
  Description of Artificial Sequence: Synthetic oligonucleotide
ccgggugcaguggcucau

SEQ ID NO: 73461 - RNA, 18 nt, Artificial Sequence
  Description of Artificial Sequence: Synthetic oligonucleotide
gugugccgggugcagugg

SEQ ID NO: 73462 - RNA, 18 nt, Artificial Sequence
  Description of Artificial Sequence: Synthetic oligonucleotide
auauggugugccgggugc

SEQ ID NO: 73463 - RNA, 18 nt, Artificial Sequence
  Description of Artificial Sequence: Synthetic oligonucleotide
aaagcauauggugugccg

SEQ ID NO: 73464 - RNA, 18 nt, Artificial Sequence
  Description of Artificial Sequence: Synthetic oligonucleotide
ugaugaaagcauauggug

SEQ ID NO: 73465 - RNA, 18 nt, Artificial Sequence
  Description of Artificial Sequence: Synthetic oligonucleotide
ucuugugaugaaagcaua

SEQ ID NO: 73466 - RNA, 18 nt, Artificial Sequence
  Description of Artificial Sequence: Synthetic oligonucleotide
cauuuucuugugaugaaa

SEQ ID NO: 73467 - RNA, 18 nt, Artificial Sequence
  Description of Artificial Sequence: Synthetic oligonucleotide
ucucacauuuucuuguga

SEQ ID NO: 73468 - RNA, 18 nt, Artificial Sequence
  Description of Artificial Sequence: Synthetic oligonucleotide
aauucucucacauuuucu

SEQ ID NO: 73469 - RNA, 18 nt, Artificial Sequence
  Description of Artificial Sequence: Synthetic oligonucleotide
cccugaauucucucacau

SEQ ID NO: 73470 - RNA, 18 nt, Artificial Sequence
  Description of Artificial Sequence: Synthetic oligonucleotide
caaagcccugaauucucu

SEQ ID NO: 73471 - RNA, 18 nt, Artificial Sequence
  Description of Artificial Sequence: Synthetic oligonucleotide
acugccaaagcccugaau

SEQ ID NO: 73472 - RNA, 18 nt, Artificial Sequence
  Description of Artificial Sequence: Synthetic oligonucleotide
cuggaacugccaaagccc

SEQ ID NO: 73473 - RNA, 18 nt, Artificial Sequence
  Description of Artificial Sequence: Synthetic oligonucleotide
ccagccuggaacugccaa

SEQ ID NO: 73474 - RNA, 18 nt, Artificial Sequence
  Description of Artificial Sequence: Synthetic oligonucleotide
gcugaccagccuggaacu

SEQ ID NO: 73475 - RNA, 18 nt, Artificial Sequence
  Description of Artificial Sequence: Synthetic oligonucleotide
gagaugcugaccagccug

SEQ ID NO: 73476 - RNA, 18 nt, Artificial Sequence
  Description of Artificial Sequence: Synthetic oligonucleotide
ggcuugagaugcugacca

SEQ ID NO: 73477 - RNA, 18 nt, Artificial Sequence
  Description of Artificial Sequence: Synthetic oligonucleotide
gggagggcuugagaugcu

SEQ ID NO: 73478 - RNA, 18 nt, Artificial Sequence
  Description of Artificial Sequence: Synthetic oligonucleotide
gggugaacagaugcuggg

SEQ ID NO: 73479 - RNA, 18 nt, Artificial Sequence
  Description of Artificial Sequence: Synthetic oligonucleotide
ggcagggugaacagaugc

SEQ ID NO: 73480 - RNA, 18 nt, Artificial Sequence
  Description of Artificial Sequence: Synthetic oligonucleotide
ugccuggcagggugaaca

SEQ ID NO: 73481 - RNA, 18 nt, Artificial Sequence
  Description of Artificial Sequence: Synthetic oligonucleotide
gagacugccuggcagggu

SEQ ID NO: 73482 - RNA, 18 nt, Artificial Sequence
  Description of Artificial Sequence: Synthetic oligonucleotide
aggaagagacugccuggc

SEQ ID NO: 73483 - RNA, 18 nt, Artificial Sequence
  Description of Artificial Sequence: Synthetic oligonucleotide
uuucuaggaagagacugc

SEQ ID NO: 73484 - RNA, 18 nt, Artificial Sequence
  Description of Artificial Sequence: Synthetic oligonucleotide
ccaaguuucuaggaagag

SEQ ID NO: 73485 - RNA, 18 nt, Artificial Sequence
  Description of Artificial Sequence: Synthetic oligonucleotide
uuuaaccaaguuucuagg

SEQ ID NO: 73486 - RNA, 18 nt, Artificial Sequence
  Description of Artificial Sequence: Synthetic oligonucleotide
gaacauuuaaccaaguuu

SEQ ID NO: 73487 - RNA, 18 nt, Artificial Sequence
  Description of Artificial Sequence: Synthetic oligonucleotide
agagugaacauuuaacca

SEQ ID NO: 73488 - RNA, 18 nt, Artificial Sequence
  Description of Artificial Sequence: Synthetic oligonucleotide
caagggugaagaaucuau

SEQ ID NO: 73489 - RNA, 18 nt, Artificial Sequence
  Description of Artificial Sequence: Synthetic oligonucleotide
cgggccaagggugaagaa

SEQ ID NO: 73490 - RNA, 18 nt, Artificial Sequence
  Description of Artificial Sequence: Synthetic oligonucleotide
aaaggcgggccaagggug

SEQ ID NO: 73491 - RNA, 18 nt, Artificial Sequence
  Description of Artificial Sequence: Synthetic oligonucleotide
gggcaaaggcgggccaag

SEQ ID NO: 73492 - RNA, 18 nt, Artificial Sequence
  Description of Artificial Sequence: Synthetic oligonucleotide
ugggcagaguaggguggg

SEQ ID NO: 73493 - RNA, 18 nt, Artificial Sequence
  Description of Artificial Sequence: Synthetic oligonucleotide
acuucugggcagaguagg

SEQ ID NO: 73494 - RNA, 18 nt, Artificial Sequence
  Description of Artificial Sequence: Synthetic oligonucleotide
cuugcacuucugggcaga

SEQ ID NO: 73495 - RNA, 18 nt, Artificial Sequence
  Description of Artificial Sequence: Synthetic oligonucleotide
aggcucuugcacuucugg

SEQ ID NO: 73496 - RNA, 18 nt, Artificial Sequence
  Description of Artificial Sequence: Synthetic oligonucleotide
ggcuuaggcucuugcacu

SEQ ID NO: 73497 - RNA, 18 nt, Artificial Sequence
  Description of Artificial Sequence: Synthetic oligonucleotide
gaggcggcuuaggcucuu

SEQ ID NO: 73498 - RNA, 18 nt, Artificial Sequence
  Description of Artificial Sequence: Synthetic oligonucleotide
ccauggaggcggcuuagg

SEQ ID NO: 73499 - RNA, 18 nt, Artificial Sequence
  Description of Artificial Sequence: Synthetic oligonucleotide
gggccauggaggcggcuu

SEQ ID NO: 73500 - RNA, 18 nt, Artificial Sequence
  Description of Artificial Sequence: Synthetic oligonucleotide
cccugaauccuuccuggg

SEQ ID NO: 73501 - RNA, 18 nt, Artificial Sequence
  Description of Artificial Sequence: Synthetic oligonucleotide
cucuccccugaauccuuc

SEQ ID NO: 73502 - RNA, 18 nt, Artificial Sequence
  Description of Artificial Sequence: Synthetic oligonucleotide
gggccucuccccugaauc

SEQ ID NO: 73503 - RNA, 18 nt, Artificial Sequence
  Description of Artificial Sequence: Synthetic oligonucleotide
cguggcucccuguuuggg

SEQ ID NO: 73504 - RNA, 18 nt, Artificial Sequence
  Description of Artificial Sequence: Synthetic oligonucleotide
gcuggcguggcucccugu

SEQ ID NO: 73505 - RNA, 18 nt, Artificial Sequence
  Description of Artificial Sequence: Synthetic oligonucleotide
gucuggcuggcguggcuc

SEQ ID NO: 73506 - RNA, 18 nt, Artificial Sequence
  Description of Artificial Sequence: Synthetic oligonucleotide
gggugucuggcuggcgug

SEQ ID NO: 73507 - RNA, 18 nt, Artificial Sequence
  Description of Artificial Sequence: Synthetic oligonucleotide
agcuccauucuggccggg

SEQ ID NO: 73508 - RNA, 18 nt, Artificial Sequence
  Description of Artificial Sequence: Synthetic oligonucleotide
cagucagcuccauucugg

SEQ ID NO: 73509 - RNA, 18 nt, Artificial Sequence
  Description of Artificial Sequence: Synthetic oligonucleotide
aagggugaagaaucuauc

SEQ ID NO: 73510 - RNA, 18 nt, Artificial Sequence
  Description of Artificial Sequence: Synthetic oligonucleotide
gggccaagggugaagaau

SEQ ID NO: 73511 - RNA, 18 nt, Artificial Sequence
  Description of Artificial Sequence: Synthetic oligonucleotide
aaggcgggccaaggguga

SEQ ID NO: 73512 - RNA, 18 nt, Artificial Sequence
  Description of Artificial Sequence: Synthetic oligonucleotide
gggcaaaggcgggccaag

SEQ ID NO: 73513 - RNA, 18 nt, Artificial Sequence
  Description of Artificial Sequence: Synthetic oligonucleotide
ugggcagaguaggguggg

SEQ ID NO: 73514 - RNA, 18 nt, Artificial Sequence
  Description of Artificial Sequence: Synthetic oligonucleotide
uucugggcagaguagggu

SEQ ID NO: 73515 - RNA, 18 nt, Artificial Sequence
  Description of Artificial Sequence: Synthetic oligonucleotide
ugcacuucugggcagagu

SEQ ID NO: 73516 - RNA, 18 nt, Artificial Sequence
  Description of Artificial Sequence: Synthetic oligonucleotide
gcucuugcacuucugggc

SEQ ID NO: 73517 - RNA, 18 nt, Artificial Sequence
  Description of Artificial Sequence: Synthetic oligonucleotide
cuuaggcucuugcacuuc

SEQ ID NO: 73518 - RNA, 18 nt, Artificial Sequence
  Description of Artificial Sequence: Synthetic oligonucleotide
ggcggcuuaggcucuugc

SEQ ID NO: 73519 - RNA, 18 nt, Artificial Sequence
  Description of Artificial Sequence: Synthetic oligonucleotide
auggaggcggcuuaggcu

SEQ ID NO: 73520 - RNA, 18 nt, Artificial Sequence
  Description of Artificial Sequence: Synthetic oligonucleotide
gggccauggaggcggcuu

SEQ ID NO: 73521 - RNA, 18 nt, Artificial Sequence
  Description of Artificial Sequence: Synthetic oligonucleotide
cccugaauccuuccuggg

SEQ ID NO: 73522 - RNA, 18 nt, Artificial Sequence
  Description of Artificial Sequence: Synthetic oligonucleotide
ucuccccugaauccuucc

SEQ ID NO: 73523 - RNA, 18 nt, Artificial Sequence
  Description of Artificial Sequence: Synthetic oligonucleotide
gggccucuccccugaauc

SEQ ID NO: 73524 - RNA, 18 nt, Artificial Sequence
  Description of Artificial Sequence: Synthetic oligonucleotide
cguggcucccuguuuggg

SEQ ID NO: 73525 - RNA, 18 nt, Artificial Sequence
  Description of Artificial Sequence: Synthetic oligonucleotide
cuggcguggcucccuguu

SEQ ID NO: 73526 - RNA, 18 nt, Artificial Sequence
  Description of Artificial Sequence: Synthetic oligonucleotide
ucuggcuggcguggcucc

SEQ ID NO: 73527 - RNA, 18 nt, Artificial Sequence
  Description of Artificial Sequence: Synthetic oligonucleotide
gggugucuggcuggcgug

SEQ ID NO: 73528 - RNA, 18 nt, Artificial Sequence
  Description of Artificial Sequence: Synthetic oligonucleotide
agcuccauucuggccggg

SEQ ID NO: 73529 - RNA, 18 nt, Artificial Sequence
  Description of Artificial Sequence: Synthetic oligonucleotide
ucagcuccauucuggccg

SEQ ID NO: 73530 - RNA, 18 nt, Artificial Sequence
  Description of Artificial Sequence: Synthetic oligonucleotide
uagccccucagguguguu

SEQ ID NO: 73531 - RNA, 18 nt, Artificial Sequence
  Description of Artificial Sequence: Synthetic oligonucleotide
ggcccuagccccucaggu

SEQ ID NO: 73532 - RNA, 18 nt, Artificial Sequence
  Description of Artificial Sequence: Synthetic oligonucleotide
cauauggcccuagccccu

SEQ ID NO: 73533 - RNA, 18 nt, Artificial Sequence
  Description of Artificial Sequence: Synthetic oligonucleotide
guuuccauauggcccuag

SEQ ID NO: 73534 - RNA, 18 nt, Artificial Sequence
  Description of Artificial Sequence: Synthetic oligonucleotide
gucauguuuccauauggc

SEQ ID NO: 73535 - RNA, 18 nt, Artificial Sequence
  Description of Artificial Sequence: Synthetic oligonucleotide
cuucugucauguuuccau

SEQ ID NO: 73536 - RNA, 18 nt, Artificial Sequence
  Description of Artificial Sequence: Synthetic oligonucleotide
cuccccuucugucauguu

SEQ ID NO: 73537 - RNA, 18 nt, Artificial Sequence
  Description of Artificial Sequence: Synthetic oligonucleotide
ucucucuccccuucuguc

SEQ ID NO: 73538 - RNA, 18 nt, Artificial Sequence
  Description of Artificial Sequence: Synthetic oligonucleotide
uccuuucucucuccccuu

SEQ ID NO: 73539 - RNA, 18 nt, Artificial Sequence
  Description of Artificial Sequence: Synthetic oligonucleotide
gugucuccuuucucucuc

SEQ ID NO: 73540 - RNA, 18 nt, Artificial Sequence
  Description of Artificial Sequence: Synthetic oligonucleotide
gcagcgugucuccuuucu

SEQ ID NO: 73541 - RNA, 18 nt, Artificial Sequence
  Description of Artificial Sequence: Synthetic oligonucleotide
ccccugcagcgugucucc

SEQ ID NO: 73542 - RNA, 18 nt, Artificial Sequence
  Description of Artificial Sequence: Synthetic oligonucleotide
ccugcccccugcagcgug

SEQ ID NO: 73543 - RNA, 18 nt, Artificial Sequence
  Description of Artificial Sequence: Synthetic oligonucleotide
agcuuccugcccccugca

SEQ ID NO: 73544 - RNA, 18 nt, Artificial Sequence
  Description of Artificial Sequence: Synthetic oligonucleotide
cccccagcuuccugcccc

SEQ ID NO: 73545 - RNA, 18 nt, Artificial Sequence
  Description of Artificial Sequence: Synthetic oligonucleotide
ggguucccccagcuuccu

SEQ ID NO: 73546 - RNA, 18 nt, Artificial Sequence
  Description of Artificial Sequence: Synthetic oligonucleotide
agaauggguucccccagc

SEQ ID NO: 73547 - RNA, 18 nt, Artificial Sequence
  Description of Artificial Sequence: Synthetic oligonucleotide
uugggagaauggguuccc

SEQ ID NO: 73548 - RNA, 18 nt, Artificial Sequence
  Description of Artificial Sequence: Synthetic oligonucleotide
uauuuuugggagaauggg

SEQ ID NO: 73549 - RNA, 18 nt, Artificial Sequence
  Description of Artificial Sequence: Synthetic oligonucleotide
ccccuuauuuuugggaga

SEQ ID NO: 73550 - RNA, 18 nt, Artificial Sequence
  Description of Artificial Sequence: Synthetic oligonucleotide
ucagaccccuuauuuuug

SEQ ID NO: 73551 - RNA, 18 nt, Artificial Sequence
  Description of Artificial Sequence: Synthetic oligonucleotide
accccucagaccccuuau

SEQ ID NO: 73552 - RNA, 18 nt, Artificial Sequence
  Description of Artificial Sequence: Synthetic oligonucleotide
aauccaccccucagaccc

SEQ ID NO: 73553 - RNA, 18 nt, Artificial Sequence
  Description of Artificial Sequence: Synthetic oligonucleotide
cagggaauccaccccuca

SEQ ID NO: 73554 - RNA, 18 nt, Artificial Sequence
  Description of Artificial Sequence: Synthetic oligonucleotide
aaacccagggaauccacc

SEQ ID NO: 73555 - RNA, 18 nt, Artificial Sequence
  Description of Artificial Sequence: Synthetic oligonucleotide
gggagaauggguuccccc

SEQ ID NO: 73556 - RNA, 18 nt, Artificial Sequence
  Description of Artificial Sequence: Synthetic oligonucleotide
uuuuugggagaauggguu

SEQ ID NO: 73557 - RNA, 18 nt, Artificial Sequence
  Description of Artificial Sequence: Synthetic oligonucleotide
ccuuauuuuugggagaau

SEQ ID NO: 73558 - RNA, 18 nt, Artificial Sequence
  Description of Artificial Sequence: Synthetic oligonucleotide
agaccccuuauuuuuggg

SEQ ID NO: 73559 - RNA, 18 nt, Artificial Sequence
  Description of Artificial Sequence: Synthetic oligonucleotide
cccucagaccccuuauuu

SEQ ID NO: 73560 - RNA, 18 nt, Artificial Sequence
  Description of Artificial Sequence: Synthetic oligonucleotide
uccaccccucagaccccu

SEQ ID NO: 73561 - RNA, 18 nt, Artificial Sequence
  Description of Artificial Sequence: Synthetic oligonucleotide
gggaauccaccccucaga

SEQ ID NO: 73562 - RNA, 18 nt, Artificial Sequence
  Description of Artificial Sequence: Synthetic oligonucleotide
acccagggaauccacccc

SEQ ID NO: 73563 - RNA, 18 nt, Artificial Sequence
  Description of Artificial Sequence: Synthetic oligonucleotide
cugaaacccagggaaucc

SEQ ID NO: 73564 - RNA, 18 nt, Artificial Sequence
  Description of Artificial Sequence: Synthetic oligonucleotide
cagaccugaaacccaggg

SEQ ID NO: 73565 - RNA, 18 nt, Artificial Sequence
  Description of Artificial Sequence: Synthetic oligonucleotide
ggacccagaccugaaacc

SEQ ID NO: 73566 - RNA, 18 nt, Artificial Sequence
  Description of Artificial Sequence: Synthetic oligonucleotide
auucaggacccagaccug

SEQ ID NO: 73567 - RNA, 18 nt, Artificial Sequence
  Description of Artificial Sequence: Synthetic oligonucleotide
uucccauucaggacccag

SEQ ID NO: 73568 - RNA, 18 nt, Artificial Sequence
  Description of Artificial Sequence: Synthetic oligonucleotide
aggaauucccauucagga

SEQ ID NO: 73569 - RNA, 18 nt, Artificial Sequence
  Description of Artificial Sequence: Synthetic oligonucleotide
auuccaggaauucccauu

SEQ ID NO: 73570 - RNA, 18 nt, Artificial Sequence
  Description of Artificial Sequence: Synthetic oligonucleotide
cugguauuccaggaauuc

SEQ ID NO: 73571 - RNA, 18 nt, Artificial Sequence
  Description of Artificial Sequence: Synthetic oligonucleotide
gucagcugguauuccagg

SEQ ID NO: 73572 - RNA, 18 nt, Artificial Sequence
  Description of Artificial Sequence: Synthetic oligonucleotide
ucauugucagcugguauu

SEQ ID NO: 73573 - RNA, 18 nt, Artificial Sequence
  Description of Artificial Sequence: Synthetic oligonucleotide
ggaaaucauugucagcug

SEQ ID NO: 73574 - RNA, 18 nt, Artificial Sequence
  Description of Artificial Sequence: Synthetic oligonucleotide
gaggaggaaaucauuguc

SEQ ID NO: 73575 - RNA, 18 nt, Artificial Sequence
  Description of Artificial Sequence: Synthetic oligonucleotide
aagaugaggaggaaauca

SEQ ID NO: 73576 - RNA, 18 nt, Artificial Sequence
  Description of Artificial Sequence: Synthetic oligonucleotide
guugaaagaugaggagga

SEQ ID NO: 73577 - RNA, 18 nt, Artificial Sequence
  Description of Artificial Sequence: Synthetic oligonucleotide
gugagguugaaagaugag

SEQ ID NO: 73578 - RNA, 18 nt, Artificial Sequence
  Description of Artificial Sequence: Synthetic oligonucleotide
augaccacgaggagcaau

SEQ ID NO: 73579 - RNA, 18 nt, Artificial Sequence
  Description of Artificial Sequence: Synthetic oligonucleotide
gaagcaugaccacgagga

SEQ ID NO: 73580 - RNA, 18 nt, Artificial Sequence
  Description of Artificial Sequence: Synthetic oligonucleotide
uaggagaagcaugaccac

SEQ ID NO: 73581 - RNA, 18 nt, Artificial Sequence
  Description of Artificial Sequence: Synthetic oligonucleotide
gcaguuaggagaagcaug

SEQ ID NO: 73582 - RNA, 18 nt, Artificial Sequence
  Description of Artificial Sequence: Synthetic oligonucleotide
gccuugcaguuaggagaa

SEQ ID NO: 73583 - RNA, 18 nt, Artificial Sequence
  Description of Artificial Sequence: Synthetic oligonucleotide
cguuagccuugcaguuag

SEQ ID NO: 73584 - RNA, 18 nt, Artificial Sequence
  Description of Artificial Sequence: Synthetic oligonucleotide
gacagcguuagccuugca

SEQ ID NO: 73585 - RNA, 18 nt, Artificial Sequence
  Description of Artificial Sequence: Synthetic oligonucleotide
ggcuggacagcguuagcc

SEQ ID NO: 73586 - RNA, 18 nt, Artificial Sequence
  Description of Artificial Sequence: Synthetic oligonucleotide
agccgggcuggacagcgu

SEQ ID NO: 73587 - RNA, 18 nt, Artificial Sequence
  Description of Artificial Sequence: Synthetic oligonucleotide
ggaggagccgggcuggac

SEQ ID NO: 73588 - RNA, 18 nt, Artificial Sequence
  Description of Artificial Sequence: Synthetic oligonucleotide
aagcaggaggagccgggc

SEQ ID NO: 73589 - RNA, 18 nt, Artificial Sequence
  Description of Artificial Sequence: Synthetic oligonucleotide
gucacaagcaggaggagc

SEQ ID NO: 73590 - RNA, 18 nt, Artificial Sequence
  Description of Artificial Sequence: Synthetic oligonucleotide
cggaggucacaagcagga

SEQ ID NO: 73591 - RNA, 18 nt, Artificial Sequence
  Description of Artificial Sequence: Synthetic oligonucleotide
ggacucggaggucacaag

SEQ ID NO: 73592 - RNA, 18 nt, Artificial Sequence
  Description of Artificial Sequence: Synthetic oligonucleotide
acugaggacucggagguc

SEQ ID NO: 73593 - RNA, 18 nt, Artificial Sequence
  Description of Artificial Sequence: Synthetic oligonucleotide
aguuuacugaggacucgg

SEQ ID NO: 73594 - RNA, 18 nt, Artificial Sequence
  Description of Artificial Sequence: Synthetic oligonucleotide
gaagcaguuuacugagga

SEQ ID NO: 73595 - RNA, 18 nt, Artificial Sequence
  Description of Artificial Sequence: Synthetic oligonucleotide
gucacgaagcaguuuacu

SEQ ID NO: 73596 - RNA, 18 nt, Artificial Sequence
  Description of Artificial Sequence: Synthetic oligonucleotide
ugggagucacgaagcagu

SEQ ID NO: 73597 - RNA, 18 nt, Artificial Sequence
  Description of Artificial Sequence: Synthetic oligonucleotide
ggacaugggagucacgaa

SEQ ID NO: 73598 - RNA, 18 nt, Artificial Sequence
  Description of Artificial Sequence: Synthetic oligonucleotide
gugaaggacaugggaguc

SEQ ID NO: 73599 - RNA, 18 nt, Artificial Sequence
  Description of Artificial Sequence: Synthetic oligonucleotide
cugcugugaaggacaugg

SEQ ID NO: 73600 - RNA, 18 nt, Artificial Sequence
  Description of Artificial Sequence: Synthetic oligonucleotide
caugaccacgaggagcaa

SEQ ID NO: 73601 - RNA, 18 nt, Artificial Sequence
  Description of Artificial Sequence: Synthetic oligonucleotide
agaagcaugaccacgagg

SEQ ID NO: 73602 - RNA, 18 nt, Artificial Sequence
  Description of Artificial Sequence: Synthetic oligonucleotide
uuaggagaagcaugacca

SEQ ID NO: 73603 - RNA, 18 nt, Artificial Sequence
  Description of Artificial Sequence: Synthetic oligonucleotide
ugcaguuaggagaagcau

SEQ ID NO: 73604 - RNA, 18 nt, Artificial Sequence
  Description of Artificial Sequence: Synthetic oligonucleotide
agccuugcaguuaggaga

SEQ ID NO: 73605 - RNA, 18 nt, Artificial Sequence
  Description of Artificial Sequence: Synthetic oligonucleotide
gcguuagccuugcaguua

SEQ ID NO: 73606 - RNA, 18 nt, Artificial Sequence
  Description of Artificial Sequence: Synthetic oligonucleotide
ggacagcguuagccuugc

SEQ ID NO: 73607 - RNA, 18 nt, Artificial Sequence
  Description of Artificial Sequence: Synthetic oligonucleotide
gggcuggacagcguuagc

SEQ ID NO: 73608 - RNA, 18 nt, Artificial Sequence
  Description of Artificial Sequence: Synthetic oligonucleotide
gagccgggcuggacagcg

SEQ ID NO: 73609 - RNA, 18 nt, Artificial Sequence
  Description of Artificial Sequence: Synthetic oligonucleotide
aggaggagccgggcugga

SEQ ID NO: 73610 - RNA, 18 nt, Artificial Sequence
  Description of Artificial Sequence: Synthetic oligonucleotide
caagcaggaggagccggg

SEQ ID NO: 73611 - RNA, 18 nt, Artificial Sequence
  Description of Artificial Sequence: Synthetic oligonucleotide
ggucacaagcaggaggag

SEQ ID NO: 73612 - RNA, 18 nt, Artificial Sequence
  Description of Artificial Sequence: Synthetic oligonucleotide
ucggaggucacaagcagg

SEQ ID NO: 73613 - RNA, 18 nt, Artificial Sequence
  Description of Artificial Sequence: Synthetic oligonucleotide
aggacucggaggucacaa

SEQ ID NO: 73614 - RNA, 18 nt, Artificial Sequence
  Description of Artificial Sequence: Synthetic oligonucleotide
uacugaggacucggaggu

SEQ ID NO: 73615 - RNA, 18 nt, Artificial Sequence
  Description of Artificial Sequence: Synthetic oligonucleotide
caguuuacugaggacucg

SEQ ID NO: 73616 - RNA, 18 nt, Artificial Sequence
  Description of Artificial Sequence: Synthetic oligonucleotide
cgaagcaguuuacugagg

SEQ ID NO: 73617 - RNA, 18 nt, Artificial Sequence
  Description of Artificial Sequence: Synthetic oligonucleotide
agucacgaagcaguuuac

SEQ ID NO: 73618 - RNA, 18 nt, Artificial Sequence
  Description of Artificial Sequence: Synthetic oligonucleotide
augggagucacgaagcag

SEQ ID NO: 73619 - RNA, 18 nt, Artificial Sequence
  Description of Artificial Sequence: Synthetic oligonucleotide
aggacaugggagucacga

SEQ ID NO: 73620 - RNA, 18 nt, Artificial Sequence
  Description of Artificial Sequence: Synthetic oligonucleotide
ugugaaggacaugggagu

SEQ ID NO: 73621 - RNA, 18 nt, Artificial Sequence
  Description of Artificial Sequence: Synthetic oligonucleotide
ucugcugugaaggacaug

SEQ ID NO: 73622 - RNA, 18 nt, Artificial Sequence
  Description of Artificial Sequence: Synthetic oligonucleotide
gggauaauguugggaguu

SEQ ID NO: 73623 - RNA, 18 nt, Artificial Sequence
  Description of Artificial Sequence: Synthetic oligonucleotide
uaccaguuacgcggauaa

SEQ ID NO: 73624 - RNA, 18 nt, Artificial Sequence
  Description of Artificial Sequence: Synthetic oligonucleotide
ugucuuaccaguuacgcg

SEQ ID NO: 73625 - RNA, 18 nt, Artificial Sequence
  Description of Artificial Sequence: Synthetic oligonucleotide
augggugucuuaccaguu

SEQ ID NO: 73626 - RNA, 18 nt, Artificial Sequence
  Description of Artificial Sequence: Synthetic oligonucleotide
ggaguaugggugucuuac

SEQ ID NO: 73627 - RNA, 18 nt, Artificial Sequence
  Description of Artificial Sequence: Synthetic oligonucleotide
uccugggaguaugggugu

SEQ ID NO: 73628 - RNA, 18 nt, Artificial Sequence
  Description of Artificial Sequence: Synthetic oligonucleotide
ugucuuccugggaguaug

SEQ ID NO: 73629 - RNA, 18 nt, Artificial Sequence
  Description of Artificial Sequence: Synthetic oligonucleotide
gauggugucuuccuggga

SEQ ID NO: 73630 - RNA, 18 nt, Artificial Sequence
  Description of Artificial Sequence: Synthetic oligonucleotide
gaagugauggugucuucc

SEQ ID NO: 73631 - RNA, 18 nt, Artificial Sequence
  Description of Artificial Sequence: Synthetic oligonucleotide
uagaggaagugauggugu

SEQ ID NO: 73632 - RNA, 18 nt, Artificial Sequence
  Description of Artificial Sequence: Synthetic oligonucleotide
ggaguuagaggaagugau

SEQ ID NO: 73633 - RNA, 18 nt, Artificial Sequence
  Description of Artificial Sequence: Synthetic oligonucleotide
gucaaggaguuagaggaa

SEQ ID NO: 73634 - RNA, 18 nt, Artificial Sequence
  Description of Artificial Sequence: Synthetic oligonucleotide
auugggucaaggaguuag

SEQ ID NO: 73635 - RNA, 18 nt, Artificial Sequence
  Description of Artificial Sequence: Synthetic oligonucleotide
uagucauugggucaagga

SEQ ID NO: 73636 - RNA, 18 nt, Artificial Sequence
  Description of Artificial Sequence: Synthetic oligonucleotide
aagaauagucauuggguc

SEQ ID NO: 73637 - RNA, 18 nt, Artificial Sequence
  Description of Artificial Sequence: Synthetic oligonucleotide
augggaagaauagucauu

SEQ ID NO: 73638 - RNA, 18 nt, Artificial Sequence
  Description of Artificial Sequence: Synthetic oligonucleotide
acaauaugggaagaauag

SEQ ID NO: 73639 - RNA, 18 nt, Artificial Sequence
  Description of Artificial Sequence: Synthetic oligonucleotide
gggacaauaugggaagaa

SEQ ID NO: 73640 - RNA, 18 nt, Artificial Sequence
  Description of Artificial Sequence: Synthetic oligonucleotide
gugugaucaguagguggg

SEQ ID NO: 73641 - RNA, 18 nt, Artificial Sequence
  Description of Artificial Sequence: Synthetic oligonucleotide
agagagugugaucaguag

SEQ ID NO: 73642 - RNA, 18 nt, Artificial Sequence
  Description of Artificial Sequence: Synthetic oligonucleotide
uugucagagagugugauc

SEQ ID NO: 73643 - RNA, 18 nt, Artificial Sequence
  Description of Artificial Sequence: Synthetic oligonucleotide
aauccuugucagagagug

SEQ ID NO: 73644 - RNA, 18 nt, Artificial Sequence
  Description of Artificial Sequence: Synthetic oligonucleotide
agaauaauccuugucaga

SEQ ID NO: 73645 - RNA, 18 nt, Artificial Sequence
  Description of Artificial Sequence: Synthetic oligonucleotide
ugugaagaauaauccuug

SEQ ID NO: 73646 - RNA, 18 nt, Artificial Sequence
  Description of Artificial Sequence: Synthetic oligonucleotide
uguauugugaagaauaau

SEQ ID NO: 73647 - RNA, 18 nt, Artificial Sequence
  Description of Artificial Sequence: Synthetic oligonucleotide
cgggcuguauugugaaga

SEQ ID NO: 73648 - RNA, 18 nt, Artificial Sequence
  Description of Artificial Sequence: Synthetic oligonucleotide
gugugaucaguagguggg

SEQ ID NO: 73649 - RNA, 18 nt, Artificial Sequence
  Description of Artificial Sequence: Synthetic oligonucleotide
gagagugugaucaguagg

SEQ ID NO: 73650 - RNA, 18 nt, Artificial Sequence
  Description of Artificial Sequence: Synthetic oligonucleotide
ugucagagagugugauca

SEQ ID NO: 73651 - RNA, 18 nt, Artificial Sequence
  Description of Artificial Sequence: Synthetic oligonucleotide
auccuugucagagagugu

SEQ ID NO: 73652 - RNA, 18 nt, Artificial Sequence
  Description of Artificial Sequence: Synthetic oligonucleotide
gaauaauccuugucagag

SEQ ID NO: 73653 - RNA, 18 nt, Artificial Sequence
  Description of Artificial Sequence: Synthetic oligonucleotide
gugaagaauaauccuugu

SEQ ID NO: 73654 - RNA, 18 nt, Artificial Sequence
  Description of Artificial Sequence: Synthetic oligonucleotide
guauugugaagaauaauc

SEQ ID NO: 73655 - RNA, 18 nt, Artificial Sequence
  Description of Artificial Sequence: Synthetic oligonucleotide
gggcuguauugugaagaa

SEQ ID NO: 73656 - RNA, 18 nt, Artificial Sequence
  Description of Artificial Sequence: Synthetic oligonucleotide
aaugcgggcuguauugug

SEQ ID NO: 73657 - RNA, 18 nt, Artificial Sequence
  Description of Artificial Sequence: Synthetic oligonucleotide
uuuuaaaugcgggcugua

SEQ ID NO: 73658 - RNA, 18 nt, Artificial Sequence
  Description of Artificial Sequence: Synthetic oligonucleotide
agagcuuuuaaaugcggg

SEQ ID NO: 73659 - RNA, 18 nt, Artificial Sequence
  Description of Artificial Sequence: Synthetic oligonucleotide
agacgagagcuuuuaaau

SEQ ID NO: 73660 - RNA, 18 nt, Artificial Sequence
  Description of Artificial Sequence: Synthetic oligonucleotide
ucucuagacgagagcuuu

SEQ ID NO: 73661 - RNA, 18 nt, Artificial Sequence
  Description of Artificial Sequence: Synthetic oligonucleotide
uacuaucucuagacgaga

SEQ ID NO: 73662 - RNA, 18 nt, Artificial Sequence
  Description of Artificial Sequence: Synthetic oligonucleotide
augaguacuaucucuaga

SEQ ID NO: 73663 - RNA, 18 nt, Artificial Sequence
  Description of Artificial Sequence: Synthetic oligonucleotide
ccuccaugaguacuaucu

SEQ ID NO: 73664 - RNA, 18 nt, Artificial Sequence
  Description of Artificial Sequence: Synthetic oligonucleotide
cuaguccuccaugaguac

SEQ ID NO: 73665 - RNA, 18 nt, Artificial Sequence
  Description of Artificial Sequence: Synthetic oligonucleotide
gcaggcuaguccuccaug

SEQ ID NO: 73666 - RNA, 18 nt, Artificial Sequence
  Description of Artificial Sequence: Synthetic oligonucleotide
aauaagcaggcuaguccu

SEQ ID NO: 73667 - RNA, 18 nt, Artificial Sequence
  Description of Artificial Sequence: Synthetic oligonucleotide
agccuaauaagcaggcua

SEQ ID NO: 73668 - RNA, 18 nt, Artificial Sequence
  Description of Artificial Sequence: Synthetic oligonucleotide
augguagccuaauaagca

SEQ ID NO: 73669 - RNA, 18 nt, Artificial Sequence
  Description of Artificial Sequence: Synthetic oligonucleotide
gagcuaugguagccuaau

SEQ ID NO: 73670 - RNA, 18 nt, Artificial Sequence
  Description of Artificial Sequence: Synthetic oligonucleotide
agagagagcuaugguagc

SEQ ID NO: 73671 - RNA, 18 nt, Artificial Sequence
  Description of Artificial Sequence: Synthetic oligonucleotide
gaaauagagagagcuaug

SEQ ID NO: 73672 - RNA, 18 nt, Artificial Sequence
  Description of Artificial Sequence: Synthetic oligonucleotide
gagcugaaauagagagag

SEQ ID NO: 73673 - RNA, 18 nt, Artificial Sequence
  Description of Artificial Sequence: Synthetic oligonucleotide
gaagggagcugaaauaga

SEQ ID NO: 73674 - RNA, 18 nt, Artificial Sequence
  Description of Artificial Sequence: Synthetic oligonucleotide
gaaccucugggcacuggc

SEQ ID NO: 73675 - RNA, 18 nt, Artificial Sequence
  Description of Artificial Sequence: Synthetic oligonucleotide
agggugaaccucugggca

SEQ ID NO: 73676 - RNA, 18 nt, Artificial Sequence
  Description of Artificial Sequence: Synthetic oligonucleotide
ggcaaagggugaaccucu

SEQ ID NO: 73677 - RNA, 18 nt, Artificial Sequence
  Description of Artificial Sequence: Synthetic oligonucleotide
guguaggcaaagggugaa

SEQ ID NO: 73678 - RNA, 18 nt, Artificial Sequence
  Description of Artificial Sequence: Synthetic oligonucleotide
gacagguguaggcaaagg

SEQ ID NO: 73679 - RNA, 18 nt, Artificial Sequence
  Description of Artificial Sequence: Synthetic oligonucleotide
agcaggacagguguaggc

SEQ ID NO: 73680 - RNA, 18 nt, Artificial Sequence
  Description of Artificial Sequence: Synthetic oligonucleotide
caggcagcaggacaggug

SEQ ID NO: 73681 - RNA, 18 nt, Artificial Sequence
  Description of Artificial Sequence: Synthetic oligonucleotide
cacagcaggcagcaggac

SEQ ID NO: 73682 - RNA, 18 nt, Artificial Sequence
  Description of Artificial Sequence: Synthetic oligonucleotide
aaguccacagcaggcagc

SEQ ID NO: 73683 - RNA, 18 nt, Artificial Sequence
  Description of Artificial Sequence: Synthetic oligonucleotide
agcuaaaguccacagcag

SEQ ID NO: 73684 - RNA, 18 nt, Artificial Sequence
  Description of Artificial Sequence: Synthetic oligonucleotide
ucccaagcuaaaguccac

SEQ ID NO: 73685 - RNA, 18 nt, Artificial Sequence
  Description of Artificial Sequence: Synthetic oligonucleotide
cauucucccaagcuaaag

SEQ ID NO: 73686 - RNA, 18 nt, Artificial Sequence
  Description of Artificial Sequence: Synthetic oligonucleotide
uuuuccauucucccaagc

SEQ ID NO: 73687 - RNA, 18 nt, Artificial Sequence
  Description of Artificial Sequence: Synthetic oligonucleotide
cuggguuuuccauucucc

SEQ ID NO: 73688 - RNA, 18 nt, Artificial Sequence
  Description of Artificial Sequence: Synthetic oligonucleotide
gaaccucugggcacuggc

SEQ ID NO: 73689 - RNA, 18 nt, Artificial Sequence
  Description of Artificial Sequence: Synthetic oligonucleotide
agggugaaccucugggca

SEQ ID NO: 73690 - RNA, 18 nt, Artificial Sequence
  Description of Artificial Sequence: Synthetic oligonucleotide
ggcaaagggugaaccucu

SEQ ID NO: 73691 - RNA, 18 nt, Artificial Sequence
  Description of Artificial Sequence: Synthetic oligonucleotide
guguaggcaaagggugaa

SEQ ID NO: 73692 - RNA, 18 nt, Artificial Sequence
  Description of Artificial Sequence: Synthetic oligonucleotide
gacagguguaggcaaagg

SEQ ID NO: 73693 - RNA, 18 nt, Artificial Sequence
  Description of Artificial Sequence: Synthetic oligonucleotide
agcaggacagguguaggc

SEQ ID NO: 73694 - RNA, 18 nt, Artificial Sequence
  Description of Artificial Sequence: Synthetic oligonucleotide
caggcagcaggacaggug

SEQ ID NO: 73695 - RNA, 18 nt, Artificial Sequence
  Description of Artificial Sequence: Synthetic oligonucleotide
cacagcaggcagcaggac

SEQ ID NO: 73696 - RNA, 18 nt, Artificial Sequence
  Description of Artificial Sequence: Synthetic oligonucleotide
aaguccacagcaggcagc

SEQ ID NO: 73697 - RNA, 18 nt, Artificial Sequence
  Description of Artificial Sequence: Synthetic oligonucleotide
agcuaaaguccacagcag

SEQ ID NO: 73698 - RNA, 18 nt, Artificial Sequence
  Description of Artificial Sequence: Synthetic oligonucleotide
ucccaagcuaaaguccac

SEQ ID NO: 73699 - RNA, 18 nt, Artificial Sequence
  Description of Artificial Sequence: Synthetic oligonucleotide
cauucucccaagcuaaag

SEQ ID NO: 73700 - RNA, 18 nt, Artificial Sequence
  Description of Artificial Sequence: Synthetic oligonucleotide
uuuuccauucucccaagc

SEQ ID NO: 73701 - RNA, 18 nt, Artificial Sequence
  Description of Artificial Sequence: Synthetic oligonucleotide
cuggguuuuccauucucc

SEQ ID NO: 73702 - RNA, 18 nt, Artificial Sequence
  Description of Artificial Sequence: Synthetic oligonucleotide
aagguuagggauggcuuu

SEQ ID NO: 73703 - RNA, 18 nt, Artificial Sequence
  Description of Artificial Sequence: Synthetic oligonucleotide
aagccaagguuagggaug

SEQ ID NO: 73704 - RNA, 18 nt, Artificial Sequence
  Description of Artificial Sequence: Synthetic oligonucleotide
uagggaagccaagguuag

SEQ ID NO: 73705 - RNA, 18 nt, Artificial Sequence
  Description of Artificial Sequence: Synthetic oligonucleotide
ggacuuagggaagccaag

SEQ ID NO: 73706 - RNA, 18 nt, Artificial Sequence
  Description of Artificial Sequence: Synthetic oligonucleotide
agacaggacuuagggaag

SEQ ID NO: 73707 - RNA, 18 nt, Artificial Sequence
  Description of Artificial Sequence: Synthetic oligonucleotide
acugaagacaggacuuag

SEQ ID NO: 73708 - RNA, 18 nt, Artificial Sequence
  Description of Artificial Sequence: Synthetic oligonucleotide
gggaaacugaagacagga

SEQ ID NO: 73709 - RNA, 18 nt, Artificial Sequence
  Description of Artificial Sequence: Synthetic oligonucleotide
gcagugggaaacugaaga

SEQ ID NO: 73710 - RNA, 18 nt, Artificial Sequence
  Description of Artificial Sequence: Synthetic oligonucleotide
gggaagcagugggaaacu

SEQ ID NO: 73711 - RNA, 18 nt, Artificial Sequence
  Description of Artificial Sequence: Synthetic oligonucleotide
uccaugggaagcaguggg

SEQ ID NO: 73712 - RNA, 18 nt, Artificial Sequence
  Description of Artificial Sequence: Synthetic oligonucleotide
gagaauccaugggaagca

SEQ ID NO: 73713 - RNA, 18 nt, Artificial Sequence
  Description of Artificial Sequence: Synthetic oligonucleotide
uguuggagaauccauggg

SEQ ID NO: 73714 - RNA, 18 nt, Artificial Sequence
  Description of Artificial Sequence: Synthetic oligonucleotide
aagaauguuggagaaucc

SEQ ID NO: 73715 - RNA, 18 nt, Artificial Sequence
  Description of Artificial Sequence: Synthetic oligonucleotide
agcucaagaauguuggag

SEQ ID NO: 73716 - RNA, 18 nt, Artificial Sequence
  Description of Artificial Sequence: Synthetic oligonucleotide
uaaaaagcucaagaaugu

SEQ ID NO: 73717 - RNA, 18 nt, Artificial Sequence
  Description of Artificial Sequence: Synthetic oligonucleotide
auuuuuaaaaagcucaag

SEQ ID NO: 73718 - RNA, 18 nt, Artificial Sequence
  Description of Artificial Sequence: Synthetic oligonucleotide
gagauauuuuuaaaaagc

SEQ ID NO: 73719 - RNA, 18 nt, Artificial Sequence
  Description of Artificial Sequence: Synthetic oligonucleotide
aaggugagauauuuuuaa

SEQ ID NO: 73720 - RNA, 18 nt, Artificial Sequence
  Description of Artificial Sequence: Synthetic oligonucleotide
agcugaaggugagauauu

SEQ ID NO: 73721 - RNA, 18 nt, Artificial Sequence
  Description of Artificial Sequence: Synthetic oligonucleotide
ggccaagcugaaggugag

SEQ ID NO: 73722 - RNA, 18 nt, Artificial Sequence
  Description of Artificial Sequence: Synthetic oligonucleotide
aggguggccaagcugaag

SEQ ID NO: 73723 - RNA, 18 nt, Artificial Sequence
  Description of Artificial Sequence: Synthetic oligonucleotide
ggguuaggguggccaagc

SEQ ID NO: 73724 - RNA, 18 nt, Artificial Sequence
  Description of Artificial Sequence: Synthetic oligonucleotide
agauuggguuaggguggc

SEQ ID NO: 73725 - RNA, 18 nt, Artificial Sequence
  Description of Artificial Sequence: Synthetic oligonucleotide
aauguagauuggguuagg

SEQ ID NO: 73726 - RNA, 18 nt, Artificial Sequence
  Description of Artificial Sequence: Synthetic oligonucleotide
aggugaauguagauuggg

SEQ ID NO: 73727 - RNA, 18 nt, Artificial Sequence
  Description of Artificial Sequence: Synthetic oligonucleotide
aucauaggugaauguaga

SEQ ID NO: 73728 - RNA, 18 nt, Artificial Sequence
  Description of Artificial Sequence: Synthetic oligonucleotide
cuaucaucauaggugaau

SEQ ID NO: 73729 - RNA, 18 nt, Artificial Sequence
  Description of Artificial Sequence: Synthetic oligonucleotide
acaggcuaucaucauagg

SEQ ID NO: 73730 - RNA, 18 nt, Artificial Sequence
  Description of Artificial Sequence: Synthetic oligonucleotide
uauccacaggcuaucauc

SEQ ID NO: 73731 - RNA, 18 nt, Artificial Sequence
  Description of Artificial Sequence: Synthetic oligonucleotide
caucuuauccacaggcua

SEQ ID NO: 73732 - RNA, 18 nt, Artificial Sequence
  Description of Artificial Sequence: Synthetic oligonucleotide
gccaucaucuuauccaca

SEQ ID NO: 73733 - RNA, 18 nt, Artificial Sequence
  Description of Artificial Sequence: Synthetic oligonucleotide
ugcaagccaucaucuuau

SEQ ID NO: 73734 - RNA, 18 nt, Artificial Sequence
  Description of Artificial Sequence: Synthetic oligonucleotide
ggaccugcaagccaucau

SEQ ID NO: 73735 - RNA, 18 nt, Artificial Sequence
  Description of Artificial Sequence: Synthetic oligonucleotide
auauuggaccugcaagcc

SEQ ID NO: 73736 - RNA, 18 nt, Artificial Sequence
  Description of Artificial Sequence: Synthetic oligonucleotide
uucacauauuggaccugc

SEQ ID NO: 73737 - RNA, 18 nt, Artificial Sequence
  Description of Artificial Sequence: Synthetic oligonucleotide
aucuauucacauauugga

SEQ ID NO: 73738 - RNA, 18 nt, Artificial Sequence
  Description of Artificial Sequence: Synthetic oligonucleotide
uucaaaucuauucacaua

SEQ ID NO: 73739 - RNA, 18 nt, Artificial Sequence
  Description of Artificial Sequence: Synthetic oligonucleotide
ucagcuucaaaucuauuc

SEQ ID NO: 73740 - RNA, 18 nt, Artificial Sequence
  Description of Artificial Sequence: Synthetic oligonucleotide
gguguucagcuucaaauc

SEQ ID NO: 73741 - RNA, 18 nt, Artificial Sequence
  Description of Artificial Sequence: Synthetic oligonucleotide
uucaugguguucagcuuc

SEQ ID NO: 73742 - RNA, 18 nt, Artificial Sequence
  Description of Artificial Sequence: Synthetic oligonucleotide
agcuuuucaugguguuca

SEQ ID NO: 73743 - RNA, 18 nt, Artificial Sequence
  Description of Artificial Sequence: Synthetic oligonucleotide
ucuccagcuuuucauggu

SEQ ID NO: 73744 - RNA, 18 nt, Artificial Sequence
  Description of Artificial Sequence: Synthetic oligonucleotide
auuucucuccagcuuuuc

SEQ ID NO: 73745 - RNA, 18 nt, Artificial Sequence
  Description of Artificial Sequence: Synthetic oligonucleotide
gagcgauuucucuccagc

SEQ ID NO: 73746 - RNA, 18 nt, Artificial Sequence
  Description of Artificial Sequence: Synthetic oligonucleotide
gccaugagcgauuucucu

SEQ ID NO: 73747 - RNA, 18 nt, Artificial Sequence
  Description of Artificial Sequence: Synthetic oligonucleotide
gcauggccaugagcgauu

SEQ ID NO: 73748 - RNA, 18 nt, Artificial Sequence
  Description of Artificial Sequence: Synthetic oligonucleotide
caaaggcauggccaugag

SEQ ID NO: 73749 - RNA, 18 nt, Artificial Sequence
  Description of Artificial Sequence: Synthetic oligonucleotide
uaggucaaaggcauggcc

SEQ ID NO: 73750 - RNA, 18 nt, Artificial Sequence
  Description of Artificial Sequence: Synthetic oligonucleotide
gggaauaggucaaaggca

SEQ ID NO: 73751 - RNA, 18 nt, Artificial Sequence
  Description of Artificial Sequence: Synthetic oligonucleotide
ugaacgggaauaggucaa

SEQ ID NO: 73752 - RNA, 18 nt, Artificial Sequence
  Description of Artificial Sequence: Synthetic oligonucleotide
aagacugaacgggaauag

SEQ ID NO: 73753 - RNA, 18 nt, Artificial Sequence
  Description of Artificial Sequence: Synthetic oligonucleotide
uuaagaagacugaacggg

SEQ ID NO: 73754 - RNA, 18 nt, Artificial Sequence
  Description of Artificial Sequence: Synthetic oligonucleotide
ccaauuuaagaagacuga

SEQ ID NO: 73755 - RNA, 18 nt, Artificial Sequence
  Description of Artificial Sequence: Synthetic oligonucleotide
ucaugccaauuuaagaag

SEQ ID NO: 73756 - RNA, 18 nt, Artificial Sequence
  Description of Artificial Sequence: Synthetic oligonucleotide
cuucuucaugccaauuua

SEQ ID NO: 73757 - RNA, 18 nt, Artificial Sequence
  Description of Artificial Sequence: Synthetic oligonucleotide
ucuugcuucuucaugcca

SEQ ID NO: 73758 - RNA, 18 nt, Artificial Sequence
  Description of Artificial Sequence: Synthetic oligonucleotide
augagucuugcuucuuca

SEQ ID NO: 73759 - RNA, 18 nt, Artificial Sequence
  Description of Artificial Sequence: Synthetic oligonucleotide
gacauaugagucuugcuu

SEQ ID NO: 73760 - RNA, 18 nt, Artificial Sequence
  Description of Artificial Sequence: Synthetic oligonucleotide
uggaugacauaugagucu

SEQ ID NO: 73761 - RNA, 18 nt, Artificial Sequence
  Description of Artificial Sequence: Synthetic oligonucleotide
aucuguggaugacauaug

SEQ ID NO: 73762 - RNA, 18 nt, Artificial Sequence
  Description of Artificial Sequence: Synthetic oligonucleotide
gugucaucuguggaugac

SEQ ID NO: 73763 - RNA, 18 nt, Artificial Sequence
  Description of Artificial Sequence: Synthetic oligonucleotide
gcuuugugucaucugugg

SEQ ID NO: 73764 - RNA, 18 nt, Artificial Sequence
  Description of Artificial Sequence: Synthetic oligonucleotide
ucccagcuuugugucauc

SEQ ID NO: 73765 - RNA, 18 nt, Artificial Sequence
  Description of Artificial Sequence: Synthetic oligonucleotide
guacuucccagcuuugug

SEQ ID NO: 73766 - RNA, 18 nt, Artificial Sequence
  Description of Artificial Sequence: Synthetic oligonucleotide
uagugguacuucccagcu

SEQ ID NO: 73767 - RNA, 18 nt, Artificial Sequence
  Description of Artificial Sequence: Synthetic oligonucleotide
uauuuuagugguacuucc

SEQ ID NO: 73768 - RNA, 18 nt, Artificial Sequence
  Description of Artificial Sequence: Synthetic oligonucleotide
uuuguuauuuuaguggua

SEQ ID NO: 73769 - RNA, 18 nt, Artificial Sequence
  Description of Artificial Sequence: Synthetic oligonucleotide
agucuuuuguuauuuuag

SEQ ID NO: 73770 - RNA, 18 nt, Artificial Sequence
  Description of Artificial Sequence: Synthetic oligonucleotide
gauucagucuuuuguuau

SEQ ID NO: 73771 - RNA, 18 nt, Artificial Sequence
  Description of Artificial Sequence: Synthetic oligonucleotide
aucuugauucagucuuuu

SEQ ID NO: 73772 - RNA, 18 nt, Artificial Sequence
  Description of Artificial Sequence: Synthetic oligonucleotide
uuugaaucuugauucagu

SEQ ID NO: 73773 - RNA, 18 nt, Artificial Sequence
  Description of Artificial Sequence: Synthetic oligonucleotide
agugauuugaaucuugau

SEQ ID NO: 73774 - RNA, 18 nt, Artificial Sequence
  Description of Artificial Sequence: Synthetic oligonucleotide
cuuucagugauuugaauc

SEQ ID NO: 73775 - RNA, 18 nt, Artificial Sequence
  Description of Artificial Sequence: Synthetic oligonucleotide
cuagucuuucagugauuu

SEQ ID NO: 73776 - RNA, 18 nt, Artificial Sequence
  Description of Artificial Sequence: Synthetic oligonucleotide
uugaccuagucuuucagu

SEQ ID NO: 73777 - RNA, 18 nt, Artificial Sequence
  Description of Artificial Sequence: Synthetic oligonucleotide
uguuuuugaccuagucuu

SEQ ID NO: 73778 - RNA, 18 nt, Artificial Sequence
  Description of Artificial Sequence: Synthetic oligonucleotide
caccuuguuuuugaccua

SEQ ID NO: 73779 - RNA, 18 nt, Artificial Sequence
  Description of Artificial Sequence: Synthetic oligonucleotide
uguuucaccuuguuuuug

SEQ ID NO: 73780 - RNA, 18 nt, Artificial Sequence
  Description of Artificial Sequence: Synthetic oligonucleotide
ucuguuguuucaccuugu

SEQ ID NO: 73781 - RNA, 18 nt, Artificial Sequence
  Description of Artificial Sequence: Synthetic oligonucleotide
auaucucuguuguuucac

SEQ ID NO: 73782 - RNA, 18 nt, Artificial Sequence
  Description of Artificial Sequence: Synthetic oligonucleotide
aguuuauaucucuguugu

SEQ ID NO: 73783 - RNA, 18 nt, Artificial Sequence
  Description of Artificial Sequence: Synthetic oligonucleotide
guagaaguuuauaucucu

SEQ ID NO: 73784 - RNA, 18 nt, Artificial Sequence
  Description of Artificial Sequence: Synthetic oligonucleotide
cacauguagaaguuuaua

SEQ ID NO: 73785 - RNA, 18 nt, Artificial Sequence
  Description of Artificial Sequence: Synthetic oligonucleotide
cggcccacauguagaagu

SEQ ID NO: 73786 - RNA, 18 nt, Artificial Sequence
  Description of Artificial Sequence: Synthetic oligonucleotide
gcccccggcccacaugua

SEQ ID NO: 73787 - RNA, 18 nt, Artificial Sequence
  Description of Artificial Sequence: Synthetic oligonucleotide
cgugagcccccggcccac

SEQ ID NO: 73788 - RNA, 18 nt, Artificial Sequence
  Description of Artificial Sequence: Synthetic oligonucleotide
acaggcgugagcccccgg

SEQ ID NO: 73789 - RNA, 18 nt, Artificial Sequence
  Description of Artificial Sequence: Synthetic oligonucleotide
ggauuacaggcgugagcc

SEQ ID NO: 73790 - RNA, 18 nt, Artificial Sequence
  Description of Artificial Sequence: Synthetic oligonucleotide
ugcugggauuacaggcgu

SEQ ID NO: 73791 - RNA, 18 nt, Artificial Sequence
  Description of Artificial Sequence: Synthetic oligonucleotide
caaagugcugggauuaca

SEQ ID NO: 73792 - RNA, 18 nt, Artificial Sequence
  Description of Artificial Sequence: Synthetic oligonucleotide
ccucccaaagugcuggga

SEQ ID NO: 73793 - RNA, 18 nt, Artificial Sequence
  Description of Artificial Sequence: Synthetic oligonucleotide
cucggccucccaaagugc

SEQ ID NO: 73794 - RNA, 18 nt, Artificial Sequence
  Description of Artificial Sequence: Synthetic oligonucleotide
ccugccucggccucccaa

SEQ ID NO: 73795 - RNA, 18 nt, Artificial Sequence
  Description of Artificial Sequence: Synthetic oligonucleotide
aucugccugccucggccu

SEQ ID NO: 73796 - RNA, 18 nt, Artificial Sequence
  Description of Artificial Sequence: Synthetic oligonucleotide
aggugaucugccugccuc

SEQ ID NO: 73797 - RNA, 18 nt, Artificial Sequence
  Description of Artificial Sequence: Synthetic oligonucleotide
cccucaggugaucugccu

SEQ ID NO: 73798 - RNA, 18 nt, Artificial Sequence
  Description of Artificial Sequence: Synthetic oligonucleotide
uccugcccucaggugauc

SEQ ID NO: 73799 - RNA, 18 nt, Artificial Sequence
  Description of Artificial Sequence: Synthetic oligonucleotide
caaacuccugcccucagg

SEQ ID NO: 73800 - RNA, 18 nt, Artificial Sequence
  Description of Artificial Sequence: Synthetic oligonucleotide
gcucucaaacuccugccc

SEQ ID NO: 73801 - RNA, 18 nt, Artificial Sequence
  Description of Artificial Sequence: Synthetic oligonucleotide
gcugggcauggugguggg

SEQ ID NO: 73802 - RNA, 18 nt, Artificial Sequence
  Description of Artificial Sequence: Synthetic oligonucleotide
aauuagcugggcauggug

SEQ ID NO: 73803 - RNA, 18 nt, Artificial Sequence
  Description of Artificial Sequence: Synthetic oligonucleotide
acaaaaauuagcugggca

SEQ ID NO: 73804 - RNA, 18 nt, Artificial Sequence
  Description of Artificial Sequence: Synthetic oligonucleotide
aaaauacaaaaauuagcu

SEQ ID NO: 73805 - RNA, 18 nt, Artificial Sequence
  Description of Artificial Sequence: Synthetic oligonucleotide
uaccaaaaauacaaaaau

SEQ ID NO: 73806 - RNA, 18 nt, Artificial Sequence
  Description of Artificial Sequence: Synthetic oligonucleotide
aucucuaccaaaaauaca

SEQ ID NO: 73807 - RNA, 18 nt, Artificial Sequence
  Description of Artificial Sequence: Synthetic oligonucleotide
accccaucucuaccaaaa

SEQ ID NO: 73808 - RNA, 18 nt, Artificial Sequence
  Description of Artificial Sequence: Synthetic oligonucleotide
gugaaaccccaucucuac

SEQ ID NO: 73809 - RNA, 18 nt, Artificial Sequence
  Description of Artificial Sequence: Synthetic oligonucleotide
acauggugaaaccccauc

SEQ ID NO: 73810 - RNA, 18 nt, Artificial Sequence
  Description of Artificial Sequence: Synthetic oligonucleotide
ggccaacauggugaaacc

SEQ ID NO: 73811 - RNA, 18 nt, Artificial Sequence
  Description of Artificial Sequence: Synthetic oligonucleotide
agccuggccaacauggug

SEQ ID NO: 73812 - RNA, 18 nt, Artificial Sequence
  Description of Artificial Sequence: Synthetic oligonucleotide
agaucagccuggccaaca

SEQ ID NO: 73813 - RNA, 18 nt, Artificial Sequence
  Description of Artificial Sequence: Synthetic oligonucleotide
guucaagaucagccuggc

SEQ ID NO: 73814 - RNA, 18 nt, Artificial Sequence
  Description of Artificial Sequence: Synthetic oligonucleotide
caggaguucaagaucagc

SEQ ID NO: 73815 - RNA, 18 nt, Artificial Sequence
  Description of Artificial Sequence: Synthetic oligonucleotide
gaggucaggaguucaaga

SEQ ID NO: 73816 - RNA, 18 nt, Artificial Sequence
  Description of Artificial Sequence: Synthetic oligonucleotide
caccugaggucaggaguu

SEQ ID NO: 73817 - RNA, 18 nt, Artificial Sequence
  Description of Artificial Sequence: Synthetic oligonucleotide
uggaucaccugaggucag

SEQ ID NO: 73818 - RNA, 18 nt, Artificial Sequence
  Description of Artificial Sequence: Synthetic oligonucleotide
gcagguggaucaccugag

SEQ ID NO: 73819 - RNA, 18 nt, Artificial Sequence
  Description of Artificial Sequence: Synthetic oligonucleotide
cugaggcagguggaucac

SEQ ID NO: 73820 - RNA, 18 nt, Artificial Sequence
  Description of Artificial Sequence: Synthetic oligonucleotide
ggaggcugaggcaggugg

SEQ ID NO: 73821 - RNA, 18 nt, Artificial Sequence
  Description of Artificial Sequence: Synthetic oligonucleotide
cuuugggaggcugaggca

SEQ ID NO: 73822 - RNA, 18 nt, Artificial Sequence
  Description of Artificial Sequence: Synthetic oligonucleotide
cagcacuuugggaggcug

SEQ ID NO: 73823 - RNA, 18 nt, Artificial Sequence
  Description of Artificial Sequence: Synthetic oligonucleotide
aaucccagcacuuuggga

SEQ ID NO: 73824 - RNA, 18 nt, Artificial Sequence
  Description of Artificial Sequence: Synthetic oligonucleotide
ccuguaaucccagcacuu

SEQ ID NO: 73825 - RNA, 18 nt, Artificial Sequence
  Description of Artificial Sequence: Synthetic oligonucleotide
ucacgccuguaaucccag

SEQ ID NO: 73826 - RNA, 18 nt, Artificial Sequence
  Description of Artificial Sequence: Synthetic oligonucleotide
guggcucacgccuguaau

SEQ ID NO: 73827 - RNA, 18 nt, Artificial Sequence
  Description of Artificial Sequence: Synthetic oligonucleotide
gugcaguggcucacgccu

SEQ ID NO: 73828 - RNA, 18 nt, Artificial Sequence
  Description of Artificial Sequence: Synthetic oligonucleotide
gcugggugcaguggcuca

SEQ ID NO: 73829 - RNA, 18 nt, Artificial Sequence
  Description of Artificial Sequence: Synthetic oligonucleotide
ugaaggcugggugcagug

SEQ ID NO: 73830 - RNA, 18 nt, Artificial Sequence
  Description of Artificial Sequence: Synthetic oligonucleotide
cugaaugaaggcugggug

SEQ ID NO: 73831 - RNA, 18 nt, Artificial Sequence
  Description of Artificial Sequence: Synthetic oligonucleotide
uuaaacugaaugaaggcu

SEQ ID NO: 73832 - RNA, 18 nt, Artificial Sequence
  Description of Artificial Sequence: Synthetic oligonucleotide
gauuuuuaaacugaauga

SEQ ID NO: 73833 - RNA, 18 nt, Artificial Sequence
  Description of Artificial Sequence: Synthetic oligonucleotide
cauuugauuuuuaaacug

SEQ ID NO: 73834 - RNA, 18 nt, Artificial Sequence
  Description of Artificial Sequence: Synthetic oligonucleotide
aggaucauuugauuuuua

SEQ ID NO: 73835 - RNA, 18 nt, Artificial Sequence
  Description of Artificial Sequence: Synthetic oligonucleotide
accuuaggaucauuugau

SEQ ID NO: 73836 - RNA, 18 nt, Artificial Sequence
  Description of Artificial Sequence: Synthetic oligonucleotide
gcaaaaccuuaggaucau

SEQ ID NO: 73837 - RNA, 18 nt, Artificial Sequence
  Description of Artificial Sequence: Synthetic oligonucleotide
cugcugcaaaaccuuagg

SEQ ID NO: 73838 - RNA, 18 nt, Artificial Sequence
  Description of Artificial Sequence: Synthetic oligonucleotide
ucuuucugcugcaaaacc

SEQ ID NO: 73839 - RNA, 18 nt, Artificial Sequence
  Description of Artificial Sequence: Synthetic oligonucleotide
uuuacucuuucugcugca

SEQ ID NO: 73840 - RNA, 18 nt, Artificial Sequence
  Description of Artificial Sequence: Synthetic oligonucleotide
gcaaauuuacucuuucug

SEQ ID NO: 73841 - RNA, 18 nt, Artificial Sequence
  Description of Artificial Sequence: Synthetic oligonucleotide
gugcugcaaauuuacucu

SEQ ID NO: 73842 - RNA, 18 nt, Artificial Sequence
  Description of Artificial Sequence: Synthetic oligonucleotide
uucuagugcugcaaauuu

SEQ ID NO: 73843 - RNA, 18 nt, Artificial Sequence
  Description of Artificial Sequence: Synthetic oligonucleotide
cuugguucuagugcugca

SEQ ID NO: 73844 - RNA, 18 nt, Artificial Sequence
  Description of Artificial Sequence: Synthetic oligonucleotide
uaccucuugguucuagug

SEQ ID NO: 73845 - RNA, 18 nt, Artificial Sequence
  Description of Artificial Sequence: Synthetic oligonucleotide
gcuuuuaccucuugguuc

SEQ ID NO: 73846 - RNA, 18 nt, Artificial Sequence
  Description of Artificial Sequence: Synthetic oligonucleotide
uuacagcuuuuaccucuu

SEQ ID NO: 73847 - RNA, 18 nt, Artificial Sequence
  Description of Artificial Sequence: Synthetic oligonucleotide
cccuguuacagcuuuuac

SEQ ID NO: 73848 - RNA, 18 nt, Artificial Sequence
  Description of Artificial Sequence: Synthetic oligonucleotide
aucugcccuguuacagcu

SEQ ID NO: 73849 - RNA, 18 nt, Artificial Sequence
  Description of Artificial Sequence: Synthetic oligonucleotide
cugaaaucugcccuguua

SEQ ID NO: 73850 - RNA, 18 nt, Artificial Sequence
  Description of Artificial Sequence: Synthetic oligonucleotide
cguugcugaaaucugccc

SEQ ID NO: 73851 - RNA, 18 nt, Artificial Sequence
  Description of Artificial Sequence: Synthetic oligonucleotide
ucuuacguugcugaaauc

SEQ ID NO: 73852 - RNA, 18 nt, Artificial Sequence
  Description of Artificial Sequence: Synthetic oligonucleotide
uuuuuucuuacguugcug

SEQ ID NO: 73853 - RNA, 18 nt, Artificial Sequence
  Description of Artificial Sequence: Synthetic oligonucleotide
gcuccuuuuuucuuacgu

SEQ ID NO: 73854 - RNA, 18 nt, Artificial Sequence
  Description of Artificial Sequence: Synthetic oligonucleotide
gaagagcuccuuuuuucu

SEQ ID NO: 73855 - RNA, 18 nt, Artificial Sequence
  Description of Artificial Sequence: Synthetic oligonucleotide
agugagaagagcuccuuu

SEQ ID NO: 73856 - RNA, 18 nt, Artificial Sequence
  Description of Artificial Sequence: Synthetic oligonucleotide
guuucagugagaagagcu

SEQ ID NO: 73857 - RNA, 18 nt, Artificial Sequence
  Description of Artificial Sequence: Synthetic oligonucleotide
acuugguuucagugagaa

SEQ ID NO: 73858 - RNA, 18 nt, Artificial Sequence
  Description of Artificial Sequence: Synthetic oligonucleotide
cuuacacuugguuucagu

SEQ ID NO: 73859 - RNA, 18 nt, Artificial Sequence
  Description of Artificial Sequence: Synthetic oligonucleotide
cuggucuuacacuugguu

SEQ ID NO: 73860 - RNA, 18 nt, Artificial Sequence
  Description of Artificial Sequence: Synthetic oligonucleotide
ccagccuggucuuacacu

SEQ ID NO: 73861 - RNA, 18 nt, Artificial Sequence
  Description of Artificial Sequence: Synthetic oligonucleotide
cuaguccagccuggucuu

SEQ ID NO: 73862 - RNA, 18 nt, Artificial Sequence
  Description of Artificial Sequence: Synthetic oligonucleotide
guccucuaguccagccug

SEQ ID NO: 73863 - RNA, 18 nt, Artificial Sequence
  Description of Artificial Sequence: Synthetic oligonucleotide
cccguguccucuagucca

SEQ ID NO: 73864 - RNA, 18 nt, Artificial Sequence
  Description of Artificial Sequence: Synthetic oligonucleotide
aaacucccguguccucua

SEQ ID NO: 73865 - RNA, 18 nt, Artificial Sequence
  Description of Artificial Sequence: Synthetic oligonucleotide
uucaaaaacucccguguc

SEQ ID NO: 73866 - RNA, 18 nt, Artificial Sequence
  Description of Artificial Sequence: Synthetic oligonucleotide
ucugcuucaaaaacuccc

SEQ ID NO: 73867 - RNA, 18 nt, Artificial Sequence
  Description of Artificial Sequence: Synthetic oligonucleotide
cagccucugcuucaaaaa

SEQ ID NO: 73868 - RNA, 18 nt, Artificial Sequence
  Description of Artificial Sequence: Synthetic oligonucleotide
gucaucagccucugcuuc

SEQ ID NO: 73869 - RNA, 18 nt, Artificial Sequence
  Description of Artificial Sequence: Synthetic oligonucleotide
agcuggucaucagccucu

SEQ ID NO: 73870 - RNA, 18 nt, Artificial Sequence
  Description of Artificial Sequence: Synthetic oligonucleotide
ccgacagcuggucaucag

SEQ ID NO: 73871 - RNA, 18 nt, Artificial Sequence
  Description of Artificial Sequence: Synthetic oligonucleotide
gucucccgacagcugguc

SEQ ID NO: 73872 - RNA, 18 nt, Artificial Sequence
  Description of Artificial Sequence: Synthetic oligonucleotide
ucacagucucccgacagc

SEQ ID NO: 73873 - RNA, 18 nt, Artificial Sequence
  Description of Artificial Sequence: Synthetic oligonucleotide
uuccuucacagucucccg

SEQ ID NO: 73874 - RNA, 18 nt, Artificial Sequence
  Description of Artificial Sequence: Synthetic oligonucleotide
aggaauuccuucacaguc

SEQ ID NO: 73875 - RNA, 18 nt, Artificial Sequence
  Description of Artificial Sequence: Synthetic oligonucleotide
agggcaggaauuccuuca

SEQ ID NO: 73876 - RNA, 18 nt, Artificial Sequence
  Description of Artificial Sequence: Synthetic oligonucleotide
cacccagggcaggaauuc

SEQ ID NO: 73877 - RNA, 18 nt, Artificial Sequence
  Description of Artificial Sequence: Synthetic oligonucleotide
ggucccacccagggcagg

SEQ ID NO: 73878 - RNA, 18 nt, Artificial Sequence
  Description of Artificial Sequence: Synthetic oligonucleotide
accaaggucccacccagg

SEQ ID NO: 73879 - RNA, 18 nt, Artificial Sequence
  Description of Artificial Sequence: Synthetic oligonucleotide
acaggaccaaggucccac

SEQ ID NO: 73880 - RNA, 18 nt, Artificial Sequence
  Description of Artificial Sequence: Synthetic oligonucleotide
acuggacaggaccaaggu

SEQ ID NO: 73881 - RNA, 18 nt, Artificial Sequence
  Description of Artificial Sequence: Synthetic oligonucleotide
ugagaacuggacaggacc

SEQ ID NO: 73882 - RNA, 18 nt, Artificial Sequence
  Description of Artificial Sequence: Synthetic oligonucleotide
caggcugagaacuggaca

SEQ ID NO: 73883 - RNA, 18 nt, Artificial Sequence
  Description of Artificial Sequence: Synthetic oligonucleotide
ucauacaggcugagaacu

SEQ ID NO: 73884 - RNA, 18 nt, Artificial Sequence
  Description of Artificial Sequence: Synthetic oligonucleotide
gugaaucauacaggcuga

SEQ ID NO: 73885 - RNA, 18 nt, Artificial Sequence
  Description of Artificial Sequence: Synthetic oligonucleotide
gcagagugaaucauacag

SEQ ID NO: 73886 - RNA, 18 nt, Artificial Sequence
  Description of Artificial Sequence: Synthetic oligonucleotide
agccagcagagugaauca

SEQ ID NO: 73887 - RNA, 18 nt, Artificial Sequence
  Description of Artificial Sequence: Synthetic oligonucleotide
ggaguagccagcagagug

SEQ ID NO: 73888 - RNA, 18 nt, Artificial Sequence
  Description of Artificial Sequence: Synthetic oligonucleotide
ccuuaggaguagccagca

SEQ ID NO: 73889 - RNA, 18 nt, Artificial Sequence
  Description of Artificial Sequence: Synthetic oligonucleotide
gggagccuuaggaguagc

SEQ ID NO: 73890 - RNA, 18 nt, Artificial Sequence
  Description of Artificial Sequence: Synthetic oligonucleotide
acacuaaaagcggguggg

SEQ ID NO: 73891 - RNA, 18 nt, Artificial Sequence
  Description of Artificial Sequence: Synthetic oligonucleotide
ggcacacuaaaagcgggu

SEQ ID NO: 73892 - RNA, 18 nt, Artificial Sequence
  Description of Artificial Sequence: Synthetic oligonucleotide
caaagggcacacuaaaag

SEQ ID NO: 73893 - RNA, 18 nt, Artificial Sequence
  Description of Artificial Sequence: Synthetic oligonucleotide
ugccucaaagggcacacu

SEQ ID NO: 73894 - RNA, 18 nt, Artificial Sequence
  Description of Artificial Sequence: Synthetic oligonucleotide
cgcacugccucaaagggc

SEQ ID NO: 73895 - RNA, 18 nt, Artificial Sequence
  Description of Artificial Sequence: Synthetic oligonucleotide
agaagcgcacugccucaa

SEQ ID NO: 73896 - RNA, 18 nt, Artificial Sequence
  Description of Artificial Sequence: Synthetic oligonucleotide
aagagagaagcgcacugc

SEQ ID NO: 73897 - RNA, 18 nt, Artificial Sequence
  Description of Artificial Sequence: Synthetic oligonucleotide
ccugugccuuggucuccu

SEQ ID NO: 73898 - RNA, 18 nt, Artificial Sequence
  Description of Artificial Sequence: Synthetic oligonucleotide
aauguccugugccuuggu

SEQ ID NO: 73899 - RNA, 18 nt, Artificial Sequence
  Description of Artificial Sequence: Synthetic oligonucleotide
cccagaauguccugugcc

SEQ ID NO: 73900 - RNA, 18 nt, Artificial Sequence
  Description of Artificial Sequence: Synthetic oligonucleotide
cugcucccagaauguccu

SEQ ID NO: 73901 - RNA, 18 nt, Artificial Sequence
  Description of Artificial Sequence: Synthetic oligonucleotide
ggucacugcucccagaau

SEQ ID NO: 73902 - RNA, 18 nt, Artificial Sequence
  Description of Artificial Sequence: Synthetic oligonucleotide
agaagggucacugcuccc

SEQ ID NO: 73903 - RNA, 18 nt, Artificial Sequence
  Description of Artificial Sequence: Synthetic oligonucleotide
ccagcagaagggucacug

SEQ ID NO: 73904 - RNA, 18 nt, Artificial Sequence
  Description of Artificial Sequence: Synthetic oligonucleotide
ucccuccagcagaagggu

SEQ ID NO: 73905 - RNA, 18 nt, Artificial Sequence
  Description of Artificial Sequence: Synthetic oligonucleotide
aucacucccuccagcaga

SEQ ID NO: 73906 - RNA, 18 nt, Artificial Sequence
  Description of Artificial Sequence: Synthetic oligonucleotide
cugccaucacucccucca

SEQ ID NO: 73907 - RNA, 18 nt, Artificial Sequence
  Description of Artificial Sequence: Synthetic oligonucleotide
ccgugcugccaucacucc

SEQ ID NO: 73908 - RNA, 18 nt, Artificial Sequence
  Description of Artificial Sequence: Synthetic oligonucleotide
uguccccgugcugccauc

SEQ ID NO: 73909 - RNA, 18 nt, Artificial Sequence
  Description of Artificial Sequence: Synthetic oligonucleotide
ccaguuguccccgugcug

SEQ ID NO: 73910 - RNA, 18 nt, Artificial Sequence
  Description of Artificial Sequence: Synthetic oligonucleotide
gggucccaguuguccccg

SEQ ID NO: 73911 - RNA, 18 nt, Artificial Sequence
  Description of Artificial Sequence: Synthetic oligonucleotide
caagugggucccaguugu

SEQ ID NO: 73912 - RNA, 18 nt, Artificial Sequence
  Description of Artificial Sequence: Synthetic oligonucleotide
agaggcaaguggguccca

SEQ ID NO: 73913 - RNA, 18 nt, Artificial Sequence
  Description of Artificial Sequence: Synthetic oligonucleotide
ggaugagaggcaaguggg

SEQ ID NO: 73914 - RNA, 18 nt, Artificial Sequence
  Description of Artificial Sequence: Synthetic oligonucleotide
aggagggaugagaggcaa

SEQ ID NO: 73915 - RNA, 18 nt, Artificial Sequence
  Description of Artificial Sequence: Synthetic oligonucleotide
gccccaggagggaugaga

SEQ ID NO: 73916 - RNA, 18 nt, Artificial Sequence
  Description of Artificial Sequence: Synthetic oligonucleotide
aagcugccccaggaggga

SEQ ID NO: 73917 - RNA, 18 nt, Artificial Sequence
  Description of Artificial Sequence: Synthetic oligonucleotide
ccagaaagcugccccagg

SEQ ID NO: 73918 - RNA, 18 nt, Artificial Sequence
  Description of Artificial Sequence: Synthetic oligonucleotide
ccuguccagaaagcugcc

SEQ ID NO: 73919 - RNA, 18 nt, Artificial Sequence
  Description of Artificial Sequence: Synthetic oligonucleotide
acggaccuguccagaaag

SEQ ID NO: 73920 - RNA, 18 nt, Artificial Sequence
  Description of Artificial Sequence: Synthetic oligonucleotide
aggagacggaccugucca

SEQ ID NO: 73921 - RNA, 18 nt, Artificial Sequence
  Description of Artificial Sequence: Synthetic oligonucleotide
caaggaggagacggaccu

SEQ ID NO: 73922 - RNA, 18 nt, Artificial Sequence
  Description of Artificial Sequence: Synthetic oligonucleotide
ggccccaaggaggagacg

SEQ ID NO: 73923 - RNA, 18 nt, Artificial Sequence
  Description of Artificial Sequence: Synthetic oligonucleotide
ugcagggccccaaggagg

SEQ ID NO: 73924 - RNA, 18 nt, Artificial Sequence
  Description of Artificial Sequence: Synthetic oligonucleotide
ggcucugcagggccccaa

SEQ ID NO: 73925 - RNA, 18 nt, Artificial Sequence
  Description of Artificial Sequence: Synthetic oligonucleotide
aaggaggcucugcagggc

SEQ ID NO: 73926 - RNA, 18 nt, Artificial Sequence
  Description of Artificial Sequence: Synthetic oligonucleotide
guuccaaggaggcucugc

SEQ ID NO: 73927 - RNA, 18 nt, Artificial Sequence
  Description of Artificial Sequence: Synthetic oligonucleotide
uccugugccuuggucucc

SEQ ID NO: 73928 - RNA, 18 nt, Artificial Sequence
  Description of Artificial Sequence: Synthetic oligonucleotide
gaauguccugugccuugg

SEQ ID NO: 73929 - RNA, 18 nt, Artificial Sequence
  Description of Artificial Sequence: Synthetic oligonucleotide
ucccagaauguccugugc

SEQ ID NO: 73930 - RNA, 18 nt, Artificial Sequence
  Description of Artificial Sequence: Synthetic oligonucleotide
acugcucccagaaugucc

SEQ ID NO: 73931 - RNA, 18 nt, Artificial Sequence
  Description of Artificial Sequence: Synthetic oligonucleotide
gggucacugcucccagaa

SEQ ID NO: 73932 - RNA, 18 nt, Artificial Sequence
  Description of Artificial Sequence: Synthetic oligonucleotide
cagaagggucacugcucc

SEQ ID NO: 73933 - RNA, 18 nt, Artificial Sequence
  Description of Artificial Sequence: Synthetic oligonucleotide
uccagcagaagggucacu

SEQ ID NO: 73934 - RNA, 18 nt, Artificial Sequence
  Description of Artificial Sequence: Synthetic oligonucleotide
cucccuccagcagaaggg

SEQ ID NO: 73935 - RNA, 18 nt, Artificial Sequence
  Description of Artificial Sequence: Synthetic oligonucleotide
caucacucccuccagcag

SEQ ID NO: 73936 - RNA, 18 nt, Artificial Sequence
  Description of Artificial Sequence: Synthetic oligonucleotide
gcugccaucacucccucc

SEQ ID NO: 73937 - RNA, 18 nt, Artificial Sequence
  Description of Artificial Sequence: Synthetic oligonucleotide
cccgugcugccaucacuc

SEQ ID NO: 73938 - RNA, 18 nt, Artificial Sequence
  Description of Artificial Sequence: Synthetic oligonucleotide
uuguccccgugcugccau

SEQ ID NO: 73939 - RNA, 18 nt, Artificial Sequence
  Description of Artificial Sequence: Synthetic oligonucleotide
cccaguuguccccgugcu

SEQ ID NO: 73940 - RNA, 18 nt, Artificial Sequence
  Description of Artificial Sequence: Synthetic oligonucleotide
ugggucccaguugucccc

SEQ ID NO: 73941 - RNA, 18 nt, Artificial Sequence
  Description of Artificial Sequence: Synthetic oligonucleotide
gcaagugggucccaguug

SEQ ID NO: 73942 - RNA, 18 nt, Artificial Sequence
  Description of Artificial Sequence: Synthetic oligonucleotide
gagaggcaaguggguccc

SEQ ID NO: 73943 - RNA, 18 nt, Artificial Sequence
  Description of Artificial Sequence: Synthetic oligonucleotide
gggaugagaggcaagugg

SEQ ID NO: 73944 - RNA, 18 nt, Artificial Sequence
  Description of Artificial Sequence: Synthetic oligonucleotide
caggagggaugagaggca

SEQ ID NO: 73945 - RNA, 18 nt, Artificial Sequence
  Description of Artificial Sequence: Synthetic oligonucleotide
ugccccaggagggaugag

SEQ ID NO: 73946 - RNA, 18 nt, Artificial Sequence
  Description of Artificial Sequence: Synthetic oligonucleotide
aaagcugccccaggaggg

SEQ ID NO: 73947 - RNA, 18 nt, Artificial Sequence
  Description of Artificial Sequence: Synthetic oligonucleotide
uccagaaagcugccccag

SEQ ID NO: 73948 - RNA, 18 nt, Artificial Sequence
  Description of Artificial Sequence: Synthetic oligonucleotide
accuguccagaaagcugc

SEQ ID NO: 73949 - RNA, 18 nt, Artificial Sequence
  Description of Artificial Sequence: Synthetic oligonucleotide
gacggaccuguccagaaa

SEQ ID NO: 73950 - RNA, 18 nt, Artificial Sequence
  Description of Artificial Sequence: Synthetic oligonucleotide
gaggagacggaccugucc

SEQ ID NO: 73951 - RNA, 18 nt, Artificial Sequence
  Description of Artificial Sequence: Synthetic oligonucleotide
ccaaggaggagacggacc

SEQ ID NO: 73952 - RNA, 18 nt, Artificial Sequence
  Description of Artificial Sequence: Synthetic oligonucleotide
gggccccaaggaggagac

SEQ ID NO: 73953 - RNA, 18 nt, Artificial Sequence
  Description of Artificial Sequence: Synthetic oligonucleotide
cugcagggccccaaggag

SEQ ID NO: 73954 - RNA, 18 nt, Artificial Sequence
  Description of Artificial Sequence: Synthetic oligonucleotide
aggcucugcagggcccca

SEQ ID NO: 73955 - RNA, 18 nt, Artificial Sequence
  Description of Artificial Sequence: Synthetic oligonucleotide
caaggaggcucugcaggg

SEQ ID NO: 73956 - RNA, 18 nt, Artificial Sequence
  Description of Artificial Sequence: Synthetic oligonucleotide
gguuccaaggaggcucug

SEQ ID NO: 73957 - RNA, 18 nt, Artificial Sequence
  Description of Artificial Sequence: Synthetic oligonucleotide
ucuacagaucccuugacu

SEQ ID NO: 73958 - RNA, 18 nt, Artificial Sequence
  Description of Artificial Sequence: Synthetic oligonucleotide
caguuucuacagaucccu

SEQ ID NO: 73959 - RNA, 18 nt, Artificial Sequence
  Description of Artificial Sequence: Synthetic oligonucleotide
aagaacaguuucuacaga

SEQ ID NO: 73960 - RNA, 18 nt, Artificial Sequence
  Description of Artificial Sequence: Synthetic oligonucleotide
cagaaaagaacaguuucu

SEQ ID NO: 73961 - RNA, 18 nt, Artificial Sequence
  Description of Artificial Sequence: Synthetic oligonucleotide
ugagucagaaaagaacag

SEQ ID NO: 73962 - RNA, 18 nt, Artificial Sequence
  Description of Artificial Sequence: Synthetic oligonucleotide
gggacugagucagaaaag

SEQ ID NO: 73963 - RNA, 18 nt, Artificial Sequence
  Description of Artificial Sequence: Synthetic oligonucleotide
cuucccucaggucuucua

SEQ ID NO: 73964 - RNA, 18 nt, Artificial Sequence
  Description of Artificial Sequence: Synthetic oligonucleotide
cccuucuucccucagguc

SEQ ID NO: 73965 - RNA, 18 nt, Artificial Sequence
  Description of Artificial Sequence: Synthetic oligonucleotide
aagagcccuucuucccuc

SEQ ID NO: 73966 - RNA, 18 nt, Artificial Sequence
  Description of Artificial Sequence: Synthetic oligonucleotide
ccuggaagagcccuucuu

SEQ ID NO: 73967 - RNA, 18 nt, Artificial Sequence
  Description of Artificial Sequence: Synthetic oligonucleotide
agcucccuggaagagccc

SEQ ID NO: 73968 - RNA, 18 nt, Artificial Sequence
  Description of Artificial Sequence: Synthetic oligonucleotide
ccuugagcucccuggaag

SEQ ID NO: 73969 - RNA, 18 nt, Artificial Sequence
  Description of Artificial Sequence: Synthetic oligonucleotide
ucugcccuugagcucccu

SEQ ID NO: 73970 - RNA, 18 nt, Artificial Sequence
  Description of Artificial Sequence: Synthetic oligonucleotide
gcucuucugcccuugagc

SEQ ID NO: 73971 - RNA, 18 nt, Artificial Sequence
  Description of Artificial Sequence: Synthetic oligonucleotide
gaucagcucuucugcccu

SEQ ID NO: 73972 - RNA, 18 nt, Artificial Sequence
  Description of Artificial Sequence: Synthetic oligonucleotide
uaguagaucagcucuucu

SEQ ID NO: 73973 - RNA, 18 nt, Artificial Sequence
  Description of Artificial Sequence: Synthetic oligonucleotide
acucuuaguagaucagcu

SEQ ID NO: 73974 - RNA, 18 nt, Artificial Sequence
  Description of Artificial Sequence: Synthetic oligonucleotide
ggagcacucuuaguagau

SEQ ID NO: 73975 - RNA, 18 nt, Artificial Sequence
  Description of Artificial Sequence: Synthetic oligonucleotide
ggcagggagcacucuuag

SEQ ID NO: 73976 - RNA, 18 nt, Artificial Sequence
  Description of Artificial Sequence: Synthetic oligonucleotide
uggcuggcagggagcacu

SEQ ID NO: 73977 - RNA, 18 nt, Artificial Sequence
  Description of Artificial Sequence: Synthetic oligonucleotide
cauuguggcuggcaggga

SEQ ID NO: 73978 - RNA, 18 nt, Artificial Sequence
  Description of Artificial Sequence: Synthetic oligonucleotide
ccaggcauuguggcuggc

SEQ ID NO: 73979 - RNA, 18 nt, Artificial Sequence
  Description of Artificial Sequence: Synthetic oligonucleotide
ucuucugcccuugagcuc

SEQ ID NO: 73980 - RNA, 18 nt, Artificial Sequence
  Description of Artificial Sequence: Synthetic oligonucleotide
ucagcucuucugcccuug

SEQ ID NO: 73981 - RNA, 18 nt, Artificial Sequence
  Description of Artificial Sequence: Synthetic oligonucleotide
guagaucagcucuucugc

SEQ ID NO: 73982 - RNA, 18 nt, Artificial Sequence
  Description of Artificial Sequence: Synthetic oligonucleotide
ucuuaguagaucagcucu

SEQ ID NO: 73983 - RNA, 18 nt, Artificial Sequence
  Description of Artificial Sequence: Synthetic oligonucleotide
agcacucuuaguagauca

SEQ ID NO: 73984 - RNA, 18 nt, Artificial Sequence
  Description of Artificial Sequence: Synthetic oligonucleotide
cagggagcacucuuagua

SEQ ID NO: 73985 - RNA, 18 nt, Artificial Sequence
  Description of Artificial Sequence: Synthetic oligonucleotide
gcuggcagggagcacucu

SEQ ID NO: 73986 - RNA, 18 nt, Artificial Sequence
  Description of Artificial Sequence: Synthetic oligonucleotide
uuguggcuggcagggagc

SEQ ID NO: 73987 - RNA, 18 nt, Artificial Sequence
  Description of Artificial Sequence: Synthetic oligonucleotide
aggcauuguggcuggcag

SEQ ID NO: 73988 - RNA, 18 nt, Artificial Sequence
  Description of Artificial Sequence: Synthetic oligonucleotide
uacccaggcauuguggcu

SEQ ID NO: 73989 - RNA, 18 nt, Artificial Sequence
  Description of Artificial Sequence: Synthetic oligonucleotide
gccaguacccaggcauug

SEQ ID NO: 73990 - RNA, 18 nt, Artificial Sequence
  Description of Artificial Sequence: Synthetic oligonucleotide
aggaugccaguacccagg

SEQ ID NO: 73991 - RNA, 18 nt, Artificial Sequence
  Description of Artificial Sequence: Synthetic oligonucleotide
aagacaggaugccaguac

SEQ ID NO: 73992 - RNA, 18 nt, Artificial Sequence
  Description of Artificial Sequence: Synthetic oligonucleotide
uaggaaagacaggaugcc

SEQ ID NO: 73993 - RNA, 18 nt, Artificial Sequence
  Description of Artificial Sequence: Synthetic oligonucleotide
cuaaguaggaaagacagg

SEQ ID NO: 73994 - RNA, 18 nt, Artificial Sequence
  Description of Artificial Sequence: Synthetic oligonucleotide
cuugucuaaguaggaaag

SEQ ID NO: 73995 - RNA, 18 nt, Artificial Sequence
  Description of Artificial Sequence: Synthetic oligonucleotide
ccucccuugucuaaguag

SEQ ID NO: 73996 - RNA, 18 nt, Artificial Sequence
  Description of Artificial Sequence: Synthetic oligonucleotide
ucaggccucccuugucua

SEQ ID NO: 73997 - RNA, 18 nt, Artificial Sequence
  Description of Artificial Sequence: Synthetic oligonucleotide
agaucucaggccucccuu

SEQ ID NO: 73998 - RNA, 18 nt, Artificial Sequence
  Description of Artificial Sequence: Synthetic oligonucleotide
gggccagaucucaggccu

SEQ ID NO: 73999 - RNA, 18 nt, Artificial Sequence
  Description of Artificial Sequence: Synthetic oligonucleotide
caccagggccagaucuca

SEQ ID NO: 74000 - RNA, 18 nt, Artificial Sequence
  Description of Artificial Sequence: Synthetic oligonucleotide
ccaaacaccagggccaga

SEQ ID NO: 74001 - RNA, 18 nt, Artificial Sequence
  Description of Artificial Sequence: Synthetic oligonucleotide
ugaggccaaacaccaggg

SEQ ID NO: 74002 - RNA, 18 nt, Artificial Sequence
  Description of Artificial Sequence: Synthetic oligonucleotide
gguccugaggccaaacac

SEQ ID NO: 74003 - RNA, 18 nt, Artificial Sequence
  Description of Artificial Sequence: Synthetic oligonucleotide
uccugcccuguggaggaa

SEQ ID NO: 74004 - RNA, 18 nt, Artificial Sequence
  Description of Artificial Sequence: Synthetic oligonucleotide
ugugguccugcccugugg

SEQ ID NO: 74005 - RNA, 18 nt, Artificial Sequence
  Description of Artificial Sequence: Synthetic oligonucleotide
ugagcugugguccugccc

SEQ ID NO: 74006 - RNA, 18 nt, Artificial Sequence
  Description of Artificial Sequence: Synthetic oligonucleotide
ccuugugagcuguggucc

SEQ ID NO: 74007 - RNA, 18 nt, Artificial Sequence
  Description of Artificial Sequence: Synthetic oligonucleotide
gggauccuugugagcugu

SEQ ID NO: 74008 - RNA, 18 nt, Artificial Sequence
  Description of Artificial Sequence: Synthetic oligonucleotide
gcauugggauccuuguga

SEQ ID NO: 74009 - RNA, 18 nt, Artificial Sequence
  Description of Artificial Sequence: Synthetic oligonucleotide
agauggcauugggauccu

SEQ ID NO: 74010 - RNA, 18 nt, Artificial Sequence
  Description of Artificial Sequence: Synthetic oligonucleotide
caggaagauggcauuggg

SEQ ID NO: 74011 - RNA, 18 nt, Artificial Sequence
  Description of Artificial Sequence: Synthetic oligonucleotide
aagcucaggaagauggca

SEQ ID NO: 74012 - RNA, 18 nt, Artificial Sequence
  Description of Artificial Sequence: Synthetic oligonucleotide
guuggaagcucaggaaga

SEQ ID NO: 74013 - RNA, 18 nt, Artificial Sequence
  Description of Artificial Sequence: Synthetic oligonucleotide
cagguguuggaagcucag

SEQ ID NO: 74014 - RNA, 18 nt, Artificial Sequence
  Description of Artificial Sequence: Synthetic oligonucleotide
cggagcagguguuggaag

SEQ ID NO: 74015 - RNA, 18 nt, Artificial Sequence
  Description of Artificial Sequence: Synthetic oligonucleotide
uuccucggagcagguguu

SEQ ID NO: 74016 - RNA, 18 nt, Artificial Sequence
  Description of Artificial Sequence: Synthetic oligonucleotide
caccuuuccucggagcag

SEQ ID NO: 74017 - RNA, 18 nt, Artificial Sequence
  Description of Artificial Sequence: Synthetic oligonucleotide
aaacgcaccuuuccucgg

SEQ ID NO: 74018 - RNA, 18 nt, Artificial Sequence
  Description of Artificial Sequence: Synthetic oligonucleotide
ucaggaaacgcaccuuuc

SEQ ID NO: 74019 - RNA, 18 nt, Artificial Sequence
  Description of Artificial Sequence: Synthetic oligonucleotide
aagcaucaggaaacgcac

SEQ ID NO: 74020 - RNA, 18 nt, Artificial Sequence
  Description of Artificial Sequence: Synthetic oligonucleotide
ccuacaagcaucaggaaa

SEQ ID NO: 74021 - RNA, 18 nt, Artificial Sequence
  Description of Artificial Sequence: Synthetic oligonucleotide
acccuccuacaagcauca

SEQ ID NO: 74022 - RNA, 18 nt, Artificial Sequence
  Description of Artificial Sequence: Synthetic oligonucleotide
gguggacccuccuacaag

SEQ ID NO: 74023 - RNA, 18 nt, Artificial Sequence
  Description of Artificial Sequence: Synthetic oligonucleotide
cagaggguggacccuccu

SEQ ID NO: 74024 - RNA, 18 nt, Artificial Sequence
  Description of Artificial Sequence: Synthetic oligonucleotide
ugacgcagaggguggacc

SEQ ID NO: 74025 - RNA, 18 nt, Artificial Sequence
  Description of Artificial Sequence: Synthetic oligonucleotide
ccgccugacgcagagggu

SEQ ID NO: 74026 - RNA, 18 nt, Artificial Sequence
  Description of Artificial Sequence: Synthetic oligonucleotide
gggcccgccugacgcaga

SEQ ID NO: 74027 - RNA, 18 nt, Artificial Sequence
  Description of Artificial Sequence: Synthetic oligonucleotide
acagcugugguggguggg

SEQ ID NO: 74028 - RNA, 18 nt, Artificial Sequence
  Description of Artificial Sequence: Synthetic oligonucleotide
gggacagcuguggugggu

SEQ ID NO: 74029 - RNA, 18 nt, Artificial Sequence
  Description of Artificial Sequence: Synthetic oligonucleotide
uagagagguucugcuggg

SEQ ID NO: 74030 - RNA, 18 nt, Artificial Sequence
  Description of Artificial Sequence: Synthetic oligonucleotide
aggacuagagagguucug

SEQ ID NO: 74031 - RNA, 18 nt, Artificial Sequence
  Description of Artificial Sequence: Synthetic oligonucleotide
gugugaggacuagagagg

SEQ ID NO: 74032 - RNA, 18 nt, Artificial Sequence
  Description of Artificial Sequence: Synthetic oligonucleotide
guucagugugaggacuag

SEQ ID NO: 74033 - RNA, 18 nt, Artificial Sequence
  Description of Artificial Sequence: Synthetic oligonucleotide
agcucguucagugugagg

SEQ ID NO: 74034 - RNA, 18 nt, Artificial Sequence
  Description of Artificial Sequence: Synthetic oligonucleotide
uugggagcucguucagug

SEQ ID NO: 74035 - RNA, 18 nt, Artificial Sequence
  Description of Artificial Sequence: Synthetic oligonucleotide
ccuguuugggagcucguu

SEQ ID NO: 74036 - RNA, 18 nt, Artificial Sequence
  Description of Artificial Sequence: Synthetic oligonucleotide
gaaguccuguuugggagc

SEQ ID NO: 74037 - RNA, 18 nt, Artificial Sequence
  Description of Artificial Sequence: Synthetic oligonucleotide
auccagaaguccuguuug

SEQ ID NO: 74038 - RNA, 18 nt, Artificial Sequence
  Description of Artificial Sequence: Synthetic oligonucleotide
caacaauccagaaguccu

SEQ ID NO: 74039 - RNA, 18 nt, Artificial Sequence
  Description of Artificial Sequence: Synthetic oligonucleotide
gucuccaacaauccagaa

SEQ ID NO: 74040 - RNA, 18 nt, Artificial Sequence
  Description of Artificial Sequence: Synthetic oligonucleotide
aguuugucuccaacaauc

SEQ ID NO: 74041 - RNA, 18 nt, Artificial Sequence
  Description of Artificial Sequence: Synthetic oligonucleotide
agugaaguuugucuccaa

SEQ ID NO: 74042 - RNA, 18 nt, Artificial Sequence
  Description of Artificial Sequence: Synthetic oligonucleotide
gaggcagugaaguuuguc

SEQ ID NO: 74043 - RNA, 18 nt, Artificial Sequence
  Description of Artificial Sequence: Synthetic oligonucleotide
uggcugaggcagugaagu

SEQ ID NO: 74044 - RNA, 18 nt, Artificial Sequence
  Description of Artificial Sequence: Synthetic oligonucleotide
aguucuggcugaggcagu

SEQ ID NO: 74045 - RNA, 18 nt, Artificial Sequence
  Description of Artificial Sequence: Synthetic oligonucleotide
ccaguaguucuggcugag

SEQ ID NO: 74046 - RNA, 18 nt, Artificial Sequence
  Description of Artificial Sequence: Synthetic oligonucleotide
cagagccaguaguucugg

SEQ ID NO: 74047 - RNA, 18 nt, Artificial Sequence
  Description of Artificial Sequence: Synthetic oligonucleotide
aagcccagagccaguagu

SEQ ID NO: 74048 - RNA, 18 nt, Artificial Sequence
  Description of Artificial Sequence: Synthetic oligonucleotide
uucagaagcccagagcca

SEQ ID NO: 74049 - RNA, 18 nt, Artificial Sequence
  Description of Artificial Sequence: Synthetic oligonucleotide
gccacuucagaagcccag

SEQ ID NO: 74050 - RNA, 18 nt, Artificial Sequence
  Description of Artificial Sequence: Synthetic oligonucleotide
cugcugccacuucagaag

SEQ ID NO: 74051 - RNA, 18 nt, Artificial Sequence
  Description of Artificial Sequence: Synthetic oligonucleotide
aaucccugcugccacuuc

SEQ ID NO: 74052 - RNA, 18 nt, Artificial Sequence
  Description of Artificial Sequence: Synthetic oligonucleotide
cucugaaucccugcugcc

SEQ ID NO: 74053 - RNA, 18 nt, Artificial Sequence
  Description of Artificial Sequence: Synthetic oligonucleotide
cuuggcucugaaucccug

SEQ ID NO: 74054 - RNA, 18 nt, Artificial Sequence
  Description of Artificial Sequence: Synthetic oligonucleotide
ggaaucuuggcucugaau

SEQ ID NO: 74055 - RNA, 18 nt, Artificial Sequence
  Description of Artificial Sequence: Synthetic oligonucleotide
gaccaggaaucuuggcuc

SEQ ID NO: 74056 - RNA, 18 nt, Artificial Sequence
  Description of Artificial Sequence: Synthetic oligonucleotide
cagcagaccaggaaucuu

SEQ ID NO: 74057 - RNA, 18 nt, Artificial Sequence
  Description of Artificial Sequence: Synthetic oligonucleotide
ugguucagcagaccagga

SEQ ID NO: 74058 - RNA, 18 nt, Artificial Sequence
  Description of Artificial Sequence: Synthetic oligonucleotide
agguuugguucagcagac

SEQ ID NO: 74059 - RNA, 18 nt, Artificial Sequence
  Description of Artificial Sequence: Synthetic oligonucleotide
ccuggagguuugguucag

SEQ ID NO: 74060 - RNA, 18 nt, Artificial Sequence
  Description of Artificial Sequence: Synthetic oligonucleotide
agggaccuggagguuugg

SEQ ID NO: 74061 - RNA, 18 nt, Artificial Sequence
  Description of Artificial Sequence: Synthetic oligonucleotide
gguccagggaccuggagg

SEQ ID NO: 74062 - RNA, 18 nt, Artificial Sequence
  Description of Artificial Sequence: Synthetic oligonucleotide
gauuugguccagggaccu

SEQ ID NO: 74063 - RNA, 18 nt, Artificial Sequence
  Description of Artificial Sequence: Synthetic oligonucleotide
gggauuugguccagggac

SEQ ID NO: 74064 - RNA, 18 nt, Artificial Sequence
  Description of Artificial Sequence: Synthetic oligonucleotide
ccuguucagguauccggg

SEQ ID NO: 74065 - RNA, 18 nt, Artificial Sequence
  Description of Artificial Sequence: Synthetic oligonucleotide
uguauccuguucagguau

SEQ ID NO: 74066 - RNA, 18 nt, Artificial Sequence
  Description of Artificial Sequence: Synthetic oligonucleotide
guucguguauccuguuca

SEQ ID NO: 74067 - RNA, 18 nt, Artificial Sequence
  Description of Artificial Sequence: Synthetic oligonucleotide
caagaguucguguauccu

SEQ ID NO: 74068 - RNA, 18 nt, Artificial Sequence
  Description of Artificial Sequence: Synthetic oligonucleotide
ccauucaagaguucgugu

SEQ ID NO: 74069 - RNA, 18 nt, Artificial Sequence
  Description of Artificial Sequence: Synthetic oligonucleotide
gaguuccauucaagaguu

SEQ ID NO: 74070 - RNA, 18 nt, Artificial Sequence
  Description of Artificial Sequence: Synthetic oligonucleotide
uccacgaguuccauucaa

SEQ ID NO: 74071 - RNA, 18 nt, Artificial Sequence
  Description of Artificial Sequence: Synthetic oligonucleotide
aagaguccacgaguucca

SEQ ID NO: 74072 - RNA, 18 nt, Artificial Sequence
  Description of Artificial Sequence: Synthetic oligonucleotide
caggaaagaguccacgag

SEQ ID NO: 74073 - RNA, 18 nt, Artificial Sequence
  Description of Artificial Sequence: Synthetic oligonucleotide
ggguccaggaaagagucc

SEQ ID NO: 74074 - RNA, 18 nt, Artificial Sequence
  Description of Artificial Sequence: Synthetic oligonucleotide
cgugaggguccaggaaag

SEQ ID NO: 74075 - RNA, 18 nt, Artificial Sequence
  Description of Artificial Sequence: Synthetic oligonucleotide
uccugcgugaggguccag

SEQ ID NO: 74076 - RNA, 18 nt, Artificial Sequence
  Description of Artificial Sequence: Synthetic oligonucleotide
uaggguccugcgugaggg

SEQ ID NO: 74077 - RNA, 18 nt, Artificial Sequence
  Description of Artificial Sequence: Synthetic oligonucleotide
gcuccuaggguccugcgu

SEQ ID NO: 74078 - RNA, 18 nt, Artificial Sequence
  Description of Artificial Sequence: Synthetic oligonucleotide
gggcuccuaggguccugc

SEQ ID NO: 74079 - RNA, 18 nt, Artificial Sequence
  Description of Artificial Sequence: Synthetic oligonucleotide
ccugaggaaauguccggg

SEQ ID NO: 74080 - RNA, 18 nt, Artificial Sequence
  Description of Artificial Sequence: Synthetic oligonucleotide
auguuccugaggaaaugu

SEQ ID NO: 74081 - RNA, 18 nt, Artificial Sequence
  Description of Artificial Sequence: Synthetic oligonucleotide
gucugauguuccugagga

SEQ ID NO: 74082 - RNA, 18 nt, Artificial Sequence
  Description of Artificial Sequence: Synthetic oligonucleotide
ccugugucugauguuccu

SEQ ID NO: 74083 - RNA, 18 nt, Artificial Sequence
  Description of Artificial Sequence: Synthetic oligonucleotide
gggagccugugucugaug

SEQ ID NO: 74084 - RNA, 18 nt, Artificial Sequence
  Description of Artificial Sequence: Synthetic oligonucleotide
uggcagggagccuguguc

SEQ ID NO: 74085 - RNA, 18 nt, Artificial Sequence
  Description of Artificial Sequence: Synthetic oligonucleotide
uuggguggcagggagccu

SEQ ID NO: 74086 - RNA, 18 nt, Artificial Sequence
  Description of Artificial Sequence: Synthetic oligonucleotide
ggagguuggguggcaggg

SEQ ID NO: 74087 - RNA, 18 nt, Artificial Sequence
  Description of Artificial Sequence: Synthetic oligonucleotide
aggcuggagguugggugg

SEQ ID NO: 74088 - RNA, 18 nt, Artificial Sequence
  Description of Artificial Sequence: Synthetic oligonucleotide
uauccaggcuggagguug

SEQ ID NO: 74089 - RNA, 18 nt, Artificial Sequence
  Description of Artificial Sequence: Synthetic oligonucleotide
gagaauauccaggcugga

SEQ ID NO: 74090 - RNA, 18 nt, Artificial Sequence
  Description of Artificial Sequence: Synthetic oligonucleotide
ggaaggagaauauccagg

SEQ ID NO: 74091 - RNA, 18 nt, Artificial Sequence
  Description of Artificial Sequence: Synthetic oligonucleotide
gggaaggagaauauccag

SEQ ID NO: 74092 - RNA, 18 nt, Artificial Sequence
  Description of Artificial Sequence: Synthetic oligonucleotide
guaggaggauggguuggg

SEQ ID NO: 74093 - RNA, 18 nt, Artificial Sequence
  Description of Artificial Sequence: Synthetic oligonucleotide
guccaguaggaggauggg

SEQ ID NO: 74094 - RNA, 18 nt, Artificial Sequence
  Description of Artificial Sequence: Synthetic oligonucleotide
auacuguccaguaggagg

SEQ ID NO: 74095 - RNA, 18 nt, Artificial Sequence
  Description of Artificial Sequence: Synthetic oligonucleotide
agcguauacuguccagua

SEQ ID NO: 74096 - RNA, 18 nt, Artificial Sequence
  Description of Artificial Sequence: Synthetic oligonucleotide
ggaagagcguauacuguc

SEQ ID NO: 74097 - RNA, 18 nt, Artificial Sequence
  Description of Artificial Sequence: Synthetic oligonucleotide
aagagggaagagcguaua

SEQ ID NO: 74098 - RNA, 18 nt, Artificial Sequence
  Description of Artificial Sequence: Synthetic oligonucleotide
gguggaagagggaagagc

SEQ ID NO: 74099 - RNA, 18 nt, Artificial Sequence
  Description of Artificial Sequence: Synthetic oligonucleotide
agguggguggaagaggga

SEQ ID NO: 74100 - RNA, 18 nt, Artificial Sequence
  Description of Artificial Sequence: Synthetic oligonucleotide
gggcaagguggguggaag

SEQ ID NO: 74101 - RNA, 18 nt, Artificial Sequence
  Description of Artificial Sequence: Synthetic oligonucleotide
gggugggcaaggugggug

SEQ ID NO: 74102 - RNA, 18 nt, Artificial Sequence
  Description of Artificial Sequence: Synthetic oligonucleotide
uggagcuggaccacaggg

SEQ ID NO: 74103 - RNA, 18 nt, Artificial Sequence
  Description of Artificial Sequence: Synthetic oligonucleotide
ggguggagcuggaccaca

SEQ ID NO: 74104 - RNA, 18 nt, Artificial Sequence
  Description of Artificial Sequence: Synthetic oligonucleotide
aagggucaggaagcaggg

SEQ ID NO: 74105 - RNA, 18 nt, Artificial Sequence
  Description of Artificial Sequence: Synthetic oligonucleotide
agcagaagggucaggaag

SEQ ID NO: 74106 - RNA, 18 nt, Artificial Sequence
  Description of Artificial Sequence: Synthetic oligonucleotide
guuggagcagaaggguca

SEQ ID NO: 74107 - RNA, 18 nt, Artificial Sequence
  Description of Artificial Sequence: Synthetic oligonucleotide
ugggcguuggagcagaag

SEQ ID NO: 74108 - RNA, 18 nt, Artificial Sequence
  Description of Artificial Sequence: Synthetic oligonucleotide
gggugggcguuggagcag

SEQ ID NO: 74109 - RNA, 18 nt, Artificial Sequence
  Description of Artificial Sequence: Synthetic oligonucleotide
agaagagggcugguaggg

SEQ ID NO: 74110 - RNA, 18 nt, Artificial Sequence
  Description of Artificial Sequence: Synthetic oligonucleotide
uguuuagaagagggcugg

SEQ ID NO: 74111 - RNA, 18 nt, Artificial Sequence
  Description of Artificial Sequence: Synthetic oligonucleotide
ggauguguuuagaagagg

SEQ ID NO: 74112 - RNA, 18 nt, Artificial Sequence
  Description of Artificial Sequence: Synthetic oligonucleotide
guguaggauguguuuaga

SEQ ID NO: 74113 - RNA, 18 nt, Artificial Sequence
  Description of Artificial Sequence: Synthetic oligonucleotide
aguggguguaggaugugu

SEQ ID NO: 74114 - RNA, 18 nt, Artificial Sequence
  Description of Artificial Sequence: Synthetic oligonucleotide
cugggaguggguguagga

SEQ ID NO: 74115 - RNA, 18 nt, Artificial Sequence
  Description of Artificial Sequence: Synthetic oligonucleotide
agauucugggagugggug

SEQ ID NO: 74116 - RNA, 18 nt, Artificial Sequence
  Description of Artificial Sequence: Synthetic oligonucleotide
gagacagauucugggagu

SEQ ID NO: 74117 - RNA, 18 nt, Artificial Sequence
  Description of Artificial Sequence: Synthetic oligonucleotide
uuccugagacagauucug

SEQ ID NO: 74118 - RNA, 18 nt, Artificial Sequence
  Description of Artificial Sequence: Synthetic oligonucleotide
uacccuuccugagacaga

SEQ ID NO: 74119 - RNA, 18 nt, Artificial Sequence
  Description of Artificial Sequence: Synthetic oligonucleotide
aaccuuacccuuccugag

SEQ ID NO: 74120 - RNA, 18 nt, Artificial Sequence
  Description of Artificial Sequence: Synthetic oligonucleotide
cugagaaccuuacccuuc

SEQ ID NO: 74121 - RNA, 18 nt, Artificial Sequence
  Description of Artificial Sequence: Synthetic oligonucleotide
agugucugagaaccuuac

SEQ ID NO: 74122 - RNA, 18 nt, Artificial Sequence
  Description of Artificial Sequence: Synthetic oligonucleotide
ucggcagugucugagaac

SEQ ID NO: 74123 - RNA, 18 nt, Artificial Sequence
  Description of Artificial Sequence: Synthetic oligonucleotide
ugaugucggcagugucug

SEQ ID NO: 74124 - RNA, 18 nt, Artificial Sequence
  Description of Artificial Sequence: Synthetic oligonucleotide
aaugcugaugucggcagu

SEQ ID NO: 74125 - RNA, 18 nt, Artificial Sequence
  Description of Artificial Sequence: Synthetic oligonucleotide
gagacaaugcugaugucg

SEQ ID NO: 74126 - RNA, 18 nt, Artificial Sequence
  Description of Artificial Sequence: Synthetic oligonucleotide
uacacgagacaaugcuga

SEQ ID NO: 74127 - RNA, 18 nt, Artificial Sequence
  Description of Artificial Sequence: Synthetic oligonucleotide
agcuguacacgagacaau

SEQ ID NO: 74128 - RNA, 18 nt, Artificial Sequence
  Description of Artificial Sequence: Synthetic oligonucleotide
aagggagcuguacacgag

SEQ ID NO: 74129 - RNA, 18 nt, Artificial Sequence
  Description of Artificial Sequence: Synthetic oligonucleotide
cagggaagggagcuguac

SEQ ID NO: 74130 - RNA, 18 nt, Artificial Sequence
  Description of Artificial Sequence: Synthetic oligonucleotide
cccugcagggaagggagc

SEQ ID NO: 74131 - RNA, 18 nt, Artificial Sequence
  Description of Artificial Sequence: Synthetic oligonucleotide
gggcgcccugcagggaag

SEQ ID NO: 74132 - RNA, 18 nt, Artificial Sequence
  Description of Artificial Sequence: Synthetic oligonucleotide
cuuguccaguugucuccc

SEQ ID NO: 74133 - RNA, 18 nt, Artificial Sequence
  Description of Artificial Sequence: Synthetic oligonucleotide
gaaaucuuguccaguugu

SEQ ID NO: 74134 - RNA, 18 nt, Artificial Sequence
  Description of Artificial Sequence: Synthetic oligonucleotide
aguaggaaaucuugucca

SEQ ID NO: 74135 - RNA, 18 nt, Artificial Sequence
  Description of Artificial Sequence: Synthetic oligonucleotide
gagaaaguaggaaaucuu

SEQ ID NO: 74136 - RNA, 18 nt, Artificial Sequence
  Description of Artificial Sequence: Synthetic oligonucleotide
uucaggagaaaguaggaa

SEQ ID NO: 74137 - RNA, 18 nt, Artificial Sequence
  Description of Artificial Sequence: Synthetic oligonucleotide
uggguuucaggagaaagu

SEQ ID NO: 74138 - RNA, 18 nt, Artificial Sequence
  Description of Artificial Sequence: Synthetic oligonucleotide
ggcuuuggguuucaggag

SEQ ID NO: 74139 - RNA, 18 nt, Artificial Sequence
  Description of Artificial Sequence: Synthetic oligonucleotide
accagggcuuuggguuuc

SEQ ID NO: 74140 - RNA, 18 nt, Artificial Sequence
  Description of Artificial Sequence: Synthetic oligonucleotide
cuuuuaccagggcuuugg

SEQ ID NO: 74141 - RNA, 18 nt, Artificial Sequence
  Description of Artificial Sequence: Synthetic oligonucleotide
uaucccuuuuaccagggc

SEQ ID NO: 74142 - RNA, 18 nt, Artificial Sequence
  Description of Artificial Sequence: Synthetic oligonucleotide
cuguguaucccuuuuacc

SEQ ID NO: 74143 - RNA, 18 nt, Artificial Sequence
  Description of Artificial Sequence: Synthetic oligonucleotide
caguccuguguaucccuu

SEQ ID NO: 74144 - RNA, 18 nt, Artificial Sequence
  Description of Artificial Sequence: Synthetic oligonucleotide
cuuuucaguccuguguau

SEQ ID NO: 74145 - RNA, 18 nt, Artificial Sequence
  Description of Artificial Sequence: Synthetic oligonucleotide
auucccuuuucaguccug

SEQ ID NO: 74146 - RNA, 18 nt, Artificial Sequence
  Description of Artificial Sequence: Synthetic oligonucleotide
aaaugauucccuuuucag

SEQ ID NO: 74147 - RNA, 18 nt, Artificial Sequence
  Description of Artificial Sequence: Synthetic oligonucleotide
gugaaaaaugauucccuu

SEQ ID NO: 74148 - RNA, 18 nt, Artificial Sequence
  Description of Artificial Sequence: Synthetic oligonucleotide
guacagugaaaaaugauu

SEQ ID NO: 74149 - RNA, 18 nt, Artificial Sequence
  Description of Artificial Sequence: Synthetic oligonucleotide
auaauguacagugaaaaa

SEQ ID NO: 74150 - RNA, 18 nt, Artificial Sequence
  Description of Artificial Sequence: Synthetic oligonucleotide
gguuuauaauguacagug

SEQ ID NO: 74151 - RNA, 18 nt, Artificial Sequence
  Description of Artificial Sequence: Synthetic oligonucleotide
cugaagguuuauaaugua

SEQ ID NO: 74152 - RNA, 18 nt, Artificial Sequence
  Description of Artificial Sequence: Synthetic oligonucleotide
agcuucugaagguuuaua

SEQ ID NO: 74153 - RNA, 18 nt, Artificial Sequence
  Description of Artificial Sequence: Synthetic oligonucleotide
aaaauagcuucugaaggu

SEQ ID NO: 74154 - RNA, 18 nt, Artificial Sequence
  Description of Artificial Sequence: Synthetic oligonucleotide
uuaaaaaaauagcuucug

SEQ ID NO: 74155 - RNA, 18 nt, Artificial Sequence
  Description of Artificial Sequence: Synthetic oligonucleotide
auagcuuaaaaaaauagc

SEQ ID NO: 74156 - RNA, 18 nt, Artificial Sequence
  Description of Artificial Sequence: Synthetic oligonucleotide
ugcugauagcuuaaaaaa

SEQ ID NO: 74157 - RNA, 18 nt, Artificial Sequence
  Description of Artificial Sequence: Synthetic oligonucleotide
aguauugcugauagcuua

SEQ ID NO: 74158 - RNA, 18 nt, Artificial Sequence
  Description of Artificial Sequence: Synthetic oligonucleotide
ugaugaguauugcugaua

SEQ ID NO: 74159 - RNA, 18 nt, Artificial Sequence
  Description of Artificial Sequence: Synthetic oligonucleotide
ugcucugaugaguauugc

SEQ ID NO: 74160 - RNA, 18 nt, Artificial Sequence
  Description of Artificial Sequence: Synthetic oligonucleotide
cuagcugcucugaugagu

SEQ ID NO: 74161 - RNA, 18 nt, Artificial Sequence
  Description of Artificial Sequence: Synthetic oligonucleotide
aagagcuagcugcucuga

SEQ ID NO: 74162 - RNA, 18 nt, Artificial Sequence
  Description of Artificial Sequence: Synthetic oligonucleotide
gaccaaagagcuagcugc

SEQ ID NO: 74163 - RNA, 18 nt, Artificial Sequence
  Description of Artificial Sequence: Synthetic oligonucleotide
aaauagaccaaagagcua

SEQ ID NO: 74164 - RNA, 18 nt, Artificial Sequence
  Description of Artificial Sequence: Synthetic oligonucleotide
gcagaaaauagaccaaag

SEQ ID NO: 74165 - RNA, 18 nt, Artificial Sequence
  Description of Artificial Sequence: Synthetic oligonucleotide
uuucugcagaaaauagac

SEQ ID NO: 74166 - RNA, 18 nt, Artificial Sequence
  Description of Artificial Sequence: Synthetic oligonucleotide
gcaaauuucugcagaaaa

SEQ ID NO: 74167 - RNA, 18 nt, Artificial Sequence
  Description of Artificial Sequence: Synthetic oligonucleotide
gaguugcaaauuucugca

SEQ ID NO: 74168 - RNA, 18 nt, Artificial Sequence
  Description of Artificial Sequence: Synthetic oligonucleotide
ucagugaguugcaaauuu

SEQ ID NO: 74169 - RNA, 18 nt, Artificial Sequence
  Description of Artificial Sequence: Synthetic oligonucleotide
gagaaucagugaguugca

SEQ ID NO: 74170 - RNA, 18 nt, Artificial Sequence
  Description of Artificial Sequence: Synthetic oligonucleotide
auguagagaaucagugag

SEQ ID NO: 74171 - RNA, 18 nt, Artificial Sequence
  Description of Artificial Sequence: Synthetic oligonucleotide
agagcauguagagaauca

SEQ ID NO: 74172 - RNA, 18 nt, Artificial Sequence
  Description of Artificial Sequence: Synthetic oligonucleotide
gaaaaagagcauguagag

SEQ ID NO: 74173 - RNA, 18 nt, Artificial Sequence
  Description of Artificial Sequence: Synthetic oligonucleotide
ucacagaaaaagagcaug

SEQ ID NO: 74174 - RNA, 18 nt, Artificial Sequence
  Description of Artificial Sequence: Synthetic oligonucleotide
aguuaucacagaaaaaga

SEQ ID NO: 74175 - RNA, 18 nt, Artificial Sequence
  Description of Artificial Sequence: Synthetic oligonucleotide
ugcagaguuaucacagaa

SEQ ID NO: 74176 - RNA, 18 nt, Artificial Sequence
  Description of Artificial Sequence: Synthetic oligonucleotide
gccuuugcagaguuauca

SEQ ID NO: 74177 - RNA, 18 nt, Artificial Sequence
  Description of Artificial Sequence: Synthetic oligonucleotide
cccaggccuuugcagagu

SEQ ID NO: 74178 - RNA, 18 nt, Artificial Sequence
  Description of Artificial Sequence: Synthetic oligonucleotide
gccagcccaggccuuugc

SEQ ID NO: 74179 - RNA, 18 nt, Artificial Sequence
  Description of Artificial Sequence: Synthetic oligonucleotide
gccaggccagcccaggcc

SEQ ID NO: 74180 - RNA, 18 nt, Artificial Sequence
  Description of Artificial Sequence: Synthetic oligonucleotide
caacugccaggccagccc

SEQ ID NO: 74181 - RNA, 18 nt, Artificial Sequence
  Description of Artificial Sequence: Synthetic oligonucleotide
cuguucaacugccaggcc

SEQ ID NO: 74182 - RNA, 18 nt, Artificial Sequence
  Description of Artificial Sequence: Synthetic oligonucleotide
ucccucuguucaacugcc

SEQ ID NO: 74183 - RNA, 18 nt, Artificial Sequence
  Description of Artificial Sequence: Synthetic oligonucleotide
gucucucccucuguucaa

SEQ ID NO: 74184 - RNA, 18 nt, Artificial Sequence
  Description of Artificial Sequence: Synthetic oligonucleotide
gguuagucucucccucug

SEQ ID NO: 74185 - RNA, 18 nt, Artificial Sequence
  Description of Artificial Sequence: Synthetic oligonucleotide
cucaagguuagucucucc

SEQ ID NO: 74186 - RNA, 18 nt, Artificial Sequence
  Description of Artificial Sequence: Synthetic oligonucleotide
ucugacucaagguuaguc

SEQ ID NO: 74187 - RNA, 18 nt, Artificial Sequence
  Description of Artificial Sequence: Synthetic oligonucleotide
uguuuucugacucaaggu

SEQ ID NO: 74188 - RNA, 18 nt, Artificial Sequence
  Description of Artificial Sequence: Synthetic oligonucleotide
uucucuguuuucugacuc

SEQ ID NO: 74189 - RNA, 18 nt, Artificial Sequence
  Description of Artificial Sequence: Synthetic oligonucleotide
acccuuucucuguuuucu

SEQ ID NO: 74190 - RNA, 18 nt, Artificial Sequence
  Description of Artificial Sequence: Synthetic oligonucleotide
aaauuacccuuucucugu

SEQ ID NO: 74191 - RNA, 18 nt, Artificial Sequence
  Description of Artificial Sequence: Synthetic oligonucleotide
aaaggaaauuacccuuuc

SEQ ID NO: 74192 - RNA, 18 nt, Artificial Sequence
  Description of Artificial Sequence: Synthetic oligonucleotide
gaagcaaaggaaauuacc

SEQ ID NO: 74193 - RNA, 18 nt, Artificial Sequence
  Description of Artificial Sequence: Synthetic oligonucleotide
aauuugaagcaaaggaaa

SEQ ID NO: 74194 - RNA, 18 nt, Artificial Sequence
  Description of Artificial Sequence: Synthetic oligonucleotide
ccuugaauuugaagcaaa

SEQ ID NO: 74195 - RNA, 18 nt, Artificial Sequence
  Description of Artificial Sequence: Synthetic oligonucleotide
gaaggccuugaauuugaa

SEQ ID NO: 74196 - RNA, 18 nt, Artificial Sequence
  Description of Artificial Sequence: Synthetic oligonucleotide
cguuggaaggccuugaau

SEQ ID NO: 74197 - RNA, 18 nt, Artificial Sequence
  Description of Artificial Sequence: Synthetic oligonucleotide
gggcguuggaaggccuug

SEQ ID NO: 74198 - RNA, 18 nt, Artificial Sequence
  Description of Artificial Sequence: Synthetic oligonucleotide
gagaaugauaguaaaggg

SEQ ID NO: 74199 - RNA, 18 nt, Artificial Sequence
  Description of Artificial Sequence: Synthetic oligonucleotide
ccacugagaaugauagua

SEQ ID NO: 74200 - RNA, 18 nt, Artificial Sequence
  Description of Artificial Sequence: Synthetic oligonucleotide
gagucccacugagaauga

SEQ ID NO: 74201 - RNA, 18 nt, Artificial Sequence
  Description of Artificial Sequence: Synthetic oligonucleotide
gaucagagucccacugag

SEQ ID NO: 74202 - RNA, 18 nt, Artificial Sequence
  Description of Artificial Sequence: Synthetic oligonucleotide
uaugggaucagaguccca

SEQ ID NO: 74203 - RNA, 18 nt, Artificial Sequence
  Description of Artificial Sequence: Synthetic oligonucleotide
aagaauaugggaucagag

SEQ ID NO: 74204 - RNA, 18 nt, Artificial Sequence
  Description of Artificial Sequence: Synthetic oligonucleotide
cuguuaagaauaugggau

SEQ ID NO: 74205 - RNA, 18 nt, Artificial Sequence
  Description of Artificial Sequence: Synthetic oligonucleotide
aagaucuguuaagaauau

SEQ ID NO: 74206 - RNA, 18 nt, Artificial Sequence
  Description of Artificial Sequence: Synthetic oligonucleotide
gaguaaagaucuguuaag

SEQ ID NO: 74207 - RNA, 18 nt, Artificial Sequence
  Description of Artificial Sequence: Synthetic oligonucleotide
cucaagaguaaagaucug

SEQ ID NO: 74208 - RNA, 18 nt, Artificial Sequence
  Description of Artificial Sequence: Synthetic oligonucleotide
cauuucucaagaguaaag

SEQ ID NO: 74209 - RNA, 18 nt, Artificial Sequence
  Description of Artificial Sequence: Synthetic oligonucleotide
uuauucauuucucaagag

SEQ ID NO: 74210 - RNA, 18 nt, Artificial Sequence
  Description of Artificial Sequence: Synthetic oligonucleotide
aaagcuuauucauuucuc

SEQ ID NO: 74211 - RNA, 18 nt, Artificial Sequence
  Description of Artificial Sequence: Synthetic oligonucleotide
gagagaaagcuuauucau

SEQ ID NO: 74212 - RNA, 18 nt, Artificial Sequence
  Description of Artificial Sequence: Synthetic oligonucleotide
uuucugagagaaagcuua

SEQ ID NO: 74213 - RNA, 18 nt, Artificial Sequence
  Description of Artificial Sequence: Synthetic oligonucleotide
cagcauuucugagagaaa

SEQ ID NO: 74214 - RNA, 18 nt, Artificial Sequence
  Description of Artificial Sequence: Synthetic oligonucleotide
agggacagcauuucugag

SEQ ID NO: 74215 - RNA, 18 nt, Artificial Sequence
  Description of Artificial Sequence: Synthetic oligonucleotide
uguauagggacagcauuu

SEQ ID NO: 74216 - RNA, 18 nt, Artificial Sequence
  Description of Artificial Sequence: Synthetic oligonucleotide
ucuaguguauagggacag

SEQ ID NO: 74217 - RNA, 18 nt, Artificial Sequence
  Description of Artificial Sequence: Synthetic oligonucleotide
uuuugucuaguguauagg

SEQ ID NO: 74218 - RNA, 18 nt, Artificial Sequence
  Description of Artificial Sequence: Synthetic oligonucleotide
cucaguuuugucuagugu

SEQ ID NO: 74219 - RNA, 18 nt, Artificial Sequence
  Description of Artificial Sequence: Synthetic oligonucleotide
acaggcucaguuuugucu

SEQ ID NO: 74220 - RNA, 18 nt, Artificial Sequence
  Description of Artificial Sequence: Synthetic oligonucleotide
cuuauacaggcucaguuu

SEQ ID NO: 74221 - RNA, 18 nt, Artificial Sequence
  Description of Artificial Sequence: Synthetic oligonucleotide
uauuccuuauacaggcuc

SEQ ID NO: 74222 - RNA, 18 nt, Artificial Sequence
  Description of Artificial Sequence: Synthetic oligonucleotide
ccauuuauuccuuauaca

SEQ ID NO: 74223 - RNA, 18 nt, Artificial Sequence
  Description of Artificial Sequence: Synthetic oligonucleotide
cgcucccauuuauuccuu

SEQ ID NO: 74224 - RNA, 18 nt, Artificial Sequence
  Description of Artificial Sequence: Synthetic oligonucleotide
uucggcgcucccauuuau

SEQ ID NO: 74225 - RNA, 18 nt, Artificial Sequence
  Description of Artificial Sequence: Synthetic oligonucleotide
agcuuuucggcgcuccca

SEQ ID NO: 74226 - RNA, 18 nt, Artificial Sequence
  Description of Artificial Sequence: Synthetic oligonucleotide
uagggagcuuuucggcgc

SEQ ID NO: 74227 - RNA, 18 nt, Artificial Sequence
  Description of Artificial Sequence: Synthetic oligonucleotide
cuuuuuagggagcuuuuc

SEQ ID NO: 74228 - RNA, 18 nt, Artificial Sequence
  Description of Artificial Sequence: Synthetic oligonucleotide
cuggacaugggcaaccug

SEQ ID NO: 74229 - RNA, 18 nt, Artificial Sequence
  Description of Artificial Sequence: Synthetic oligonucleotide
uuuuccuggacaugggca

SEQ ID NO: 74230 - RNA, 18 nt, Artificial Sequence
  Description of Artificial Sequence: Synthetic oligonucleotide
ccaucuuuuccuggacau

SEQ ID NO: 74231 - RNA, 18 nt, Artificial Sequence
  Description of Artificial Sequence: Synthetic oligonucleotide
gggauccaucuuuuccug

SEQ ID NO: 74232 - RNA, 18 nt, Artificial Sequence
  Description of Artificial Sequence: Synthetic oligonucleotide
gagaagauuuggauaggg

SEQ ID NO: 74233 - RNA, 18 nt, Artificial Sequence
  Description of Artificial Sequence: Synthetic oligonucleotide
cggagaagauuuggauag

SEQ ID NO: 74234 - RNA, 18 nt, Artificial Sequence
  Description of Artificial Sequence: Synthetic oligonucleotide
caccacggagaagauuug

SEQ ID NO: 74235 - RNA, 18 nt, Artificial Sequence
  Description of Artificial Sequence: Synthetic oligonucleotide
acacacaccacggagaag

SEQ ID NO: 74236 - RNA, 18 nt, Artificial Sequence
  Description of Artificial Sequence: Synthetic oligonucleotide
cacccacacacaccacgg

SEQ ID NO: 74237 - RNA, 18 nt, Artificial Sequence
  Description of Artificial Sequence: Synthetic oligonucleotide
uccuccacccacacacac

SEQ ID NO: 74238 - RNA, 18 nt, Artificial Sequence
  Description of Artificial Sequence: Synthetic oligonucleotide
uccacuccuccacccaca

SEQ ID NO: 74239 - RNA, 18 nt, Artificial Sequence
  Description of Artificial Sequence: Synthetic oligonucleotide
caggguccacuccuccac

SEQ ID NO: 74240 - RNA, 18 nt, Artificial Sequence
  Description of Artificial Sequence: Synthetic oligonucleotide
uggaccaggguccacucc

SEQ ID NO: 74241 - RNA, 18 nt, Artificial Sequence
  Description of Artificial Sequence: Synthetic oligonucleotide
cugccuggaccagggucc

SEQ ID NO: 74242 - RNA, 18 nt, Artificial Sequence
  Description of Artificial Sequence: Synthetic oligonucleotide
agccccugccuggaccag

SEQ ID NO: 74243 - RNA, 18 nt, Artificial Sequence
  Description of Artificial Sequence: Synthetic oligonucleotide
ccuggagccccugccugg

SEQ ID NO: 74244 - RNA, 18 nt, Artificial Sequence
  Description of Artificial Sequence: Synthetic oligonucleotide
ucuucccuggagccccug

SEQ ID NO: 74245 - RNA, 18 nt, Artificial Sequence
  Description of Artificial Sequence: Synthetic oligonucleotide
ccuucucuucccuggagc

SEQ ID NO: 74246 - RNA, 18 nt, Artificial Sequence
  Description of Artificial Sequence: Synthetic oligonucleotide
ugacgccuucucuucccu

SEQ ID NO: 74247 - RNA, 18 nt, Artificial Sequence
  Description of Artificial Sequence: Synthetic oligonucleotide
ggaagugacgccuucucu

SEQ ID NO: 74248 - RNA, 18 nt, Artificial Sequence
  Description of Artificial Sequence: Synthetic oligonucleotide
cccccggaagugacgccu

SEQ ID NO: 74249 - RNA, 18 nt, Artificial Sequence
  Description of Artificial Sequence: Synthetic oligonucleotide
gaaggcccccggaaguga

SEQ ID NO: 74250 - RNA, 18 nt, Artificial Sequence
  Description of Artificial Sequence: Synthetic oligonucleotide
cuggugaaggcccccgga

SEQ ID NO: 74251 - RNA, 18 nt, Artificial Sequence
  Description of Artificial Sequence: Synthetic oligonucleotide
agacacuggugaaggccc

SEQ ID NO: 74252 - RNA, 18 nt, Artificial Sequence
  Description of Artificial Sequence: Synthetic oligonucleotide
ccaccagacacuggugaa

SEQ ID NO: 74253 - RNA, 18 nt, Artificial Sequence
  Description of Artificial Sequence: Synthetic oligonucleotide
gggagccaccagacacug

SEQ ID NO: 74254 - RNA, 18 nt, Artificial Sequence
  Description of Artificial Sequence: Synthetic oligonucleotide
gagaagggagccaccaga

SEQ ID NO: 74255 - RNA, 18 nt, Artificial Sequence
  Description of Artificial Sequence: Synthetic oligonucleotide
aaucagagaagggagcca

SEQ ID NO: 74256 - RNA, 18 nt, Artificial Sequence
  Description of Artificial Sequence: Synthetic oligonucleotide
ugcccaaucagagaaggg

SEQ ID NO: 74257 - RNA, 18 nt, Artificial Sequence
  Description of Artificial Sequence: Synthetic oligonucleotide
acuucugcccaaucagag

SEQ ID NO: 74258 - RNA, 18 nt, Artificial Sequence
  Description of Artificial Sequence: Synthetic oligonucleotide
gggccacuucugcccaau

SEQ ID NO: 74259 - RNA, 18 nt, Artificial Sequence
  Description of Artificial Sequence: Synthetic oligonucleotide
ugccugggccacuucugc

SEQ ID NO: 74260 - RNA, 18 nt, Artificial Sequence
  Description of Artificial Sequence: Synthetic oligonucleotide
acgccugccugggccacu

SEQ ID NO: 74261 - RNA, 18 nt, Artificial Sequence
  Description of Artificial Sequence: Synthetic oligonucleotide
gucauacgccugccuggg

SEQ ID NO: 74262 - RNA, 18 nt, Artificial Sequence
  Description of Artificial Sequence: Synthetic oligonucleotide
agcaggucauacgccugc

SEQ ID NO: 74263 - RNA, 18 nt, Artificial Sequence
  Description of Artificial Sequence: Synthetic oligonucleotide
acagcagcaggucauacg

SEQ ID NO: 74264 - RNA, 18 nt, Artificial Sequence
  Description of Artificial Sequence: Synthetic oligonucleotide
ccuccacagcagcagguc

SEQ ID NO: 74265 - RNA, 18 nt, Artificial Sequence
  Description of Artificial Sequence: Synthetic oligonucleotide
cagccccuccacagcagc

SEQ ID NO: 74266 - RNA, 18 nt, Artificial Sequence
  Description of Artificial Sequence: Synthetic oligonucleotide
gggcacagccccuccaca

SEQ ID NO: 74267 - RNA, 18 nt, Artificial Sequence
  Description of Artificial Sequence: Synthetic oligonucleotide
aagacauguggcgguggg

SEQ ID NO: 74268 - RNA, 18 nt, Artificial Sequence
  Description of Artificial Sequence: Synthetic oligonucleotide
aggaagacauguggcggu

SEQ ID NO: 74269 - RNA, 18 nt, Artificial Sequence
  Description of Artificial Sequence: Synthetic oligonucleotide
uggguaggaagacaugug

SEQ ID NO: 74270 - RNA, 18 nt, Artificial Sequence
  Description of Artificial Sequence: Synthetic oligonucleotide
gcagauggguaggaagac

SEQ ID NO: 74271 - RNA, 18 nt, Artificial Sequence
  Description of Artificial Sequence: Synthetic oligonucleotide
agcaggcagcccucuggg

SEQ ID NO: 74272 - RNA, 18 nt, Artificial Sequence
  Description of Artificial Sequence: Synthetic oligonucleotide
ugcacagcaggcagcccu

SEQ ID NO: 74273 - RNA, 18 nt, Artificial Sequence
  Description of Artificial Sequence: Synthetic oligonucleotide
ccaagugcacagcaggca

SEQ ID NO: 74274 - RNA, 18 nt, Artificial Sequence
  Description of Artificial Sequence: Synthetic oligonucleotide
aggacccaagugcacagc

SEQ ID NO: 74275 - RNA, 18 nt, Artificial Sequence
  Description of Artificial Sequence: Synthetic oligonucleotide
gcuccaggacccaagugc

SEQ ID NO: 74276 - RNA, 18 nt, Artificial Sequence
  Description of Artificial Sequence: Synthetic oligonucleotide
gaagggcuccaggaccca

SEQ ID NO: 74277 - RNA, 18 nt, Artificial Sequence
  Description of Artificial Sequence: Synthetic oligonucleotide
guggagaagggcuccagg

SEQ ID NO: 74278 - RNA, 18 nt, Artificial Sequence
  Description of Artificial Sequence: Synthetic oligonucleotide
cccacacccugcuggcca

SEQ ID NO: 74279 - RNA, 18 nt, Artificial Sequence
  Description of Artificial Sequence: Synthetic oligonucleotide
auaaccccacacccugcu

SEQ ID NO: 74280 - RNA, 18 nt, Artificial Sequence
  Description of Artificial Sequence: Synthetic oligonucleotide
cucacauaaccccacacc

SEQ ID NO: 74281 - RNA, 18 nt, Artificial Sequence
  Description of Artificial Sequence: Synthetic oligonucleotide
cuacccucacauaacccc

SEQ ID NO: 74282 - RNA, 18 nt, Artificial Sequence
  Description of Artificial Sequence: Synthetic oligonucleotide
ccuuucuacccucacaua

SEQ ID NO: 74283 - RNA, 18 nt, Artificial Sequence
  Description of Artificial Sequence: Synthetic oligonucleotide
gcuguccuuucuacccuc

SEQ ID NO: 74284 - RNA, 18 nt, Artificial Sequence
  Description of Artificial Sequence: Synthetic oligonucleotide
ucuuugcuguccuuucua

SEQ ID NO: 74285 - RNA, 18 nt, Artificial Sequence
  Description of Artificial Sequence: Synthetic oligonucleotide
auuucucuuugcuguccu

SEQ ID NO: 74286 - RNA, 18 nt, Artificial Sequence
  Description of Artificial Sequence: Synthetic oligonucleotide
agcccauuucucuuugcu

SEQ ID NO: 74287 - RNA, 18 nt, Artificial Sequence
  Description of Artificial Sequence: Synthetic oligonucleotide
cugggagcccauuucucu

SEQ ID NO: 74288 - RNA, 18 nt, Artificial Sequence
  Description of Artificial Sequence: Synthetic oligonucleotide
cccagcugggagcccauu

SEQ ID NO: 74289 - RNA, 18 nt, Artificial Sequence
  Description of Artificial Sequence: Synthetic oligonucleotide
ccucccccagcugggagc

SEQ ID NO: 74290 - RNA, 18 nt, Artificial Sequence
  Description of Artificial Sequence: Synthetic oligonucleotide
cugccccucccccagcug

SEQ ID NO: 74291 - RNA, 18 nt, Artificial Sequence
  Description of Artificial Sequence: Synthetic oligonucleotide
uuugccugccccuccccc

SEQ ID NO: 74292 - RNA, 18 nt, Artificial Sequence
  Description of Artificial Sequence: Synthetic oligonucleotide
uccaguuugccugccccu

SEQ ID NO: 74293 - RNA, 18 nt, Artificial Sequence
  Description of Artificial Sequence: Synthetic oligonucleotide
uagguuccaguuugccug

SEQ ID NO: 74294 - RNA, 18 nt, Artificial Sequence
  Description of Artificial Sequence: Synthetic oligonucleotide
gccuguagguuccaguuu

SEQ ID NO: 74295 - RNA, 18 nt, Artificial Sequence
  Description of Artificial Sequence: Synthetic oligonucleotide
ucagugccuguagguucc

SEQ ID NO: 74296 - RNA, 18 nt, Artificial Sequence
  Description of Artificial Sequence: Synthetic oligonucleotide
aaaggucagugccuguag

SEQ ID NO: 74297 - RNA, 18 nt, Artificial Sequence
  Description of Artificial Sequence: Synthetic oligonucleotide
ucgacaaaggucagugcc

SEQ ID NO: 74298 - RNA, 18 nt, Artificial Sequence
  Description of Artificial Sequence: Synthetic oligonucleotide
ucuucucgacaaagguca

SEQ ID NO: 74299 - RNA, 18 nt, Artificial Sequence
  Description of Artificial Sequence: Synthetic oligonucleotide
uacacucuucucgacaaa

SEQ ID NO: 74300 - RNA, 18 nt, Artificial Sequence
  Description of Artificial Sequence: Synthetic oligonucleotide
aaggcuacacucuucucg

SEQ ID NO: 74301 - RNA, 18 nt, Artificial Sequence
  Description of Artificial Sequence: Synthetic oligonucleotide
cugggaaggcuacacucu

SEQ ID NO: 74302 - RNA, 18 nt, Artificial Sequence
  Description of Artificial Sequence: Synthetic oligonucleotide
ccauucugggaaggcuac

SEQ ID NO: 74303 - RNA, 18 nt, Artificial Sequence
  Description of Artificial Sequence: Synthetic oligonucleotide
uccucccauucugggaag

SEQ ID NO: 74304 - RNA, 18 nt, Artificial Sequence
  Description of Artificial Sequence: Synthetic oligonucleotide
ccugcuccucccauucug

SEQ ID NO: 74305 - RNA, 18 nt, Artificial Sequence
  Description of Artificial Sequence: Synthetic oligonucleotide
ucugcccugcuccuccca

SEQ ID NO: 74306 - RNA, 18 nt, Artificial Sequence
  Description of Artificial Sequence: Synthetic oligonucleotide
ccugcucugcccugcucc

SEQ ID NO: 74307 - RNA, 18 nt, Artificial Sequence
  Description of Artificial Sequence: Synthetic oligonucleotide
cuaccccugcucugcccu

SEQ ID NO: 74308 - RNA, 18 nt, Artificial Sequence
  Description of Artificial Sequence: Synthetic oligonucleotide
acccccuaccccugcucu

SEQ ID NO: 74309 - RNA, 18 nt, Artificial Sequence
  Description of Artificial Sequence: Synthetic oligonucleotide
accccacccccuaccccu

SEQ ID NO: 74310 - RNA, 18 nt, Artificial Sequence
  Description of Artificial Sequence: Synthetic oligonucleotide
ccagcaccccacccccua

SEQ ID NO: 74311 - RNA, 18 nt, Artificial Sequence
  Description of Artificial Sequence: Synthetic oligonucleotide
agaaaccagcaccccacc

SEQ ID NO: 74312 - RNA, 18 nt, Artificial Sequence
  Description of Artificial Sequence: Synthetic oligonucleotide
cccucagaaaccagcacc

SEQ ID NO: 74313 - RNA, 18 nt, Artificial Sequence
  Description of Artificial Sequence: Synthetic oligonucleotide
ucagucccucagaaacca

SEQ ID NO: 74314 - RNA, 18 nt, Artificial Sequence
  Description of Artificial Sequence: Synthetic oligonucleotide
agugaucagucccucaga

SEQ ID NO: 74315 - RNA, 18 nt, Artificial Sequence
  Description of Artificial Sequence: Synthetic oligonucleotide
aaguaagugaucaguccc

SEQ ID NO: 74316 - RNA, 18 nt, Artificial Sequence
  Description of Artificial Sequence: Synthetic oligonucleotide
ccaccaaguaagugauca

SEQ ID NO: 74317 - RNA, 18 nt, Artificial Sequence
  Description of Artificial Sequence: Synthetic oligonucleotide
guauuccaccaaguaagu

SEQ ID NO: 74318 - RNA, 18 nt, Artificial Sequence
  Description of Artificial Sequence: Synthetic oligonucleotide
gugcuguauuccaccaag

SEQ ID NO: 74319 - RNA, 18 nt, Artificial Sequence
  Description of Artificial Sequence: Synthetic oligonucleotide
gggcugugcuguauucca

SEQ ID NO: 74320 - RNA, 18 nt, Artificial Sequence
  Description of Artificial Sequence: Synthetic oligonucleotide
agccagggcugugcugua

SEQ ID NO: 74321 - RNA, 18 nt, Artificial Sequence
  Description of Artificial Sequence: Synthetic oligonucleotide
gggccagccagggcugug

SEQ ID NO: 74322 - RNA, 18 nt, Artificial Sequence
  Description of Artificial Sequence: Synthetic oligonucleotide
ccuuagggccagccaggg

SEQ ID NO: 74323 - RNA, 18 nt, Artificial Sequence
  Description of Artificial Sequence: Synthetic oligonucleotide
ccuuuccuuagggccagc

SEQ ID NO: 74324 - RNA, 18 nt, Artificial Sequence
  Description of Artificial Sequence: Synthetic oligonucleotide
uguccccuuuccuuaggg

SEQ ID NO: 74325 - RNA, 18 nt, Artificial Sequence
  Description of Artificial Sequence: Synthetic oligonucleotide
gcucauguccccuuuccu

SEQ ID NO: 74326 - RNA, 18 nt, Artificial Sequence
  Description of Artificial Sequence: Synthetic oligonucleotide
ccugggcucauguccccu

SEQ ID NO: 74327 - RNA, 18 nt, Artificial Sequence
  Description of Artificial Sequence: Synthetic oligonucleotide
uucucccugggcucaugu

SEQ ID NO: 74328 - RNA, 18 nt, Artificial Sequence
  Description of Artificial Sequence: Synthetic oligonucleotide
uuauuuucucccugggcu

SEQ ID NO: 74329 - RNA, 18 nt, Artificial Sequence
  Description of Artificial Sequence: Synthetic oligonucleotide
cucucuuauuuucucccu

SEQ ID NO: 74330 - RNA, 18 nt, Artificial Sequence
  Description of Artificial Sequence: Synthetic oligonucleotide
gcucccucucuuauuuuc

SEQ ID NO: 74331 - RNA, 18 nt, Artificial Sequence
  Description of Artificial Sequence: Synthetic oligonucleotide
gugcagcucccucucuua

SEQ ID NO: 74332 - RNA, 18 nt, Artificial Sequence
  Description of Artificial Sequence: Synthetic oligonucleotide
ccuaagugcagcucccuc

SEQ ID NO: 74333 - RNA, 18 nt, Artificial Sequence
  Description of Artificial Sequence: Synthetic oligonucleotide
uaagcccuaagugcagcu

SEQ ID NO: 74334 - RNA, 18 nt, Artificial Sequence
  Description of Artificial Sequence: Synthetic oligonucleotide
uuugcuaagcccuaagug

SEQ ID NO: 74335 - RNA, 18 nt, Artificial Sequence
  Description of Artificial Sequence: Synthetic oligonucleotide
cuguguuugcuaagcccu

SEQ ID NO: 74336 - RNA, 18 nt, Artificial Sequence
  Description of Artificial Sequence: Synthetic oligonucleotide
uacuacuguguuugcuaa

SEQ ID NO: 74337 - RNA, 18 nt, Artificial Sequence
  Description of Artificial Sequence: Synthetic oligonucleotide
caucuuacuacuguguuu

SEQ ID NO: 74338 - RNA, 18 nt, Artificial Sequence
  Description of Artificial Sequence: Synthetic oligonucleotide
guguccaucuuacuacug

SEQ ID NO: 74339 - RNA, 18 nt, Artificial Sequence
  Description of Artificial Sequence: Synthetic oligonucleotide
gggcuguguccaucuuac

SEQ ID NO: 74340 - RNA, 18 nt, Artificial Sequence
  Description of Artificial Sequence: Synthetic oligonucleotide
aaugaccagcuaagaaug

SEQ ID NO: 74341 - RNA, 18 nt, Artificial Sequence
  Description of Artificial Sequence: Synthetic oligonucleotide
cgaggaaugaccagcuaa

SEQ ID NO: 74342 - RNA, 18 nt, Artificial Sequence
  Description of Artificial Sequence: Synthetic oligonucleotide
gcuaacgaggaaugacca

SEQ ID NO: 74343 - RNA, 18 nt, Artificial Sequence
  Description of Artificial Sequence: Synthetic oligonucleotide
cuuaagcuaacgaggaau

SEQ ID NO: 74344 - RNA, 18 nt, Artificial Sequence
  Description of Artificial Sequence: Synthetic oligonucleotide
agaaccuuaagcuaacga

SEQ ID NO: 74345 - RNA, 18 nt, Artificial Sequence
  Description of Artificial Sequence: Synthetic oligonucleotide
gauucagaaccuuaagcu

SEQ ID NO: 74346 - RNA, 18 nt, Artificial Sequence
  Description of Artificial Sequence: Synthetic oligonucleotide
caccagauucagaaccuu

SEQ ID NO: 74347 - RNA, 18 nt, Artificial Sequence
  Description of Artificial Sequence: Synthetic oligonucleotide
cccagcaccagauucaga

SEQ ID NO: 74348 - RNA, 18 nt, Artificial Sequence
  Description of Artificial Sequence: Synthetic oligonucleotide
gcuuccccagcaccagau

SEQ ID NO: 74349 - RNA, 18 nt, Artificial Sequence
  Description of Artificial Sequence: Synthetic oligonucleotide
gcccagcuuccccagcac

SEQ ID NO: 74350 - RNA, 18 nt, Artificial Sequence
  Description of Artificial Sequence: Synthetic oligonucleotide
gccuggcccagcuucccc

SEQ ID NO: 74351 - RNA, 18 nt, Artificial Sequence
  Description of Artificial Sequence: Synthetic oligonucleotide
ggcuugccuggcccagcu

SEQ ID NO: 74352 - RNA, 18 nt, Artificial Sequence
  Description of Artificial Sequence: Synthetic oligonucleotide
gcccuggcuugccuggcc

SEQ ID NO: 74353 - RNA, 18 nt, Artificial Sequence
  Description of Artificial Sequence: Synthetic oligonucleotide
cuugcgcccuggcuugcc

SEQ ID NO: 74354 - RNA, 18 nt, Artificial Sequence
  Description of Artificial Sequence: Synthetic oligonucleotide
cucuccuugcgcccuggc

SEQ ID NO: 74355 - RNA, 18 nt, Artificial Sequence
  Description of Artificial Sequence: Synthetic oligonucleotide
uuacccucuccuugcgcc

SEQ ID NO: 74356 - RNA, 18 nt, Artificial Sequence
  Description of Artificial Sequence: Synthetic oligonucleotide
ucccauuacccucuccuu

SEQ ID NO: 74357 - RNA, 18 nt, Artificial Sequence
  Description of Artificial Sequence: Synthetic oligonucleotide
ccuccucccauuacccuc

SEQ ID NO: 74358 - RNA, 18 nt, Artificial Sequence
  Description of Artificial Sequence: Synthetic oligonucleotide
ugggcccuccucccauua

SEQ ID NO: 74359 - RNA, 18 nt, Artificial Sequence
  Description of Artificial Sequence: Synthetic oligonucleotide
augagugggcccuccucc

SEQ ID NO: 74360 - RNA, 18 nt, Artificial Sequence
  Description of Artificial Sequence: Synthetic oligonucleotide
ucaacaugagugggcccu

SEQ ID NO: 74361 - RNA, 18 nt, Artificial Sequence
  Description of Artificial Sequence: Synthetic oligonucleotide
gucugucaacaugagugg

SEQ ID NO: 74362 - RNA, 18 nt, Artificial Sequence
  Description of Artificial Sequence: Synthetic oligonucleotide
uguaggucugucaacaug

SEQ ID NO: 74363 - RNA, 18 nt, Artificial Sequence
  Description of Artificial Sequence: Synthetic oligonucleotide
uuuccuguaggucuguca

SEQ ID NO: 74364 - RNA, 18 nt, Artificial Sequence
  Description of Artificial Sequence: Synthetic oligonucleotide
ugggauuuccuguagguc

SEQ ID NO: 74365 - RNA, 18 nt, Artificial Sequence
  Description of Artificial Sequence: Synthetic oligonucleotide
aauauugggauuuccugu

SEQ ID NO: 74366 - RNA, 18 nt, Artificial Sequence
  Description of Artificial Sequence: Synthetic oligonucleotide
gauucaauauugggauuu

SEQ ID NO: 74367 - RNA, 18 nt, Artificial Sequence
  Description of Artificial Sequence: Synthetic oligonucleotide
caccugauucaauauugg

SEQ ID NO: 74368 - RNA, 18 nt, Artificial Sequence
  Description of Artificial Sequence: Synthetic oligonucleotide
gcuugcaccugauucaau

SEQ ID NO: 74369 - RNA, 18 nt, Artificial Sequence
  Description of Artificial Sequence: Synthetic oligonucleotide
aagaggcuugcaccugau

SEQ ID NO: 74370 - RNA, 18 nt, Artificial Sequence
  Description of Artificial Sequence: Synthetic oligonucleotide
gugcaaagaggcuugcac

SEQ ID NO: 74371 - RNA, 18 nt, Artificial Sequence
  Description of Artificial Sequence: Synthetic oligonucleotide
aaguugugcaaagaggcu

SEQ ID NO: 74372 - RNA, 18 nt, Artificial Sequence
  Description of Artificial Sequence: Synthetic oligonucleotide
uucacaaguugugcaaag

SEQ ID NO: 74373 - RNA, 18 nt, Artificial Sequence
  Description of Artificial Sequence: Synthetic oligonucleotide
ucuccuuuuugucaggac

SEQ ID NO: 74374 - RNA, 18 nt, Artificial Sequence
  Description of Artificial Sequence: Synthetic oligonucleotide
uggugucuccuuuuuguc

SEQ ID NO: 74375 - RNA, 18 nt, Artificial Sequence
  Description of Artificial Sequence: Synthetic oligonucleotide
gcauauggugucuccuuu

SEQ ID NO: 74376 - RNA, 18 nt, Artificial Sequence
  Description of Artificial Sequence: Synthetic oligonucleotide
agaaagcauauggugucu

SEQ ID NO: 74377 - RNA, 18 nt, Artificial Sequence
  Description of Artificial Sequence: Synthetic oligonucleotide
aagcaagaaagcauaugg

SEQ ID NO: 74378 - RNA, 18 nt, Artificial Sequence
  Description of Artificial Sequence: Synthetic oligonucleotide
aaagaaagcaagaaagca

SEQ ID NO: 74379 - RNA, 18 nt, Artificial Sequence
  Description of Artificial Sequence: Synthetic oligonucleotide
gaaagaaagaaagcaaga

SEQ ID NO: 74380 - RNA, 18 nt, Artificial Sequence
  Description of Artificial Sequence: Synthetic oligonucleotide
agaaagaaagaaagaaag

SEQ ID NO: 74381 - RNA, 18 nt, Artificial Sequence
  Description of Artificial Sequence: Synthetic oligonucleotide
aagaaagaaagaaagaaa

SEQ ID NO: 74382 - RNA, 18 nt, Artificial Sequence
  Description of Artificial Sequence: Synthetic oligonucleotide
aaagaaagaaagaaagaa

SEQ ID NO: 74383 - RNA, 18 nt, Artificial Sequence
  Description of Artificial Sequence: Synthetic oligonucleotide
aaaaaaaagaaagaaaga

SEQ ID NO: 74384 - RNA, 18 nt, Artificial Sequence
  Description of Artificial Sequence: Synthetic oligonucleotide
caaaaaaaaaaaagaaag

SEQ ID NO: 74385 - RNA, 18 nt, Artificial Sequence
  Description of Artificial Sequence: Synthetic oligonucleotide
cgucucaaaaaaaaaaaa

SEQ ID NO: 74386 - RNA, 18 nt, Artificial Sequence
  Description of Artificial Sequence: Synthetic oligonucleotide
aacuccgucucaaaaaaa

SEQ ID NO: 74387 - RNA, 18 nt, Artificial Sequence
  Description of Artificial Sequence: Synthetic oligonucleotide
agugaaacuccgucucaa

SEQ ID NO: 74388 - RNA, 18 nt, Artificial Sequence
  Description of Artificial Sequence: Synthetic oligonucleotide
auaagagugaaacuccgu

SEQ ID NO: 74389 - RNA, 18 nt, Artificial Sequence
  Description of Artificial Sequence: Synthetic oligonucleotide
gggcaauaagagugaaac

SEQ ID NO: 74390 - RNA, 18 nt, Artificial Sequence
  Description of Artificial Sequence: Synthetic oligonucleotide
agccugggcaauaagagu

SEQ ID NO: 74391 - RNA, 18 nt, Artificial Sequence
  Description of Artificial Sequence: Synthetic oligonucleotide
acuccagccugggcaaua

SEQ ID NO: 74392 - RNA, 18 nt, Artificial Sequence
  Description of Artificial Sequence: Synthetic oligonucleotide
auugcacuccagccuggg

SEQ ID NO: 74393 - RNA, 18 nt, Artificial Sequence
  Description of Artificial Sequence: Synthetic oligonucleotide
gcaccauugcacuccagc

SEQ ID NO: 74394 - RNA, 18 nt, Artificial Sequence
  Description of Artificial Sequence: Synthetic oligonucleotide
agaucgcaccauugcacu

SEQ ID NO: 74395 - RNA, 18 nt, Artificial Sequence
  Description of Artificial Sequence: Synthetic oligonucleotide
agccgagaucgcaccauu

SEQ ID NO: 74396 - RNA, 18 nt, Artificial Sequence
  Description of Artificial Sequence: Synthetic oligonucleotide
uggugagccgagaucgca

SEQ ID NO: 74397 - RNA, 18 nt, Artificial Sequence
  Description of Artificial Sequence: Synthetic oligonucleotide
gguuguggugagccgaga

SEQ ID NO: 74398 - RNA, 18 nt, Artificial Sequence
  Description of Artificial Sequence: Synthetic oligonucleotide
gcggagguuguggugagc

SEQ ID NO: 74399 - RNA, 18 nt, Artificial Sequence
  Description of Artificial Sequence: Synthetic oligonucleotide
gggaggcggagguugugg

SEQ ID NO: 74400 - RNA, 18 nt, Artificial Sequence
  Description of Artificial Sequence: Synthetic oligonucleotide
uaccugggaggcggaggu

SEQ ID NO: 74401 - RNA, 18 nt, Artificial Sequence
  Description of Artificial Sequence: Synthetic oligonucleotide
gcuuguaccugggaggcg

SEQ ID NO: 74402 - RNA, 18 nt, Artificial Sequence
  Description of Artificial Sequence: Synthetic oligonucleotide
gaaucgcuuguaccuggg

SEQ ID NO: 74403 - RNA, 18 nt, Artificial Sequence
  Description of Artificial Sequence: Synthetic oligonucleotide
caggagaaucgcuuguac

SEQ ID NO: 74404 - RNA, 18 nt, Artificial Sequence
  Description of Artificial Sequence: Synthetic oligonucleotide
ugagacaggagaaucgcu

SEQ ID NO: 74405 - RNA, 18 nt, Artificial Sequence
  Description of Artificial Sequence: Synthetic oligonucleotide
gaggcugagacaggagaa

SEQ ID NO: 74406 - RNA, 18 nt, Artificial Sequence
  Description of Artificial Sequence: Synthetic oligonucleotide
cuugggaggcugagacag

SEQ ID NO: 74407 - RNA, 18 nt, Artificial Sequence
  Description of Artificial Sequence: Synthetic oligonucleotide
agcuacuugggaggcuga

SEQ ID NO: 74408 - RNA, 18 nt, Artificial Sequence
  Description of Artificial Sequence: Synthetic oligonucleotide
auccaagcuacuugggag

SEQ ID NO: 74409 - RNA, 18 nt, Artificial Sequence
  Description of Artificial Sequence: Synthetic oligonucleotide
cuguaauccaagcuacuu

SEQ ID NO: 74410 - RNA, 18 nt, Artificial Sequence
  Description of Artificial Sequence: Synthetic oligonucleotide
caugccuguaauccaagc

SEQ ID NO: 74411 - RNA, 18 nt, Artificial Sequence
  Description of Artificial Sequence: Synthetic oligonucleotide
ugguucaugccuguaauc

SEQ ID NO: 74412 - RNA, 18 nt, Artificial Sequence
  Description of Artificial Sequence: Synthetic oligonucleotide
uguggugguucaugccug

SEQ ID NO: 74413 - RNA, 18 nt, Artificial Sequence
  Description of Artificial Sequence: Synthetic oligonucleotide
caggguguggugguucau

SEQ ID NO: 74414 - RNA, 18 nt, Artificial Sequence
  Description of Artificial Sequence: Synthetic oligonucleotide
acuagcaggguguggugg

SEQ ID NO: 74415 - RNA, 18 nt, Artificial Sequence
  Description of Artificial Sequence: Synthetic oligonucleotide
aaaaaacuagcagggugu

SEQ ID NO: 74416 - RNA, 18 nt, Artificial Sequence
  Description of Artificial Sequence: Synthetic oligonucleotide
auacaaaaaaacuagcag

SEQ ID NO: 74417 - RNA, 18 nt, Artificial Sequence
  Description of Artificial Sequence: Synthetic oligonucleotide
acgaaauacaaaaaaacu

SEQ ID NO: 74418 - RNA, 18 nt, Artificial Sequence
  Description of Artificial Sequence: Synthetic oligonucleotide
gcucuacgaaauacaaaa

SEQ ID NO: 74419 - RNA, 18 nt, Artificial Sequence
  Description of Artificial Sequence: Synthetic oligonucleotide
ccccggcucuacgaaaua

SEQ ID NO: 74420 - RNA, 18 nt, Artificial Sequence
  Description of Artificial Sequence: Synthetic oligonucleotide
ugaaaccccggcucuacg

SEQ ID NO: 74421 - RNA, 18 nt, Artificial Sequence
  Description of Artificial Sequence: Synthetic oligonucleotide
cauggugaaaccccggcu

SEQ ID NO: 74422 - RNA, 18 nt, Artificial Sequence
  Description of Artificial Sequence: Synthetic oligonucleotide
acuaacauggugaaaccc

SEQ ID NO: 74423 - RNA, 18 nt, Artificial Sequence
  Description of Artificial Sequence: Synthetic oligonucleotide
gccucacuaacaugguga

SEQ ID NO: 74424 - RNA, 18 nt, Artificial Sequence
  Description of Artificial Sequence: Synthetic oligonucleotide
caccagccucacuaacau

SEQ ID NO: 74425 - RNA, 18 nt, Artificial Sequence
  Description of Artificial Sequence: Synthetic oligonucleotide
uucgccaccagccucacu

SEQ ID NO: 74426 - RNA, 18 nt, Artificial Sequence
  Description of Artificial Sequence: Synthetic oligonucleotide
aggaguucgccaccagcc

SEQ ID NO: 74427 - RNA, 18 nt, Artificial Sequence
  Description of Artificial Sequence: Synthetic oligonucleotide
aggucaggaguucgccac

SEQ ID NO: 74428 - RNA, 18 nt, Artificial Sequence
  Description of Artificial Sequence: Synthetic oligonucleotide
accugaggucaggaguuc

SEQ ID NO: 74429 - RNA, 18 nt, Artificial Sequence
  Description of Artificial Sequence: Synthetic oligonucleotide
ggaucaccugaggucagg

SEQ ID NO: 74430 - RNA, 18 nt, Artificial Sequence
  Description of Artificial Sequence: Synthetic oligonucleotide
cggguggaucaccugagg

SEQ ID NO: 74431 - RNA, 18 nt, Artificial Sequence
  Description of Artificial Sequence: Synthetic oligonucleotide
caaggcggguggaucacc

SEQ ID NO: 74432 - RNA, 18 nt, Artificial Sequence
  Description of Artificial Sequence: Synthetic oligonucleotide
gaguccaaggcgggugga

SEQ ID NO: 74433 - RNA, 18 nt, Artificial Sequence
  Description of Artificial Sequence: Synthetic oligonucleotide
uuugggaguccaaggcgg

SEQ ID NO: 74434 - RNA, 18 nt, Artificial Sequence
  Description of Artificial Sequence: Synthetic oligonucleotide
agcacuuugggaguccaa

SEQ ID NO: 74435 - RNA, 18 nt, Artificial Sequence
  Description of Artificial Sequence: Synthetic oligonucleotide
aucccagcacuuugggag

SEQ ID NO: 74436 - RNA, 18 nt, Artificial Sequence
  Description of Artificial Sequence: Synthetic oligonucleotide
cuguaaucccagcacuuu

SEQ ID NO: 74437 - RNA, 18 nt, Artificial Sequence
  Description of Artificial Sequence: Synthetic oligonucleotide
caugccuguaaucccagc

SEQ ID NO: 74438 - RNA, 18 nt, Artificial Sequence
  Description of Artificial Sequence: Synthetic oligonucleotide
uggcucaugccuguaauc

SEQ ID NO: 74439 - RNA, 18 nt, Artificial Sequence
  Description of Artificial Sequence: Synthetic oligonucleotide
ugcaguggcucaugccug

SEQ ID NO: 74440 - RNA, 18 nt, Artificial Sequence
  Description of Artificial Sequence: Synthetic oligonucleotide
ccgggugcaguggcucau

SEQ ID NO: 74441 - RNA, 18 nt, Artificial Sequence
  Description of Artificial Sequence: Synthetic oligonucleotide
gugugccgggugcagugg

SEQ ID NO: 74442 - RNA, 18 nt, Artificial Sequence
  Description of Artificial Sequence: Synthetic oligonucleotide
auauggugugccgggugc

SEQ ID NO: 74443 - RNA, 18 nt, Artificial Sequence
  Description of Artificial Sequence: Synthetic oligonucleotide
aaagcauauggugugccg

SEQ ID NO: 74444 - RNA, 18 nt, Artificial Sequence
  Description of Artificial Sequence: Synthetic oligonucleotide
ugaugaaagcauauggug

SEQ ID NO: 74445 - RNA, 18 nt, Artificial Sequence
  Description of Artificial Sequence: Synthetic oligonucleotide
ucuugugaugaaagcaua

SEQ ID NO: 74446 - RNA, 18 nt, Artificial Sequence
  Description of Artificial Sequence: Synthetic oligonucleotide
cauuuucuugugaugaaa

SEQ ID NO: 74447 - RNA, 18 nt, Artificial Sequence
  Description of Artificial Sequence: Synthetic oligonucleotide
ucucacauuuucuuguga

SEQ ID NO: 74448 - RNA, 18 nt, Artificial Sequence
  Description of Artificial Sequence: Synthetic oligonucleotide
aauucucucacauuuucu

SEQ ID NO: 74449 - RNA, 18 nt, Artificial Sequence
  Description of Artificial Sequence: Synthetic oligonucleotide
cccugaauucucucacau

SEQ ID NO: 74450 - RNA, 18 nt, Artificial Sequence
  Description of Artificial Sequence: Synthetic oligonucleotide
caaagcccugaauucucu

SEQ ID NO: 74451 - RNA, 18 nt, Artificial Sequence
  Description of Artificial Sequence: Synthetic oligonucleotide
acugccaaagcccugaau

SEQ ID NO: 74452 - RNA, 18 nt, Artificial Sequence
  Description of Artificial Sequence: Synthetic oligonucleotide
cuggaacugccaaagccc

SEQ ID NO: 74453 - RNA, 18 nt, Artificial Sequence
  Description of Artificial Sequence: Synthetic oligonucleotide
ccagccuggaacugccaa

SEQ ID NO: 74454 - RNA, 18 nt, Artificial Sequence
  Description of Artificial Sequence: Synthetic oligonucleotide
gcugaccagccuggaacu

SEQ ID NO: 74455 - RNA, 18 nt, Artificial Sequence
  Description of Artificial Sequence: Synthetic oligonucleotide
gagaugcugaccagccug

SEQ ID NO: 74456 - RNA, 18 nt, Artificial Sequence
  Description of Artificial Sequence: Synthetic oligonucleotide
ggcuugagaugcugacca

SEQ ID NO: 74457 - RNA, 18 nt, Artificial Sequence
  Description of Artificial Sequence: Synthetic oligonucleotide
gggagggcuugagaugcu

SEQ ID NO: 74458 - RNA, 18 nt, Artificial Sequence
  Description of Artificial Sequence: Synthetic oligonucleotide
gggugaacagaugcuggg

SEQ ID NO: 74459 - RNA, 18 nt, Artificial Sequence
  Description of Artificial Sequence: Synthetic oligonucleotide
ggcagggugaacagaugc

SEQ ID NO: 74460 - RNA, 18 nt, Artificial Sequence
  Description of Artificial Sequence: Synthetic oligonucleotide
ugccuggcagggugaaca

SEQ ID NO: 74461 - RNA, 18 nt, Artificial Sequence
  Description of Artificial Sequence: Synthetic oligonucleotide
gagacugccuggcagggu

SEQ ID NO: 74462 - RNA, 18 nt, Artificial Sequence
  Description of Artificial Sequence: Synthetic oligonucleotide
aggaagagacugccuggc

SEQ ID NO: 74463 - RNA, 18 nt, Artificial Sequence
  Description of Artificial Sequence: Synthetic oligonucleotide
uuucuaggaagagacugc

SEQ ID NO: 74464 - RNA, 18 nt, Artificial Sequence
  Description of Artificial Sequence: Synthetic oligonucleotide
ccaaguuucuaggaagag

SEQ ID NO: 74465 - RNA, 18 nt, Artificial Sequence
  Description of Artificial Sequence: Synthetic oligonucleotide
uuuaaccaaguuucuagg

SEQ ID NO: 74466 - RNA, 18 nt, Artificial Sequence
  Description of Artificial Sequence: Synthetic oligonucleotide
gaacauuuaaccaaguuu

SEQ ID NO: 74467 - RNA, 18 nt, Artificial Sequence
  Description of Artificial Sequence: Synthetic oligonucleotide
agagugaacauuuaacca

SEQ ID NO: 74468 - RNA, 18 nt, Artificial Sequence
  Description of Artificial Sequence: Synthetic oligonucleotide
caagggugaagaaucuau

SEQ ID NO: 74469 - RNA, 18 nt, Artificial Sequence
  Description of Artificial Sequence: Synthetic oligonucleotide
cgggccaagggugaagaa

SEQ ID NO: 74470 - RNA, 18 nt, Artificial Sequence
  Description of Artificial Sequence: Synthetic oligonucleotide
aaaggcgggccaagggug

SEQ ID NO: 74471 - RNA, 18 nt, Artificial Sequence
  Description of Artificial Sequence: Synthetic oligonucleotide
gggcaaaggcgggccaag

SEQ ID NO: 74472 - RNA, 18 nt, Artificial Sequence
  Description of Artificial Sequence: Synthetic oligonucleotide
ugggcagaguaggguggg

SEQ ID NO: 74473 - RNA, 18 nt, Artificial Sequence
  Description of Artificial Sequence: Synthetic oligonucleotide
acuucugggcagaguagg

SEQ ID NO: 74474 - RNA, 18 nt, Artificial Sequence
  Description of Artificial Sequence: Synthetic oligonucleotide
cuugcacuucugggcaga

SEQ ID NO: 74475 - RNA, 18 nt, Artificial Sequence
  Description of Artificial Sequence: Synthetic oligonucleotide
aggcucuugcacuucugg

SEQ ID NO: 74476 - RNA, 18 nt, Artificial Sequence
  Description of Artificial Sequence: Synthetic oligonucleotide
ggcuuaggcucuugcacu

SEQ ID NO: 74477 - RNA, 18 nt, Artificial Sequence
  Description of Artificial Sequence: Synthetic oligonucleotide
gaggcggcuuaggcucuu

SEQ ID NO: 74478 - RNA, 18 nt, Artificial Sequence
  Description of Artificial Sequence: Synthetic oligonucleotide
ccauggaggcggcuuagg

SEQ ID NO: 74479 - RNA, 18 nt, Artificial Sequence
  Description of Artificial Sequence: Synthetic oligonucleotide
gggccauggaggcggcuu

SEQ ID NO: 74480 - RNA, 18 nt, Artificial Sequence
  Description of Artificial Sequence: Synthetic oligonucleotide
cccugaauccuuccuggg

SEQ ID NO: 74481 - RNA, 18 nt, Artificial Sequence
  Description of Artificial Sequence: Synthetic oligonucleotide
cucuccccugaauccuuc

SEQ ID NO: 74482 - RNA, 18 nt, Artificial Sequence
  Description of Artificial Sequence: Synthetic oligonucleotide
gggccucuccccugaauc

SEQ ID NO: 74483 - RNA, 18 nt, Artificial Sequence
  Description of Artificial Sequence: Synthetic oligonucleotide
cguggcucccuguuuggg

SEQ ID NO: 74484 - RNA, 18 nt, Artificial Sequence
  Description of Artificial Sequence: Synthetic oligonucleotide
gcuggcguggcucccugu

SEQ ID NO: 74485 - RNA, 18 nt, Artificial Sequence
  Description of Artificial Sequence: Synthetic oligonucleotide
gucuggcuggcguggcuc

SEQ ID NO: 74486 - RNA, 18 nt, Artificial Sequence
  Description of Artificial Sequence: Synthetic oligonucleotide
gggugucuggcuggcgug

SEQ ID NO: 74487 - RNA, 18 nt, Artificial Sequence
  Description of Artificial Sequence: Synthetic oligonucleotide
agcuccauucuggccggg

SEQ ID NO: 74488 - RNA, 18 nt, Artificial Sequence
  Description of Artificial Sequence: Synthetic oligonucleotide
cagucagcuccauucugg

SEQ ID NO: 74489 - RNA, 18 nt, Artificial Sequence
  Description of Artificial Sequence: Synthetic oligonucleotide
aagggugaagaaucuauc

SEQ ID NO: 74490 - RNA, 18 nt, Artificial Sequence
  Description of Artificial Sequence: Synthetic oligonucleotide
gggccaagggugaagaau

SEQ ID NO: 74491 - RNA, 18 nt, Artificial Sequence
  Description of Artificial Sequence: Synthetic oligonucleotide
aaggcgggccaaggguga

SEQ ID NO: 74492 - RNA, 18 nt, Artificial Sequence
  Description of Artificial Sequence: Synthetic oligonucleotide
gggcaaaggcgggccaag

SEQ ID NO: 74493 - RNA, 18 nt, Artificial Sequence
  Description of Artificial Sequence: Synthetic oligonucleotide
ugggcagaguaggguggg

SEQ ID NO: 74494 - RNA, 18 nt, Artificial Sequence
  Description of Artificial Sequence: Synthetic oligonucleotide
uucugggcagaguagggu

SEQ ID NO: 74495 - RNA, 18 nt, Artificial Sequence
  Description of Artificial Sequence: Synthetic oligonucleotide
ugcacuucugggcagagu

SEQ ID NO: 74496 - RNA, 18 nt, Artificial Sequence
  Description of Artificial Sequence: Synthetic oligonucleotide
gcucuugcacuucugggc

SEQ ID NO: 74497 - RNA, 18 nt, Artificial Sequence
  Description of Artificial Sequence: Synthetic oligonucleotide
cuuaggcucuugcacuuc

SEQ ID NO: 74498 - RNA, 18 nt, Artificial Sequence
  Description of Artificial Sequence: Synthetic oligonucleotide
ggcggcuuaggcucuugc

SEQ ID NO: 74499 - RNA, 18 nt, Artificial Sequence
  Description of Artificial Sequence: Synthetic oligonucleotide
auggaggcggcuuaggcu

SEQ ID NO: 74500 - RNA, 18 nt, Artificial Sequence
  Description of Artificial Sequence: Synthetic oligonucleotide
gggccauggaggcggcuu

SEQ ID NO: 74501 - RNA, 18 nt, Artificial Sequence
  Description of Artificial Sequence: Synthetic oligonucleotide
cccugaauccuuccuggg

SEQ ID NO: 74502 - RNA, 18 nt, Artificial Sequence
  Description of Artificial Sequence: Synthetic oligonucleotide
ucuccccugaauccuucc

SEQ ID NO: 74503 - RNA, 18 nt, Artificial Sequence
  Description of Artificial Sequence: Synthetic oligonucleotide
gggccucuccccugaauc

SEQ ID NO: 74504 - RNA, 18 nt, Artificial Sequence
  Description of Artificial Sequence: Synthetic oligonucleotide
cguggcucccuguuuggg

SEQ ID NO: 74505 - RNA, 18 nt, Artificial Sequence
  Description of Artificial Sequence: Synthetic oligonucleotide
cuggcguggcucccuguu

SEQ ID NO: 74506 - RNA, 18 nt, Artificial Sequence
  Description of Artificial Sequence: Synthetic oligonucleotide
ucuggcuggcguggcucc

SEQ ID NO: 74507 - RNA, 18 nt, Artificial Sequence
  Description of Artificial Sequence: Synthetic oligonucleotide
gggugucuggcuggcgug

SEQ ID NO: 74508 - RNA, 18 nt, Artificial Sequence
  Description of Artificial Sequence: Synthetic oligonucleotide
agcuccauucuggccggg

SEQ ID NO: 74509 - RNA, 18 nt, Artificial Sequence
  Description of Artificial Sequence: Synthetic oligonucleotide
ucagcuccauucuggccg

SEQ ID NO: 74510 - RNA, 18 nt, Artificial Sequence
  Description of Artificial Sequence: Synthetic oligonucleotide
uagccccucagguguguu

SEQ ID NO: 74511 - RNA, 18 nt, Artificial Sequence
  Description of Artificial Sequence: Synthetic oligonucleotide
ggcccuagccccucaggu

SEQ ID NO: 74512 - RNA, 18 nt, Artificial Sequence
  Description of Artificial Sequence: Synthetic oligonucleotide
cauauggcccuagccccu

SEQ ID NO: 74513 - RNA, 18 nt, Artificial Sequence
  Description of Artificial Sequence: Synthetic oligonucleotide
guuuccauauggcccuag

SEQ ID NO: 74514 - RNA, 18 nt, Artificial Sequence
  Description of Artificial Sequence: Synthetic oligonucleotide
gucauguuuccauauggc

SEQ ID NO: 74515 - RNA, 18 nt, Artificial Sequence
  Description of Artificial Sequence: Synthetic oligonucleotide
cuucugucauguuuccau

SEQ ID NO: 74516 - RNA, 18 nt, Artificial Sequence
  Description of Artificial Sequence: Synthetic oligonucleotide
cuccccuucugucauguu

SEQ ID NO: 74517 - RNA, 18 nt, Artificial Sequence
  Description of Artificial Sequence: Synthetic oligonucleotide
ucucucuccccuucuguc

SEQ ID NO: 74518 - RNA, 18 nt, Artificial Sequence
  Description of Artificial Sequence: Synthetic oligonucleotide
uccuuucucucuccccuu

SEQ ID NO: 74519 - RNA, 18 nt, Artificial Sequence
  Description of Artificial Sequence: Synthetic oligonucleotide
gugucuccuuucucucuc

SEQ ID NO: 74520 - RNA, 18 nt, Artificial Sequence
  Description of Artificial Sequence: Synthetic oligonucleotide
gcagcgugucuccuuucu

SEQ ID NO: 74521 - RNA, 18 nt, Artificial Sequence
  Description of Artificial Sequence: Synthetic oligonucleotide
ccccugcagcgugucucc

SEQ ID NO: 74522 - RNA, 18 nt, Artificial Sequence
  Description of Artificial Sequence: Synthetic oligonucleotide
ccugcccccugcagcgug

SEQ ID NO: 74523 - RNA, 18 nt, Artificial Sequence
  Description of Artificial Sequence: Synthetic oligonucleotide
agcuuccugcccccugca

SEQ ID NO: 74524 - RNA, 18 nt, Artificial Sequence
  Description of Artificial Sequence: Synthetic oligonucleotide
cccccagcuuccugcccc

SEQ ID NO: 74525 - RNA, 18 nt, Artificial Sequence
  Description of Artificial Sequence: Synthetic oligonucleotide
ggguucccccagcuuccu

SEQ ID NO: 74526 - RNA, 18 nt, Artificial Sequence
  Description of Artificial Sequence: Synthetic oligonucleotide
agaauggguucccccagc

SEQ ID NO: 74527 - RNA, 18 nt, Artificial Sequence
  Description of Artificial Sequence: Synthetic oligonucleotide
uugggagaauggguuccc

SEQ ID NO: 74528 - RNA, 18 nt, Artificial Sequence
  Description of Artificial Sequence: Synthetic oligonucleotide
uauuuuugggagaauggg

SEQ ID NO: 74529 - RNA, 18 nt, Artificial Sequence
  Description of Artificial Sequence: Synthetic oligonucleotide
ccccuuauuuuugggaga

SEQ ID NO: 74530 - RNA, 18 nt, Artificial Sequence
  Description of Artificial Sequence: Synthetic oligonucleotide
ucagaccccuuauuuuug

SEQ ID NO: 74531 - RNA, 18 nt, Artificial Sequence
  Description of Artificial Sequence: Synthetic oligonucleotide
accccucagaccccuuau

SEQ ID NO: 74532 - RNA, 18 nt, Artificial Sequence
  Description of Artificial Sequence: Synthetic oligonucleotide
aauccaccccucagaccc

SEQ ID NO: 74533 - RNA, 18 nt, Artificial Sequence
  Description of Artificial Sequence: Synthetic oligonucleotide
cagggaauccaccccuca

SEQ ID NO: 74534 - RNA, 18 nt, Artificial Sequence
  Description of Artificial Sequence: Synthetic oligonucleotide
aaacccagggaauccacc

SEQ ID NO: 74535 - RNA, 18 nt, Artificial Sequence
  Description of Artificial Sequence: Synthetic oligonucleotide
gggagaauggguuccccc

SEQ ID NO: 74536 - RNA, 18 nt, Artificial Sequence
  Description of Artificial Sequence: Synthetic oligonucleotide
uuuuugggagaauggguu

SEQ ID NO: 74537 - RNA, 18 nt, Artificial Sequence
  Description of Artificial Sequence: Synthetic oligonucleotide
ccuuauuuuugggagaau

SEQ ID NO: 74538 - RNA, 18 nt, Artificial Sequence
  Description of Artificial Sequence: Synthetic oligonucleotide
agaccccuuauuuuuggg

SEQ ID NO: 74539 - RNA, 18 nt, Artificial Sequence
  Description of Artificial Sequence: Synthetic oligonucleotide
cccucagaccccuuauuu

SEQ ID NO: 74540 - RNA, 18 nt, Artificial Sequence
  Description of Artificial Sequence: Synthetic oligonucleotide
uccaccccucagaccccu

SEQ ID NO: 74541 - RNA, 18 nt, Artificial Sequence
  Description of Artificial Sequence: Synthetic oligonucleotide
gggaauccaccccucaga

SEQ ID NO: 74542 - RNA, 18 nt, Artificial Sequence
  Description of Artificial Sequence: Synthetic oligonucleotide
acccagggaauccacccc

SEQ ID NO: 74543 - RNA, 18 nt, Artificial Sequence
  Description of Artificial Sequence: Synthetic oligonucleotide
cugaaacccagggaaucc

SEQ ID NO: 74544 - RNA, 18 nt, Artificial Sequence
  Description of Artificial Sequence: Synthetic oligonucleotide
cagaccugaaacccaggg

SEQ ID NO: 74545 - RNA, 18 nt, Artificial Sequence
  Description of Artificial Sequence: Synthetic oligonucleotide
ggacccagaccugaaacc

SEQ ID NO: 74546 - RNA, 18 nt, Artificial Sequence
  Description of Artificial Sequence: Synthetic oligonucleotide
auucaggacccagaccug

SEQ ID NO: 74547 - RNA, 18 nt, Artificial Sequence
  Description of Artificial Sequence: Synthetic oligonucleotide
uucccauucaggacccag

SEQ ID NO: 74548 - RNA, 18 nt, Artificial Sequence
  Description of Artificial Sequence: Synthetic oligonucleotide
aggaauucccauucagga

SEQ ID NO: 74549 - RNA, 18 nt, Artificial Sequence
  Description of Artificial Sequence: Synthetic oligonucleotide
auuccaggaauucccauu

SEQ ID NO: 74550 - RNA, 18 nt, Artificial Sequence
  Description of Artificial Sequence: Synthetic oligonucleotide
cugguauuccaggaauuc

SEQ ID NO: 74551 - RNA, 18 nt, Artificial Sequence
  Description of Artificial Sequence: Synthetic oligonucleotide
gucagcugguauuccagg

SEQ ID NO: 74552 - RNA, 18 nt, Artificial Sequence
  Description of Artificial Sequence: Synthetic oligonucleotide
ucauugucagcugguauu

SEQ ID NO: 74553 - RNA, 18 nt, Artificial Sequence
  Description of Artificial Sequence: Synthetic oligonucleotide
ggaaaucauugucagcug

SEQ ID NO: 74554 - RNA, 18 nt, Artificial Sequence
  Description of Artificial Sequence: Synthetic oligonucleotide
gaggaggaaaucauuguc

SEQ ID NO: 74555 - RNA, 18 nt, Artificial Sequence
  Description of Artificial Sequence: Synthetic oligonucleotide
aagaugaggaggaaauca

SEQ ID NO: 74556 - RNA, 18 nt, Artificial Sequence
  Description of Artificial Sequence: Synthetic oligonucleotide
guugaaagaugaggagga

SEQ ID NO: 74557 - RNA, 18 nt, Artificial Sequence
  Description of Artificial Sequence: Synthetic oligonucleotide
gugagguugaaagaugag

SEQ ID NO: 74558 - RNA, 18 nt, Artificial Sequence
  Description of Artificial Sequence: Synthetic oligonucleotide
augaccacgaggagcaau

SEQ ID NO: 74559 - RNA, 18 nt, Artificial Sequence
  Description of Artificial Sequence: Synthetic oligonucleotide
gaagcaugaccacgagga

SEQ ID NO: 74560 - RNA, 18 nt, Artificial Sequence
  Description of Artificial Sequence: Synthetic oligonucleotide
uaggagaagcaugaccac

SEQ ID NO: 74561 - RNA, 18 nt, Artificial Sequence
  Description of Artificial Sequence: Synthetic oligonucleotide
gcaguuaggagaagcaug

SEQ ID NO: 74562 - RNA, 18 nt, Artificial Sequence
  Description of Artificial Sequence: Synthetic oligonucleotide
gccuugcaguuaggagaa

SEQ ID NO: 74563 - RNA, 18 nt, Artificial Sequence
  Description of Artificial Sequence: Synthetic oligonucleotide
cguuagccuugcaguuag

SEQ ID NO: 74564 - RNA, 18 nt, Artificial Sequence
  Description of Artificial Sequence: Synthetic oligonucleotide
gacagcguuagccuugca

SEQ ID NO: 74565 - RNA, 18 nt, Artificial Sequence
  Description of Artificial Sequence: Synthetic oligonucleotide
ggcuggacagcguuagcc

SEQ ID NO: 74566 - RNA, 18 nt, Artificial Sequence
  Description of Artificial Sequence: Synthetic oligonucleotide
agccgggcuggacagcgu

SEQ ID NO: 74567 - RNA, 18 nt, Artificial Sequence
  Description of Artificial Sequence: Synthetic oligonucleotide
ggaggagccgggcuggac

SEQ ID NO: 74568 - RNA, 18 nt, Artificial Sequence
  Description of Artificial Sequence: Synthetic oligonucleotide
aagcaggaggagccgggc

SEQ ID NO: 74569 - RNA, 18 nt, Artificial Sequence
  Description of Artificial Sequence: Synthetic oligonucleotide
gucacaagcaggaggagc

SEQ ID NO: 74570 - RNA, 18 nt, Artificial Sequence
  Description of Artificial Sequence: Synthetic oligonucleotide
cggaggucacaagcagga

SEQ ID NO: 74571 - RNA, 18 nt, Artificial Sequence
  Description of Artificial Sequence: Synthetic oligonucleotide
ggacucggaggucacaag

SEQ ID NO: 74572 - RNA, 18 nt, Artificial Sequence
  Description of Artificial Sequence: Synthetic oligonucleotide
acugaggacucggagguc

SEQ ID NO: 74573 - RNA, 18 nt, Artificial Sequence
  Description of Artificial Sequence: Synthetic oligonucleotide
aguuuacugaggacucgg

SEQ ID NO: 74574 - RNA, 18 nt, Artificial Sequence
  Description of Artificial Sequence: Synthetic oligonucleotide
gaagcaguuuacugagga

SEQ ID NO: 74575 - RNA, 18 nt, Artificial Sequence
  Description of Artificial Sequence: Synthetic oligonucleotide
gucacgaagcaguuuacu

SEQ ID NO: 74576 - RNA, 18 nt, Artificial Sequence
  Description of Artificial Sequence: Synthetic oligonucleotide
ugggagucacgaagcagu

SEQ ID NO: 74577 - RNA, 18 nt, Artificial Sequence
  Description of Artificial Sequence: Synthetic oligonucleotide
ggacaugggagucacgaa

SEQ ID NO: 74578 - RNA, 18 nt, Artificial Sequence
  Description of Artificial Sequence: Synthetic oligonucleotide
gugaaggacaugggaguc

SEQ ID NO: 74579 - RNA, 18 nt, Artificial Sequence
  Description of Artificial Sequence: Synthetic oligonucleotide
cugcugugaaggacaugg

SEQ ID NO: 74580 - RNA, 18 nt, Artificial Sequence
  Description of Artificial Sequence: Synthetic oligonucleotide
caugaccacgaggagcaa

SEQ ID NO: 74581 - RNA, 18 nt, Artificial Sequence
  Description of Artificial Sequence: Synthetic oligonucleotide
agaagcaugaccacgagg

SEQ ID NO: 74582 - RNA, 18 nt, Artificial Sequence
  Description of Artificial Sequence: Synthetic oligonucleotide
uuaggagaagcaugacca

SEQ ID NO: 74583 - RNA, 18 nt, Artificial Sequence
  Description of Artificial Sequence: Synthetic oligonucleotide
ugcaguuaggagaagcau

SEQ ID NO: 74584 - RNA, 18 nt, Artificial Sequence
  Description of Artificial Sequence: Synthetic oligonucleotide
agccuugcaguuaggaga

SEQ ID NO: 74585 - RNA, 18 nt, Artificial Sequence
  Description of Artificial Sequence: Synthetic oligonucleotide
gcguuagccuugcaguua

SEQ ID NO: 74586 - RNA, 18 nt, Artificial Sequence
  Description of Artificial Sequence: Synthetic oligonucleotide
ggacagcguuagccuugc

SEQ ID NO: 74587 - RNA, 18 nt, Artificial Sequence
  Description of Artificial Sequence: Synthetic oligonucleotide
gggcuggacagcguuagc

SEQ ID NO: 74588 - RNA, 18 nt, Artificial Sequence
  Description of Artificial Sequence: Synthetic oligonucleotide
gagccgggcuggacagcg

SEQ ID NO: 74589 - RNA, 18 nt, Artificial Sequence
  Description of Artificial Sequence: Synthetic oligonucleotide
aggaggagccgggcugga

SEQ ID NO: 74590 - RNA, 18 nt, Artificial Sequence
  Description of Artificial Sequence: Synthetic oligonucleotide
caagcaggaggagccggg

SEQ ID NO: 74591 - RNA, 18 nt, Artificial Sequence
  Description of Artificial Sequence: Synthetic oligonucleotide
ggucacaagcaggaggag

SEQ ID NO: 74592 - RNA, 18 nt, Artificial Sequence
  Description of Artificial Sequence: Synthetic oligonucleotide
ucggaggucacaagcagg

SEQ ID NO: 74593 - RNA, 18 nt, Artificial Sequence
  Description of Artificial Sequence: Synthetic oligonucleotide
aggacucggaggucacaa

SEQ ID NO: 74594 - RNA, 18 nt, Artificial Sequence
  Description of Artificial Sequence: Synthetic oligonucleotide
uacugaggacucggaggu

SEQ ID NO: 74595 - RNA, 18 nt, Artificial Sequence
  Description of Artificial Sequence: Synthetic oligonucleotide
caguuuacugaggacucg

SEQ ID NO: 74596 - RNA, 18 nt, Artificial Sequence
  Description of Artificial Sequence: Synthetic oligonucleotide
cgaagcaguuuacugagg

SEQ ID NO: 74597 - RNA, 18 nt, Artificial Sequence
  Description of Artificial Sequence: Synthetic oligonucleotide
agucacgaagcaguuuac

SEQ ID NO: 74598 - RNA, 18 nt, Artificial Sequence
  Description of Artificial Sequence: Synthetic oligonucleotide
augggagucacgaagcag

SEQ ID NO: 74599 - RNA, 18 nt, Artificial Sequence
  Description of Artificial Sequence: Synthetic oligonucleotide
aggacaugggagucacga

SEQ ID NO: 74600 - RNA, 18 nt, Artificial Sequence
  Description of Artificial Sequence: Synthetic oligonucleotide
ugugaaggacaugggagu

SEQ ID NO: 74601 - RNA, 18 nt, Artificial Sequence
  Description of Artificial Sequence: Synthetic oligonucleotide
ucugcugugaaggacaug

SEQ ID NO: 74602 - RNA, 18 nt, Artificial Sequence
  Description of Artificial Sequence: Synthetic oligonucleotide
gggauaauguugggaguu

SEQ ID NO: 74603 - RNA, 18 nt, Artificial Sequence
  Description of Artificial Sequence: Synthetic oligonucleotide
uaccaguuacgcggauaa

SEQ ID NO: 74604 - RNA, 18 nt, Artificial Sequence
  Description of Artificial Sequence: Synthetic oligonucleotide
ugucuuaccaguuacgcg

SEQ ID NO: 74605 - RNA, 18 nt, Artificial Sequence
  Description of Artificial Sequence: Synthetic oligonucleotide
augggugucuuaccaguu

SEQ ID NO: 74606 - RNA, 18 nt, Artificial Sequence
  Description of Artificial Sequence: Synthetic oligonucleotide
ggaguaugggugucuuac

SEQ ID NO: 74607 - RNA, 18 nt, Artificial Sequence
  Description of Artificial Sequence: Synthetic oligonucleotide
uccugggaguaugggugu

SEQ ID NO: 74608 - RNA, 18 nt, Artificial Sequence
  Description of Artificial Sequence: Synthetic oligonucleotide
ugucuuccugggaguaug

SEQ ID NO: 74609 - RNA, 18 nt, Artificial Sequence
  Description of Artificial Sequence: Synthetic oligonucleotide
gauggugucuuccuggga

SEQ ID NO: 74610 - RNA, 18 nt, Artificial Sequence
  Description of Artificial Sequence: Synthetic oligonucleotide
gaagugauggugucuucc

SEQ ID NO: 74611 - RNA, 18 nt, Artificial Sequence
  Description of Artificial Sequence: Synthetic oligonucleotide
uagaggaagugauggugu

SEQ ID NO: 74612 - RNA, 18 nt, Artificial Sequence
  Description of Artificial Sequence: Synthetic oligonucleotide
ggaguuagaggaagugau

SEQ ID NO: 74613 - RNA, 18 nt, Artificial Sequence
  Description of Artificial Sequence: Synthetic oligonucleotide
gucaaggaguuagaggaa

SEQ ID NO: 74614 - RNA, 18 nt, Artificial Sequence
  Description of Artificial Sequence: Synthetic oligonucleotide
auugggucaaggaguuag

SEQ ID NO: 74615 - RNA, 18 nt, Artificial Sequence
  Description of Artificial Sequence: Synthetic oligonucleotide
uagucauugggucaagga

SEQ ID NO: 74616 - RNA, 18 nt, Artificial Sequence
  Description of Artificial Sequence: Synthetic oligonucleotide
aagaauagucauuggguc

SEQ ID NO: 74617 - RNA, 18 nt, Artificial Sequence
  Description of Artificial Sequence: Synthetic oligonucleotide
augggaagaauagucauu

SEQ ID NO: 74618 - RNA, 18 nt, Artificial Sequence
  Description of Artificial Sequence: Synthetic oligonucleotide
acaauaugggaagaauag

SEQ ID NO: 74619 - RNA, 18 nt, Artificial Sequence
  Description of Artificial Sequence: Synthetic oligonucleotide
gggacaauaugggaagaa

SEQ ID NO: 74620 - RNA, 18 nt, Artificial Sequence
  Description of Artificial Sequence: Synthetic oligonucleotide
gugugaucaguagguggg

SEQ ID NO: 74621 - RNA, 18 nt, Artificial Sequence
  Description of Artificial Sequence: Synthetic oligonucleotide
agagagugugaucaguag

SEQ ID NO: 74622 - RNA, 18 nt, Artificial Sequence
  Description of Artificial Sequence: Synthetic oligonucleotide
uugucagagagugugauc

SEQ ID NO: 74623 - RNA, 18 nt, Artificial Sequence
  Description of Artificial Sequence: Synthetic oligonucleotide
aauccuugucagagagug

SEQ ID NO: 74624 - RNA, 18 nt, Artificial Sequence
  Description of Artificial Sequence: Synthetic oligonucleotide
agaauaauccuugucaga

SEQ ID NO: 74625 - RNA, 18 nt, Artificial Sequence
  Description of Artificial Sequence: Synthetic oligonucleotide
ugugaagaauaauccuug

SEQ ID NO: 74626 - RNA, 18 nt, Artificial Sequence
  Description of Artificial Sequence: Synthetic oligonucleotide
uguauugugaagaauaau

SEQ ID NO: 74627 - RNA, 18 nt, Artificial Sequence
  Description of Artificial Sequence: Synthetic oligonucleotide
cgggcuguauugugaaga

SEQ ID NO: 74628 - RNA, 18 nt, Artificial Sequence
  Description of Artificial Sequence: Synthetic oligonucleotide
gugugaucaguagguggg

SEQ ID NO: 74629 - RNA, 18 nt, Artificial Sequence
  Description of Artificial Sequence: Synthetic oligonucleotide
gagagugugaucaguagg

SEQ ID NO: 74630 - RNA, 18 nt, Artificial Sequence
  Description of Artificial Sequence: Synthetic oligonucleotide
ugucagagagugugauca

SEQ ID NO: 74631 - RNA, 18 nt, Artificial Sequence
  Description of Artificial Sequence: Synthetic oligonucleotide
auccuugucagagagugu

SEQ ID NO: 74632 - RNA, 18 nt, Artificial Sequence
  Description of Artificial Sequence: Synthetic oligonucleotide
gaauaauccuugucagag

SEQ ID NO: 74633 - RNA, 18 nt, Artificial Sequence
  Description of Artificial Sequence: Synthetic oligonucleotide
gugaagaauaauccuugu

SEQ ID NO: 74634 - RNA, 18 nt, Artificial Sequence
  Description of Artificial Sequence: Synthetic oligonucleotide
guauugugaagaauaauc

SEQ ID NO: 74635 - RNA, 18 nt, Artificial Sequence
  Description of Artificial Sequence: Synthetic oligonucleotide
gggcuguauugugaagaa

SEQ ID NO: 74636 - RNA, 18 nt, Artificial Sequence
  Description of Artificial Sequence: Synthetic oligonucleotide
aaugcgggcuguauugug

SEQ ID NO: 74637 - RNA, 18 nt, Artificial Sequence
  Description of Artificial Sequence: Synthetic oligonucleotide
uuuuaaaugcgggcugua

SEQ ID NO: 74638 - RNA, 18 nt, Artificial Sequence
  Description of Artificial Sequence: Synthetic oligonucleotide
agagcuuuuaaaugcggg

SEQ ID NO: 74639 - RNA, 18 nt, Artificial Sequence
  Description of Artificial Sequence: Synthetic oligonucleotide
agacgagagcuuuuaaau

SEQ ID NO: 74640 - RNA, 18 nt, Artificial Sequence
  Description of Artificial Sequence: Synthetic oligonucleotide
ucucuagacgagagcuuu

SEQ ID NO: 74641 - RNA, 18 nt, Artificial Sequence
  Description of Artificial Sequence: Synthetic oligonucleotide
uacuaucucuagacgaga

SEQ ID NO: 74642 - RNA, 18 nt, Artificial Sequence
  Description of Artificial Sequence: Synthetic oligonucleotide
augaguacuaucucuaga

SEQ ID NO: 74643 - RNA, 18 nt, Artificial Sequence
  Description of Artificial Sequence: Synthetic oligonucleotide
ccuccaugaguacuaucu

SEQ ID NO: 74644 - RNA, 18 nt, Artificial Sequence
  Description of Artificial Sequence: Synthetic oligonucleotide
cuaguccuccaugaguac

SEQ ID NO: 74645 - RNA, 18 nt, Artificial Sequence
  Description of Artificial Sequence: Synthetic oligonucleotide
gcaggcuaguccuccaug

SEQ ID NO: 74646 - RNA, 18 nt, Artificial Sequence
  Description of Artificial Sequence: Synthetic oligonucleotide
aauaagcaggcuaguccu

SEQ ID NO: 74647 - RNA, 18 nt, Artificial Sequence
  Description of Artificial Sequence: Synthetic oligonucleotide
agccuaauaagcaggcua

SEQ ID NO: 74648 - RNA, 18 nt, Artificial Sequence
  Description of Artificial Sequence: Synthetic oligonucleotide
augguagccuaauaagca

SEQ ID NO: 74649 - RNA, 18 nt, Artificial Sequence
  Description of Artificial Sequence: Synthetic oligonucleotide
gagcuaugguagccuaau

SEQ ID NO: 74650 - RNA, 18 nt, Artificial Sequence
  Description of Artificial Sequence: Synthetic oligonucleotide
agagagagcuaugguagc

SEQ ID NO: 74651 - RNA, 18 nt, Artificial Sequence
  Description of Artificial Sequence: Synthetic oligonucleotide
gaaauagagagagcuaug

SEQ ID NO: 74652 - RNA, 18 nt, Artificial Sequence
  Description of Artificial Sequence: Synthetic oligonucleotide
gagcugaaauagagagag

SEQ ID NO: 74653 - RNA, 18 nt, Artificial Sequence
  Description of Artificial Sequence: Synthetic oligonucleotide
gaagggagcugaaauaga

SEQ ID NO: 74654 - RNA, 18 nt, Artificial Sequence
  Description of Artificial Sequence: Synthetic oligonucleotide
gaaccucugggcacuggc

SEQ ID NO: 74655 - RNA, 18 nt, Artificial Sequence
  Description of Artificial Sequence: Synthetic oligonucleotide
agggugaaccucugggca

SEQ ID NO: 74656 - RNA, 18 nt, Artificial Sequence
  Description of Artificial Sequence: Synthetic oligonucleotide
ggcaaagggugaaccucu

SEQ ID NO: 74657 - RNA, 18 nt, Artificial Sequence
  Description of Artificial Sequence: Synthetic oligonucleotide
guguaggcaaagggugaa

SEQ ID NO: 74658 - RNA, 18 nt, Artificial Sequence
  Description of Artificial Sequence: Synthetic oligonucleotide
gacagguguaggcaaagg

SEQ ID NO: 74659 - RNA, 18 nt, Artificial Sequence
  Description of Artificial Sequence: Synthetic oligonucleotide
agcaggacagguguaggc

SEQ ID NO: 74660 - RNA, 18 nt, Artificial Sequence
  Description of Artificial Sequence: Synthetic oligonucleotide
caggcagcaggacaggug

SEQ ID NO: 74661 - RNA, 18 nt, Artificial Sequence
  Description of Artificial Sequence: Synthetic oligonucleotide
cacagcaggcagcaggac

SEQ ID NO: 74662 - RNA, 18 nt, Artificial Sequence
  Description of Artificial Sequence: Synthetic oligonucleotide
aaguccacagcaggcagc

SEQ ID NO: 74663 - RNA, 18 nt, Artificial Sequence
  Description of Artificial Sequence: Synthetic oligonucleotide
agcuaaaguccacagcag

SEQ ID NO: 74664 - RNA, 18 nt, Artificial Sequence
  Description of Artificial Sequence: Synthetic oligonucleotide
ucccaagcuaaaguccac

SEQ ID NO: 74665 - RNA, 18 nt, Artificial Sequence
  Description of Artificial Sequence: Synthetic oligonucleotide
cauucucccaagcuaaag

SEQ ID NO: 74666 - RNA, 18 nt, Artificial Sequence
  Description of Artificial Sequence: Synthetic oligonucleotide
uuuuccauucucccaagc

SEQ ID NO: 74667 - RNA, 18 nt, Artificial Sequence
  Description of Artificial Sequence: Synthetic oligonucleotide
cuggguuuuccauucucc

SEQ ID NO: 74668 - RNA, 18 nt, Artificial Sequence
  Description of Artificial Sequence: Synthetic oligonucleotide
gaaccucugggcacuggc

SEQ ID NO: 74669 - RNA, 18 nt, Artificial Sequence
  Description of Artificial Sequence: Synthetic oligonucleotide
agggugaaccucugggca

SEQ ID NO: 74670 - RNA, 18 nt, Artificial Sequence
  Description of Artificial Sequence: Synthetic oligonucleotide
ggcaaagggugaaccucu

SEQ ID NO: 74671 - RNA, 18 nt, Artificial Sequence
  Description of Artificial Sequence: Synthetic oligonucleotide
guguaggcaaagggugaa

SEQ ID NO: 74672 - RNA, 18 nt, Artificial Sequence
  Description of Artificial Sequence: Synthetic oligonucleotide
gacagguguaggcaaagg

SEQ ID NO: 74673 - RNA, 18 nt, Artificial Sequence
  Description of Artificial Sequence: Synthetic oligonucleotide
agcaggacagguguaggc

SEQ ID NO: 74674 - RNA, 18 nt, Artificial Sequence
  Description of Artificial Sequence: Synthetic oligonucleotide
caggcagcaggacaggug

SEQ ID NO: 74675 - RNA, 18 nt, Artificial Sequence
  Description of Artificial Sequence: Synthetic oligonucleotide
cacagcaggcagcaggac

SEQ ID NO: 74676 - RNA, 18 nt, Artificial Sequence
  Description of Artificial Sequence: Synthetic oligonucleotide
aaguccacagcaggcagc

SEQ ID NO: 74677 - RNA, 18 nt, Artificial Sequence
  Description of Artificial Sequence: Synthetic oligonucleotide
agcuaaaguccacagcag

SEQ ID NO: 74678 - RNA, 18 nt, Artificial Sequence
  Description of Artificial Sequence: Synthetic oligonucleotide
ucccaagcuaaaguccac

SEQ ID NO: 74679 - RNA, 18 nt, Artificial Sequence
  Description of Artificial Sequence: Synthetic oligonucleotide
cauucucccaagcuaaag

SEQ ID NO: 74680 - RNA, 18 nt, Artificial Sequence
  Description of Artificial Sequence: Synthetic oligonucleotide
uuuuccauucucccaagc

SEQ ID NO: 74681 - RNA, 18 nt, Artificial Sequence
  Description of Artificial Sequence: Synthetic oligonucleotide
cuggguuuuccauucucc

SEQ ID NO: 74682 - RNA, 18 nt, Artificial Sequence
  Description of Artificial Sequence: Synthetic oligonucleotide
aagguuagggauggcuuu

SEQ ID NO: 74683 - RNA, 18 nt, Artificial Sequence
  Description of Artificial Sequence: Synthetic oligonucleotide
aagccaagguuagggaug

SEQ ID NO: 74684 - RNA, 18 nt, Artificial Sequence
  Description of Artificial Sequence: Synthetic oligonucleotide
uagggaagccaagguuag

SEQ ID NO: 74685 - RNA, 18 nt, Artificial Sequence
  Description of Artificial Sequence: Synthetic oligonucleotide
ggacuuagggaagccaag

SEQ ID NO: 74686 - RNA, 18 nt, Artificial Sequence
  Description of Artificial Sequence: Synthetic oligonucleotide
agacaggacuuagggaag

SEQ ID NO: 74687 - RNA, 18 nt, Artificial Sequence
  Description of Artificial Sequence: Synthetic oligonucleotide
acugaagacaggacuuag

SEQ ID NO: 74688 - RNA, 18 nt, Artificial Sequence
  Description of Artificial Sequence: Synthetic oligonucleotide
gggaaacugaagacagga

SEQ ID NO: 74689 - RNA, 18 nt, Artificial Sequence
  Description of Artificial Sequence: Synthetic oligonucleotide
gcagugggaaacugaaga

SEQ ID NO: 74690 - RNA, 18 nt, Artificial Sequence
  Description of Artificial Sequence: Synthetic oligonucleotide
gggaagcagugggaaacu

SEQ ID NO: 74691 - RNA, 18 nt, Artificial Sequence
  Description of Artificial Sequence: Synthetic oligonucleotide
uccaugggaagcaguggg

SEQ ID NO: 74692 - RNA, 18 nt, Artificial Sequence
  Description of Artificial Sequence: Synthetic oligonucleotide
gagaauccaugggaagca

SEQ ID NO: 74693 - RNA, 18 nt, Artificial Sequence
  Description of Artificial Sequence: Synthetic oligonucleotide
uguuggagaauccauggg

SEQ ID NO: 74694 - RNA, 18 nt, Artificial Sequence
  Description of Artificial Sequence: Synthetic oligonucleotide
aagaauguuggagaaucc

SEQ ID NO: 74695 - RNA, 18 nt, Artificial Sequence
  Description of Artificial Sequence: Synthetic oligonucleotide
agcucaagaauguuggag

SEQ ID NO: 74696 - RNA, 18 nt, Artificial Sequence
  Description of Artificial Sequence: Synthetic oligonucleotide
uaaaaagcucaagaaugu

SEQ ID NO: 74697 - RNA, 18 nt, Artificial Sequence
  Description of Artificial Sequence: Synthetic oligonucleotide
auuuuuaaaaagcucaag

SEQ ID NO: 74698 - RNA, 18 nt, Artificial Sequence
  Description of Artificial Sequence: Synthetic oligonucleotide
gagauauuuuuaaaaagc

SEQ ID NO: 74699 - RNA, 18 nt, Artificial Sequence
  Description of Artificial Sequence: Synthetic oligonucleotide
aaggugagauauuuuuaa

SEQ ID NO: 74700 - RNA, 18 nt, Artificial Sequence
  Description of Artificial Sequence: Synthetic oligonucleotide
agcugaaggugagauauu

SEQ ID NO: 74701 - RNA, 18 nt, Artificial Sequence
  Description of Artificial Sequence: Synthetic oligonucleotide
ggccaagcugaaggugag

SEQ ID NO: 74702 - RNA, 18 nt, Artificial Sequence
  Description of Artificial Sequence: Synthetic oligonucleotide
aggguggccaagcugaag

SEQ ID NO: 74703 - RNA, 18 nt, Artificial Sequence
  Description of Artificial Sequence: Synthetic oligonucleotide
ggguuaggguggccaagc

SEQ ID NO: 74704 - RNA, 18 nt, Artificial Sequence
  Description of Artificial Sequence: Synthetic oligonucleotide
agauuggguuaggguggc

SEQ ID NO: 74705 - RNA, 18 nt, Artificial Sequence
  Description of Artificial Sequence: Synthetic oligonucleotide
aauguagauuggguuagg

SEQ ID NO: 74706 - RNA, 18 nt, Artificial Sequence
  Description of Artificial Sequence: Synthetic oligonucleotide
aggugaauguagauuggg

SEQ ID NO: 74707 - RNA, 18 nt, Artificial Sequence
  Description of Artificial Sequence: Synthetic oligonucleotide
aucauaggugaauguaga

SEQ ID NO: 74708 - RNA, 18 nt, Artificial Sequence
  Description of Artificial Sequence: Synthetic oligonucleotide
cuaucaucauaggugaau

SEQ ID NO: 74709 - RNA, 18 nt, Artificial Sequence
  Description of Artificial Sequence: Synthetic oligonucleotide
acaggcuaucaucauagg

SEQ ID NO: 74710 - RNA, 18 nt, Artificial Sequence
  Description of Artificial Sequence: Synthetic oligonucleotide
uauccacaggcuaucauc

SEQ ID NO: 74711 - RNA, 18 nt, Artificial Sequence
  Description of Artificial Sequence: Synthetic oligonucleotide
caucuuauccacaggcua

SEQ ID NO: 74712 - RNA, 18 nt, Artificial Sequence
  Description of Artificial Sequence: Synthetic oligonucleotide
gccaucaucuuauccaca

SEQ ID NO: 74713 - RNA, 18 nt, Artificial Sequence
  Description of Artificial Sequence: Synthetic oligonucleotide
ugcaagccaucaucuuau

SEQ ID NO: 74714 - RNA, 18 nt, Artificial Sequence
  Description of Artificial Sequence: Synthetic oligonucleotide
ggaccugcaagccaucau

SEQ ID NO: 74715 - RNA, 18 nt, Artificial Sequence
  Description of Artificial Sequence: Synthetic oligonucleotide
auauuggaccugcaagcc

SEQ ID NO: 74716 - RNA, 18 nt, Artificial Sequence
  Description of Artificial Sequence: Synthetic oligonucleotide
uucacauauuggaccugc

SEQ ID NO: 74717 - RNA, 18 nt, Artificial Sequence
  Description of Artificial Sequence: Synthetic oligonucleotide
aucuauucacauauugga

SEQ ID NO: 74718 - RNA, 18 nt, Artificial Sequence
  Description of Artificial Sequence: Synthetic oligonucleotide
uucaaaucuauucacaua

SEQ ID NO: 74719 - RNA, 18 nt, Artificial Sequence
  Description of Artificial Sequence: Synthetic oligonucleotide
ucagcuucaaaucuauuc

SEQ ID NO: 74720 - RNA, 18 nt, Artificial Sequence
  Description of Artificial Sequence: Synthetic oligonucleotide
gguguucagcuucaaauc

SEQ ID NO: 74721 - RNA, 18 nt, Artificial Sequence
  Description of Artificial Sequence: Synthetic oligonucleotide
uucaugguguucagcuuc

SEQ ID NO: 74722 - RNA, 18 nt, Artificial Sequence
  Description of Artificial Sequence: Synthetic oligonucleotide
agcuuuucaugguguuca

SEQ ID NO: 74723 - RNA, 18 nt, Artificial Sequence
  Description of Artificial Sequence: Synthetic oligonucleotide
ucuccagcuuuucauggu

SEQ ID NO: 74724 - RNA, 18 nt, Artificial Sequence
  Description of Artificial Sequence: Synthetic oligonucleotide
auuucucuccagcuuuuc

SEQ ID NO: 74725 - RNA, 18 nt, Artificial Sequence
  Description of Artificial Sequence: Synthetic oligonucleotide
gagcgauuucucuccagc

SEQ ID NO: 74726 - RNA, 18 nt, Artificial Sequence
  Description of Artificial Sequence: Synthetic oligonucleotide
gccaugagcgauuucucu

SEQ ID NO: 74727 - RNA, 18 nt, Artificial Sequence
  Description of Artificial Sequence: Synthetic oligonucleotide
gcauggccaugagcgauu

SEQ ID NO: 74728 - RNA, 18 nt, Artificial Sequence
  Description of Artificial Sequence: Synthetic oligonucleotide
caaaggcauggccaugag

SEQ ID NO: 74729 - RNA, 18 nt, Artificial Sequence
  Description of Artificial Sequence: Synthetic oligonucleotide
uaggucaaaggcauggcc

SEQ ID NO: 74730 - RNA, 18 nt, Artificial Sequence
  Description of Artificial Sequence: Synthetic oligonucleotide
gggaauaggucaaaggca

SEQ ID NO: 74731 - RNA, 18 nt, Artificial Sequence
  Description of Artificial Sequence: Synthetic oligonucleotide
ugaacgggaauaggucaa

SEQ ID NO: 74732 - RNA, 18 nt, Artificial Sequence
  Description of Artificial Sequence: Synthetic oligonucleotide
aagacugaacgggaauag

SEQ ID NO: 74733 - RNA, 18 nt, Artificial Sequence
  Description of Artificial Sequence: Synthetic oligonucleotide
uuaagaagacugaacggg

SEQ ID NO: 74734 - RNA, 18 nt, Artificial Sequence
  Description of Artificial Sequence: Synthetic oligonucleotide
ccaauuuaagaagacuga

SEQ ID NO: 74735 - RNA, 18 nt, Artificial Sequence
  Description of Artificial Sequence: Synthetic oligonucleotide
ucaugccaauuuaagaag

SEQ ID NO: 74736 - RNA, 18 nt, Artificial Sequence
  Description of Artificial Sequence: Synthetic oligonucleotide
cuucuucaugccaauuua

SEQ ID NO: 74737 - RNA, 18 nt, Artificial Sequence
  Description of Artificial Sequence: Synthetic oligonucleotide
ucuugcuucuucaugcca

SEQ ID NO: 74738 - RNA, 18 nt, Artificial Sequence
  Description of Artificial Sequence: Synthetic oligonucleotide
augagucuugcuucuuca

SEQ ID NO: 74739 - RNA, 18 nt, Artificial Sequence
  Description of Artificial Sequence: Synthetic oligonucleotide
gacauaugagucuugcuu

SEQ ID NO: 74740 - RNA, 18 nt, Artificial Sequence
  Description of Artificial Sequence: Synthetic oligonucleotide
uggaugacauaugagucu

SEQ ID NO: 74741 - RNA, 18 nt, Artificial Sequence
  Description of Artificial Sequence: Synthetic oligonucleotide
aucuguggaugacauaug

SEQ ID NO: 74742 - RNA, 18 nt, Artificial Sequence
  Description of Artificial Sequence: Synthetic oligonucleotide
gugucaucuguggaugac

SEQ ID NO: 74743 - RNA, 18 nt, Artificial Sequence
  Description of Artificial Sequence: Synthetic oligonucleotide
gcuuugugucaucugugg

SEQ ID NO: 74744 - RNA, 18 nt, Artificial Sequence
  Description of Artificial Sequence: Synthetic oligonucleotide
ucccagcuuugugucauc

SEQ ID NO: 74745 - RNA, 18 nt, Artificial Sequence
  Description of Artificial Sequence: Synthetic oligonucleotide
guacuucccagcuuugug

SEQ ID NO: 74746 - RNA, 18 nt, Artificial Sequence
  Description of Artificial Sequence: Synthetic oligonucleotide
uagugguacuucccagcu

SEQ ID NO: 74747 - RNA, 18 nt, Artificial Sequence
  Description of Artificial Sequence: Synthetic oligonucleotide
uauuuuagugguacuucc

SEQ ID NO: 74748 - RNA, 18 nt, Artificial Sequence
  Description of Artificial Sequence: Synthetic oligonucleotide
uuuguuauuuuaguggua

SEQ ID NO: 74749 - RNA, 18 nt, Artificial Sequence
  Description of Artificial Sequence: Synthetic oligonucleotide
agucuuuuguuauuuuag

SEQ ID NO: 74750 - RNA, 18 nt, Artificial Sequence
  Description of Artificial Sequence: Synthetic oligonucleotide
gauucagucuuuuguuau

SEQ ID NO: 74751 - RNA, 18 nt, Artificial Sequence
  Description of Artificial Sequence: Synthetic oligonucleotide
aucuugauucagucuuuu

SEQ ID NO: 74752 - RNA, 18 nt, Artificial Sequence
  Description of Artificial Sequence: Synthetic oligonucleotide
uuugaaucuugauucagu

SEQ ID NO: 74753 - RNA, 18 nt, Artificial Sequence
  Description of Artificial Sequence: Synthetic oligonucleotide
agugauuugaaucuugau

SEQ ID NO: 74754 - RNA, 18 nt, Artificial Sequence
  Description of Artificial Sequence: Synthetic oligonucleotide
cuuucagugauuugaauc

SEQ ID NO: 74755 - RNA, 18 nt, Artificial Sequence
  Description of Artificial Sequence: Synthetic oligonucleotide
cuagucuuucagugauuu

SEQ ID NO: 74756 - RNA, 18 nt, Artificial Sequence
  Description of Artificial Sequence: Synthetic oligonucleotide
uugaccuagucuuucagu

SEQ ID NO: 74757 - RNA, 18 nt, Artificial Sequence
  Description of Artificial Sequence: Synthetic oligonucleotide
uguuuuugaccuagucuu

SEQ ID NO: 74758 - RNA, 18 nt, Artificial Sequence
  Description of Artificial Sequence: Synthetic oligonucleotide
caccuuguuuuugaccua

SEQ ID NO: 74759 - RNA, 18 nt, Artificial Sequence
  Description of Artificial Sequence: Synthetic oligonucleotide
uguuucaccuuguuuuug

SEQ ID NO: 74760 - RNA, 18 nt, Artificial Sequence
  Description of Artificial Sequence: Synthetic oligonucleotide
ucuguuguuucaccuugu

SEQ ID NO: 74761 - RNA, 18 nt, Artificial Sequence
  Description of Artificial Sequence: Synthetic oligonucleotide
auaucucuguuguuucac

SEQ ID NO: 74762 - RNA, 18 nt, Artificial Sequence
  Description of Artificial Sequence: Synthetic oligonucleotide
aguuuauaucucuguugu

SEQ ID NO: 74763 - RNA, 18 nt, Artificial Sequence
  Description of Artificial Sequence: Synthetic oligonucleotide
guagaaguuuauaucucu

SEQ ID NO: 74764 - RNA, 18 nt, Artificial Sequence
  Description of Artificial Sequence: Synthetic oligonucleotide
cacauguagaaguuuaua

SEQ ID NO: 74765 - RNA, 18 nt, Artificial Sequence
  Description of Artificial Sequence: Synthetic oligonucleotide
cggcccacauguagaagu

SEQ ID NO: 74766 - RNA, 18 nt, Artificial Sequence
  Description of Artificial Sequence: Synthetic oligonucleotide
gcccccggcccacaugua

SEQ ID NO: 74767 - RNA, 18 nt, Artificial Sequence
  Description of Artificial Sequence: Synthetic oligonucleotide
cgugagcccccggcccac

SEQ ID NO: 74768 - RNA, 18 nt, Artificial Sequence
  Description of Artificial Sequence: Synthetic oligonucleotide
acaggcgugagcccccgg

SEQ ID NO: 74769 - RNA, 18 nt, Artificial Sequence
  Description of Artificial Sequence: Synthetic oligonucleotide
ggauuacaggcgugagcc

SEQ ID NO: 74770 - RNA, 18 nt, Artificial Sequence
  Description of Artificial Sequence: Synthetic oligonucleotide
ugcugggauuacaggcgu

SEQ ID NO: 74771 - RNA, 18 nt, Artificial Sequence
  Description of Artificial Sequence: Synthetic oligonucleotide
caaagugcugggauuaca

SEQ ID NO: 74772 - RNA, 18 nt, Artificial Sequence
  Description of Artificial Sequence: Synthetic oligonucleotide
ccucccaaagugcuggga

SEQ ID NO: 74773 - RNA, 18 nt, Artificial Sequence
  Description of Artificial Sequence: Synthetic oligonucleotide
cucggccucccaaagugc

SEQ ID NO: 74774 - RNA, 18 nt, Artificial Sequence
  Description of Artificial Sequence: Synthetic oligonucleotide
ccugccucggccucccaa

SEQ ID NO: 74775 - RNA, 18 nt, Artificial Sequence
  Description of Artificial Sequence: Synthetic oligonucleotide
aucugccugccucggccu

SEQ ID NO: 74776 - RNA, 18 nt, Artificial Sequence
  Description of Artificial Sequence: Synthetic oligonucleotide
aggugaucugccugccuc

SEQ ID NO: 74777 - RNA, 18 nt, Artificial Sequence
  Description of Artificial Sequence: Synthetic oligonucleotide
cccucaggugaucugccu

SEQ ID NO: 74778 - RNA, 18 nt, Artificial Sequence
  Description of Artificial Sequence: Synthetic oligonucleotide
uccugcccucaggugauc

SEQ ID NO: 74779 - RNA, 18 nt, Artificial Sequence
  Description of Artificial Sequence: Synthetic oligonucleotide
caaacuccugcccucagg

SEQ ID NO: 74780 - RNA, 18 nt, Artificial Sequence
  Description of Artificial Sequence: Synthetic oligonucleotide
gcucucaaacuccugccc

SEQ ID NO: 74781 - RNA, 18 nt, Artificial Sequence
  Description of Artificial Sequence: Synthetic oligonucleotide
gcugggcauggugguggg

SEQ ID NO: 74782 - RNA, 18 nt, Artificial Sequence
  Description of Artificial Sequence: Synthetic oligonucleotide
aauuagcugggcauggug

SEQ ID NO: 74783 - RNA, 18 nt, Artificial Sequence
  Description of Artificial Sequence: Synthetic oligonucleotide
acaaaaauuagcugggca

SEQ ID NO: 74784 - RNA, 18 nt, Artificial Sequence
  Description of Artificial Sequence: Synthetic oligonucleotide
aaaauacaaaaauuagcu

SEQ ID NO: 74785 - RNA, 18 nt, Artificial Sequence
  Description of Artificial Sequence: Synthetic oligonucleotide
uaccaaaaauacaaaaau

SEQ ID NO: 74786 - RNA, 18 nt, Artificial Sequence
  Description of Artificial Sequence: Synthetic oligonucleotide
aucucuaccaaaaauaca

SEQ ID NO: 74787 - RNA, 18 nt, Artificial Sequence
  Description of Artificial Sequence: Synthetic oligonucleotide
accccaucucuaccaaaa

SEQ ID NO: 74788 - RNA, 18 nt, Artificial Sequence
  Description of Artificial Sequence: Synthetic oligonucleotide
gugaaaccccaucucuac

SEQ ID NO: 74789 - RNA, 18 nt, Artificial Sequence
  Description of Artificial Sequence: Synthetic oligonucleotide
acauggugaaaccccauc

SEQ ID NO: 74790 - RNA, 18 nt, Artificial Sequence
  Description of Artificial Sequence: Synthetic oligonucleotide
ggccaacauggugaaacc

SEQ ID NO: 74791 - RNA, 18 nt, Artificial Sequence
  Description of Artificial Sequence: Synthetic oligonucleotide
agccuggccaacauggug

SEQ ID NO: 74792 - RNA, 18 nt, Artificial Sequence
  Description of Artificial Sequence: Synthetic oligonucleotide
agaucagccuggccaaca

SEQ ID NO: 74793 - RNA, 18 nt, Artificial Sequence
  Description of Artificial Sequence: Synthetic oligonucleotide
guucaagaucagccuggc

SEQ ID NO: 74794 - RNA, 18 nt, Artificial Sequence
  Description of Artificial Sequence: Synthetic oligonucleotide
caggaguucaagaucagc

SEQ ID NO: 74795 - RNA, 18 nt, Artificial Sequence
  Description of Artificial Sequence: Synthetic oligonucleotide
gaggucaggaguucaaga

SEQ ID NO: 74796 - RNA, 18 nt, Artificial Sequence
  Description of Artificial Sequence: Synthetic oligonucleotide
caccugaggucaggaguu

SEQ ID NO: 74797 - RNA, 18 nt, Artificial Sequence
  Description of Artificial Sequence: Synthetic oligonucleotide
uggaucaccugaggucag

SEQ ID NO: 74798 - RNA, 18 nt, Artificial Sequence
  Description of Artificial Sequence: Synthetic oligonucleotide
gcagguggaucaccugag

SEQ ID NO: 74799 - RNA, 18 nt, Artificial Sequence
  Description of Artificial Sequence: Synthetic oligonucleotide
cugaggcagguggaucac

SEQ ID NO: 74800 - RNA, 18 nt, Artificial Sequence
  Description of Artificial Sequence: Synthetic oligonucleotide
ggaggcugaggcaggugg

SEQ ID NO: 74801 - RNA, 18 nt, Artificial Sequence
  Description of Artificial Sequence: Synthetic oligonucleotide
cuuugggaggcugaggca

SEQ ID NO: 74802 - RNA, 18 nt, Artificial Sequence
  Description of Artificial Sequence: Synthetic oligonucleotide
cagcacuuugggaggcug

SEQ ID NO: 74803 - RNA, 18 nt, Artificial Sequence
  Description of Artificial Sequence: Synthetic oligonucleotide
aaucccagcacuuuggga

SEQ ID NO: 74804 - RNA, 18 nt, Artificial Sequence
  Description of Artificial Sequence: Synthetic oligonucleotide
ccuguaaucccagcacuu

SEQ ID NO: 74805 - RNA, 18 nt, Artificial Sequence
  Description of Artificial Sequence: Synthetic oligonucleotide
ucacgccuguaaucccag

SEQ ID NO: 74806 - RNA, 18 nt, Artificial Sequence
  Description of Artificial Sequence: Synthetic oligonucleotide
guggcucacgccuguaau

SEQ ID NO: 74807 - RNA, 18 nt, Artificial Sequence
  Description of Artificial Sequence: Synthetic oligonucleotide
gugcaguggcucacgccu

SEQ ID NO: 74808 - RNA, 18 nt, Artificial Sequence
  Description of Artificial Sequence: Synthetic oligonucleotide
gcugggugcaguggcuca

SEQ ID NO: 74809 - RNA, 18 nt, Artificial Sequence
  Description of Artificial Sequence: Synthetic oligonucleotide
ugaaggcugggugcagug

SEQ ID NO: 74810 - RNA, 18 nt, Artificial Sequence
  Description of Artificial Sequence: Synthetic oligonucleotide
cugaaugaaggcugggug

SEQ ID NO: 74811 - RNA, 18 nt, Artificial Sequence
  Description of Artificial Sequence: Synthetic oligonucleotide
uuaaacugaaugaaggcu

SEQ ID NO: 74812 - RNA, 18 nt, Artificial Sequence
  Description of Artificial Sequence: Synthetic oligonucleotide
gauuuuuaaacugaauga

SEQ ID NO: 74813 - RNA, 18 nt, Artificial Sequence
  Description of Artificial Sequence: Synthetic oligonucleotide
cauuugauuuuuaaacug

SEQ ID NO: 74814 - RNA, 18 nt, Artificial Sequence
  Description of Artificial Sequence: Synthetic oligonucleotide
aggaucauuugauuuuua

SEQ ID NO: 74815 - RNA, 18 nt, Artificial Sequence
  Description of Artificial Sequence: Synthetic oligonucleotide
accuuaggaucauuugau

SEQ ID NO: 74816 - RNA, 18 nt, Artificial Sequence
  Description of Artificial Sequence: Synthetic oligonucleotide
gcaaaaccuuaggaucau

SEQ ID NO: 74817 - RNA, 18 nt, Artificial Sequence
  Description of Artificial Sequence: Synthetic oligonucleotide
cugcugcaaaaccuuagg

SEQ ID NO: 74818 - RNA, 18 nt, Artificial Sequence
  Description of Artificial Sequence: Synthetic oligonucleotide
ucuuucugcugcaaaacc

SEQ ID NO: 74819 - RNA, 18 nt, Artificial Sequence
  Description of Artificial Sequence: Synthetic oligonucleotide
uuuacucuuucugcugca

SEQ ID NO: 74820 - RNA, 18 nt, Artificial Sequence
  Description of Artificial Sequence: Synthetic oligonucleotide
gcaaauuuacucuuucug

SEQ ID NO: 74821 - RNA, 18 nt, Artificial Sequence
  Description of Artificial Sequence: Synthetic oligonucleotide
gugcugcaaauuuacucu

SEQ ID NO: 74822 - RNA, 18 nt, Artificial Sequence
  Description of Artificial Sequence: Synthetic oligonucleotide
uucuagugcugcaaauuu

SEQ ID NO: 74823 - RNA, 18 nt, Artificial Sequence
  Description of Artificial Sequence: Synthetic oligonucleotide
cuugguucuagugcugca

SEQ ID NO: 74824 - RNA, 18 nt, Artificial Sequence
  Description of Artificial Sequence: Synthetic oligonucleotide
uaccucuugguucuagug

SEQ ID NO: 74825 - RNA, 18 nt, Artificial Sequence
  Description of Artificial Sequence: Synthetic oligonucleotide
gcuuuuaccucuugguuc

SEQ ID NO: 74826 - RNA, 18 nt, Artificial Sequence
  Description of Artificial Sequence: Synthetic oligonucleotide
uuacagcuuuuaccucuu

SEQ ID NO: 74827 - RNA, 18 nt, Artificial Sequence
  Description of Artificial Sequence: Synthetic oligonucleotide
cccuguuacagcuuuuac

SEQ ID NO: 74828 - RNA, 18 nt, Artificial Sequence
  Description of Artificial Sequence: Synthetic oligonucleotide
aucugcccuguuacagcu

SEQ ID NO: 74829 - RNA, 18 nt, Artificial Sequence
  Description of Artificial Sequence: Synthetic oligonucleotide
cugaaaucugcccuguua

SEQ ID NO: 74830 - RNA, 18 nt, Artificial Sequence
  Description of Artificial Sequence: Synthetic oligonucleotide
cguugcugaaaucugccc

SEQ ID NO: 74831 - RNA, 18 nt, Artificial Sequence
  Description of Artificial Sequence: Synthetic oligonucleotide
ucuuacguugcugaaauc

SEQ ID NO: 74832 - RNA, 18 nt, Artificial Sequence
  Description of Artificial Sequence: Synthetic oligonucleotide
uuuuuucuuacguugcug

SEQ ID NO: 74833 - RNA, 18 nt, Artificial Sequence
  Description of Artificial Sequence: Synthetic oligonucleotide
gcuccuuuuuucuuacgu

SEQ ID NO: 74834 - RNA, 18 nt, Artificial Sequence
  Description of Artificial Sequence: Synthetic oligonucleotide
gaagagcuccuuuuuucu

SEQ ID NO: 74835 - RNA, 18 nt, Artificial Sequence
  Description of Artificial Sequence: Synthetic oligonucleotide
agugagaagagcuccuuu

SEQ ID NO: 74836 - RNA, 18 nt, Artificial Sequence
  Description of Artificial Sequence: Synthetic oligonucleotide
guuucagugagaagagcu

SEQ ID NO: 74837 - RNA, 18 nt, Artificial Sequence
  Description of Artificial Sequence: Synthetic oligonucleotide
acuugguuucagugagaa

SEQ ID NO: 74838 - RNA, 18 nt, Artificial Sequence
  Description of Artificial Sequence: Synthetic oligonucleotide
cuuacacuugguuucagu

SEQ ID NO: 74839 - RNA, 18 nt, Artificial Sequence
  Description of Artificial Sequence: Synthetic oligonucleotide
cuggucuuacacuugguu

SEQ ID NO: 74840 - RNA, 18 nt, Artificial Sequence
  Description of Artificial Sequence: Synthetic oligonucleotide
ccagccuggucuuacacu

SEQ ID NO: 74841 - RNA, 18 nt, Artificial Sequence
  Description of Artificial Sequence: Synthetic oligonucleotide
cuaguccagccuggucuu

SEQ ID NO: 74842 - RNA, 18 nt, Artificial Sequence
  Description of Artificial Sequence: Synthetic oligonucleotide
guccucuaguccagccug

SEQ ID NO: 74843 - RNA, 18 nt, Artificial Sequence
  Description of Artificial Sequence: Synthetic oligonucleotide
cccguguccucuagucca

SEQ ID NO: 74844 - RNA, 18 nt, Artificial Sequence
  Description of Artificial Sequence: Synthetic oligonucleotide
aaacucccguguccucua

SEQ ID NO: 74845 - RNA, 18 nt, Artificial Sequence
  Description of Artificial Sequence: Synthetic oligonucleotide
uucaaaaacucccguguc

SEQ ID NO: 74846 - RNA, 18 nt, Artificial Sequence
  Description of Artificial Sequence: Synthetic oligonucleotide
ucugcuucaaaaacuccc

SEQ ID NO: 74847 - RNA, 18 nt, Artificial Sequence
  Description of Artificial Sequence: Synthetic oligonucleotide
cagccucugcuucaaaaa

SEQ ID NO: 74848 - RNA, 18 nt, Artificial Sequence
  Description of Artificial Sequence: Synthetic oligonucleotide
gucaucagccucugcuuc

SEQ ID NO: 74849 - RNA, 18 nt, Artificial Sequence
  Description of Artificial Sequence: Synthetic oligonucleotide
agcuggucaucagccucu

SEQ ID NO: 74850 - RNA, 18 nt, Artificial Sequence
  Description of Artificial Sequence: Synthetic oligonucleotide
ccgacagcuggucaucag

SEQ ID NO: 74851 - RNA, 18 nt, Artificial Sequence
  Description of Artificial Sequence: Synthetic oligonucleotide
gucucccgacagcugguc

SEQ ID NO: 74852 - RNA, 18 nt, Artificial Sequence
  Description of Artificial Sequence: Synthetic oligonucleotide
ucacagucucccgacagc

SEQ ID NO: 74853 - RNA, 18 nt, Artificial Sequence
  Description of Artificial Sequence: Synthetic oligonucleotide
uuccuucacagucucccg

SEQ ID NO: 74854 - RNA, 18 nt, Artificial Sequence
  Description of Artificial Sequence: Synthetic oligonucleotide
aggaauuccuucacaguc

SEQ ID NO: 74855 - RNA, 18 nt, Artificial Sequence
  Description of Artificial Sequence: Synthetic oligonucleotide
agggcaggaauuccuuca

SEQ ID NO: 74856 - RNA, 18 nt, Artificial Sequence
  Description of Artificial Sequence: Synthetic oligonucleotide
cacccagggcaggaauuc

SEQ ID NO: 74857 - RNA, 18 nt, Artificial Sequence
  Description of Artificial Sequence: Synthetic oligonucleotide
ggucccacccagggcagg

SEQ ID NO: 74858 - RNA, 18 nt, Artificial Sequence
  Description of Artificial Sequence: Synthetic oligonucleotide
accaaggucccacccagg

SEQ ID NO: 74859 - RNA, 18 nt, Artificial Sequence
  Description of Artificial Sequence: Synthetic oligonucleotide
acaggaccaaggucccac

SEQ ID NO: 74860 - RNA, 18 nt, Artificial Sequence
  Description of Artificial Sequence: Synthetic oligonucleotide
acuggacaggaccaaggu

SEQ ID NO: 74861 - RNA, 18 nt, Artificial Sequence
  Description of Artificial Sequence: Synthetic oligonucleotide
ugagaacuggacaggacc

SEQ ID NO: 74862 - RNA, 18 nt, Artificial Sequence
  Description of Artificial Sequence: Synthetic oligonucleotide
caggcugagaacuggaca

SEQ ID NO: 74863 - RNA, 18 nt, Artificial Sequence
  Description of Artificial Sequence: Synthetic oligonucleotide
ucauacaggcugagaacu

SEQ ID NO: 74864 - RNA, 18 nt, Artificial Sequence
  Description of Artificial Sequence: Synthetic oligonucleotide
gugaaucauacaggcuga

SEQ ID NO: 74865 - RNA, 18 nt, Artificial Sequence
  Description of Artificial Sequence: Synthetic oligonucleotide
gcagagugaaucauacag

SEQ ID NO: 74866 - RNA, 18 nt, Artificial Sequence
  Description of Artificial Sequence: Synthetic oligonucleotide
agccagcagagugaauca

SEQ ID NO: 74867 - RNA, 18 nt, Artificial Sequence
  Description of Artificial Sequence: Synthetic oligonucleotide
ggaguagccagcagagug

SEQ ID NO: 74868 - RNA, 18 nt, Artificial Sequence
  Description of Artificial Sequence: Synthetic oligonucleotide
ccuuaggaguagccagca

SEQ ID NO: 74869 - RNA, 18 nt, Artificial Sequence
  Description of Artificial Sequence: Synthetic oligonucleotide
gggagccuuaggaguagc

SEQ ID NO: 74870 - RNA, 18 nt, Artificial Sequence
  Description of Artificial Sequence: Synthetic oligonucleotide
acacuaaaagcggguggg

SEQ ID NO: 74871 - RNA, 18 nt, Artificial Sequence
  Description of Artificial Sequence: Synthetic oligonucleotide
ggcacacuaaaagcgggu

SEQ ID NO: 74872 - RNA, 18 nt, Artificial Sequence
  Description of Artificial Sequence: Synthetic oligonucleotide
caaagggcacacuaaaag

SEQ ID NO: 74873 - RNA, 18 nt, Artificial Sequence
  Description of Artificial Sequence: Synthetic oligonucleotide
ugccucaaagggcacacu

SEQ ID NO: 74874 - RNA, 18 nt, Artificial Sequence
  Description of Artificial Sequence: Synthetic oligonucleotide
cgcacugccucaaagggc

SEQ ID NO: 74875 - RNA, 18 nt, Artificial Sequence
  Description of Artificial Sequence: Synthetic oligonucleotide
agaagcgcacugccucaa

SEQ ID NO: 74876 - RNA, 18 nt, Artificial Sequence
  Description of Artificial Sequence: Synthetic oligonucleotide
aagagagaagcgcacugc

SEQ ID NO: 74877 - RNA, 18 nt, Artificial Sequence
  Description of Artificial Sequence: Synthetic oligonucleotide
ccugugccuuggucuccu

SEQ ID NO: 74878 - RNA, 18 nt, Artificial Sequence
  Description of Artificial Sequence: Synthetic oligonucleotide
aauguccugugccuuggu

SEQ ID NO: 74879 - RNA, 18 nt, Artificial Sequence
  Description of Artificial Sequence: Synthetic oligonucleotide
cccagaauguccugugcc

SEQ ID NO: 74880 - RNA, 18 nt, Artificial Sequence
  Description of Artificial Sequence: Synthetic oligonucleotide
cugcucccagaauguccu

SEQ ID NO: 74881 - RNA, 18 nt, Artificial Sequence
  Description of Artificial Sequence: Synthetic oligonucleotide
ggucacugcucccagaau

SEQ ID NO: 74882 - RNA, 18 nt, Artificial Sequence
  Description of Artificial Sequence: Synthetic oligonucleotide
agaagggucacugcuccc

SEQ ID NO: 74883 - RNA, 18 nt, Artificial Sequence
  Description of Artificial Sequence: Synthetic oligonucleotide
ccagcagaagggucacug

SEQ ID NO: 74884 - RNA, 18 nt, Artificial Sequence
  Description of Artificial Sequence: Synthetic oligonucleotide
ucccuccagcagaagggu

SEQ ID NO: 74885 - RNA, 18 nt, Artificial Sequence
  Description of Artificial Sequence: Synthetic oligonucleotide
aucacucccuccagcaga

SEQ ID NO: 74886 - RNA, 18 nt, Artificial Sequence
  Description of Artificial Sequence: Synthetic oligonucleotide
cugccaucacucccucca

SEQ ID NO: 74887 - RNA, 18 nt, Artificial Sequence
  Description of Artificial Sequence: Synthetic oligonucleotide
ccgugcugccaucacucc

SEQ ID NO: 74888 - RNA, 18 nt, Artificial Sequence
  Description of Artificial Sequence: Synthetic oligonucleotide
uguccccgugcugccauc

SEQ ID NO: 74889 - RNA, 18 nt, Artificial Sequence
  Description of Artificial Sequence: Synthetic oligonucleotide
ccaguuguccccgugcug

SEQ ID NO: 74890 - RNA, 18 nt, Artificial Sequence
  Description of Artificial Sequence: Synthetic oligonucleotide
gggucccaguuguccccg

SEQ ID NO: 74891 - RNA, 18 nt, Artificial Sequence
  Description of Artificial Sequence: Synthetic oligonucleotide
caagugggucccaguugu

SEQ ID NO: 74892 - RNA, 18 nt, Artificial Sequence
  Description of Artificial Sequence: Synthetic oligonucleotide
agaggcaaguggguccca

SEQ ID NO: 74893 - RNA, 18 nt, Artificial Sequence
  Description of Artificial Sequence: Synthetic oligonucleotide
ggaugagaggcaaguggg

SEQ ID NO: 74894 - RNA, 18 nt, Artificial Sequence
  Description of Artificial Sequence: Synthetic oligonucleotide
aggagggaugagaggcaa

SEQ ID NO: 74895 - RNA, 18 nt, Artificial Sequence
  Description of Artificial Sequence: Synthetic oligonucleotide
gccccaggagggaugaga

SEQ ID NO: 74896 - RNA, 18 nt, Artificial Sequence
  Description of Artificial Sequence: Synthetic oligonucleotide
aagcugccccaggaggga

SEQ ID NO: 74897 - RNA, 18 nt, Artificial Sequence
  Description of Artificial Sequence: Synthetic oligonucleotide
ccagaaagcugccccagg

SEQ ID NO: 74898 - RNA, 18 nt, Artificial Sequence
  Description of Artificial Sequence: Synthetic oligonucleotide
ccuguccagaaagcugcc

SEQ ID NO: 74899 - RNA, 18 nt, Artificial Sequence
  Description of Artificial Sequence: Synthetic oligonucleotide
acggaccuguccagaaag

SEQ ID NO: 74900 - RNA, 18 nt, Artificial Sequence
  Description of Artificial Sequence: Synthetic oligonucleotide
aggagacggaccugucca

SEQ ID NO: 74901 - RNA, 18 nt, Artificial Sequence
  Description of Artificial Sequence: Synthetic oligonucleotide
caaggaggagacggaccu

SEQ ID NO: 74902 - RNA, 18 nt, Artificial Sequence
  Description of Artificial Sequence: Synthetic oligonucleotide
ggccccaaggaggagacg

SEQ ID NO: 74903 - RNA, 18 nt, Artificial Sequence
  Description of Artificial Sequence: Synthetic oligonucleotide
ugcagggccccaaggagg

SEQ ID NO: 74904 - RNA, 18 nt, Artificial Sequence
  Description of Artificial Sequence: Synthetic oligonucleotide
ggcucugcagggccccaa

SEQ ID NO: 74905 - RNA, 18 nt, Artificial Sequence
  Description of Artificial Sequence: Synthetic oligonucleotide
aaggaggcucugcagggc

SEQ ID NO: 74906 - RNA, 18 nt, Artificial Sequence
  Description of Artificial Sequence: Synthetic oligonucleotide
guuccaaggaggcucugc

SEQ ID NO: 74907 - RNA, 18 nt, Artificial Sequence
  Description of Artificial Sequence: Synthetic oligonucleotide
uccugugccuuggucucc

SEQ ID NO: 74908 - RNA, 18 nt, Artificial Sequence
  Description of Artificial Sequence: Synthetic oligonucleotide
gaauguccugugccuugg

SEQ ID NO: 74909 - RNA, 18 nt, Artificial Sequence
  Description of Artificial Sequence: Synthetic oligonucleotide
ucccagaauguccugugc

SEQ ID NO: 74910 - RNA, 18 nt, Artificial Sequence
  Description of Artificial Sequence: Synthetic oligonucleotide
acugcucccagaaugucc

SEQ ID NO: 74911 - RNA, 18 nt, Artificial Sequence
  Description of Artificial Sequence: Synthetic oligonucleotide
gggucacugcucccagaa

SEQ ID NO: 74912 - RNA, 18 nt, Artificial Sequence
  Description of Artificial Sequence: Synthetic oligonucleotide
cagaagggucacugcucc

SEQ ID NO: 74913 - RNA, 18 nt, Artificial Sequence
  Description of Artificial Sequence: Synthetic oligonucleotide
uccagcagaagggucacu

SEQ ID NO: 74914 - RNA, 18 nt, Artificial Sequence
  Description of Artificial Sequence: Synthetic oligonucleotide
cucccuccagcagaaggg

SEQ ID NO: 74915 - RNA, 18 nt, Artificial Sequence
  Description of Artificial Sequence: Synthetic oligonucleotide
caucacucccuccagcag

SEQ ID NO: 74916 - RNA, 18 nt, Artificial Sequence
  Description of Artificial Sequence: Synthetic oligonucleotide
gcugccaucacucccucc

SEQ ID NO: 74917 - RNA, 18 nt, Artificial Sequence
  Description of Artificial Sequence: Synthetic oligonucleotide
cccgugcugccaucacuc

SEQ ID NO: 74918 - RNA, 18 nt, Artificial Sequence
  Description of Artificial Sequence: Synthetic oligonucleotide
uuguccccgugcugccau

SEQ ID NO: 74919 - RNA, 18 nt, Artificial Sequence
  Description of Artificial Sequence: Synthetic oligonucleotide
cccaguuguccccgugcu

SEQ ID NO: 74920 - RNA, 18 nt, Artificial Sequence
  Description of Artificial Sequence: Synthetic oligonucleotide
ugggucccaguugucccc

SEQ ID NO: 74921 - RNA, 18 nt, Artificial Sequence
  Description of Artificial Sequence: Synthetic oligonucleotide
gcaagugggucccaguug

SEQ ID NO: 74922 - RNA, 18 nt, Artificial Sequence
  Description of Artificial Sequence: Synthetic oligonucleotide
gagaggcaaguggguccc

SEQ ID NO: 74923 - RNA, 18 nt, Artificial Sequence
  Description of Artificial Sequence: Synthetic oligonucleotide
gggaugagaggcaagugg

SEQ ID NO: 74924 - RNA, 18 nt, Artificial Sequence
  Description of Artificial Sequence: Synthetic oligonucleotide
caggagggaugagaggca

SEQ ID NO: 74925 - RNA, 18 nt, Artificial Sequence
  Description of Artificial Sequence: Synthetic oligonucleotide
ugccccaggagggaugag

SEQ ID NO: 74926 - RNA, 18 nt, Artificial Sequence
  Description of Artificial Sequence: Synthetic oligonucleotide
aaagcugccccaggaggg

SEQ ID NO: 74927 - RNA, 18 nt, Artificial Sequence
  Description of Artificial Sequence: Synthetic oligonucleotide
uccagaaagcugccccag

SEQ ID NO: 74928 - RNA, 18 nt, Artificial Sequence
  Description of Artificial Sequence: Synthetic oligonucleotide
accuguccagaaagcugc

SEQ ID NO: 74929 - RNA, 18 nt, Artificial Sequence
  Description of Artificial Sequence: Synthetic oligonucleotide
gacggaccuguccagaaa

SEQ ID NO: 74930 - RNA, 18 nt, Artificial Sequence
  Description of Artificial Sequence: Synthetic oligonucleotide
gaggagacggaccugucc

SEQ ID NO: 74931 - RNA, 18 nt, Artificial Sequence
  Description of Artificial Sequence: Synthetic oligonucleotide
ccaaggaggagacggacc

SEQ ID NO: 74932 - RNA, 18 nt, Artificial Sequence
  Description of Artificial Sequence: Synthetic oligonucleotide
gggccccaaggaggagac

SEQ ID NO: 74933 - RNA, 18 nt, Artificial Sequence
  Description of Artificial Sequence: Synthetic oligonucleotide
cugcagggccccaaggag

SEQ ID NO: 74934 - RNA, 18 nt, Artificial Sequence
  Description of Artificial Sequence: Synthetic oligonucleotide
aggcucugcagggcccca

SEQ ID NO: 74935 - RNA, 18 nt, Artificial Sequence
  Description of Artificial Sequence: Synthetic oligonucleotide
caaggaggcucugcaggg

SEQ ID NO: 74936 - RNA, 18 nt, Artificial Sequence
  Description of Artificial Sequence: Synthetic oligonucleotide
gguuccaaggaggcucug

SEQ ID NO: 74937 - RNA, 18 nt, Artificial Sequence
  Description of Artificial Sequence: Synthetic oligonucleotide
ucuacagaucccuugacu

SEQ ID NO: 74938 - RNA, 18 nt, Artificial Sequence
  Description of Artificial Sequence: Synthetic oligonucleotide
caguuucuacagaucccu

SEQ ID NO: 74939 - RNA, 18 nt, Artificial Sequence
  Description of Artificial Sequence: Synthetic oligonucleotide
aagaacaguuucuacaga

SEQ ID NO: 74940 - RNA, 18 nt, Artificial Sequence
  Description of Artificial Sequence: Synthetic oligonucleotide
cagaaaagaacaguuucu

SEQ ID NO: 74941 - RNA, 18 nt, Artificial Sequence
  Description of Artificial Sequence: Synthetic oligonucleotide
ugagucagaaaagaacag

SEQ ID NO: 74942 - RNA, 18 nt, Artificial Sequence
  Description of Artificial Sequence: Synthetic oligonucleotide
gggacugagucagaaaag

SEQ ID NO: 74943 - RNA, 18 nt, Artificial Sequence
  Description of Artificial Sequence: Synthetic oligonucleotide
cuucccucaggucuucua

SEQ ID NO: 74944 - RNA, 18 nt, Artificial Sequence
  Description of Artificial Sequence: Synthetic oligonucleotide
cccuucuucccucagguc

SEQ ID NO: 74945 - RNA, 18 nt, Artificial Sequence
  Description of Artificial Sequence: Synthetic oligonucleotide
aagagcccuucuucccuc

SEQ ID NO: 74946 - RNA, 18 nt, Artificial Sequence
  Description of Artificial Sequence: Synthetic oligonucleotide
ccuggaagagcccuucuu

SEQ ID NO: 74947 - RNA, 18 nt, Artificial Sequence
  Description of Artificial Sequence: Synthetic oligonucleotide
agcucccuggaagagccc

SEQ ID NO: 74948 - RNA, 18 nt, Artificial Sequence
  Description of Artificial Sequence: Synthetic oligonucleotide
ccuugagcucccuggaag

SEQ ID NO: 74949 - RNA, 18 nt, Artificial Sequence
  Description of Artificial Sequence: Synthetic oligonucleotide
ucugcccuugagcucccu

SEQ ID NO: 74950 - RNA, 18 nt, Artificial Sequence
  Description of Artificial Sequence: Synthetic oligonucleotide
gcucuucugcccuugagc

SEQ ID NO: 74951 - RNA, 18 nt, Artificial Sequence
  Description of Artificial Sequence: Synthetic oligonucleotide
gaucagcucuucugcccu

SEQ ID NO: 74952 - RNA, 18 nt, Artificial Sequence
  Description of Artificial Sequence: Synthetic oligonucleotide
uaguagaucagcucuucu

SEQ ID NO: 74953 - RNA, 18 nt, Artificial Sequence
  Description of Artificial Sequence: Synthetic oligonucleotide
acucuuaguagaucagcu

SEQ ID NO: 74954 - RNA, 18 nt, Artificial Sequence
  Description of Artificial Sequence: Synthetic oligonucleotide
ggagcacucuuaguagau

SEQ ID NO: 74955 - RNA, 18 nt, Artificial Sequence
  Description of Artificial Sequence: Synthetic oligonucleotide
ggcagggagcacucuuag

SEQ ID NO: 74956 - RNA, 18 nt, Artificial Sequence
  Description of Artificial Sequence: Synthetic oligonucleotide
uggcuggcagggagcacu

SEQ ID NO: 74957 - RNA, 18 nt, Artificial Sequence
  Description of Artificial Sequence: Synthetic oligonucleotide
cauuguggcuggcaggga

SEQ ID NO: 74958 - RNA, 18 nt, Artificial Sequence
  Description of Artificial Sequence: Synthetic oligonucleotide
ccaggcauuguggcuggc

SEQ ID NO: 74959 - RNA, 18 nt, Artificial Sequence
  Description of Artificial Sequence: Synthetic oligonucleotide
ucuucugcccuugagcuc

SEQ ID NO: 74960 - RNA, 18 nt, Artificial Sequence
  Description of Artificial Sequence: Synthetic oligonucleotide
ucagcucuucugcccuug

SEQ ID NO: 74961 - RNA, 18 nt, Artificial Sequence
  Description of Artificial Sequence: Synthetic oligonucleotide
guagaucagcucuucugc

SEQ ID NO: 74962 - RNA, 18 nt, Artificial Sequence
  Description of Artificial Sequence: Synthetic oligonucleotide
ucuuaguagaucagcucu

SEQ ID NO: 74963 - RNA, 18 nt, Artificial Sequence
  Description of Artificial Sequence: Synthetic oligonucleotide
agcacucuuaguagauca

SEQ ID NO: 74964 - RNA, 18 nt, Artificial Sequence
  Description of Artificial Sequence: Synthetic oligonucleotide
cagggagcacucuuagua

SEQ ID NO: 74965 - RNA, 18 nt, Artificial Sequence
  Description of Artificial Sequence: Synthetic oligonucleotide
gcuggcagggagcacucu

SEQ ID NO: 74966 - RNA, 18 nt, Artificial Sequence
  Description of Artificial Sequence: Synthetic oligonucleotide
uuguggcuggcagggagc

SEQ ID NO: 74967 - RNA, 18 nt, Artificial Sequence
  Description of Artificial Sequence: Synthetic oligonucleotide
aggcauuguggcuggcag

SEQ ID NO: 74968 - RNA, 18 nt, Artificial Sequence
  Description of Artificial Sequence: Synthetic oligonucleotide
uacccaggcauuguggcu

SEQ ID NO: 74969 - RNA, 18 nt, Artificial Sequence
  Description of Artificial Sequence: Synthetic oligonucleotide
gccaguacccaggcauug

SEQ ID NO: 74970 - RNA, 18 nt, Artificial Sequence
  Description of Artificial Sequence: Synthetic oligonucleotide
aggaugccaguacccagg

SEQ ID NO: 74971 - RNA, 18 nt, Artificial Sequence
  Description of Artificial Sequence: Synthetic oligonucleotide
aagacaggaugccaguac

SEQ ID NO: 74972 - RNA, 18 nt, Artificial Sequence
  Description of Artificial Sequence: Synthetic oligonucleotide
uaggaaagacaggaugcc

SEQ ID NO: 74973 - RNA, 18 nt, Artificial Sequence
  Description of Artificial Sequence: Synthetic oligonucleotide
cuaaguaggaaagacagg

SEQ ID NO: 74974 - RNA, 18 nt, Artificial Sequence
  Description of Artificial Sequence: Synthetic oligonucleotide
cuugucuaaguaggaaag

SEQ ID NO: 74975 - RNA, 18 nt, Artificial Sequence
  Description of Artificial Sequence: Synthetic oligonucleotide
ccucccuugucuaaguag

SEQ ID NO: 74976 - RNA, 18 nt, Artificial Sequence
  Description of Artificial Sequence: Synthetic oligonucleotide
ucaggccucccuugucua

SEQ ID NO: 74977 - RNA, 18 nt, Artificial Sequence
  Description of Artificial Sequence: Synthetic oligonucleotide
agaucucaggccucccuu

SEQ ID NO: 74978 - RNA, 18 nt, Artificial Sequence
  Description of Artificial Sequence: Synthetic oligonucleotide
gggccagaucucaggccu

SEQ ID NO: 74979 - RNA, 18 nt, Artificial Sequence
  Description of Artificial Sequence: Synthetic oligonucleotide
caccagggccagaucuca

SEQ ID NO: 74980 - RNA, 18 nt, Artificial Sequence
  Description of Artificial Sequence: Synthetic oligonucleotide
ccaaacaccagggccaga

SEQ ID NO: 74981 - RNA, 18 nt, Artificial Sequence
  Description of Artificial Sequence: Synthetic oligonucleotide
ugaggccaaacaccaggg

SEQ ID NO: 74982 - RNA, 18 nt, Artificial Sequence
  Description of Artificial Sequence: Synthetic oligonucleotide
gguccugaggccaaacac

SEQ ID NO: 74983 - RNA, 18 nt, Artificial Sequence
  Description of Artificial Sequence: Synthetic oligonucleotide
uccugcccuguggaggaa

SEQ ID NO: 74984 - RNA, 18 nt, Artificial Sequence
  Description of Artificial Sequence: Synthetic oligonucleotide
ugugguccugcccugugg

SEQ ID NO: 74985 - RNA, 18 nt, Artificial Sequence
  Description of Artificial Sequence: Synthetic oligonucleotide
ugagcugugguccugccc

SEQ ID NO: 74986 - RNA, 18 nt, Artificial Sequence
  Description of Artificial Sequence: Synthetic oligonucleotide
ccuugugagcuguggucc

SEQ ID NO: 74987 - RNA, 18 nt, Artificial Sequence
  Description of Artificial Sequence: Synthetic oligonucleotide
gggauccuugugagcugu

SEQ ID NO: 74988 - RNA, 18 nt, Artificial Sequence
  Description of Artificial Sequence: Synthetic oligonucleotide
gcauugggauccuuguga

SEQ ID NO: 74989 - RNA, 18 nt, Artificial Sequence
  Description of Artificial Sequence: Synthetic oligonucleotide
agauggcauugggauccu

SEQ ID NO: 74990 - RNA, 18 nt, Artificial Sequence
  Description of Artificial Sequence: Synthetic oligonucleotide
caggaagauggcauuggg

SEQ ID NO: 74991 - RNA, 18 nt, Artificial Sequence
  Description of Artificial Sequence: Synthetic oligonucleotide
aagcucaggaagauggca

SEQ ID NO: 74992 - RNA, 18 nt, Artificial Sequence
  Description of Artificial Sequence: Synthetic oligonucleotide
guuggaagcucaggaaga

SEQ ID NO: 74993 - RNA, 18 nt, Artificial Sequence
  Description of Artificial Sequence: Synthetic oligonucleotide
cagguguuggaagcucag

SEQ ID NO: 74994 - RNA, 18 nt, Artificial Sequence
  Description of Artificial Sequence: Synthetic oligonucleotide
cggagcagguguuggaag

SEQ ID NO: 74995 - RNA, 18 nt, Artificial Sequence
  Description of Artificial Sequence: Synthetic oligonucleotide
uuccucggagcagguguu

SEQ ID NO: 74996 - RNA, 18 nt, Artificial Sequence
  Description of Artificial Sequence: Synthetic oligonucleotide
cuggacaugggcaaccug

SEQ ID NO: 74997 - RNA, 18 nt, Artificial Sequence
  Description of Artificial Sequence: Synthetic oligonucleotide
uuuuccuggacaugggca

SEQ ID NO: 74998 - RNA, 18 nt, Artificial Sequence
  Description of Artificial Sequence: Synthetic oligonucleotide
ccaucuuuuccuggacau

SEQ ID NO: 74999 - RNA, 18 nt, Artificial Sequence
  Description of Artificial Sequence: Synthetic oligonucleotide
gggauccaucuuuuccug

SEQ ID NO: 75000 - RNA, 18 nt, Artificial Sequence
  Description of Artificial Sequence: Synthetic oligonucleotide
gagaagauuuggauaggg

SEQ ID NO: 75001 - RNA, 18 nt, Artificial Sequence
  Description of Artificial Sequence: Synthetic oligonucleotide
cggagaagauuuggauag

SEQ ID NO: 75002 - RNA, 18 nt, Artificial Sequence
  Description of Artificial Sequence: Synthetic oligonucleotide
caccacggagaagauuug

SEQ ID NO: 75003 - RNA, 18 nt, Artificial Sequence
  Description of Artificial Sequence: Synthetic oligonucleotide
acacacaccacggagaag

SEQ ID NO: 75004 - RNA, 18 nt, Artificial Sequence
  Description of Artificial Sequence: Synthetic oligonucleotide
cacccacacacaccacgg

SEQ ID NO: 75005 - RNA, 18 nt, Artificial Sequence
  Description of Artificial Sequence: Synthetic oligonucleotide
uccuccacccacacacac

SEQ ID NO: 75006 - RNA, 18 nt, Artificial Sequence
  Description of Artificial Sequence: Synthetic oligonucleotide
uccacuccuccacccaca

SEQ ID NO: 75007 - RNA, 18 nt, Artificial Sequence
  Description of Artificial Sequence: Synthetic oligonucleotide
caggguccacuccuccac

SEQ ID NO: 75008 - RNA, 18 nt, Artificial Sequence
  Description of Artificial Sequence: Synthetic oligonucleotide
uggaccaggguccacucc

SEQ ID NO: 75009 - RNA, 18 nt, Artificial Sequence
  Description of Artificial Sequence: Synthetic oligonucleotide
cugccuggaccagggucc

SEQ ID NO: 75010 - RNA, 18 nt, Artificial Sequence
  Description of Artificial Sequence: Synthetic oligonucleotide
agccccugccuggaccag

SEQ ID NO: 75011 - RNA, 18 nt, Artificial Sequence
  Description of Artificial Sequence: Synthetic oligonucleotide
ccuggagccccugccugg

SEQ ID NO: 75012 - RNA, 18 nt, Artificial Sequence
  Description of Artificial Sequence: Synthetic oligonucleotide
ucuucccuggagccccug

SEQ ID NO: 75013 - RNA, 18 nt, Artificial Sequence
  Description of Artificial Sequence: Synthetic oligonucleotide
ccuucucuucccuggagc

SEQ ID NO: 75014 - RNA, 18 nt, Artificial Sequence
  Description of Artificial Sequence: Synthetic oligonucleotide
ugacgccuucucuucccu

SEQ ID NO: 75015 - RNA, 18 nt, Artificial Sequence
  Description of Artificial Sequence: Synthetic oligonucleotide
ggaagugacgccuucucu

SEQ ID NO: 75016 - RNA, 18 nt, Artificial Sequence
  Description of Artificial Sequence: Synthetic oligonucleotide
cccccggaagugacgccu

SEQ ID NO: 75017 - RNA, 18 nt, Artificial Sequence
  Description of Artificial Sequence: Synthetic oligonucleotide
gaaggcccccggaaguga

SEQ ID NO: 75018 - RNA, 18 nt, Artificial Sequence
  Description of Artificial Sequence: Synthetic oligonucleotide
cuggugaaggcccccgga

SEQ ID NO: 75019 - RNA, 18 nt, Artificial Sequence
  Description of Artificial Sequence: Synthetic oligonucleotide
agacacuggugaaggccc

SEQ ID NO: 75020 - RNA, 18 nt, Artificial Sequence
  Description of Artificial Sequence: Synthetic oligonucleotide
ccaccagacacuggugaa

SEQ ID NO: 75021 - RNA, 18 nt, Artificial Sequence
  Description of Artificial Sequence: Synthetic oligonucleotide
gggagccaccagacacug

SEQ ID NO: 75022 - RNA, 18 nt, Artificial Sequence
  Description of Artificial Sequence: Synthetic oligonucleotide
gagaagggagccaccaga

SEQ ID NO: 75023 - RNA, 18 nt, Artificial Sequence
  Description of Artificial Sequence: Synthetic oligonucleotide
aaucagagaagggagcca

SEQ ID NO: 75024 - RNA, 18 nt, Artificial Sequence
  Description of Artificial Sequence: Synthetic oligonucleotide
ugcccaaucagagaaggg

SEQ ID NO: 75025 - RNA, 18 nt, Artificial Sequence
  Description of Artificial Sequence: Synthetic oligonucleotide
acuucugcccaaucagag

SEQ ID NO: 75026 - RNA, 18 nt, Artificial Sequence
  Description of Artificial Sequence: Synthetic oligonucleotide
gggccacuucugcccaau

SEQ ID NO: 75027 - RNA, 18 nt, Artificial Sequence
  Description of Artificial Sequence: Synthetic oligonucleotide
ugccugggccacuucugc

SEQ ID NO: 75028 - RNA, 18 nt, Artificial Sequence
  Description of Artificial Sequence: Synthetic oligonucleotide
acgccugccugggccacu

SEQ ID NO: 75029 - RNA, 18 nt, Artificial Sequence
  Description of Artificial Sequence: Synthetic oligonucleotide
gucauacgccugccuggg

SEQ ID NO: 75030 - RNA, 18 nt, Artificial Sequence
  Description of Artificial Sequence: Synthetic oligonucleotide
agcaggucauacgccugc

SEQ ID NO: 75031 - RNA, 18 nt, Artificial Sequence
  Description of Artificial Sequence: Synthetic oligonucleotide
acagcagcaggucauacg

SEQ ID NO: 75032 - RNA, 18 nt, Artificial Sequence
  Description of Artificial Sequence: Synthetic oligonucleotide
ccuccacagcagcagguc

SEQ ID NO: 75033 - RNA, 18 nt, Artificial Sequence
  Description of Artificial Sequence: Synthetic oligonucleotide
cagccccuccacagcagc

SEQ ID NO: 75034 - RNA, 18 nt, Artificial Sequence
  Description of Artificial Sequence: Synthetic oligonucleotide
gggcacagccccuccaca

SEQ ID NO: 75035 - RNA, 18 nt, Artificial Sequence
  Description of Artificial Sequence: Synthetic oligonucleotide
aagacauguggcgguggg

SEQ ID NO: 75036 - RNA, 18 nt, Artificial Sequence
  Description of Artificial Sequence: Synthetic oligonucleotide
aggaagacauguggcggu

SEQ ID NO: 75037 - RNA, 18 nt, Artificial Sequence
  Description of Artificial Sequence: Synthetic oligonucleotide
uggguaggaagacaugug

SEQ ID NO: 75038 - RNA, 18 nt, Artificial Sequence
  Description of Artificial Sequence: Synthetic oligonucleotide
gcagauggguaggaagac

SEQ ID NO: 75039 - RNA, 18 nt, Artificial Sequence
  Description of Artificial Sequence: Synthetic oligonucleotide
agcaggcagcccucuggg

SEQ ID NO: 75040 - RNA, 18 nt, Artificial Sequence
  Description of Artificial Sequence: Synthetic oligonucleotide
ugcacagcaggcagcccu

SEQ ID NO: 75041 - RNA, 18 nt, Artificial Sequence
  Description of Artificial Sequence: Synthetic oligonucleotide
ccaagugcacagcaggca

SEQ ID NO: 75042 - RNA, 18 nt, Artificial Sequence
  Description of Artificial Sequence: Synthetic oligonucleotide
aggacccaagugcacagc

SEQ ID NO: 75043 - RNA, 18 nt, Artificial Sequence
  Description of Artificial Sequence: Synthetic oligonucleotide
gcuccaggacccaagugc

SEQ ID NO: 75044 - RNA, 18 nt, Artificial Sequence
  Description of Artificial Sequence: Synthetic oligonucleotide
gaagggcuccaggaccca

SEQ ID NO: 75045 - RNA, 18 nt, Artificial Sequence
  Description of Artificial Sequence: Synthetic oligonucleotide
guggagaagggcuccagg

SEQ ID NO: 75046 - RNA, 18 nt, Artificial Sequence
  Description of Artificial Sequence: Synthetic oligonucleotide
cccacacccugcuggcca

SEQ ID NO: 75047 - RNA, 18 nt, Artificial Sequence
  Description of Artificial Sequence: Synthetic oligonucleotide
auaaccccacacccugcu

SEQ ID NO: 75048 - RNA, 18 nt, Artificial Sequence
  Description of Artificial Sequence: Synthetic oligonucleotide
cucacauaaccccacacc

SEQ ID NO: 75049 - RNA, 18 nt, Artificial Sequence
  Description of Artificial Sequence: Synthetic oligonucleotide
cuacccucacauaacccc

SEQ ID NO: 75050 - RNA, 18 nt, Artificial Sequence
  Description of Artificial Sequence: Synthetic oligonucleotide
ccuuucuacccucacaua

SEQ ID NO: 75051 - RNA, 18 nt, Artificial Sequence
  Description of Artificial Sequence: Synthetic oligonucleotide
gcuguccuuucuacccuc

SEQ ID NO: 75052 - RNA, 18 nt, Artificial Sequence
  Description of Artificial Sequence: Synthetic oligonucleotide
ucuuugcuguccuuucua

SEQ ID NO: 75053 - RNA, 18 nt, Artificial Sequence
  Description of Artificial Sequence: Synthetic oligonucleotide
auuucucuuugcuguccu

SEQ ID NO: 75054 - RNA, 18 nt, Artificial Sequence
  Description of Artificial Sequence: Synthetic oligonucleotide
agcccauuucucuuugcu

SEQ ID NO: 75055 - RNA, 18 nt, Artificial Sequence
  Description of Artificial Sequence: Synthetic oligonucleotide
cugggagcccauuucucu

SEQ ID NO: 75056 - RNA, 18 nt, Artificial Sequence
  Description of Artificial Sequence: Synthetic oligonucleotide
cccagcugggagcccauu

SEQ ID NO: 75057 - RNA, 18 nt, Artificial Sequence
  Description of Artificial Sequence: Synthetic oligonucleotide
ccucccccagcugggagc

SEQ ID NO: 75058 - RNA, 18 nt, Artificial Sequence
  Description of Artificial Sequence: Synthetic oligonucleotide
cugccccucccccagcug

SEQ ID NO: 75059 - RNA, 18 nt, Artificial Sequence
  Description of Artificial Sequence: Synthetic oligonucleotide
uuugccugccccuccccc

SEQ ID NO: 75060 - RNA, 18 nt, Artificial Sequence
  Description of Artificial Sequence: Synthetic oligonucleotide
uccaguuugccugccccu

SEQ ID NO: 75061 - RNA, 18 nt, Artificial Sequence
  Description of Artificial Sequence: Synthetic oligonucleotide
uagguuccaguuugccug

SEQ ID NO: 75062 - RNA, 18 nt, Artificial Sequence
  Description of Artificial Sequence: Synthetic oligonucleotide
gccuguagguuccaguuu

SEQ ID NO: 75063 - RNA, 18 nt, Artificial Sequence
  Description of Artificial Sequence: Synthetic oligonucleotide
ucagugccuguagguucc

SEQ ID NO: 75064 - RNA, 18 nt, Artificial Sequence
  Description of Artificial Sequence: Synthetic oligonucleotide
aaaggucagugccuguag

SEQ ID NO: 75065 - RNA, 18 nt, Artificial Sequence
  Description of Artificial Sequence: Synthetic oligonucleotide
ucgacaaaggucagugcc

SEQ ID NO: 75066 - RNA, 18 nt, Artificial Sequence
  Description of Artificial Sequence: Synthetic oligonucleotide
ucuucucgacaaagguca

SEQ ID NO: 75067 - RNA, 18 nt, Artificial Sequence
  Description of Artificial Sequence: Synthetic oligonucleotide
uacacucuucucgacaaa

SEQ ID NO: 75068 - RNA, 18 nt, Artificial Sequence
  Description of Artificial Sequence: Synthetic oligonucleotide
aaggcuacacucuucucg

SEQ ID NO: 75069 - RNA, 18 nt, Artificial Sequence
  Description of Artificial Sequence: Synthetic oligonucleotide
cugggaaggcuacacucu

SEQ ID NO: 75070 - RNA, 18 nt, Artificial Sequence
  Description of Artificial Sequence: Synthetic oligonucleotide
ccauucugggaaggcuac

SEQ ID NO: 75071 - RNA, 18 nt, Artificial Sequence
  Description of Artificial Sequence: Synthetic oligonucleotide
uccucccauucugggaag

SEQ ID NO: 75072 - RNA, 18 nt, Artificial Sequence
  Description of Artificial Sequence: Synthetic oligonucleotide
ccugcuccucccauucug

SEQ ID NO: 75073 - RNA, 18 nt, Artificial Sequence
  Description of Artificial Sequence: Synthetic oligonucleotide
ucugcccugcuccuccca

SEQ ID NO: 75074 - RNA, 18 nt, Artificial Sequence
  Description of Artificial Sequence: Synthetic oligonucleotide
ccugcucugcccugcucc

SEQ ID NO: 75075 - RNA, 18 nt, Artificial Sequence
  Description of Artificial Sequence: Synthetic oligonucleotide
cuaccccugcucugcccu

SEQ ID NO: 75076 - RNA, 18 nt, Artificial Sequence
  Description of Artificial Sequence: Synthetic oligonucleotide
acccccuaccccugcucu

SEQ ID NO: 75077 - RNA, 18 nt, Artificial Sequence
  Description of Artificial Sequence: Synthetic oligonucleotide
accccacccccuaccccu

SEQ ID NO: 75078 - RNA, 18 nt, Artificial Sequence
  Description of Artificial Sequence: Synthetic oligonucleotide
ccagcaccccacccccua

SEQ ID NO: 75079 - RNA, 18 nt, Artificial Sequence
  Description of Artificial Sequence: Synthetic oligonucleotide
agaaaccagcaccccacc

SEQ ID NO: 75080 - RNA, 18 nt, Artificial Sequence
  Description of Artificial Sequence: Synthetic oligonucleotide
cccucagaaaccagcacc

SEQ ID NO: 75081 - RNA, 18 nt, Artificial Sequence
  Description of Artificial Sequence: Synthetic oligonucleotide
ucagucccucagaaacca

SEQ ID NO: 75082 - RNA, 18 nt, Artificial Sequence
  Description of Artificial Sequence: Synthetic oligonucleotide
agugaucagucccucaga

SEQ ID NO: 75083 - RNA, 18 nt, Artificial Sequence
  Description of Artificial Sequence: Synthetic oligonucleotide
aaguaagugaucaguccc

SEQ ID NO: 75084 - RNA, 18 nt, Artificial Sequence
  Description of Artificial Sequence: Synthetic oligonucleotide
ccaccaaguaagugauca

SEQ ID NO: 75085 - RNA, 18 nt, Artificial Sequence
  Description of Artificial Sequence: Synthetic oligonucleotide
guauuccaccaaguaagu

SEQ ID NO: 75086 - RNA, 18 nt, Artificial Sequence
  Description of Artificial Sequence: Synthetic oligonucleotide
gugcuguauuccaccaag

SEQ ID NO: 75087 - RNA, 18 nt, Artificial Sequence
  Description of Artificial Sequence: Synthetic oligonucleotide
gggcugugcuguauucca

SEQ ID NO: 75088 - RNA, 18 nt, Artificial Sequence
  Description of Artificial Sequence: Synthetic oligonucleotide
agccagggcugugcugua

SEQ ID NO: 75089 - RNA, 18 nt, Artificial Sequence
  Description of Artificial Sequence: Synthetic oligonucleotide
gggccagccagggcugug

SEQ ID NO: 75090 - RNA, 18 nt, Artificial Sequence
  Description of Artificial Sequence: Synthetic oligonucleotide
ccuuagggccagccaggg

SEQ ID NO: 75091 - RNA, 18 nt, Artificial Sequence
  Description of Artificial Sequence: Synthetic oligonucleotide
ccuuuccuuagggccagc

SEQ ID NO: 75092 - RNA, 18 nt, Artificial Sequence
  Description of Artificial Sequence: Synthetic oligonucleotide
uguccccuuuccuuaggg

SEQ ID NO: 75093 - RNA, 18 nt, Artificial Sequence
  Description of Artificial Sequence: Synthetic oligonucleotide
gcucauguccccuuuccu

SEQ ID NO: 75094 - RNA, 18 nt, Artificial Sequence
  Description of Artificial Sequence: Synthetic oligonucleotide
ccugggcucauguccccu

SEQ ID NO: 75095 - RNA, 18 nt, Artificial Sequence
  Description of Artificial Sequence: Synthetic oligonucleotide
uucucccugggcucaugu

SEQ ID NO: 75096 - RNA, 18 nt, Artificial Sequence
  Description of Artificial Sequence: Synthetic oligonucleotide
uuauuuucucccugggcu

SEQ ID NO: 75097 - RNA, 18 nt, Artificial Sequence
  Description of Artificial Sequence: Synthetic oligonucleotide
cucucuuauuuucucccu

SEQ ID NO: 75098 - RNA, 18 nt, Artificial Sequence
  Description of Artificial Sequence: Synthetic oligonucleotide
gcucccucucuuauuuuc

SEQ ID NO: 75099 - RNA, 18 nt, Artificial Sequence
  Description of Artificial Sequence: Synthetic oligonucleotide
gugcagcucccucucuua

SEQ ID NO: 75100 - RNA, 18 nt, Artificial Sequence
  Description of Artificial Sequence: Synthetic oligonucleotide
ccuaagugcagcucccuc

SEQ ID NO: 75101 - RNA, 18 nt, Artificial Sequence
  Description of Artificial Sequence: Synthetic oligonucleotide
uaagcccuaagugcagcu

SEQ ID NO: 75102 - RNA, 18 nt, Artificial Sequence
  Description of Artificial Sequence: Synthetic oligonucleotide
uuugcuaagcccuaagug

SEQ ID NO: 75103 - RNA, 18 nt, Artificial Sequence
  Description of Artificial Sequence: Synthetic oligonucleotide
cuguguuugcuaagcccu

SEQ ID NO: 75104 - RNA, 18 nt, Artificial Sequence
  Description of Artificial Sequence: Synthetic oligonucleotide
uacuacuguguuugcuaa

SEQ ID NO: 75105 - RNA, 18 nt, Artificial Sequence
  Description of Artificial Sequence: Synthetic oligonucleotide
caucuuacuacuguguuu

SEQ ID NO: 75106 - RNA, 18 nt, Artificial Sequence
  Description of Artificial Sequence: Synthetic oligonucleotide
guguccaucuuacuacug

SEQ ID NO: 75107 - RNA, 18 nt, Artificial Sequence
  Description of Artificial Sequence: Synthetic oligonucleotide
gggcuguguccaucuuac

SEQ ID NO: 75108 - RNA, 18 nt, Artificial Sequence
  Description of Artificial Sequence: Synthetic oligonucleotide
aaugaccagcuaagaaug

SEQ ID NO: 75109 - RNA, 18 nt, Artificial Sequence
  Description of Artificial Sequence: Synthetic oligonucleotide
cgaggaaugaccagcuaa

SEQ ID NO: 75110 - RNA, 18 nt, Artificial Sequence
  Description of Artificial Sequence: Synthetic oligonucleotide
gcuaacgaggaaugacca

SEQ ID NO: 75111 - RNA, 18 nt, Artificial Sequence
  Description of Artificial Sequence: Synthetic oligonucleotide
cuuaagcuaacgaggaau

SEQ ID NO: 75112 - RNA, 18 nt, Artificial Sequence
  Description of Artificial Sequence: Synthetic oligonucleotide
agaaccuuaagcuaacga

SEQ ID NO: 75113 - RNA, 18 nt, Artificial Sequence
  Description of Artificial Sequence: Synthetic oligonucleotide
gauucagaaccuuaagcu

SEQ ID NO: 75114 - RNA, 18 nt, Artificial Sequence
  Description of Artificial Sequence: Synthetic oligonucleotide
caccagauucagaaccuu

SEQ ID NO: 75115 - RNA, 18 nt, Artificial Sequence
  Description of Artificial Sequence: Synthetic oligonucleotide
cccagcaccagauucaga

SEQ ID NO: 75116 - RNA, 18 nt, Artificial Sequence
  Description of Artificial Sequence: Synthetic oligonucleotide
gcuuccccagcaccagau

SEQ ID NO: 75117 - RNA, 18 nt, Artificial Sequence
  Description of Artificial Sequence: Synthetic oligonucleotide
gcccagcuuccccagcac

SEQ ID NO: 75118 - RNA, 18 nt, Artificial Sequence
  Description of Artificial Sequence: Synthetic oligonucleotide
gccuggcccagcuucccc

SEQ ID NO: 75119 - RNA, 18 nt, Artificial Sequence
  Description of Artificial Sequence: Synthetic oligonucleotide
ggcuugccuggcccagcu

SEQ ID NO: 75120 - RNA, 18 nt, Artificial Sequence
  Description of Artificial Sequence: Synthetic oligonucleotide
gcccuggcuugccuggcc

SEQ ID NO: 75121 - RNA, 18 nt, Artificial Sequence
  Description of Artificial Sequence: Synthetic oligonucleotide
cuugcgcccuggcuugcc

SEQ ID NO: 75122 - RNA, 18 nt, Artificial Sequence
  Description of Artificial Sequence: Synthetic oligonucleotide
cucuccuugcgcccuggc

SEQ ID NO: 75123 - RNA, 18 nt, Artificial Sequence
  Description of Artificial Sequence: Synthetic oligonucleotide
uuacccucuccuugcgcc

SEQ ID NO: 75124 - RNA, 18 nt, Artificial Sequence
  Description of Artificial Sequence: Synthetic oligonucleotide
ucccauuacccucuccuu

SEQ ID NO: 75125 - RNA, 18 nt, Artificial Sequence
  Description of Artificial Sequence: Synthetic oligonucleotide
ccuccucccauuacccuc

SEQ ID NO: 75126 - RNA, 18 nt, Artificial Sequence
  Description of Artificial Sequence: Synthetic oligonucleotide
ugggcccuccucccauua

SEQ ID NO: 75127 - RNA, 18 nt, Artificial Sequence
  Description of Artificial Sequence: Synthetic oligonucleotide
augagugggcccuccucc

SEQ ID NO: 75128 - RNA, 18 nt, Artificial Sequence
  Description of Artificial Sequence: Synthetic oligonucleotide
ucaacaugagugggcccu

SEQ ID NO: 75129 - RNA, 18 nt, Artificial Sequence
  Description of Artificial Sequence: Synthetic oligonucleotide
gucugucaacaugagugg

SEQ ID NO: 75130 - RNA, 18 nt, Artificial Sequence
  Description of Artificial Sequence: Synthetic oligonucleotide
uguaggucugucaacaug

SEQ ID NO: 75131 - RNA, 18 nt, Artificial Sequence
  Description of Artificial Sequence: Synthetic oligonucleotide
uuuccuguaggucuguca

SEQ ID NO: 75132 - RNA, 18 nt, Artificial Sequence
  Description of Artificial Sequence: Synthetic oligonucleotide
ugggauuuccuguagguc

SEQ ID NO: 75133 - RNA, 18 nt, Artificial Sequence
  Description of Artificial Sequence: Synthetic oligonucleotide
aauauugggauuuccugu

SEQ ID NO: 75134 - RNA, 18 nt, Artificial Sequence
  Description of Artificial Sequence: Synthetic oligonucleotide
gauucaauauugggauuu

SEQ ID NO: 75135 - RNA, 18 nt, Artificial Sequence
  Description of Artificial Sequence: Synthetic oligonucleotide
caccugauucaauauugg

SEQ ID NO: 75136 - RNA, 18 nt, Artificial Sequence
  Description of Artificial Sequence: Synthetic oligonucleotide
gcuugcaccugauucaau

SEQ ID NO: 75137 - RNA, 18 nt, Artificial Sequence
  Description of Artificial Sequence: Synthetic oligonucleotide
aagaggcuugcaccugau

SEQ ID NO: 75138 - RNA, 18 nt, Artificial Sequence
  Description of Artificial Sequence: Synthetic oligonucleotide
gugcaaagaggcuugcac

SEQ ID NO: 75139 - RNA, 18 nt, Artificial Sequence
  Description of Artificial Sequence: Synthetic oligonucleotide
aaguugugcaaagaggcu

SEQ ID NO: 75140 - RNA, 18 nt, Artificial Sequence
  Description of Artificial Sequence: Synthetic oligonucleotide
uucacaaguugugcaaag

SEQ ID NO: 75141 - RNA, 18 nt, Artificial Sequence
  Description of Artificial Sequence: Synthetic oligonucleotide
ucuccuuuuugucaggac

SEQ ID NO: 75142 - RNA, 18 nt, Artificial Sequence
  Description of Artificial Sequence: Synthetic oligonucleotide
uggugucuccuuuuuguc

SEQ ID NO: 75143 - RNA, 18 nt, Artificial Sequence
  Description of Artificial Sequence: Synthetic oligonucleotide
gcauauggugucuccuuu

SEQ ID NO: 75144 - RNA, 18 nt, Artificial Sequence
  Description of Artificial Sequence: Synthetic oligonucleotide
agaaagcauauggugucu

SEQ ID NO: 75145 - RNA, 18 nt, Artificial Sequence
  Description of Artificial Sequence: Synthetic oligonucleotide
aagcaagaaagcauaugg

SEQ ID NO: 75146 - RNA, 18 nt, Artificial Sequence
  Description of Artificial Sequence: Synthetic oligonucleotide
aaagaaagcaagaaagca

SEQ ID NO: 75147 - RNA, 18 nt, Artificial Sequence
  Description of Artificial Sequence: Synthetic oligonucleotide
gaaagaaagaaagcaaga

SEQ ID NO: 75148 - RNA, 18 nt, Artificial Sequence
  Description of Artificial Sequence: Synthetic oligonucleotide
agaaagaaagaaagaaag

SEQ ID NO: 75149 - RNA, 18 nt, Artificial Sequence
  Description of Artificial Sequence: Synthetic oligonucleotide
aagaaagaaagaaagaaa

SEQ ID NO: 75150 - RNA, 18 nt, Artificial Sequence
  Description of Artificial Sequence: Synthetic oligonucleotide
aaagaaagaaagaaagaa

SEQ ID NO: 75151 - RNA, 18 nt, Artificial Sequence
  Description of Artificial Sequence: Synthetic oligonucleotide
aaaaaaaagaaagaaaga

SEQ ID NO: 75152 - RNA, 18 nt, Artificial Sequence
  Description of Artificial Sequence: Synthetic oligonucleotide
caaaaaaaaaaaagaaag

SEQ ID NO: 75153 - RNA, 18 nt, Artificial Sequence
  Description of Artificial Sequence: Synthetic oligonucleotide
cgucucaaaaaaaaaaaa

SEQ ID NO: 75154 - RNA, 18 nt, Artificial Sequence
  Description of Artificial Sequence: Synthetic oligonucleotide
aacuccgucucaaaaaaa

SEQ ID NO: 75155 - RNA, 18 nt, Artificial Sequence
  Description of Artificial Sequence: Synthetic oligonucleotide
agugaaacuccgucucaa

SEQ ID NO: 75156 - RNA, 18 nt, Artificial Sequence
  Description of Artificial Sequence: Synthetic oligonucleotide
auaagagugaaacuccgu

SEQ ID NO: 75157 - RNA, 18 nt, Artificial Sequence
  Description of Artificial Sequence: Synthetic oligonucleotide
gggcaauaagagugaaac

SEQ ID NO: 75158 - RNA, 18 nt, Artificial Sequence
  Description of Artificial Sequence: Synthetic oligonucleotide
agccugggcaauaagagu

SEQ ID NO: 75159 - RNA, 18 nt, Artificial Sequence
  Description of Artificial Sequence: Synthetic oligonucleotide
acuccagccugggcaaua

SEQ ID NO: 75160 - RNA, 18 nt, Artificial Sequence
  Description of Artificial Sequence: Synthetic oligonucleotide
auugcacuccagccuggg

SEQ ID NO: 75161 - RNA, 18 nt, Artificial Sequence
  Description of Artificial Sequence: Synthetic oligonucleotide
gcaccauugcacuccagc

SEQ ID NO: 75162 - RNA, 18 nt, Artificial Sequence
  Description of Artificial Sequence: Synthetic oligonucleotide
agaucgcaccauugcacu

SEQ ID NO: 75163 - RNA, 18 nt, Artificial Sequence
  Description of Artificial Sequence: Synthetic oligonucleotide
agccgagaucgcaccauu

SEQ ID NO: 75164 - RNA, 18 nt, Artificial Sequence
  Description of Artificial Sequence: Synthetic oligonucleotide
uggugagccgagaucgca

SEQ ID NO: 75165 - RNA, 18 nt, Artificial Sequence
  Description of Artificial Sequence: Synthetic oligonucleotide
gguuguggugagccgaga

SEQ ID NO: 75166 - RNA, 18 nt, Artificial Sequence
  Description of Artificial Sequence: Synthetic oligonucleotide
gcggagguuguggugagc

SEQ ID NO: 75167 - RNA, 18 nt, Artificial Sequence
  Description of Artificial Sequence: Synthetic oligonucleotide
gggaggcggagguugugg

SEQ ID NO: 75168 - RNA, 18 nt, Artificial Sequence
  Description of Artificial Sequence: Synthetic oligonucleotide
uaccugggaggcggaggu

SEQ ID NO: 75169 - RNA, 18 nt, Artificial Sequence
  Description of Artificial Sequence: Synthetic oligonucleotide
gcuuguaccugggaggcg

SEQ ID NO: 75170 - RNA, 18 nt, Artificial Sequence
  Description of Artificial Sequence: Synthetic oligonucleotide
gaaucgcuuguaccuggg

SEQ ID NO: 75171 - RNA, 18 nt, Artificial Sequence
  Description of Artificial Sequence: Synthetic oligonucleotide
caggagaaucgcuuguac

SEQ ID NO: 75172 - RNA, 18 nt, Artificial Sequence
  Description of Artificial Sequence: Synthetic oligonucleotide
ugagacaggagaaucgcu

SEQ ID NO: 75173 - RNA, 18 nt, Artificial Sequence
  Description of Artificial Sequence: Synthetic oligonucleotide
gaggcugagacaggagaa

SEQ ID NO: 75174 - RNA, 18 nt, Artificial Sequence
  Description of Artificial Sequence: Synthetic oligonucleotide
cuugggaggcugagacag

SEQ ID NO: 75175 - RNA, 18 nt, Artificial Sequence
  Description of Artificial Sequence: Synthetic oligonucleotide
agcuacuugggaggcuga

SEQ ID NO: 75176 - RNA, 18 nt, Artificial Sequence
  Description of Artificial Sequence: Synthetic oligonucleotide
auccaagcuacuugggag

SEQ ID NO: 75177 - RNA, 18 nt, Artificial Sequence
  Description of Artificial Sequence: Synthetic oligonucleotide
cuguaauccaagcuacuu

SEQ ID NO: 75178 - RNA, 18 nt, Artificial Sequence
  Description of Artificial Sequence: Synthetic oligonucleotide
caugccuguaauccaagc

SEQ ID NO: 75179 - RNA, 18 nt, Artificial Sequence
  Description of Artificial Sequence: Synthetic oligonucleotide
ugguucaugccuguaauc

SEQ ID NO: 75180 - RNA, 18 nt, Artificial Sequence
  Description of Artificial Sequence: Synthetic oligonucleotide
uguggugguucaugccug

SEQ ID NO: 75181 - RNA, 18 nt, Artificial Sequence
  Description of Artificial Sequence: Synthetic oligonucleotide
caggguguggugguucau

SEQ ID NO: 75182 - RNA, 18 nt, Artificial Sequence
  Description of Artificial Sequence: Synthetic oligonucleotide
acuagcaggguguggugg

SEQ ID NO: 75183 - RNA, 18 nt, Artificial Sequence
  Description of Artificial Sequence: Synthetic oligonucleotide
aaaaaacuagcagggugu

SEQ ID NO: 75184 - RNA, 18 nt, Artificial Sequence
  Description of Artificial Sequence: Synthetic oligonucleotide
auacaaaaaaacuagcag

SEQ ID NO: 75185 - RNA, 18 nt, Artificial Sequence
  Description of Artificial Sequence: Synthetic oligonucleotide
acgaaauacaaaaaaacu

SEQ ID NO: 75186 - RNA, 18 nt, Artificial Sequence
  Description of Artificial Sequence: Synthetic oligonucleotide
gcucuacgaaauacaaaa

SEQ ID NO: 75187 - RNA, 18 nt, Artificial Sequence
  Description of Artificial Sequence: Synthetic oligonucleotide
ccccggcucuacgaaaua

SEQ ID NO: 75188 - RNA, 18 nt, Artificial Sequence
  Description of Artificial Sequence: Synthetic oligonucleotide
ugaaaccccggcucuacg

SEQ ID NO: 75189 - RNA, 18 nt, Artificial Sequence
  Description of Artificial Sequence: Synthetic oligonucleotide
cauggugaaaccccggcu

SEQ ID NO: 75190 - RNA, 18 nt, Artificial Sequence
  Description of Artificial Sequence: Synthetic oligonucleotide
acuaacauggugaaaccc

SEQ ID NO: 75191 - RNA, 18 nt, Artificial Sequence
  Description of Artificial Sequence: Synthetic oligonucleotide
gccucacuaacaugguga

SEQ ID NO: 75192 - RNA, 18 nt, Artificial Sequence
  Description of Artificial Sequence: Synthetic oligonucleotide
caccagccucacuaacau

SEQ ID NO: 75193 - RNA, 18 nt, Artificial Sequence
  Description of Artificial Sequence: Synthetic oligonucleotide
uucgccaccagccucacu

SEQ ID NO: 75194 - RNA, 18 nt, Artificial Sequence
  Description of Artificial Sequence: Synthetic oligonucleotide
aggaguucgccaccagcc

SEQ ID NO: 75195 - RNA, 18 nt, Artificial Sequence
  Description of Artificial Sequence: Synthetic oligonucleotide
aggucaggaguucgccac

SEQ ID NO: 75196 - RNA, 18 nt, Artificial Sequence
  Description of Artificial Sequence: Synthetic oligonucleotide
accugaggucaggaguuc

SEQ ID NO: 75197 - RNA, 18 nt, Artificial Sequence
  Description of Artificial Sequence: Synthetic oligonucleotide
ggaucaccugaggucagg

SEQ ID NO: 75198 - RNA, 18 nt, Artificial Sequence
  Description of Artificial Sequence: Synthetic oligonucleotide
cggguggaucaccugagg

SEQ ID NO: 75199 - RNA, 18 nt, Artificial Sequence
  Description of Artificial Sequence: Synthetic oligonucleotide
caaggcggguggaucacc

SEQ ID NO: 75200 - RNA, 18 nt, Artificial Sequence
  Description of Artificial Sequence: Synthetic oligonucleotide
gaguccaaggcgggugga

SEQ ID NO: 75201 - RNA, 18 nt, Artificial Sequence
  Description of Artificial Sequence: Synthetic oligonucleotide
uuugggaguccaaggcgg

SEQ ID NO: 75202 - RNA, 18 nt, Artificial Sequence
  Description of Artificial Sequence: Synthetic oligonucleotide
agcacuuugggaguccaa

SEQ ID NO: 75203 - RNA, 18 nt, Artificial Sequence
  Description of Artificial Sequence: Synthetic oligonucleotide
aucccagcacuuugggag

SEQ ID NO: 75204 - RNA, 18 nt, Artificial Sequence
  Description of Artificial Sequence: Synthetic oligonucleotide
cuguaaucccagcacuuu

SEQ ID NO: 75205 - RNA, 18 nt, Artificial Sequence
  Description of Artificial Sequence: Synthetic oligonucleotide
caugccuguaaucccagc

SEQ ID NO: 75206 - RNA, 18 nt, Artificial Sequence
  Description of Artificial Sequence: Synthetic oligonucleotide
uggcucaugccuguaauc

SEQ ID NO: 75207 - RNA, 18 nt, Artificial Sequence
  Description of Artificial Sequence: Synthetic oligonucleotide
ugcaguggcucaugccug

SEQ ID NO: 75208 - RNA, 18 nt, Artificial Sequence
  Description of Artificial Sequence: Synthetic oligonucleotide
ccgggugcaguggcucau

SEQ ID NO: 75209 - RNA, 18 nt, Artificial Sequence
  Description of Artificial Sequence: Synthetic oligonucleotide
gugugccgggugcagugg

SEQ ID NO: 75210 - RNA, 18 nt, Artificial Sequence
  Description of Artificial Sequence: Synthetic oligonucleotide
auauggugugccgggugc

SEQ ID NO: 75211 - RNA, 18 nt, Artificial Sequence
  Description of Artificial Sequence: Synthetic oligonucleotide
aaagcauauggugugccg

SEQ ID NO: 75212 - RNA, 18 nt, Artificial Sequence
  Description of Artificial Sequence: Synthetic oligonucleotide
ugaugaaagcauauggug

SEQ ID NO: 75213 - RNA, 18 nt, Artificial Sequence
  Description of Artificial Sequence: Synthetic oligonucleotide
ucuugugaugaaagcaua

SEQ ID NO: 75214 - RNA, 18 nt, Artificial Sequence
  Description of Artificial Sequence: Synthetic oligonucleotide
cauuuucuugugaugaaa

SEQ ID NO: 75215 - RNA, 18 nt, Artificial Sequence
  Description of Artificial Sequence: Synthetic oligonucleotide
ucucacauuuucuuguga

SEQ ID NO: 75216 - RNA, 18 nt, Artificial Sequence
  Description of Artificial Sequence: Synthetic oligonucleotide
aauucucucacauuuucu

SEQ ID NO: 75217 - RNA, 18 nt, Artificial Sequence
  Description of Artificial Sequence: Synthetic oligonucleotide
cccugaauucucucacau

SEQ ID NO: 75218 - RNA, 18 nt, Artificial Sequence
  Description of Artificial Sequence: Synthetic oligonucleotide
caaagcccugaauucucu

SEQ ID NO: 75219 - RNA, 18 nt, Artificial Sequence
  Description of Artificial Sequence: Synthetic oligonucleotide
acugccaaagcccugaau

SEQ ID NO: 75220 - RNA, 18 nt, Artificial Sequence
  Description of Artificial Sequence: Synthetic oligonucleotide
cuggaacugccaaagccc

SEQ ID NO: 75221 - RNA, 18 nt, Artificial Sequence
  Description of Artificial Sequence: Synthetic oligonucleotide
ccagccuggaacugccaa

SEQ ID NO: 75222 - RNA, 18 nt, Artificial Sequence
  Description of Artificial Sequence: Synthetic oligonucleotide
gcugaccagccuggaacu

SEQ ID NO: 75223 - RNA, 18 nt, Artificial Sequence
  Description of Artificial Sequence: Synthetic oligonucleotide
gagaugcugaccagccug

SEQ ID NO: 75224 - RNA, 18 nt, Artificial Sequence
  Description of Artificial Sequence: Synthetic oligonucleotide
ggcuugagaugcugacca

SEQ ID NO: 75225 - RNA, 18 nt, Artificial Sequence
  Description of Artificial Sequence: Synthetic oligonucleotide
gggagggcuugagaugcu

SEQ ID NO: 75226 - RNA, 18 nt, Artificial Sequence
  Description of Artificial Sequence: Synthetic oligonucleotide
gggugaacagaugcuggg

SEQ ID NO: 75227 - RNA, 18 nt, Artificial Sequence
  Description of Artificial Sequence: Synthetic oligonucleotide
ggcagggugaacagaugc

SEQ ID NO: 75228 - RNA, 18 nt, Artificial Sequence
  Description of Artificial Sequence: Synthetic oligonucleotide
ugccuggcagggugaaca

SEQ ID NO: 75229 - RNA, 18 nt, Artificial Sequence
  Description of Artificial Sequence: Synthetic oligonucleotide
gagacugccuggcagggu

SEQ ID NO: 75230 - RNA, 18 nt, Artificial Sequence
  Description of Artificial Sequence: Synthetic oligonucleotide
aggaagagacugccuggc

SEQ ID NO: 75231 - RNA, 18 nt, Artificial Sequence
  Description of Artificial Sequence: Synthetic oligonucleotide
uuucuaggaagagacugc

SEQ ID NO: 75232 - RNA, 18 nt, Artificial Sequence
  Description of Artificial Sequence: Synthetic oligonucleotide
ccaaguuucuaggaagag

SEQ ID NO: 75233 - RNA, 18 nt, Artificial Sequence
  Description of Artificial Sequence: Synthetic oligonucleotide
uuuaaccaaguuucuagg

SEQ ID NO: 75234 - RNA, 18 nt, Artificial Sequence
  Description of Artificial Sequence: Synthetic oligonucleotide
gaacauuuaaccaaguuu

SEQ ID NO: 75235 - RNA, 18 nt, Artificial Sequence
  Description of Artificial Sequence: Synthetic oligonucleotide
agagugaacauuuaacca

SEQ ID NO: 75236 - RNA, 18 nt, Artificial Sequence
  Description of Artificial Sequence: Synthetic oligonucleotide
caagggugaagaaucuau

SEQ ID NO: 75237 - RNA, 18 nt, Artificial Sequence
  Description of Artificial Sequence: Synthetic oligonucleotide
cgggccaagggugaagaa

SEQ ID NO: 75238 - RNA, 18 nt, Artificial Sequence
  Description of Artificial Sequence: Synthetic oligonucleotide
aaaggcgggccaagggug

SEQ ID NO: 75239 - RNA, 18 nt, Artificial Sequence
  Description of Artificial Sequence: Synthetic oligonucleotide
gggcaaaggcgggccaag

SEQ ID NO: 75240 - RNA, 18 nt, Artificial Sequence
  Description of Artificial Sequence: Synthetic oligonucleotide
ugggcagaguaggguggg

SEQ ID NO: 75241 - RNA, 18 nt, Artificial Sequence
  Description of Artificial Sequence: Synthetic oligonucleotide
acuucugggcagaguagg

SEQ ID NO: 75242 - RNA, 18 nt, Artificial Sequence
  Description of Artificial Sequence: Synthetic oligonucleotide
cuugcacuucugggcaga

SEQ ID NO: 75243 - RNA, 18 nt, Artificial Sequence
  Description of Artificial Sequence: Synthetic oligonucleotide
aggcucuugcacuucugg

SEQ ID NO: 75244 - RNA, 18 nt, Artificial Sequence
  Description of Artificial Sequence: Synthetic oligonucleotide
ggcuuaggcucuugcacu

SEQ ID NO: 75245 - RNA, 18 nt, Artificial Sequence
  Description of Artificial Sequence: Synthetic oligonucleotide
gaggcggcuuaggcucuu

SEQ ID NO: 75246 - RNA, 18 nt, Artificial Sequence
  Description of Artificial Sequence: Synthetic oligonucleotide
ccauggaggcggcuuagg

SEQ ID NO: 75247 - RNA, 18 nt, Artificial Sequence
  Description of Artificial Sequence: Synthetic oligonucleotide
gggccauggaggcggcuu

SEQ ID NO: 75248 - RNA, 18 nt, Artificial Sequence
  Description of Artificial Sequence: Synthetic oligonucleotide
cccugaauccuuccuggg

SEQ ID NO: 75249 - RNA, 18 nt, Artificial Sequence
  Description of Artificial Sequence: Synthetic oligonucleotide
cucuccccugaauccuuc

SEQ ID NO: 75250 - RNA, 18 nt, Artificial Sequence
  Description of Artificial Sequence: Synthetic oligonucleotide
gggccucuccccugaauc

SEQ ID NO: 75251 - RNA, 18 nt, Artificial Sequence
  Description of Artificial Sequence: Synthetic oligonucleotide
cguggcucccuguuuggg

SEQ ID NO: 75252 - RNA, 18 nt, Artificial Sequence
  Description of Artificial Sequence: Synthetic oligonucleotide
gcuggcguggcucccugu

SEQ ID NO: 75253 - RNA, 18 nt, Artificial Sequence
  Description of Artificial Sequence: Synthetic oligonucleotide
gucuggcuggcguggcuc

SEQ ID NO: 75254 - RNA, 18 nt, Artificial Sequence
  Description of Artificial Sequence: Synthetic oligonucleotide
gggugucuggcuggcgug

SEQ ID NO: 75255 - RNA, 18 nt, Artificial Sequence
  Description of Artificial Sequence: Synthetic oligonucleotide
agcuccauucuggccggg

SEQ ID NO: 75256 - RNA, 18 nt, Artificial Sequence
  Description of Artificial Sequence: Synthetic oligonucleotide
cagucagcuccauucugg

SEQ ID NO: 75257 - RNA, 18 nt, Artificial Sequence
  Description of Artificial Sequence: Synthetic oligonucleotide
aagggugaagaaucuauc

SEQ ID NO: 75258 - RNA, 18 nt, Artificial Sequence
  Description of Artificial Sequence: Synthetic oligonucleotide
gggccaagggugaagaau

SEQ ID NO: 75259 - RNA, 18 nt, Artificial Sequence
  Description of Artificial Sequence: Synthetic oligonucleotide
aaggcgggccaaggguga

SEQ ID NO: 75260 - RNA, 18 nt, Artificial Sequence
  Description of Artificial Sequence: Synthetic oligonucleotide
gggcaaaggcgggccaag

SEQ ID NO: 75261 - RNA, 18 nt, Artificial Sequence
  Description of Artificial Sequence: Synthetic oligonucleotide
ugggcagaguaggguggg

SEQ ID NO: 75262 - RNA, 18 nt, Artificial Sequence
  Description of Artificial Sequence: Synthetic oligonucleotide
uucugggcagaguagggu

SEQ ID NO: 75263 - RNA, 18 nt, Artificial Sequence
  Description of Artificial Sequence: Synthetic oligonucleotide
ugcacuucugggcagagu

SEQ ID NO: 75264 - RNA, 18 nt, Artificial Sequence
  Description of Artificial Sequence: Synthetic oligonucleotide
gcucuugcacuucugggc

SEQ ID NO: 75265 - RNA, 18 nt, Artificial Sequence
  Description of Artificial Sequence: Synthetic oligonucleotide
cuuaggcucuugcacuuc

SEQ ID NO: 75266 - RNA, 18 nt, Artificial Sequence
  Description of Artificial Sequence: Synthetic oligonucleotide
ggcggcuuaggcucuugc

SEQ ID NO: 75267 - RNA, 18 nt, Artificial Sequence
  Description of Artificial Sequence: Synthetic oligonucleotide
auggaggcggcuuaggcu

SEQ ID NO: 75268 - RNA, 18 nt, Artificial Sequence
  Description of Artificial Sequence: Synthetic oligonucleotide
gggccauggaggcggcuu

SEQ ID NO: 75269 - RNA, 18 nt, Artificial Sequence
  Description of Artificial Sequence: Synthetic oligonucleotide
cccugaauccuuccuggg

SEQ ID NO: 75270 - RNA, 18 nt, Artificial Sequence
  Description of Artificial Sequence: Synthetic oligonucleotide
ucuccccugaauccuucc

SEQ ID NO: 75271 - RNA, 18 nt, Artificial Sequence
  Description of Artificial Sequence: Synthetic oligonucleotide
gggccucuccccugaauc

SEQ ID NO: 75272 - RNA, 18 nt, Artificial Sequence
  Description of Artificial Sequence: Synthetic oligonucleotide
cguggcucccuguuuggg

SEQ ID NO: 75273 - RNA, 18 nt, Artificial Sequence
  Description of Artificial Sequence: Synthetic oligonucleotide
cuggcguggcucccuguu

SEQ ID NO: 75274 - RNA, 18 nt, Artificial Sequence
  Description of Artificial Sequence: Synthetic oligonucleotide
ucuggcuggcguggcucc

SEQ ID NO: 75275 - RNA, 18 nt, Artificial Sequence
  Description of Artificial Sequence: Synthetic oligonucleotide
gggugucuggcuggcgug

SEQ ID NO: 75276 - RNA, 18 nt, Artificial Sequence
  Description of Artificial Sequence: Synthetic oligonucleotide
agcuccauucuggccggg

SEQ ID NO: 75277 - RNA, 18 nt, Artificial Sequence
  Description of Artificial Sequence: Synthetic oligonucleotide
ucagcuccauucuggccg

SEQ ID NO: 75278 - RNA, 18 nt, Artificial Sequence
  Description of Artificial Sequence: Synthetic oligonucleotide
uagccccucagguguguu

SEQ ID NO: 75279 - RNA, 18 nt, Artificial Sequence
  Description of Artificial Sequence: Synthetic oligonucleotide
ggcccuagccccucaggu

SEQ ID NO: 75280 - RNA, 18 nt, Artificial Sequence
  Description of Artificial Sequence: Synthetic oligonucleotide
cauauggcccuagccccu

SEQ ID NO: 75281 - RNA, 18 nt, Artificial Sequence
  Description of Artificial Sequence: Synthetic oligonucleotide
guuuccauauggcccuag

SEQ ID NO: 75282 - RNA, 18 nt, Artificial Sequence
  Description of Artificial Sequence: Synthetic oligonucleotide
gucauguuuccauauggc

SEQ ID NO: 75283 - RNA, 18 nt, Artificial Sequence
  Description of Artificial Sequence: Synthetic oligonucleotide
cuucugucauguuuccau

SEQ ID NO: 75284 - RNA, 18 nt, Artificial Sequence
  Description of Artificial Sequence: Synthetic oligonucleotide
cuccccuucugucauguu

SEQ ID NO: 75285 - RNA, 18 nt, Artificial Sequence
  Description of Artificial Sequence: Synthetic oligonucleotide
ucucucuccccuucuguc

SEQ ID NO: 75286 - RNA, 18 nt, Artificial Sequence
  Description of Artificial Sequence: Synthetic oligonucleotide
uccuuucucucuccccuu

SEQ ID NO: 75287 - RNA, 18 nt, Artificial Sequence
  Description of Artificial Sequence: Synthetic oligonucleotide
gugucuccuuucucucuc

SEQ ID NO: 75288 - RNA, 18 nt, Artificial Sequence
  Description of Artificial Sequence: Synthetic oligonucleotide
gcagcgugucuccuuucu

SEQ ID NO: 75289 - RNA, 18 nt, Artificial Sequence
  Description of Artificial Sequence: Synthetic oligonucleotide
ccccugcagcgugucucc

SEQ ID NO: 75290 - RNA, 18 nt, Artificial Sequence
  Description of Artificial Sequence: Synthetic oligonucleotide
ccugcccccugcagcgug

SEQ ID NO: 75291 - RNA, 18 nt, Artificial Sequence
  Description of Artificial Sequence: Synthetic oligonucleotide
agcuuccugcccccugca

SEQ ID NO: 75292 - RNA, 18 nt, Artificial Sequence
  Description of Artificial Sequence: Synthetic oligonucleotide
cccccagcuuccugcccc

SEQ ID NO: 75293 - RNA, 18 nt, Artificial Sequence
  Description of Artificial Sequence: Synthetic oligonucleotide
ggguucccccagcuuccu

SEQ ID NO: 75294 - RNA, 18 nt, Artificial Sequence
  Description of Artificial Sequence: Synthetic oligonucleotide
agaauggguucccccagc

SEQ ID NO: 75295 - RNA, 18 nt, Artificial Sequence
  Description of Artificial Sequence: Synthetic oligonucleotide
uugggagaauggguuccc

SEQ ID NO: 75296 - RNA, 18 nt, Artificial Sequence
  Description of Artificial Sequence: Synthetic oligonucleotide
uauuuuugggagaauggg

SEQ ID NO: 75297 - RNA, 18 nt, Artificial Sequence
  Description of Artificial Sequence: Synthetic oligonucleotide
ccccuuauuuuugggaga

SEQ ID NO: 75298 - RNA, 18 nt, Artificial Sequence
  Description of Artificial Sequence: Synthetic oligonucleotide
ucagaccccuuauuuuug

SEQ ID NO: 75299 - RNA, 18 nt, Artificial Sequence
  Description of Artificial Sequence: Synthetic oligonucleotide
accccucagaccccuuau

SEQ ID NO: 75300 - RNA, 18 nt, Artificial Sequence
  Description of Artificial Sequence: Synthetic oligonucleotide
aauccaccccucagaccc

SEQ ID NO: 75301 - RNA, 18 nt, Artificial Sequence
  Description of Artificial Sequence: Synthetic oligonucleotide
cagggaauccaccccuca

SEQ ID NO: 75302 - RNA, 18 nt, Artificial Sequence
  Description of Artificial Sequence: Synthetic oligonucleotide
aaacccagggaauccacc

SEQ ID NO: 75303 - RNA, 18 nt, Artificial Sequence
  Description of Artificial Sequence: Synthetic oligonucleotide
gggagaauggguuccccc

SEQ ID NO: 75304 - RNA, 18 nt, Artificial Sequence
  Description of Artificial Sequence: Synthetic oligonucleotide
uuuuugggagaauggguu

SEQ ID NO: 75305 - RNA, 18 nt, Artificial Sequence
  Description of Artificial Sequence: Synthetic oligonucleotide
ccuuauuuuugggagaau

SEQ ID NO: 75306 - RNA, 18 nt, Artificial Sequence
  Description of Artificial Sequence: Synthetic oligonucleotide
agaccccuuauuuuuggg

SEQ ID NO: 75307 - RNA, 18 nt, Artificial Sequence
  Description of Artificial Sequence: Synthetic oligonucleotide
cccucagaccccuuauuu

SEQ ID NO: 75308 - RNA, 18 nt, Artificial Sequence
  Description of Artificial Sequence: Synthetic oligonucleotide
uccaccccucagaccccu

SEQ ID NO: 75309 - RNA, 18 nt, Artificial Sequence
  Description of Artificial Sequence: Synthetic oligonucleotide
gggaauccaccccucaga

SEQ ID NO: 75310 - RNA, 18 nt, Artificial Sequence
  Description of Artificial Sequence: Synthetic oligonucleotide
acccagggaauccacccc

SEQ ID NO: 75311 - RNA, 18 nt, Artificial Sequence
  Description of Artificial Sequence: Synthetic oligonucleotide
cugaaacccagggaaucc

SEQ ID NO: 75312 - RNA, 18 nt, Artificial Sequence
  Description of Artificial Sequence: Synthetic oligonucleotide
cagaccugaaacccaggg

SEQ ID NO: 75313 - RNA, 18 nt, Artificial Sequence
  Description of Artificial Sequence: Synthetic oligonucleotide
ggacccagaccugaaacc

SEQ ID NO: 75314 - RNA, 18 nt, Artificial Sequence
  Description of Artificial Sequence: Synthetic oligonucleotide
auucaggacccagaccug

SEQ ID NO: 75315 - RNA, 18 nt, Artificial Sequence
  Description of Artificial Sequence: Synthetic oligonucleotide
uucccauucaggacccag

SEQ ID NO: 75316 - RNA, 18 nt, Artificial Sequence
  Description of Artificial Sequence: Synthetic oligonucleotide
aggaauucccauucagga

SEQ ID NO: 75317 - RNA, 18 nt, Artificial Sequence
  Description of Artificial Sequence: Synthetic oligonucleotide
auuccaggaauucccauu

SEQ ID NO: 75318 - RNA, 18 nt, Artificial Sequence
  Description of Artificial Sequence: Synthetic oligonucleotide
cugguauuccaggaauuc

SEQ ID NO: 75319 - RNA, 18 nt, Artificial Sequence
  Description of Artificial Sequence: Synthetic oligonucleotide
gucagcugguauuccagg

SEQ ID NO: 75320 - RNA, 18 nt, Artificial Sequence
  Description of Artificial Sequence: Synthetic oligonucleotide
ucauugucagcugguauu

SEQ ID NO: 75321 - RNA, 18 nt, Artificial Sequence
  Description of Artificial Sequence: Synthetic oligonucleotide
ggaaaucauugucagcug

SEQ ID NO: 75322 - RNA, 18 nt, Artificial Sequence
  Description of Artificial Sequence: Synthetic oligonucleotide
gaggaggaaaucauuguc

SEQ ID NO: 75323 - RNA, 18 nt, Artificial Sequence
  Description of Artificial Sequence: Synthetic oligonucleotide
aagaugaggaggaaauca

SEQ ID NO: 75324 - RNA, 18 nt, Artificial Sequence
  Description of Artificial Sequence: Synthetic oligonucleotide
guugaaagaugaggagga

SEQ ID NO: 75325 - RNA, 18 nt, Artificial Sequence
  Description of Artificial Sequence: Synthetic oligonucleotide
gugagguugaaagaugag

SEQ ID NO: 75326 - RNA, 18 nt, Artificial Sequence
  Description of Artificial Sequence: Synthetic oligonucleotide
augaccacgaggagcaau

SEQ ID NO: 75327 - RNA, 18 nt, Artificial Sequence
  Description of Artificial Sequence: Synthetic oligonucleotide
gaagcaugaccacgagga

SEQ ID NO: 75328 - RNA, 18 nt, Artificial Sequence
  Description of Artificial Sequence: Synthetic oligonucleotide
uaggagaagcaugaccac

SEQ ID NO: 75329 - RNA, 18 nt, Artificial Sequence
  Description of Artificial Sequence: Synthetic oligonucleotide
gcaguuaggagaagcaug

SEQ ID NO: 75330 - RNA, 18 nt, Artificial Sequence
  Description of Artificial Sequence: Synthetic oligonucleotide
gccuugcaguuaggagaa

SEQ ID NO: 75331 - RNA, 18 nt, Artificial Sequence
  Description of Artificial Sequence: Synthetic oligonucleotide
cguuagccuugcaguuag

SEQ ID NO: 75332 - RNA, 18 nt, Artificial Sequence
  Description of Artificial Sequence: Synthetic oligonucleotide
gacagcguuagccuugca

SEQ ID NO: 75333 - RNA, 18 nt, Artificial Sequence
  Description of Artificial Sequence: Synthetic oligonucleotide
ggcuggacagcguuagcc

SEQ ID NO: 75334 - RNA, 18 nt, Artificial Sequence
  Description of Artificial Sequence: Synthetic oligonucleotide
agccgggcuggacagcgu

SEQ ID NO: 75335 - RNA, 18 nt, Artificial Sequence
  Description of Artificial Sequence: Synthetic oligonucleotide
ggaggagccgggcuggac

SEQ ID NO: 75336 - RNA, 18 nt, Artificial Sequence
  Description of Artificial Sequence: Synthetic oligonucleotide
aagcaggaggagccgggc

SEQ ID NO: 75337 - RNA, 18 nt, Artificial Sequence
  Description of Artificial Sequence: Synthetic oligonucleotide
gucacaagcaggaggagc

SEQ ID NO: 75338 - RNA, 18 nt, Artificial Sequence
  Description of Artificial Sequence: Synthetic oligonucleotide
cggaggucacaagcagga

SEQ ID NO: 75339 - RNA, 18 nt, Artificial Sequence
  Description of Artificial Sequence: Synthetic oligonucleotide
ggacucggaggucacaag

SEQ ID NO: 75340 - RNA, 18 nt, Artificial Sequence
  Description of Artificial Sequence: Synthetic oligonucleotide
acugaggacucggagguc

SEQ ID NO: 75341 - RNA, 18 nt, Artificial Sequence
  Description of Artificial Sequence: Synthetic oligonucleotide
aguuuacugaggacucgg

SEQ ID NO: 75342 - RNA, 18 nt, Artificial Sequence
  Description of Artificial Sequence: Synthetic oligonucleotide
gaagcaguuuacugagga

SEQ ID NO: 75343 - RNA, 18 nt, Artificial Sequence
  Description of Artificial Sequence: Synthetic oligonucleotide
gucacgaagcaguuuacu

SEQ ID NO: 75344 - RNA, 18 nt, Artificial Sequence
  Description of Artificial Sequence: Synthetic oligonucleotide
ugggagucacgaagcagu

SEQ ID NO: 75345 - RNA, 18 nt, Artificial Sequence
  Description of Artificial Sequence: Synthetic oligonucleotide
ggacaugggagucacgaa

SEQ ID NO: 75346 - RNA, 18 nt, Artificial Sequence
  Description of Artificial Sequence: Synthetic oligonucleotide
gugaaggacaugggaguc

SEQ ID NO: 75347 - RNA, 18 nt, Artificial Sequence
  Description of Artificial Sequence: Synthetic oligonucleotide
cugcugugaaggacaugg

SEQ ID NO: 75348 - RNA, 18 nt, Artificial Sequence
  Description of Artificial Sequence: Synthetic oligonucleotide
caugaccacgaggagcaa

SEQ ID NO: 75349 - RNA, 18 nt, Artificial Sequence
  Description of Artificial Sequence: Synthetic oligonucleotide
agaagcaugaccacgagg

SEQ ID NO: 75350 - RNA, 18 nt, Artificial Sequence
  Description of Artificial Sequence: Synthetic oligonucleotide
uuaggagaagcaugacca

SEQ ID NO: 75351 - RNA, 18 nt, Artificial Sequence
  Description of Artificial Sequence: Synthetic oligonucleotide
ugcaguuaggagaagcau

SEQ ID NO: 75352 - RNA, 18 nt, Artificial Sequence
  Description of Artificial Sequence: Synthetic oligonucleotide
agccuugcaguuaggaga

SEQ ID NO: 75353 - RNA, 18 nt, Artificial Sequence
  Description of Artificial Sequence: Synthetic oligonucleotide
gcguuagccuugcaguua

SEQ ID NO: 75354 - RNA, 18 nt, Artificial Sequence
  Description of Artificial Sequence: Synthetic oligonucleotide
ggacagcguuagccuugc

SEQ ID NO: 75355 - RNA, 18 nt, Artificial Sequence
  Description of Artificial Sequence: Synthetic oligonucleotide
gggcuggacagcguuagc

SEQ ID NO: 75356 - RNA, 18 nt, Artificial Sequence
  Description of Artificial Sequence: Synthetic oligonucleotide
gagccgggcuggacagcg

SEQ ID NO: 75357 - RNA, 18 nt, Artificial Sequence
  Description of Artificial Sequence: Synthetic oligonucleotide
aggaggagccgggcugga

SEQ ID NO: 75358 - RNA, 18 nt, Artificial Sequence
  Description of Artificial Sequence: Synthetic oligonucleotide
caagcaggaggagccggg

SEQ ID NO: 75359 - RNA, 18 nt, Artificial Sequence
  Description of Artificial Sequence: Synthetic oligonucleotide
ggucacaagcaggaggag

SEQ ID NO: 75360 - RNA, 18 nt, Artificial Sequence
  Description of Artificial Sequence: Synthetic oligonucleotide
ucggaggucacaagcagg

SEQ ID NO: 75361 - RNA, 18 nt, Artificial Sequence
  Description of Artificial Sequence: Synthetic oligonucleotide
aggacucggaggucacaa

SEQ ID NO: 75362 - RNA, 18 nt, Artificial Sequence
  Description of Artificial Sequence: Synthetic oligonucleotide
uacugaggacucggaggu

SEQ ID NO: 75363 - RNA, 18 nt, Artificial Sequence
  Description of Artificial Sequence: Synthetic oligonucleotide
caguuuacugaggacucg

SEQ ID NO: 75364 - RNA, 18 nt, Artificial Sequence
  Description of Artificial Sequence: Synthetic oligonucleotide
cgaagcaguuuacugagg

SEQ ID NO: 75365 - RNA, 18 nt, Artificial Sequence
  Description of Artificial Sequence: Synthetic oligonucleotide
agucacgaagcaguuuac

SEQ ID NO: 75366 - RNA, 18 nt, Artificial Sequence
  Description of Artificial Sequence: Synthetic oligonucleotide
augggagucacgaagcag

SEQ ID NO: 75367 - RNA, 18 nt, Artificial Sequence
  Description of Artificial Sequence: Synthetic oligonucleotide
aggacaugggagucacga

SEQ ID NO: 75368 - RNA, 18 nt, Artificial Sequence
  Description of Artificial Sequence: Synthetic oligonucleotide
ugugaaggacaugggagu

SEQ ID NO: 75369 - RNA, 18 nt, Artificial Sequence
  Description of Artificial Sequence: Synthetic oligonucleotide
ucugcugugaaggacaug

SEQ ID NO: 75370 - RNA, 18 nt, Artificial Sequence
  Description of Artificial Sequence: Synthetic oligonucleotide
gggauaauguugggaguu

SEQ ID NO: 75371 - RNA, 18 nt, Artificial Sequence
  Description of Artificial Sequence: Synthetic oligonucleotide
uaccaguuacgcggauaa

SEQ ID NO: 75372 - RNA, 18 nt, Artificial Sequence
  Description of Artificial Sequence: Synthetic oligonucleotide
ugucuuaccaguuacgcg

SEQ ID NO: 75373 - RNA, 18 nt, Artificial Sequence
  Description of Artificial Sequence: Synthetic oligonucleotide
augggugucuuaccaguu

SEQ ID NO: 75374 - RNA, 18 nt, Artificial Sequence
  Description of Artificial Sequence: Synthetic oligonucleotide
ggaguaugggugucuuac

SEQ ID NO: 75375 - RNA, 18 nt, Artificial Sequence
  Description of Artificial Sequence: Synthetic oligonucleotide
uccugggaguaugggugu

SEQ ID NO: 75376 - RNA, 18 nt, Artificial Sequence
  Description of Artificial Sequence: Synthetic oligonucleotide
ugucuuccugggaguaug

SEQ ID NO: 75377 - RNA, 18 nt, Artificial Sequence
  Description of Artificial Sequence: Synthetic oligonucleotide
gauggugucuuccuggga

SEQ ID NO: 75378 - RNA, 18 nt, Artificial Sequence
  Description of Artificial Sequence: Synthetic oligonucleotide
gaagugauggugucuucc

SEQ ID NO: 75379 - RNA, 18 nt, Artificial Sequence
  Description of Artificial Sequence: Synthetic oligonucleotide
uagaggaagugauggugu

SEQ ID NO: 75380 - RNA, 18 nt, Artificial Sequence
  Description of Artificial Sequence: Synthetic oligonucleotide
ggaguuagaggaagugau

SEQ ID NO: 75381 - RNA, 18 nt, Artificial Sequence
  Description of Artificial Sequence: Synthetic oligonucleotide
gucaaggaguuagaggaa

SEQ ID NO: 75382 - RNA, 18 nt, Artificial Sequence
  Description of Artificial Sequence: Synthetic oligonucleotide
auugggucaaggaguuag

SEQ ID NO: 75383 - RNA, 18 nt, Artificial Sequence
  Description of Artificial Sequence: Synthetic oligonucleotide
uagucauugggucaagga

SEQ ID NO: 75384 - RNA, 18 nt, Artificial Sequence
  Description of Artificial Sequence: Synthetic oligonucleotide
aagaauagucauuggguc

SEQ ID NO: 75385 - RNA, 18 nt, Artificial Sequence
  Description of Artificial Sequence: Synthetic oligonucleotide
augggaagaauagucauu

SEQ ID NO: 75386 - RNA, 18 nt, Artificial Sequence
  Description of Artificial Sequence: Synthetic oligonucleotide
acaauaugggaagaauag

SEQ ID NO: 75387 - RNA, 18 nt, Artificial Sequence
  Description of Artificial Sequence: Synthetic oligonucleotide
gggacaauaugggaagaa

SEQ ID NO: 75388 - RNA, 18 nt, Artificial Sequence
  Description of Artificial Sequence: Synthetic oligonucleotide
gugugaucaguagguggg

SEQ ID NO: 75389 - RNA, 18 nt, Artificial Sequence
  Description of Artificial Sequence: Synthetic oligonucleotide
agagagugugaucaguag

SEQ ID NO: 75390 - RNA, 18 nt, Artificial Sequence
  Description of Artificial Sequence: Synthetic oligonucleotide
uugucagagagugugauc

SEQ ID NO: 75391 - RNA, 18 nt, Artificial Sequence
  Description of Artificial Sequence: Synthetic oligonucleotide
aauccuugucagagagug

SEQ ID NO: 75392 - RNA, 18 nt, Artificial Sequence
  Description of Artificial Sequence: Synthetic oligonucleotide
agaauaauccuugucaga

SEQ ID NO: 75393 - RNA, 18 nt, Artificial Sequence
  Description of Artificial Sequence: Synthetic oligonucleotide
ugugaagaauaauccuug

SEQ ID NO: 75394 - RNA, 18 nt, Artificial Sequence
  Description of Artificial Sequence: Synthetic oligonucleotide
uguauugugaagaauaau

SEQ ID NO: 75395 - RNA, 18 nt, Artificial Sequence
  Description of Artificial Sequence: Synthetic oligonucleotide
cgggcuguauugugaaga

SEQ ID NO: 75396 - RNA, 18 nt, Artificial Sequence
  Description of Artificial Sequence: Synthetic oligonucleotide
gugugaucaguagguggg

SEQ ID NO: 75397 - RNA, 18 nt, Artificial Sequence
  Description of Artificial Sequence: Synthetic oligonucleotide
gagagugugaucaguagg

SEQ ID NO: 75398 - RNA, 18 nt, Artificial Sequence
  Description of Artificial Sequence: Synthetic oligonucleotide
ugucagagagugugauca

SEQ ID NO: 75399 - RNA, 18 nt, Artificial Sequence
  Description of Artificial Sequence: Synthetic oligonucleotide
auccuugucagagagugu

SEQ ID NO: 75400 - RNA, 18 nt, Artificial Sequence
  Description of Artificial Sequence: Synthetic oligonucleotide
gaauaauccuugucagag

SEQ ID NO: 75401 - RNA, 18 nt, Artificial Sequence
  Description of Artificial Sequence: Synthetic oligonucleotide
gugaagaauaauccuugu

SEQ ID NO: 75402 - RNA, 18 nt, Artificial Sequence
  Description of Artificial Sequence: Synthetic oligonucleotide
guauugugaagaauaauc

SEQ ID NO: 75403 - RNA, 18 nt, Artificial Sequence
  Description of Artificial Sequence: Synthetic oligonucleotide
gggcuguauugugaagaa

SEQ ID NO: 75404 - RNA, 18 nt, Artificial Sequence
  Description of Artificial Sequence: Synthetic oligonucleotide
aaugcgggcuguauugug

SEQ ID NO: 75405 - RNA, 18 nt, Artificial Sequence
  Description of Artificial Sequence: Synthetic oligonucleotide
uuuuaaaugcgggcugua

SEQ ID NO: 75406 - RNA, 18 nt, Artificial Sequence
  Description of Artificial Sequence: Synthetic oligonucleotide
agagcuuuuaaaugcggg

SEQ ID NO: 75407 - RNA, 18 nt, Artificial Sequence
  Description of Artificial Sequence: Synthetic oligonucleotide
agacgagagcuuuuaaau

SEQ ID NO: 75408 - RNA, 18 nt, Artificial Sequence
  Description of Artificial Sequence: Synthetic oligonucleotide
ucucuagacgagagcuuu

SEQ ID NO: 75409 - RNA, 18 nt, Artificial Sequence
  Description of Artificial Sequence: Synthetic oligonucleotide
uacuaucucuagacgaga

SEQ ID NO: 75410 - RNA, 18 nt, Artificial Sequence
  Description of Artificial Sequence: Synthetic oligonucleotide
augaguacuaucucuaga

SEQ ID NO: 75411 - RNA, 18 nt, Artificial Sequence
  Description of Artificial Sequence: Synthetic oligonucleotide
ccuccaugaguacuaucu

SEQ ID NO: 75412 - RNA, 18 nt, Artificial Sequence
  Description of Artificial Sequence: Synthetic oligonucleotide
cuaguccuccaugaguac

SEQ ID NO: 75413 - RNA, 18 nt, Artificial Sequence
  Description of Artificial Sequence: Synthetic oligonucleotide
gcaggcuaguccuccaug

SEQ ID NO: 75414 - RNA, 18 nt, Artificial Sequence
  Description of Artificial Sequence: Synthetic oligonucleotide
aauaagcaggcuaguccu

SEQ ID NO: 75415 - RNA, 18 nt, Artificial Sequence
  Description of Artificial Sequence: Synthetic oligonucleotide
agccuaauaagcaggcua

SEQ ID NO: 75416 - RNA, 18 nt, Artificial Sequence
  Description of Artificial Sequence: Synthetic oligonucleotide
augguagccuaauaagca

SEQ ID NO: 75417 - RNA, 18 nt, Artificial Sequence
  Description of Artificial Sequence: Synthetic oligonucleotide
gagcuaugguagccuaau

SEQ ID NO: 75418 - RNA, 18 nt, Artificial Sequence
  Description of Artificial Sequence: Synthetic oligonucleotide
agagagagcuaugguagc

SEQ ID NO: 75419 - RNA, 18 nt, Artificial Sequence
  Description of Artificial Sequence: Synthetic oligonucleotide
gaaauagagagagcuaug

SEQ ID NO: 75420 - RNA, 18 nt, Artificial Sequence
  Description of Artificial Sequence: Synthetic oligonucleotide
gagcugaaauagagagag

SEQ ID NO: 75421 - RNA, 18 nt, Artificial Sequence
  Description of Artificial Sequence: Synthetic oligonucleotide
gaagggagcugaaauaga

SEQ ID NO: 75422 - RNA, 18 nt, Artificial Sequence
  Description of Artificial Sequence: Synthetic oligonucleotide
gaaccucugggcacuggc

SEQ ID NO: 75423 - RNA, 18 nt, Artificial Sequence
  Description of Artificial Sequence: Synthetic oligonucleotide
agggugaaccucugggca

SEQ ID NO: 75424 - RNA, 18 nt, Artificial Sequence
  Description of Artificial Sequence: Synthetic oligonucleotide
ggcaaagggugaaccucu

SEQ ID NO: 75425 - RNA, 18 nt, Artificial Sequence
  Description of Artificial Sequence: Synthetic oligonucleotide
guguaggcaaagggugaa

SEQ ID NO: 75426 - RNA, 18 nt, Artificial Sequence
  Description of Artificial Sequence: Synthetic oligonucleotide
gacagguguaggcaaagg

SEQ ID NO: 75427 - RNA, 18 nt, Artificial Sequence
  Description of Artificial Sequence: Synthetic oligonucleotide
agcaggacagguguaggc

SEQ ID NO: 75428 - RNA, 18 nt, Artificial Sequence
  Description of Artificial Sequence: Synthetic oligonucleotide
caggcagcaggacaggug

SEQ ID NO: 75429 - RNA, 18 nt, Artificial Sequence
  Description of Artificial Sequence: Synthetic oligonucleotide
cacagcaggcagcaggac

SEQ ID NO: 75430 - RNA, 18 nt, Artificial Sequence
  Description of Artificial Sequence: Synthetic oligonucleotide
aaguccacagcaggcagc

SEQ ID NO: 75431 - RNA, 18 nt, Artificial Sequence
  Description of Artificial Sequence: Synthetic oligonucleotide
agcuaaaguccacagcag

SEQ ID NO: 75432 - RNA, 18 nt, Artificial Sequence
  Description of Artificial Sequence: Synthetic oligonucleotide
ucccaagcuaaaguccac

SEQ ID NO: 75433 - RNA, 18 nt, Artificial Sequence
  Description of Artificial Sequence: Synthetic oligonucleotide
cauucucccaagcuaaag

SEQ ID NO: 75434 - RNA, 18 nt, Artificial Sequence
  Description of Artificial Sequence: Synthetic oligonucleotide
uuuuccauucucccaagc

SEQ ID NO: 75435 - RNA, 18 nt, Artificial Sequence
  Description of Artificial Sequence: Synthetic oligonucleotide
cuggguuuuccauucucc

SEQ ID NO: 75436 - RNA, 18 nt, Artificial Sequence
  Description of Artificial Sequence: Synthetic oligonucleotide
gaaccucugggcacuggc

SEQ ID NO: 75437 - RNA, 18 nt, Artificial Sequence
  Description of Artificial Sequence: Synthetic oligonucleotide
agggugaaccucugggca

SEQ ID NO: 75438 - RNA, 18 nt, Artificial Sequence
  Description of Artificial Sequence: Synthetic oligonucleotide
ggcaaagggugaaccucu

SEQ ID NO: 75439 - RNA, 18 nt, Artificial Sequence
  Description of Artificial Sequence: Synthetic oligonucleotide
guguaggcaaagggugaa

SEQ ID NO: 75440 - RNA, 18 nt, Artificial Sequence
  Description of Artificial Sequence: Synthetic oligonucleotide
gacagguguaggcaaagg

SEQ ID NO: 75441 - RNA, 18 nt, Artificial Sequence
  Description of Artificial Sequence: Synthetic oligonucleotide
agcaggacagguguaggc

SEQ ID NO: 75442 - RNA, 18 nt, Artificial Sequence
  Description of Artificial Sequence: Synthetic oligonucleotide
caggcagcaggacaggug

SEQ ID NO: 75443 - RNA, 18 nt, Artificial Sequence
  Description of Artificial Sequence: Synthetic oligonucleotide
cacagcaggcagcaggac

SEQ ID NO: 75444 - RNA, 18 nt, Artificial Sequence
  Description of Artificial Sequence: Synthetic oligonucleotide
aaguccacagcaggcagc

SEQ ID NO: 75445 - RNA, 18 nt, Artificial Sequence
  Description of Artificial Sequence: Synthetic oligonucleotide
agcuaaaguccacagcag

SEQ ID NO: 75446 - RNA, 18 nt, Artificial Sequence
  Description of Artificial Sequence: Synthetic oligonucleotide
ucccaagcuaaaguccac

SEQ ID NO: 75447 - RNA, 18 nt, Artificial Sequence
  Description of Artificial Sequence: Synthetic oligonucleotide
cauucucccaagcuaaag

SEQ ID NO: 75448 - RNA, 18 nt, Artificial Sequence
  Description of Artificial Sequence: Synthetic oligonucleotide
uuuuccauucucccaagc

SEQ ID NO: 75449 - RNA, 18 nt, Artificial Sequence
  Description of Artificial Sequence: Synthetic oligonucleotide
cuggguuuuccauucucc

SEQ ID NO: 75450 - RNA, 18 nt, Artificial Sequence
  Description of Artificial Sequence: Synthetic oligonucleotide
aagguuagggauggcuuu

SEQ ID NO: 75451 - RNA, 18 nt, Artificial Sequence
  Description of Artificial Sequence: Synthetic oligonucleotide
aagccaagguuagggaug

SEQ ID NO: 75452 - RNA, 18 nt, Artificial Sequence
  Description of Artificial Sequence: Synthetic oligonucleotide
uagggaagccaagguuag

SEQ ID NO: 75453 - RNA, 18 nt, Artificial Sequence
  Description of Artificial Sequence: Synthetic oligonucleotide
ggacuuagggaagccaag

SEQ ID NO: 75454 - RNA, 18 nt, Artificial Sequence
  Description of Artificial Sequence: Synthetic oligonucleotide
agacaggacuuagggaag

SEQ ID NO: 75455 - RNA, 18 nt, Artificial Sequence
  Description of Artificial Sequence: Synthetic oligonucleotide
acugaagacaggacuuag

SEQ ID NO: 75456 - RNA, 18 nt, Artificial Sequence
  Description of Artificial Sequence: Synthetic oligonucleotide
gggaaacugaagacagga

SEQ ID NO: 75457 - RNA, 18 nt, Artificial Sequence
  Description of Artificial Sequence: Synthetic oligonucleotide
gcagugggaaacugaaga

SEQ ID NO: 75458 - RNA, 18 nt, Artificial Sequence
  Description of Artificial Sequence: Synthetic oligonucleotide
gggaagcagugggaaacu

SEQ ID NO: 75459 - RNA, 18 nt, Artificial Sequence
  Description of Artificial Sequence: Synthetic oligonucleotide
uccaugggaagcaguggg

SEQ ID NO: 75460 - RNA, 18 nt, Artificial Sequence
  Description of Artificial Sequence: Synthetic oligonucleotide
gagaauccaugggaagca

SEQ ID NO: 75461 - RNA, 18 nt, Artificial Sequence
  Description of Artificial Sequence: Synthetic oligonucleotide
uguuggagaauccauggg

SEQ ID NO: 75462 - RNA, 18 nt, Artificial Sequence
  Description of Artificial Sequence: Synthetic oligonucleotide
aagaauguuggagaaucc

SEQ ID NO: 75463 - RNA, 18 nt, Artificial Sequence
  Description of Artificial Sequence: Synthetic oligonucleotide
agcucaagaauguuggag

SEQ ID NO: 75464 - RNA, 18 nt, Artificial Sequence
  Description of Artificial Sequence: Synthetic oligonucleotide
uaaaaagcucaagaaugu

SEQ ID NO: 75465 - RNA, 18 nt, Artificial Sequence
  Description of Artificial Sequence: Synthetic oligonucleotide
auuuuuaaaaagcucaag

SEQ ID NO: 75466 - RNA, 18 nt, Artificial Sequence
  Description of Artificial Sequence: Synthetic oligonucleotide
gagauauuuuuaaaaagc

SEQ ID NO: 75467 - RNA, 18 nt, Artificial Sequence
  Description of Artificial Sequence: Synthetic oligonucleotide
aaggugagauauuuuuaa

SEQ ID NO: 75468 - RNA, 18 nt, Artificial Sequence
  Description of Artificial Sequence: Synthetic oligonucleotide
agcugaaggugagauauu

SEQ ID NO: 75469 - RNA, 18 nt, Artificial Sequence
  Description of Artificial Sequence: Synthetic oligonucleotide
ggccaagcugaaggugag

SEQ ID NO: 75470 - RNA, 18 nt, Artificial Sequence
  Description of Artificial Sequence: Synthetic oligonucleotide
aggguggccaagcugaag

SEQ ID NO: 75471 - RNA, 18 nt, Artificial Sequence
  Description of Artificial Sequence: Synthetic oligonucleotide
ggguuaggguggccaagc

SEQ ID NO: 75472 - RNA, 18 nt, Artificial Sequence
  Description of Artificial Sequence: Synthetic oligonucleotide
agauuggguuaggguggc

SEQ ID NO: 75473 - RNA, 18 nt, Artificial Sequence
  Description of Artificial Sequence: Synthetic oligonucleotide
aauguagauuggguuagg

SEQ ID NO: 75474 - RNA, 18 nt, Artificial Sequence
  Description of Artificial Sequence: Synthetic oligonucleotide
aggugaauguagauuggg

SEQ ID NO: 75475 - RNA, 18 nt, Artificial Sequence
  Description of Artificial Sequence: Synthetic oligonucleotide
aucauaggugaauguaga

SEQ ID NO: 75476 - RNA, 18 nt, Artificial Sequence
  Description of Artificial Sequence: Synthetic oligonucleotide
cuaucaucauaggugaau

SEQ ID NO: 75477 - RNA, 18 nt, Artificial Sequence
  Description of Artificial Sequence: Synthetic oligonucleotide
acaggcuaucaucauagg

SEQ ID NO: 75478 - RNA, 18 nt, Artificial Sequence
  Description of Artificial Sequence: Synthetic oligonucleotide
uauccacaggcuaucauc

SEQ ID NO: 75479 - RNA, 18 nt, Artificial Sequence
  Description of Artificial Sequence: Synthetic oligonucleotide
caucuuauccacaggcua

SEQ ID NO: 75480 - RNA, 18 nt, Artificial Sequence
  Description of Artificial Sequence: Synthetic oligonucleotide
gccaucaucuuauccaca

SEQ ID NO: 75481 - RNA, 18 nt, Artificial Sequence
  Description of Artificial Sequence: Synthetic oligonucleotide
ugcaagccaucaucuuau

SEQ ID NO: 75482 - RNA, 18 nt, Artificial Sequence
  Description of Artificial Sequence: Synthetic oligonucleotide
ggaccugcaagccaucau

SEQ ID NO: 75483 - RNA, 18 nt, Artificial Sequence
  Description of Artificial Sequence: Synthetic oligonucleotide
auauuggaccugcaagcc

SEQ ID NO: 75484 - RNA, 18 nt, Artificial Sequence
  Description of Artificial Sequence: Synthetic oligonucleotide
uucacauauuggaccugc

SEQ ID NO: 75485 - RNA, 18 nt, Artificial Sequence
  Description of Artificial Sequence: Synthetic oligonucleotide
aucuauucacauauugga

SEQ ID NO: 75486 - RNA, 18 nt, Artificial Sequence
  Description of Artificial Sequence: Synthetic oligonucleotide
uucaaaucuauucacaua

SEQ ID NO: 75487 - RNA, 18 nt, Artificial Sequence
  Description of Artificial Sequence: Synthetic oligonucleotide
ucagcuucaaaucuauuc

SEQ ID NO: 75488 - RNA, 18 nt, Artificial Sequence
  Description of Artificial Sequence: Synthetic oligonucleotide
gguguucagcuucaaauc

SEQ ID NO: 75489 - RNA, 18 nt, Artificial Sequence
  Description of Artificial Sequence: Synthetic oligonucleotide
uucaugguguucagcuuc

SEQ ID NO: 75490 - RNA, 18 nt, Artificial Sequence
  Description of Artificial Sequence: Synthetic oligonucleotide
agcuuuucaugguguuca

SEQ ID NO: 75491 - RNA, 18 nt, Artificial Sequence
  Description of Artificial Sequence: Synthetic oligonucleotide
ucuccagcuuuucauggu

SEQ ID NO: 75492 - RNA, 18 nt, Artificial Sequence
  Description of Artificial Sequence: Synthetic oligonucleotide
auuucucuccagcuuuuc

SEQ ID NO: 75493 - RNA, 18 nt, Artificial Sequence
  Description of Artificial Sequence: Synthetic oligonucleotide
gagcgauuucucuccagc

SEQ ID NO: 75494 - RNA, 18 nt, Artificial Sequence
  Description of Artificial Sequence: Synthetic oligonucleotide
gccaugagcgauuucucu

SEQ ID NO: 75495 - RNA, 18 nt, Artificial Sequence
  Description of Artificial Sequence: Synthetic oligonucleotide
gcauggccaugagcgauu

SEQ ID NO: 75496 - RNA, 18 nt, Artificial Sequence
  Description of Artificial Sequence: Synthetic oligonucleotide
caaaggcauggccaugag

SEQ ID NO: 75497 - RNA, 18 nt, Artificial Sequence
  Description of Artificial Sequence: Synthetic oligonucleotide
uaggucaaaggcauggcc

SEQ ID NO: 75498 - RNA, 18 nt, Artificial Sequence
  Description of Artificial Sequence: Synthetic oligonucleotide
gggaauaggucaaaggca

SEQ ID NO: 75499 - RNA, 18 nt, Artificial Sequence
  Description of Artificial Sequence: Synthetic oligonucleotide
ugaacgggaauaggucaa

SEQ ID NO: 75500 - RNA, 18 nt, Artificial Sequence
  Description of Artificial Sequence: Synthetic oligonucleotide
aagacugaacgggaauag

SEQ ID NO: 75501 - RNA, 18 nt, Artificial Sequence
  Description of Artificial Sequence: Synthetic oligonucleotide
uuaagaagacugaacggg

SEQ ID NO: 75502 - RNA, 18 nt, Artificial Sequence
  Description of Artificial Sequence: Synthetic oligonucleotide
ccaauuuaagaagacuga

SEQ ID NO: 75503 - RNA, 18 nt, Artificial Sequence
  Description of Artificial Sequence: Synthetic oligonucleotide
ucaugccaauuuaagaag

SEQ ID NO: 75504 - RNA, 18 nt, Artificial Sequence
  Description of Artificial Sequence: Synthetic oligonucleotide
cuucuucaugccaauuua

SEQ ID NO: 75505 - RNA, 18 nt, Artificial Sequence
  Description of Artificial Sequence: Synthetic oligonucleotide
ucuugcuucuucaugcca

SEQ ID NO: 75506 - RNA, 18 nt, Artificial Sequence
  Description of Artificial Sequence: Synthetic oligonucleotide
augagucuugcuucuuca

SEQ ID NO: 75507 - RNA, 18 nt, Artificial Sequence
  Description of Artificial Sequence: Synthetic oligonucleotide
gacauaugagucuugcuu

SEQ ID NO: 75508 - RNA, 18 nt, Artificial Sequence
  Description of Artificial Sequence: Synthetic oligonucleotide
uggaugacauaugagucu

SEQ ID NO: 75509 - RNA, 18 nt, Artificial Sequence
  Description of Artificial Sequence: Synthetic oligonucleotide
aucuguggaugacauaug

SEQ ID NO: 75510 - RNA, 18 nt, Artificial Sequence
  Description of Artificial Sequence: Synthetic oligonucleotide
gugucaucuguggaugac

SEQ ID NO: 75511 - RNA, 18 nt, Artificial Sequence
  Description of Artificial Sequence: Synthetic oligonucleotide
gcuuugugucaucugugg

SEQ ID NO: 75512 - RNA, 18 nt, Artificial Sequence
  Description of Artificial Sequence: Synthetic oligonucleotide
ucccagcuuugugucauc

SEQ ID NO: 75513 - RNA, 18 nt, Artificial Sequence
  Description of Artificial Sequence: Synthetic oligonucleotide
guacuucccagcuuugug

SEQ ID NO: 75514 - RNA, 18 nt, Artificial Sequence
  Description of Artificial Sequence: Synthetic oligonucleotide
uagugguacuucccagcu

SEQ ID NO: 75515 - RNA, 18 nt, Artificial Sequence
  Description of Artificial Sequence: Synthetic oligonucleotide
uauuuuagugguacuucc

SEQ ID NO: 75516 - RNA, 18 nt, Artificial Sequence
  Description of Artificial Sequence: Synthetic oligonucleotide
uuuguuauuuuaguggua

SEQ ID NO: 75517 - RNA, 18 nt, Artificial Sequence
  Description of Artificial Sequence: Synthetic oligonucleotide
agucuuuuguuauuuuag

SEQ ID NO: 75518 - RNA, 18 nt, Artificial Sequence
  Description of Artificial Sequence: Synthetic oligonucleotide
gauucagucuuuuguuau

SEQ ID NO: 75519 - RNA, 18 nt, Artificial Sequence
  Description of Artificial Sequence: Synthetic oligonucleotide
aucuugauucagucuuuu

SEQ ID NO: 75520 - RNA, 18 nt, Artificial Sequence
  Description of Artificial Sequence: Synthetic oligonucleotide
uuugaaucuugauucagu

SEQ ID NO: 75521 - RNA, 18 nt, Artificial Sequence
  Description of Artificial Sequence: Synthetic oligonucleotide
agugauuugaaucuugau

SEQ ID NO: 75522 - RNA, 18 nt, Artificial Sequence
  Description of Artificial Sequence: Synthetic oligonucleotide
cuuucagugauuugaauc

SEQ ID NO: 75523 - RNA, 18 nt, Artificial Sequence
  Description of Artificial Sequence: Synthetic oligonucleotide
cuagucuuucagugauuu

SEQ ID NO: 75524 - RNA, 18 nt, Artificial Sequence
  Description of Artificial Sequence: Synthetic oligonucleotide
uugaccuagucuuucagu

SEQ ID NO: 75525 - RNA, 18 nt, Artificial Sequence
  Description of Artificial Sequence: Synthetic oligonucleotide
uguuuuugaccuagucuu

SEQ ID NO: 75526 - RNA, 18 nt, Artificial Sequence
  Description of Artificial Sequence: Synthetic oligonucleotide
caccuuguuuuugaccua

SEQ ID NO: 75527 - RNA, 18 nt, Artificial Sequence
  Description of Artificial Sequence: Synthetic oligonucleotide
uguuucaccuuguuuuug

SEQ ID NO: 75528 - RNA, 18 nt, Artificial Sequence
  Description of Artificial Sequence: Synthetic oligonucleotide
ucuguuguuucaccuugu

SEQ ID NO: 75529 - RNA, 18 nt, Artificial Sequence
  Description of Artificial Sequence: Synthetic oligonucleotide
auaucucuguuguuucac

SEQ ID NO: 75530 - RNA, 18 nt, Artificial Sequence
  Description of Artificial Sequence: Synthetic oligonucleotide
aguuuauaucucuguugu

SEQ ID NO: 75531 - RNA, 18 nt, Artificial Sequence
  Description of Artificial Sequence: Synthetic oligonucleotide
guagaaguuuauaucucu

SEQ ID NO: 75532 - RNA, 18 nt, Artificial Sequence
  Description of Artificial Sequence: Synthetic oligonucleotide
cacauguagaaguuuaua

SEQ ID NO: 75533 - RNA, 18 nt, Artificial Sequence
  Description of Artificial Sequence: Synthetic oligonucleotide
cggcccacauguagaagu

SEQ ID NO: 75534 - RNA, 18 nt, Artificial Sequence
  Description of Artificial Sequence: Synthetic oligonucleotide
gcccccggcccacaugua

SEQ ID NO: 75535 - RNA, 18 nt, Artificial Sequence
  Description of Artificial Sequence: Synthetic oligonucleotide
cgugagcccccggcccac

SEQ ID NO: 75536 - RNA, 18 nt, Artificial Sequence
  Description of Artificial Sequence: Synthetic oligonucleotide
acaggcgugagcccccgg

SEQ ID NO: 75537 - RNA, 18 nt, Artificial Sequence
  Description of Artificial Sequence: Synthetic oligonucleotide
ggauuacaggcgugagcc

SEQ ID NO: 75538 - RNA, 18 nt, Artificial Sequence
  Description of Artificial Sequence: Synthetic oligonucleotide
ugcugggauuacaggcgu

SEQ ID NO: 75539 - RNA, 18 nt, Artificial Sequence
  Description of Artificial Sequence: Synthetic oligonucleotide
caaagugcugggauuaca

SEQ ID NO: 75540 - RNA, 18 nt, Artificial Sequence
  Description of Artificial Sequence: Synthetic oligonucleotide
ccucccaaagugcuggga

SEQ ID NO: 75541 - RNA, 18 nt, Artificial Sequence
  Description of Artificial Sequence: Synthetic oligonucleotide
cucggccucccaaagugc

SEQ ID NO: 75542 - RNA, 18 nt, Artificial Sequence
  Description of Artificial Sequence: Synthetic oligonucleotide
ccugccucggccucccaa

SEQ ID NO: 75543 - RNA, 18 nt, Artificial Sequence
  Description of Artificial Sequence: Synthetic oligonucleotide
aucugccugccucggccu

SEQ ID NO: 75544 - RNA, 18 nt, Artificial Sequence
  Description of Artificial Sequence: Synthetic oligonucleotide
aggugaucugccugccuc

SEQ ID NO: 75545 - RNA, 18 nt, Artificial Sequence
  Description of Artificial Sequence: Synthetic oligonucleotide
cccucaggugaucugccu

SEQ ID NO: 75546 - RNA, 18 nt, Artificial Sequence
  Description of Artificial Sequence: Synthetic oligonucleotide
uccugcccucaggugauc

SEQ ID NO: 75547 - RNA, 18 nt, Artificial Sequence
  Description of Artificial Sequence: Synthetic oligonucleotide
caaacuccugcccucagg

SEQ ID NO: 75548 - RNA, 18 nt, Artificial Sequence
  Description of Artificial Sequence: Synthetic oligonucleotide
gcucucaaacuccugccc

SEQ ID NO: 75549 - RNA, 18 nt, Artificial Sequence
  Description of Artificial Sequence: Synthetic oligonucleotide
gcugggcauggugguggg

SEQ ID NO: 75550 - RNA, 18 nt, Artificial Sequence
  Description of Artificial Sequence: Synthetic oligonucleotide
aauuagcugggcauggug

SEQ ID NO: 75551 - RNA, 18 nt, Artificial Sequence
  Description of Artificial Sequence: Synthetic oligonucleotide
acaaaaauuagcugggca

SEQ ID NO: 75552 - RNA, 18 nt, Artificial Sequence
  Description of Artificial Sequence: Synthetic oligonucleotide
aaaauacaaaaauuagcu

SEQ ID NO: 75553 - RNA, 18 nt, Artificial Sequence
  Description of Artificial Sequence: Synthetic oligonucleotide
uaccaaaaauacaaaaau

SEQ ID NO: 75554 - RNA, 18 nt, Artificial Sequence
  Description of Artificial Sequence: Synthetic oligonucleotide
aucucuaccaaaaauaca

SEQ ID NO: 75555 - RNA, 18 nt, Artificial Sequence
  Description of Artificial Sequence: Synthetic oligonucleotide
accccaucucuaccaaaa

SEQ ID NO: 75556 - RNA, 18 nt, Artificial Sequence
  Description of Artificial Sequence: Synthetic oligonucleotide
gugaaaccccaucucuac

SEQ ID NO: 75557 - RNA, 18 nt, Artificial Sequence
  Description of Artificial Sequence: Synthetic oligonucleotide
acauggugaaaccccauc

SEQ ID NO: 75558 - RNA, 18 nt, Artificial Sequence
  Description of Artificial Sequence: Synthetic oligonucleotide
ggccaacauggugaaacc

SEQ ID NO: 75559 - RNA, 18 nt, Artificial Sequence
  Description of Artificial Sequence: Synthetic oligonucleotide
agccuggccaacauggug

SEQ ID NO: 75560 - RNA, 18 nt, Artificial Sequence
  Description of Artificial Sequence: Synthetic oligonucleotide
agaucagccuggccaaca

SEQ ID NO: 75561 - RNA, 18 nt, Artificial Sequence
  Description of Artificial Sequence: Synthetic oligonucleotide
guucaagaucagccuggc

SEQ ID NO: 75562 - RNA, 18 nt, Artificial Sequence
  Description of Artificial Sequence: Synthetic oligonucleotide
caggaguucaagaucagc

SEQ ID NO: 75563 - RNA, 18 nt, Artificial Sequence
  Description of Artificial Sequence: Synthetic oligonucleotide
gaggucaggaguucaaga

SEQ ID NO: 75564 - RNA, 18 nt, Artificial Sequence
  Description of Artificial Sequence: Synthetic oligonucleotide
caccugaggucaggaguu

SEQ ID NO: 75565 - RNA, 18 nt, Artificial Sequence
  Description of Artificial Sequence: Synthetic oligonucleotide
uggaucaccugaggucag

SEQ ID NO: 75566 - RNA, 18 nt, Artificial Sequence
  Description of Artificial Sequence: Synthetic oligonucleotide
gcagguggaucaccugag

SEQ ID NO: 75567 - RNA, 18 nt, Artificial Sequence
  Description of Artificial Sequence: Synthetic oligonucleotide
cugaggcagguggaucac

SEQ ID NO: 75568 - RNA, 18 nt, Artificial Sequence
  Description of Artificial Sequence: Synthetic oligonucleotide
ggaggcugaggcaggugg

SEQ ID NO: 75569 - RNA, 18 nt, Artificial Sequence
  Description of Artificial Sequence: Synthetic oligonucleotide
cuuugggaggcugaggca

SEQ ID NO: 75570 - RNA, 18 nt, Artificial Sequence
  Description of Artificial Sequence: Synthetic oligonucleotide
cagcacuuugggaggcug

SEQ ID NO: 75571 - RNA, 18 nt, Artificial Sequence
  Description of Artificial Sequence: Synthetic oligonucleotide
aaucccagcacuuuggga

SEQ ID NO: 75572 - RNA, 18 nt, Artificial Sequence
  Description of Artificial Sequence: Synthetic oligonucleotide
ccuguaaucccagcacuu

SEQ ID NO: 75573 - RNA, 18 nt, Artificial Sequence
  Description of Artificial Sequence: Synthetic oligonucleotide
ucacgccuguaaucccag

SEQ ID NO: 75574 - RNA, 18 nt, Artificial Sequence
  Description of Artificial Sequence: Synthetic oligonucleotide
guggcucacgccuguaau

SEQ ID NO: 75575 - RNA, 18 nt, Artificial Sequence
  Description of Artificial Sequence: Synthetic oligonucleotide
gugcaguggcucacgccu

SEQ ID NO: 75576 - RNA, 18 nt, Artificial Sequence
  Description of Artificial Sequence: Synthetic oligonucleotide
gcugggugcaguggcuca

SEQ ID NO: 75577 - RNA, 18 nt, Artificial Sequence
  Description of Artificial Sequence: Synthetic oligonucleotide
ugaaggcugggugcagug

SEQ ID NO: 75578 - RNA, 18 nt, Artificial Sequence
  Description of Artificial Sequence: Synthetic oligonucleotide
cugaaugaaggcugggug

SEQ ID NO: 75579 - RNA, 18 nt, Artificial Sequence
  Description of Artificial Sequence: Synthetic oligonucleotide
uuaaacugaaugaaggcu

SEQ ID NO: 75580 - RNA, 18 nt, Artificial Sequence
  Description of Artificial Sequence: Synthetic oligonucleotide
gauuuuuaaacugaauga

SEQ ID NO: 75581 - RNA, 18 nt, Artificial Sequence
  Description of Artificial Sequence: Synthetic oligonucleotide
cauuugauuuuuaaacug

SEQ ID NO: 75582 - RNA, 18 nt, Artificial Sequence
  Description of Artificial Sequence: Synthetic oligonucleotide
aggaucauuugauuuuua

SEQ ID NO: 75583 - RNA, 18 nt, Artificial Sequence
  Description of Artificial Sequence: Synthetic oligonucleotide
accuuaggaucauuugau

SEQ ID NO: 75584 - RNA, 18 nt, Artificial Sequence
  Description of Artificial Sequence: Synthetic oligonucleotide
gcaaaaccuuaggaucau

SEQ ID NO: 75585 - RNA, 18 nt, Artificial Sequence
  Description of Artificial Sequence: Synthetic oligonucleotide
cugcugcaaaaccuuagg

SEQ ID NO: 75586 - RNA, 18 nt, Artificial Sequence
  Description of Artificial Sequence: Synthetic oligonucleotide
ucuuucugcugcaaaacc

SEQ ID NO: 75587 - RNA, 18 nt, Artificial Sequence
  Description of Artificial Sequence: Synthetic oligonucleotide
uuuacucuuucugcugca

SEQ ID NO: 75588 - RNA, 18 nt, Artificial Sequence
  Description of Artificial Sequence: Synthetic oligonucleotide
gcaaauuuacucuuucug

SEQ ID NO: 75589 - RNA, 18 nt, Artificial Sequence
  Description of Artificial Sequence: Synthetic oligonucleotide
gugcugcaaauuuacucu

SEQ ID NO: 75590 - RNA, 18 nt, Artificial Sequence
  Description of Artificial Sequence: Synthetic oligonucleotide
uucuagugcugcaaauuu

SEQ ID NO: 75591 - RNA, 18 nt, Artificial Sequence
  Description of Artificial Sequence: Synthetic oligonucleotide
cuugguucuagugcugca

SEQ ID NO: 75592 - RNA, 18 nt, Artificial Sequence
  Description of Artificial Sequence: Synthetic oligonucleotide
uaccucuugguucuagug

SEQ ID NO: 75593 - RNA, 18 nt, Artificial Sequence
  Description of Artificial Sequence: Synthetic oligonucleotide
gcuuuuaccucuugguuc

SEQ ID NO: 75594 - RNA, 18 nt, Artificial Sequence
  Description of Artificial Sequence: Synthetic oligonucleotide
uuacagcuuuuaccucuu

SEQ ID NO: 75595 - RNA, 18 nt, Artificial Sequence
  Description of Artificial Sequence: Synthetic oligonucleotide
cccuguuacagcuuuuac

SEQ ID NO: 75596 - RNA, 18 nt, Artificial Sequence
  Description of Artificial Sequence: Synthetic oligonucleotide
aucugcccuguuacagcu

SEQ ID NO: 75597 - RNA, 18 nt, Artificial Sequence
  Description of Artificial Sequence: Synthetic oligonucleotide
cugaaaucugcccuguua

SEQ ID NO: 75598 - RNA, 18 nt, Artificial Sequence
  Description of Artificial Sequence: Synthetic oligonucleotide
cguugcugaaaucugccc

SEQ ID NO: 75599 - RNA, 18 nt, Artificial Sequence
  Description of Artificial Sequence: Synthetic oligonucleotide
ucuuacguugcugaaauc

SEQ ID NO: 75600 - RNA, 18 nt, Artificial Sequence
  Description of Artificial Sequence: Synthetic oligonucleotide
uuuuuucuuacguugcug

SEQ ID NO: 75601 - RNA, 18 nt, Artificial Sequence
  Description of Artificial Sequence: Synthetic oligonucleotide
gcuccuuuuuucuuacgu

SEQ ID NO: 75602 - RNA, 18 nt, Artificial Sequence
  Description of Artificial Sequence: Synthetic oligonucleotide
gaagagcuccuuuuuucu

SEQ ID NO: 75603 - RNA, 18 nt, Artificial Sequence
  Description of Artificial Sequence: Synthetic oligonucleotide
agugagaagagcuccuuu

SEQ ID NO: 75604 - RNA, 18 nt, Artificial Sequence
  Description of Artificial Sequence: Synthetic oligonucleotide
guuucagugagaagagcu

SEQ ID NO: 75605 - RNA, 18 nt, Artificial Sequence
  Description of Artificial Sequence: Synthetic oligonucleotide
acuugguuucagugagaa

SEQ ID NO: 75606 - RNA, 18 nt, Artificial Sequence
  Description of Artificial Sequence: Synthetic oligonucleotide
cuuacacuugguuucagu

SEQ ID NO: 75607 - RNA, 18 nt, Artificial Sequence
  Description of Artificial Sequence: Synthetic oligonucleotide
cuggucuuacacuugguu

SEQ ID NO: 75608 - RNA, 18 nt, Artificial Sequence
  Description of Artificial Sequence: Synthetic oligonucleotide
ccagccuggucuuacacu

SEQ ID NO: 75609 - RNA, 18 nt, Artificial Sequence
  Description of Artificial Sequence: Synthetic oligonucleotide
cuaguccagccuggucuu

SEQ ID NO: 75610 - RNA, 18 nt, Artificial Sequence
  Description of Artificial Sequence: Synthetic oligonucleotide
guccucuaguccagccug

SEQ ID NO: 75611 - RNA, 18 nt, Artificial Sequence
  Description of Artificial Sequence: Synthetic oligonucleotide
cccguguccucuagucca

SEQ ID NO: 75612 - RNA, 18 nt, Artificial Sequence
  Description of Artificial Sequence: Synthetic oligonucleotide
aaacucccguguccucua

SEQ ID NO: 75613 - RNA, 18 nt, Artificial Sequence
  Description of Artificial Sequence: Synthetic oligonucleotide
uucaaaaacucccguguc

SEQ ID NO: 75614 - RNA, 18 nt, Artificial Sequence
  Description of Artificial Sequence: Synthetic oligonucleotide
ucugcuucaaaaacuccc

SEQ ID NO: 75615 - RNA, 18 nt, Artificial Sequence
  Description of Artificial Sequence: Synthetic oligonucleotide
cagccucugcuucaaaaa

SEQ ID NO: 75616 - RNA, 18 nt, Artificial Sequence
  Description of Artificial Sequence: Synthetic oligonucleotide
gucaucagccucugcuuc

SEQ ID NO: 75617 - RNA, 18 nt, Artificial Sequence
  Description of Artificial Sequence: Synthetic oligonucleotide
agcuggucaucagccucu

SEQ ID NO: 75618 - RNA, 18 nt, Artificial Sequence
  Description of Artificial Sequence: Synthetic oligonucleotide
ccgacagcuggucaucag

SEQ ID NO: 75619 - RNA, 18 nt, Artificial Sequence
  Description of Artificial Sequence: Synthetic oligonucleotide
gucucccgacagcugguc

SEQ ID NO: 75620 - RNA, 18 nt, Artificial Sequence
  Description of Artificial Sequence: Synthetic oligonucleotide
ucacagucucccgacagc

SEQ ID NO: 75621 - RNA, 18 nt, Artificial Sequence
  Description of Artificial Sequence: Synthetic oligonucleotide
uuccuucacagucucccg

SEQ ID NO: 75622 - RNA, 18 nt, Artificial Sequence
  Description of Artificial Sequence: Synthetic oligonucleotide
aggaauuccuucacaguc

SEQ ID NO: 75623 - RNA, 18 nt, Artificial Sequence
  Description of Artificial Sequence: Synthetic oligonucleotide
agggcaggaauuccuuca

SEQ ID NO: 75624 - RNA, 18 nt, Artificial Sequence
  Description of Artificial Sequence: Synthetic oligonucleotide
cacccagggcaggaauuc

SEQ ID NO: 75625 - RNA, 18 nt, Artificial Sequence
  Description of Artificial Sequence: Synthetic oligonucleotide
ggucccacccagggcagg

SEQ ID NO: 75626 - RNA, 18 nt, Artificial Sequence
  Description of Artificial Sequence: Synthetic oligonucleotide
accaaggucccacccagg

SEQ ID NO: 75627 - RNA, 18 nt, Artificial Sequence
  Description of Artificial Sequence: Synthetic oligonucleotide
acaggaccaaggucccac

SEQ ID NO: 75628 - RNA, 18 nt, Artificial Sequence
  Description of Artificial Sequence: Synthetic oligonucleotide
acuggacaggaccaaggu

SEQ ID NO: 75629 - RNA, 18 nt, Artificial Sequence
  Description of Artificial Sequence: Synthetic oligonucleotide
ugagaacuggacaggacc

SEQ ID NO: 75630 - RNA, 18 nt, Artificial Sequence
  Description of Artificial Sequence: Synthetic oligonucleotide
caggcugagaacuggaca

SEQ ID NO: 75631 - RNA, 18 nt, Artificial Sequence
  Description of Artificial Sequence: Synthetic oligonucleotide
ucauacaggcugagaacu

SEQ ID NO: 75632 - RNA, 18 nt, Artificial Sequence
  Description of Artificial Sequence: Synthetic oligonucleotide
gugaaucauacaggcuga

SEQ ID NO: 75633 - RNA, 18 nt, Artificial Sequence
  Description of Artificial Sequence: Synthetic oligonucleotide
gcagagugaaucauacag

SEQ ID NO: 75634 - RNA, 18 nt, Artificial Sequence
  Description of Artificial Sequence: Synthetic oligonucleotide
agccagcagagugaauca

SEQ ID NO: 75635 - RNA, 18 nt, Artificial Sequence
  Description of Artificial Sequence: Synthetic oligonucleotide
ggaguagccagcagagug

SEQ ID NO: 75636 - RNA, 18 nt, Artificial Sequence
  Description of Artificial Sequence: Synthetic oligonucleotide
ccuuaggaguagccagca

SEQ ID NO: 75637 - RNA, 18 nt, Artificial Sequence
  Description of Artificial Sequence: Synthetic oligonucleotide
gggagccuuaggaguagc

SEQ ID NO: 75638 - RNA, 18 nt, Artificial Sequence
  Description of Artificial Sequence: Synthetic oligonucleotide
acacuaaaagcggguggg

SEQ ID NO: 75639 - RNA, 18 nt, Artificial Sequence
  Description of Artificial Sequence: Synthetic oligonucleotide
ggcacacuaaaagcgggu

SEQ ID NO: 75640 - RNA, 18 nt, Artificial Sequence
  Description of Artificial Sequence: Synthetic oligonucleotide
caaagggcacacuaaaag

SEQ ID NO: 75641 - RNA, 18 nt, Artificial Sequence
  Description of Artificial Sequence: Synthetic oligonucleotide
ugccucaaagggcacacu

SEQ ID NO: 75642 - RNA, 18 nt, Artificial Sequence
  Description of Artificial Sequence: Synthetic oligonucleotide
cgcacugccucaaagggc

SEQ ID NO: 75643 - RNA, 18 nt, Artificial Sequence
  Description of Artificial Sequence: Synthetic oligonucleotide
agaagcgcacugccucaa

SEQ ID NO: 75644 - RNA, 18 nt, Artificial Sequence
  Description of Artificial Sequence: Synthetic oligonucleotide
aagagagaagcgcacugc

SEQ ID NO: 75645 - RNA, 18 nt, Artificial Sequence
  Description of Artificial Sequence: Synthetic oligonucleotide
ccugugccuuggucuccu

SEQ ID NO: 75646 - RNA, 18 nt, Artificial Sequence
  Description of Artificial Sequence: Synthetic oligonucleotide
aauguccugugccuuggu

SEQ ID NO: 75647 - RNA, 18 nt, Artificial Sequence
  Description of Artificial Sequence: Synthetic oligonucleotide
cccagaauguccugugcc

SEQ ID NO: 75648 - RNA, 18 nt, Artificial Sequence
  Description of Artificial Sequence: Synthetic oligonucleotide
cugcucccagaauguccu

SEQ ID NO: 75649 - RNA, 18 nt, Artificial Sequence
  Description of Artificial Sequence: Synthetic oligonucleotide
ggucacugcucccagaau

SEQ ID NO: 75650 - RNA, 18 nt, Artificial Sequence
  Description of Artificial Sequence: Synthetic oligonucleotide
agaagggucacugcuccc

SEQ ID NO: 75651 - RNA, 18 nt, Artificial Sequence
  Description of Artificial Sequence: Synthetic oligonucleotide
ccagcagaagggucacug

SEQ ID NO: 75652 - RNA, 18 nt, Artificial Sequence
  Description of Artificial Sequence: Synthetic oligonucleotide
ucccuccagcagaagggu

SEQ ID NO: 75653 - RNA, 18 nt, Artificial Sequence
  Description of Artificial Sequence: Synthetic oligonucleotide
aucacucccuccagcaga

SEQ ID NO: 75654 - RNA, 18 nt, Artificial Sequence
  Description of Artificial Sequence: Synthetic oligonucleotide
cugccaucacucccucca

SEQ ID NO: 75655 - RNA, 18 nt, Artificial Sequence
  Description of Artificial Sequence: Synthetic oligonucleotide
ccgugcugccaucacucc

SEQ ID NO: 75656 - RNA, 18 nt, Artificial Sequence
  Description of Artificial Sequence: Synthetic oligonucleotide
uguccccgugcugccauc

SEQ ID NO: 75657 - RNA, 18 nt, Artificial Sequence
  Description of Artificial Sequence: Synthetic oligonucleotide
ccaguuguccccgugcug

SEQ ID NO: 75658 - RNA, 18 nt, Artificial Sequence
  Description of Artificial Sequence: Synthetic oligonucleotide
gggucccaguuguccccg

SEQ ID NO: 75659 - RNA, 18 nt, Artificial Sequence
  Description of Artificial Sequence: Synthetic oligonucleotide
caagugggucccaguugu

SEQ ID NO: 75660 - RNA, 18 nt, Artificial Sequence
  Description of Artificial Sequence: Synthetic oligonucleotide
agaggcaaguggguccca

SEQ ID NO: 75661 - RNA, 18 nt, Artificial Sequence
  Description of Artificial Sequence: Synthetic oligonucleotide
ggaugagaggcaaguggg

SEQ ID NO: 75662 - RNA, 18 nt, Artificial Sequence
  Description of Artificial Sequence: Synthetic oligonucleotide
aggagggaugagaggcaa

SEQ ID NO: 75663 - RNA, 18 nt, Artificial Sequence
  Description of Artificial Sequence: Synthetic oligonucleotide
gccccaggagggaugaga

SEQ ID NO: 75664 - RNA, 18 nt, Artificial Sequence
  Description of Artificial Sequence: Synthetic oligonucleotide
aagcugccccaggaggga

SEQ ID NO: 75665 - RNA, 18 nt, Artificial Sequence
  Description of Artificial Sequence: Synthetic oligonucleotide
ccagaaagcugccccagg

SEQ ID NO: 75666 - RNA, 18 nt, Artificial Sequence
  Description of Artificial Sequence: Synthetic oligonucleotide
ccuguccagaaagcugcc

SEQ ID NO: 75667 - RNA, 18 nt, Artificial Sequence
  Description of Artificial Sequence: Synthetic oligonucleotide
acggaccuguccagaaag

SEQ ID NO: 75668 - RNA, 18 nt, Artificial Sequence
  Description of Artificial Sequence: Synthetic oligonucleotide
aggagacggaccugucca

SEQ ID NO: 75669 - RNA, 18 nt, Artificial Sequence
  Description of Artificial Sequence: Synthetic oligonucleotide
caaggaggagacggaccu

SEQ ID NO: 75670 - RNA, 18 nt, Artificial Sequence
  Description of Artificial Sequence: Synthetic oligonucleotide
ggccccaaggaggagacg

SEQ ID NO: 75671 - RNA, 18 nt, Artificial Sequence
  Description of Artificial Sequence: Synthetic oligonucleotide
ugcagggccccaaggagg

SEQ ID NO: 75672 - RNA, 18 nt, Artificial Sequence
  Description of Artificial Sequence: Synthetic oligonucleotide
ggcucugcagggccccaa

SEQ ID NO: 75673 - RNA, 18 nt, Artificial Sequence
  Description of Artificial Sequence: Synthetic oligonucleotide
aaggaggcucugcagggc

SEQ ID NO: 75674 - RNA, 18 nt, Artificial Sequence
  Description of Artificial Sequence: Synthetic oligonucleotide
guuccaaggaggcucugc

SEQ ID NO: 75675 - RNA, 18 nt, Artificial Sequence
  Description of Artificial Sequence: Synthetic oligonucleotide
uccugugccuuggucucc

SEQ ID NO: 75676 - RNA, 18 nt, Artificial Sequence
  Description of Artificial Sequence: Synthetic oligonucleotide
gaauguccugugccuugg

SEQ ID NO: 75677 - RNA, 18 nt, Artificial Sequence
  Description of Artificial Sequence: Synthetic oligonucleotide
ucccagaauguccugugc

SEQ ID NO: 75678 - RNA, 18 nt, Artificial Sequence
  Description of Artificial Sequence: Synthetic oligonucleotide
acugcucccagaaugucc

SEQ ID NO: 75679 - RNA, 18 nt, Artificial Sequence
  Description of Artificial Sequence: Synthetic oligonucleotide
gggucacugcucccagaa

SEQ ID NO: 75680 - RNA, 18 nt, Artificial Sequence
  Description of Artificial Sequence: Synthetic oligonucleotide
cagaagggucacugcucc

SEQ ID NO: 75681 - RNA, 18 nt, Artificial Sequence
  Description of Artificial Sequence: Synthetic oligonucleotide
uccagcagaagggucacu

SEQ ID NO: 75682 - RNA, 18 nt, Artificial Sequence
  Description of Artificial Sequence: Synthetic oligonucleotide
cucccuccagcagaaggg

SEQ ID NO: 75683 - RNA, 18 nt, Artificial Sequence
  Description of Artificial Sequence: Synthetic oligonucleotide
caucacucccuccagcag

SEQ ID NO: 75684 - RNA, 18 nt, Artificial Sequence
  Description of Artificial Sequence: Synthetic oligonucleotide
gcugccaucacucccucc

SEQ ID NO: 75685 - RNA, 18 nt, Artificial Sequence
  Description of Artificial Sequence: Synthetic oligonucleotide
cccgugcugccaucacuc

SEQ ID NO: 75686 - RNA, 18 nt, Artificial Sequence
  Description of Artificial Sequence: Synthetic oligonucleotide
uuguccccgugcugccau

SEQ ID NO: 75687 - RNA, 18 nt, Artificial Sequence
  Description of Artificial Sequence: Synthetic oligonucleotide
cccaguuguccccgugcu

SEQ ID NO: 75688 - RNA, 18 nt, Artificial Sequence
  Description of Artificial Sequence: Synthetic oligonucleotide
ugggucccaguugucccc

SEQ ID NO: 75689 - RNA, 18 nt, Artificial Sequence
  Description of Artificial Sequence: Synthetic oligonucleotide
gcaagugggucccaguug

SEQ ID NO: 75690 - RNA, 18 nt, Artificial Sequence
  Description of Artificial Sequence: Synthetic oligonucleotide
gagaggcaaguggguccc

SEQ ID NO: 75691 - RNA, 18 nt, Artificial Sequence
  Description of Artificial Sequence: Synthetic oligonucleotide
gggaugagaggcaagugg

SEQ ID NO: 75692 - RNA, 18 nt, Artificial Sequence
  Description of Artificial Sequence: Synthetic oligonucleotide
caggagggaugagaggca

SEQ ID NO: 75693 - RNA, 18 nt, Artificial Sequence
  Description of Artificial Sequence: Synthetic oligonucleotide
ugccccaggagggaugag

SEQ ID NO: 75694 - RNA, 18 nt, Artificial Sequence
  Description of Artificial Sequence: Synthetic oligonucleotide
aaagcugccccaggaggg

SEQ ID NO: 75695 - RNA, 18 nt, Artificial Sequence
  Description of Artificial Sequence: Synthetic oligonucleotide
uccagaaagcugccccag

SEQ ID NO: 75696 - RNA, 18 nt, Artificial Sequence
  Description of Artificial Sequence: Synthetic oligonucleotide
accuguccagaaagcugc

SEQ ID NO: 75697 - RNA, 18 nt, Artificial Sequence
  Description of Artificial Sequence: Synthetic oligonucleotide
gacggaccuguccagaaa

SEQ ID NO: 75698 - RNA, 18 nt, Artificial Sequence
  Description of Artificial Sequence: Synthetic oligonucleotide
gaggagacggaccugucc

SEQ ID NO: 75699 - RNA, 18 nt, Artificial Sequence
  Description of Artificial Sequence: Synthetic oligonucleotide
ccaaggaggagacggacc

SEQ ID NO: 75700 - RNA, 18 nt, Artificial Sequence
  Description of Artificial Sequence: Synthetic oligonucleotide
gggccccaaggaggagac

SEQ ID NO: 75701 - RNA, 18 nt, Artificial Sequence
  Description of Artificial Sequence: Synthetic oligonucleotide
cugcagggccccaaggag

SEQ ID NO: 75702 - RNA, 18 nt, Artificial Sequence
  Description of Artificial Sequence: Synthetic oligonucleotide
aggcucugcagggcccca

SEQ ID NO: 75703 - RNA, 18 nt, Artificial Sequence
  Description of Artificial Sequence: Synthetic oligonucleotide
caaggaggcucugcaggg

SEQ ID NO: 75704 - RNA, 18 nt, Artificial Sequence
  Description of Artificial Sequence: Synthetic oligonucleotide
gguuccaaggaggcucug

SEQ ID NO: 75705 - RNA, 18 nt, Artificial Sequence
  Description of Artificial Sequence: Synthetic oligonucleotide
ucuacagaucccuugacu

SEQ ID NO: 75706 - RNA, 18 nt, Artificial Sequence
  Description of Artificial Sequence: Synthetic oligonucleotide
caguuucuacagaucccu

SEQ ID NO: 75707 - RNA, 18 nt, Artificial Sequence
  Description of Artificial Sequence: Synthetic oligonucleotide
aagaacaguuucuacaga

SEQ ID NO: 75708 - RNA, 18 nt, Artificial Sequence
  Description of Artificial Sequence: Synthetic oligonucleotide
cagaaaagaacaguuucu

SEQ ID NO: 75709 - RNA, 18 nt, Artificial Sequence
  Description of Artificial Sequence: Synthetic oligonucleotide
ugagucagaaaagaacag

SEQ ID NO: 75710 - RNA, 18 nt, Artificial Sequence
  Description of Artificial Sequence: Synthetic oligonucleotide
gggacugagucagaaaag

SEQ ID NO: 75711 - RNA, 18 nt, Artificial Sequence
  Description of Artificial Sequence: Synthetic oligonucleotide
cuucccucaggucuucua

SEQ ID NO: 75712 - RNA, 18 nt, Artificial Sequence
  Description of Artificial Sequence: Synthetic oligonucleotide
cccuucuucccucagguc

SEQ ID NO: 75713 - RNA, 18 nt, Artificial Sequence
  Description of Artificial Sequence: Synthetic oligonucleotide
aagagcccuucuucccuc

SEQ ID NO: 75714 - RNA, 18 nt, Artificial Sequence
  Description of Artificial Sequence: Synthetic oligonucleotide
ccuggaagagcccuucuu

SEQ ID NO: 75715 - RNA, 18 nt, Artificial Sequence
  Description of Artificial Sequence: Synthetic oligonucleotide
agcucccuggaagagccc

SEQ ID NO: 75716 - RNA, 18 nt, Artificial Sequence
  Description of Artificial Sequence: Synthetic oligonucleotide
ccuugagcucccuggaag

SEQ ID NO: 75717 - RNA, 18 nt, Artificial Sequence
  Description of Artificial Sequence: Synthetic oligonucleotide
ucugcccuugagcucccu

SEQ ID NO: 75718 - RNA, 18 nt, Artificial Sequence
  Description of Artificial Sequence: Synthetic oligonucleotide
gcucuucugcccuugagc

SEQ ID NO: 75719 - RNA, 18 nt, Artificial Sequence
  Description of Artificial Sequence: Synthetic oligonucleotide
gaucagcucuucugcccu

SEQ ID NO: 75720 - RNA, 18 nt, Artificial Sequence
  Description of Artificial Sequence: Synthetic oligonucleotide
uaguagaucagcucuucu

SEQ ID NO: 75721 - RNA, 18 nt, Artificial Sequence
  Description of Artificial Sequence: Synthetic oligonucleotide
acucuuaguagaucagcu

SEQ ID NO: 75722 - RNA, 18 nt, Artificial Sequence
  Description of Artificial Sequence: Synthetic oligonucleotide
ggagcacucuuaguagau

SEQ ID NO: 75723 - RNA, 18 nt, Artificial Sequence
  Description of Artificial Sequence: Synthetic oligonucleotide
ggcagggagcacucuuag

SEQ ID NO: 75724 - RNA, 18 nt, Artificial Sequence
  Description of Artificial Sequence: Synthetic oligonucleotide
uggcuggcagggagcacu

SEQ ID NO: 75725 - RNA, 18 nt, Artificial Sequence
  Description of Artificial Sequence: Synthetic oligonucleotide
cauuguggcuggcaggga

SEQ ID NO: 75726 - RNA, 18 nt, Artificial Sequence
  Description of Artificial Sequence: Synthetic oligonucleotide
ccaggcauuguggcuggc

SEQ ID NO: 75727 - RNA, 18 nt, Artificial Sequence
  Description of Artificial Sequence: Synthetic oligonucleotide
aguacccaggcauugugg

SEQ ID NO: 75728 - RNA, 18 nt, Artificial Sequence
  Description of Artificial Sequence: Synthetic oligonucleotide
gaucagcucuucugcccu

SEQ ID NO: 75729 - RNA, 18 nt, Artificial Sequence
  Description of Artificial Sequence: Synthetic oligonucleotide
uaguagaucagcucuucu

SEQ ID NO: 75730 - RNA, 18 nt, Artificial Sequence
  Description of Artificial Sequence: Synthetic oligonucleotide
acucuuaguagaucagcu

SEQ ID NO: 75731 - RNA, 18 nt, Artificial Sequence
  Description of Artificial Sequence: Synthetic oligonucleotide
ggagcacucuuaguagau

SEQ ID NO: 75732 - RNA, 18 nt, Artificial Sequence
  Description of Artificial Sequence: Synthetic oligonucleotide
ggcagggagcacucuuag

SEQ ID NO: 75733 - RNA, 18 nt, Artificial Sequence
  Description of Artificial Sequence: Synthetic oligonucleotide
uggcuggcagggagcacu

SEQ ID NO: 75734 - RNA, 18 nt, Artificial Sequence
  Description of Artificial Sequence: Synthetic oligonucleotide
cauuguggcuggcaggga

SEQ ID NO: 75735 - RNA, 18 nt, Artificial Sequence
  Description of Artificial Sequence: Synthetic oligonucleotide
ccaggcauuguggcuggc

SEQ ID NO: 75736 - RNA, 18 nt, Artificial Sequence
  Description of Artificial Sequence: Synthetic oligonucleotide
aguacccaggcauugugg

SEQ ID NO: 75737 - RNA, 18 nt, Artificial Sequence
  Description of Artificial Sequence: Synthetic oligonucleotide
augccaguacccaggcau

SEQ ID NO: 75738 - RNA, 18 nt, Artificial Sequence
  Description of Artificial Sequence: Synthetic oligonucleotide
acaggaugccaguaccca

SEQ ID NO: 75739 - RNA, 18 nt, Artificial Sequence
  Description of Artificial Sequence: Synthetic oligonucleotide
gaaagacaggaugccagu

SEQ ID NO: 75740 - RNA, 18 nt, Artificial Sequence
  Description of Artificial Sequence: Synthetic oligonucleotide
aguaggaaagacaggaug

SEQ ID NO: 75741 - RNA, 18 nt, Artificial Sequence
  Description of Artificial Sequence: Synthetic oligonucleotide
gucuaaguaggaaagaca

SEQ ID NO: 75742 - RNA, 18 nt, Artificial Sequence
  Description of Artificial Sequence: Synthetic oligonucleotide
cccuugucuaaguaggaa

SEQ ID NO: 75743 - RNA, 18 nt, Artificial Sequence
  Description of Artificial Sequence: Synthetic oligonucleotide
ggccucccuugucuaagu

SEQ ID NO: 75744 - RNA, 18 nt, Artificial Sequence
  Description of Artificial Sequence: Synthetic oligonucleotide
ucucaggccucccuuguc

SEQ ID NO: 75745 - RNA, 18 nt, Artificial Sequence
  Description of Artificial Sequence: Synthetic oligonucleotide
ccagaucucaggccuccc

SEQ ID NO: 75746 - RNA, 18 nt, Artificial Sequence
  Description of Artificial Sequence: Synthetic oligonucleotide
cagggccagaucucaggc

SEQ ID NO: 75747 - RNA, 18 nt, Artificial Sequence
  Description of Artificial Sequence: Synthetic oligonucleotide
aacaccagggccagaucu

SEQ ID NO: 75748 - RNA, 18 nt, Artificial Sequence
  Description of Artificial Sequence: Synthetic oligonucleotide
ggccaaacaccagggcca

SEQ ID NO: 75749 - RNA, 18 nt, Artificial Sequence
  Description of Artificial Sequence: Synthetic oligonucleotide
ccugaggccaaacaccag

SEQ ID NO: 75750 - RNA, 18 nt, Artificial Sequence
  Description of Artificial Sequence: Synthetic oligonucleotide
augguccugaggccaaac

SEQ ID NO: 75751 - RNA, 18 nt, Artificial Sequence
  Description of Artificial Sequence: Synthetic oligonucleotide
agaggaugguccugaggc

SEQ ID NO: 75752 - RNA, 18 nt, Artificial Sequence
  Description of Artificial Sequence: Synthetic oligonucleotide
agggcagaggaugguccu

SEQ ID NO: 75753 - RNA, 18 nt, Artificial Sequence
  Description of Artificial Sequence: Synthetic oligonucleotide
agcugagggcagaggaug

SEQ ID NO: 75754 - RNA, 18 nt, Artificial Sequence
  Description of Artificial Sequence: Synthetic oligonucleotide
auccuugugagcuguggu

SEQ ID NO: 75755 - RNA, 18 nt, Artificial Sequence
  Description of Artificial Sequence: Synthetic oligonucleotide
uugggauccuugugagcu

SEQ ID NO: 75756 - RNA, 18 nt, Artificial Sequence
  Description of Artificial Sequence: Synthetic oligonucleotide
uggcauugggauccuugu

SEQ ID NO: 75757 - RNA, 18 nt, Artificial Sequence
  Description of Artificial Sequence: Synthetic oligonucleotide
gaagauggcauugggauc

SEQ ID NO: 75758 - RNA, 18 nt, Artificial Sequence
  Description of Artificial Sequence: Synthetic oligonucleotide
cucaggaagauggcauug

SEQ ID NO: 75759 - RNA, 18 nt, Artificial Sequence
  Description of Artificial Sequence: Synthetic oligonucleotide
ggaagcucaggaagaugg

SEQ ID NO: 75760 - RNA, 18 nt, Artificial Sequence
  Description of Artificial Sequence: Synthetic oligonucleotide
guguuggaagcucaggaa

SEQ ID NO: 75761 - RNA, 18 nt, Artificial Sequence
  Description of Artificial Sequence: Synthetic oligonucleotide
agcagguguuggaagcuc

SEQ ID NO: 75762 - RNA, 18 nt, Artificial Sequence
  Description of Artificial Sequence: Synthetic oligonucleotide
cucggagcagguguugga

SEQ ID NO: 75763 - RNA, 18 nt, Artificial Sequence
  Description of Artificial Sequence: Synthetic oligonucleotide
cuuuccucggagcaggug

SEQ ID NO: 75764 - RNA, 18 nt, Artificial Sequence
  Description of Artificial Sequence: Synthetic oligonucleotide
cgcaccuuuccucggagc

SEQ ID NO: 75765 - RNA, 18 nt, Artificial Sequence
  Description of Artificial Sequence: Synthetic oligonucleotide
ggaaacgcaccuuuccuc

SEQ ID NO: 75766 - RNA, 18 nt, Artificial Sequence
  Description of Artificial Sequence: Synthetic oligonucleotide
caucaggaaacgcaccuu

SEQ ID NO: 75767 - RNA, 18 nt, Artificial Sequence
  Description of Artificial Sequence: Synthetic oligonucleotide
acaagcaucaggaaacgc

SEQ ID NO: 75768 - RNA, 18 nt, Artificial Sequence
  Description of Artificial Sequence: Synthetic oligonucleotide
cuccuacaagcaucagga

SEQ ID NO: 75769 - RNA, 18 nt, Artificial Sequence
  Description of Artificial Sequence: Synthetic oligonucleotide
ggacccuccuacaagcau

SEQ ID NO: 75770 - RNA, 18 nt, Artificial Sequence
  Description of Artificial Sequence: Synthetic oligonucleotide
aggguggacccuccuaca

SEQ ID NO: 75771 - RNA, 18 nt, Artificial Sequence
  Description of Artificial Sequence: Synthetic oligonucleotide
cgcagaggguggacccuc

SEQ ID NO: 75772 - RNA, 18 nt, Artificial Sequence
  Description of Artificial Sequence: Synthetic oligonucleotide
ccugacgcagagggugga

SEQ ID NO: 75773 - RNA, 18 nt, Artificial Sequence
  Description of Artificial Sequence: Synthetic oligonucleotide
gcccgccugacgcagagg

SEQ ID NO: 75774 - RNA, 18 nt, Artificial Sequence
  Description of Artificial Sequence: Synthetic oligonucleotide
gggcccgccugacgcaga

SEQ ID NO: 75775 - RNA, 18 nt, Artificial Sequence
  Description of Artificial Sequence: Synthetic oligonucleotide
acagcugugguggguggg

SEQ ID NO: 75776 - RNA, 18 nt, Artificial Sequence
  Description of Artificial Sequence: Synthetic oligonucleotide
gggacagcuguggugggu

SEQ ID NO: 75777 - RNA, 18 nt, Artificial Sequence
  Description of Artificial Sequence: Synthetic oligonucleotide
uagagagguucugcuggg

SEQ ID NO: 75778 - RNA, 18 nt, Artificial Sequence
  Description of Artificial Sequence: Synthetic oligonucleotide
aggacuagagagguucug

SEQ ID NO: 75779 - RNA, 18 nt, Artificial Sequence
  Description of Artificial Sequence: Synthetic oligonucleotide
gugugaggacuagagagg

SEQ ID NO: 75780 - RNA, 18 nt, Artificial Sequence
  Description of Artificial Sequence: Synthetic oligonucleotide
guucagugugaggacuag

SEQ ID NO: 75781 - RNA, 18 nt, Artificial Sequence
  Description of Artificial Sequence: Synthetic oligonucleotide
agcucguucagugugagg

SEQ ID NO: 75782 - RNA, 18 nt, Artificial Sequence
  Description of Artificial Sequence: Synthetic oligonucleotide
uugggagcucguucagug

SEQ ID NO: 75783 - RNA, 18 nt, Artificial Sequence
  Description of Artificial Sequence: Synthetic oligonucleotide
ccuguuugggagcucguu

SEQ ID NO: 75784 - RNA, 18 nt, Artificial Sequence
  Description of Artificial Sequence: Synthetic oligonucleotide
gaaguccuguuugggagc

SEQ ID NO: 75785 - RNA, 18 nt, Artificial Sequence
  Description of Artificial Sequence: Synthetic oligonucleotide
auccagaaguccuguuug

SEQ ID NO: 75786 - RNA, 18 nt, Artificial Sequence
  Description of Artificial Sequence: Synthetic oligonucleotide
caacaauccagaaguccu

SEQ ID NO: 75787 - RNA, 18 nt, Artificial Sequence
  Description of Artificial Sequence: Synthetic oligonucleotide
gucuccaacaauccagaa

SEQ ID NO: 75788 - RNA, 18 nt, Artificial Sequence
  Description of Artificial Sequence: Synthetic oligonucleotide
aguuugucuccaacaauc

SEQ ID NO: 75789 - RNA, 18 nt, Artificial Sequence
  Description of Artificial Sequence: Synthetic oligonucleotide
agugaaguuugucuccaa

SEQ ID NO: 75790 - RNA, 18 nt, Artificial Sequence
  Description of Artificial Sequence: Synthetic oligonucleotide
gaggcagugaaguuuguc

SEQ ID NO: 75791 - RNA, 18 nt, Artificial Sequence
  Description of Artificial Sequence: Synthetic oligonucleotide
uggcugaggcagugaagu

SEQ ID NO: 75792 - RNA, 18 nt, Artificial Sequence
  Description of Artificial Sequence: Synthetic oligonucleotide
aguucuggcugaggcagu

SEQ ID NO: 75793 - RNA, 18 nt, Artificial Sequence
  Description of Artificial Sequence: Synthetic oligonucleotide
ccaguaguucuggcugag

SEQ ID NO: 75794 - RNA, 18 nt, Artificial Sequence
  Description of Artificial Sequence: Synthetic oligonucleotide
cagagccaguaguucugg

SEQ ID NO: 75795 - RNA, 18 nt, Artificial Sequence
  Description of Artificial Sequence: Synthetic oligonucleotide
aagcccagagccaguagu

SEQ ID NO: 75796 - RNA, 18 nt, Artificial Sequence
  Description of Artificial Sequence: Synthetic oligonucleotide
uucagaagcccagagcca

SEQ ID NO: 75797 - RNA, 18 nt, Artificial Sequence
  Description of Artificial Sequence: Synthetic oligonucleotide
gccacuucagaagcccag

SEQ ID NO: 75798 - RNA, 18 nt, Artificial Sequence
  Description of Artificial Sequence: Synthetic oligonucleotide
cugcugccacuucagaag

SEQ ID NO: 75799 - RNA, 18 nt, Artificial Sequence
  Description of Artificial Sequence: Synthetic oligonucleotide
aaucccugcugccacuuc

SEQ ID NO: 75800 - RNA, 18 nt, Artificial Sequence
  Description of Artificial Sequence: Synthetic oligonucleotide
cucugaaucccugcugcc

SEQ ID NO: 75801 - RNA, 18 nt, Artificial Sequence
  Description of Artificial Sequence: Synthetic oligonucleotide
cuuggcucugaaucccug

SEQ ID NO: 75802 - RNA, 18 nt, Artificial Sequence
  Description of Artificial Sequence: Synthetic oligonucleotide
ggaaucuuggcucugaau

SEQ ID NO: 75803 - RNA, 18 nt, Artificial Sequence
  Description of Artificial Sequence: Synthetic oligonucleotide
gaccaggaaucuuggcuc

SEQ ID NO: 75804 - RNA, 18 nt, Artificial Sequence
  Description of Artificial Sequence: Synthetic oligonucleotide
cagcagaccaggaaucuu

SEQ ID NO: 75805 - RNA, 18 nt, Artificial Sequence
  Description of Artificial Sequence: Synthetic oligonucleotide
ugguucagcagaccagga

SEQ ID NO: 75806 - RNA, 18 nt, Artificial Sequence
  Description of Artificial Sequence: Synthetic oligonucleotide
agguuugguucagcagac

SEQ ID NO: 75807 - RNA, 18 nt, Artificial Sequence
  Description of Artificial Sequence: Synthetic oligonucleotide
ccuggagguuugguucag

SEQ ID NO: 75808 - RNA, 18 nt, Artificial Sequence
  Description of Artificial Sequence: Synthetic oligonucleotide
agggaccuggagguuugg

SEQ ID NO: 75809 - RNA, 18 nt, Artificial Sequence
  Description of Artificial Sequence: Synthetic oligonucleotide
gguccagggaccuggagg

SEQ ID NO: 75810 - RNA, 18 nt, Artificial Sequence
  Description of Artificial Sequence: Synthetic oligonucleotide
gauuugguccagggaccu

SEQ ID NO: 75811 - RNA, 18 nt, Artificial Sequence
  Description of Artificial Sequence: Synthetic oligonucleotide
gggauuugguccagggac

SEQ ID NO: 75812 - RNA, 18 nt, Artificial Sequence
  Description of Artificial Sequence: Synthetic oligonucleotide
ccuguucagguauccggg

SEQ ID NO: 75813 - RNA, 18 nt, Artificial Sequence
  Description of Artificial Sequence: Synthetic oligonucleotide
uguauccuguucagguau

SEQ ID NO: 75814 - RNA, 18 nt, Artificial Sequence
  Description of Artificial Sequence: Synthetic oligonucleotide
guucguguauccuguuca

SEQ ID NO: 75815 - RNA, 18 nt, Artificial Sequence
  Description of Artificial Sequence: Synthetic oligonucleotide
caagaguucguguauccu

SEQ ID NO: 75816 - RNA, 18 nt, Artificial Sequence
  Description of Artificial Sequence: Synthetic oligonucleotide
ccauucaagaguucgugu

SEQ ID NO: 75817 - RNA, 18 nt, Artificial Sequence
  Description of Artificial Sequence: Synthetic oligonucleotide
gaguuccauucaagaguu

SEQ ID NO: 75818 - RNA, 18 nt, Artificial Sequence
  Description of Artificial Sequence: Synthetic oligonucleotide
uccacgaguuccauucaa

SEQ ID NO: 75819 - RNA, 18 nt, Artificial Sequence
  Description of Artificial Sequence: Synthetic oligonucleotide
aagaguccacgaguucca

SEQ ID NO: 75820 - RNA, 18 nt, Artificial Sequence
  Description of Artificial Sequence: Synthetic oligonucleotide
caggaaagaguccacgag

SEQ ID NO: 75821 - RNA, 18 nt, Artificial Sequence
  Description of Artificial Sequence: Synthetic oligonucleotide
ggguccaggaaagagucc

SEQ ID NO: 75822 - RNA, 18 nt, Artificial Sequence
  Description of Artificial Sequence: Synthetic oligonucleotide
cgugaggguccaggaaag

SEQ ID NO: 75823 - RNA, 18 nt, Artificial Sequence
  Description of Artificial Sequence: Synthetic oligonucleotide
uccugcgugaggguccag

SEQ ID NO: 75824 - RNA, 18 nt, Artificial Sequence
  Description of Artificial Sequence: Synthetic oligonucleotide
uaggguccugcgugaggg

SEQ ID NO: 75825 - RNA, 18 nt, Artificial Sequence
  Description of Artificial Sequence: Synthetic oligonucleotide
gcuccuaggguccugcgu

SEQ ID NO: 75826 - RNA, 18 nt, Artificial Sequence
  Description of Artificial Sequence: Synthetic oligonucleotide
gggcuccuaggguccugc

SEQ ID NO: 75827 - RNA, 18 nt, Artificial Sequence
  Description of Artificial Sequence: Synthetic oligonucleotide
ccugaggaaauguccggg

SEQ ID NO: 75828 - RNA, 18 nt, Artificial Sequence
  Description of Artificial Sequence: Synthetic oligonucleotide
auguuccugaggaaaugu

SEQ ID NO: 75829 - RNA, 18 nt, Artificial Sequence
  Description of Artificial Sequence: Synthetic oligonucleotide
gucugauguuccugagga

SEQ ID NO: 75830 - RNA, 18 nt, Artificial Sequence
  Description of Artificial Sequence: Synthetic oligonucleotide
ccugugucugauguuccu

SEQ ID NO: 75831 - RNA, 18 nt, Artificial Sequence
  Description of Artificial Sequence: Synthetic oligonucleotide
gggagccugugucugaug

SEQ ID NO: 75832 - RNA, 18 nt, Artificial Sequence
  Description of Artificial Sequence: Synthetic oligonucleotide
uggcagggagccuguguc

SEQ ID NO: 75833 - RNA, 18 nt, Artificial Sequence
  Description of Artificial Sequence: Synthetic oligonucleotide
uuggguggcagggagccu

SEQ ID NO: 75834 - RNA, 18 nt, Artificial Sequence
  Description of Artificial Sequence: Synthetic oligonucleotide
ggagguuggguggcaggg

SEQ ID NO: 75835 - RNA, 18 nt, Artificial Sequence
  Description of Artificial Sequence: Synthetic oligonucleotide
aggcuggagguugggugg

SEQ ID NO: 75836 - RNA, 18 nt, Artificial Sequence
  Description of Artificial Sequence: Synthetic oligonucleotide
uauccaggcuggagguug

SEQ ID NO: 75837 - RNA, 18 nt, Artificial Sequence
  Description of Artificial Sequence: Synthetic oligonucleotide
gagaauauccaggcugga

SEQ ID NO: 75838 - RNA, 18 nt, Artificial Sequence
  Description of Artificial Sequence: Synthetic oligonucleotide
ggaaggagaauauccagg

SEQ ID NO: 75839 - RNA, 18 nt, Artificial Sequence
  Description of Artificial Sequence: Synthetic oligonucleotide
gggaaggagaauauccag

SEQ ID NO: 75840 - RNA, 18 nt, Artificial Sequence
  Description of Artificial Sequence: Synthetic oligonucleotide
guaggaggauggguuggg

SEQ ID NO: 75841 - RNA, 18 nt, Artificial Sequence
  Description of Artificial Sequence: Synthetic oligonucleotide
guccaguaggaggauggg

SEQ ID NO: 75842 - RNA, 18 nt, Artificial Sequence
  Description of Artificial Sequence: Synthetic oligonucleotide
auacuguccaguaggagg

SEQ ID NO: 75843 - RNA, 18 nt, Artificial Sequence
  Description of Artificial Sequence: Synthetic oligonucleotide
agcguauacuguccagua

SEQ ID NO: 75844 - RNA, 18 nt, Artificial Sequence
  Description of Artificial Sequence: Synthetic oligonucleotide
ggaagagcguauacuguc

SEQ ID NO: 75845 - RNA, 18 nt, Artificial Sequence
  Description of Artificial Sequence: Synthetic oligonucleotide
aagagggaagagcguaua

SEQ ID NO: 75846 - RNA, 18 nt, Artificial Sequence
  Description of Artificial Sequence: Synthetic oligonucleotide
gguggaagagggaagagc

SEQ ID NO: 75847 - RNA, 18 nt, Artificial Sequence
  Description of Artificial Sequence: Synthetic oligonucleotide
agguggguggaagaggga

SEQ ID NO: 75848 - RNA, 18 nt, Artificial Sequence
  Description of Artificial Sequence: Synthetic oligonucleotide
gggcaagguggguggaag

SEQ ID NO: 75849 - RNA, 18 nt, Artificial Sequence
  Description of Artificial Sequence: Synthetic oligonucleotide
gggugggcaaggugggug

SEQ ID NO: 75850 - RNA, 18 nt, Artificial Sequence
  Description of Artificial Sequence: Synthetic oligonucleotide
uggagcuggaccacaggg

SEQ ID NO: 75851 - RNA, 18 nt, Artificial Sequence
  Description of Artificial Sequence: Synthetic oligonucleotide
ggguggagcuggaccaca

SEQ ID NO: 75852 - RNA, 18 nt, Artificial Sequence
  Description of Artificial Sequence: Synthetic oligonucleotide
aagggucaggaagcaggg

SEQ ID NO: 75853 - RNA, 18 nt, Artificial Sequence
  Description of Artificial Sequence: Synthetic oligonucleotide
agcagaagggucaggaag

SEQ ID NO: 75854 - RNA, 18 nt, Artificial Sequence
  Description of Artificial Sequence: Synthetic oligonucleotide
guuggagcagaaggguca

SEQ ID NO: 75855 - RNA, 18 nt, Artificial Sequence
  Description of Artificial Sequence: Synthetic oligonucleotide
ugggcguuggagcagaag

SEQ ID NO: 75856 - RNA, 18 nt, Artificial Sequence
  Description of Artificial Sequence: Synthetic oligonucleotide
gggugggcguuggagcag

SEQ ID NO: 75857 - RNA, 18 nt, Artificial Sequence
  Description of Artificial Sequence: Synthetic oligonucleotide
agaagagggcugguaggg

SEQ ID NO: 75858 - RNA, 18 nt, Artificial Sequence
  Description of Artificial Sequence: Synthetic oligonucleotide
uguuuagaagagggcugg

SEQ ID NO: 75859 - RNA, 18 nt, Artificial Sequence
  Description of Artificial Sequence: Synthetic oligonucleotide
ggauguguuuagaagagg

SEQ ID NO: 75860 - RNA, 18 nt, Artificial Sequence
  Description of Artificial Sequence: Synthetic oligonucleotide
guguaggauguguuuaga

SEQ ID NO: 75861 - RNA, 18 nt, Artificial Sequence
  Description of Artificial Sequence: Synthetic oligonucleotide
aguggguguaggaugugu

SEQ ID NO: 75862 - RNA, 18 nt, Artificial Sequence
  Description of Artificial Sequence: Synthetic oligonucleotide
cugggaguggguguagga

SEQ ID NO: 75863 - RNA, 18 nt, Artificial Sequence
  Description of Artificial Sequence: Synthetic oligonucleotide
agauucugggagugggug

SEQ ID NO: 75864 - RNA, 18 nt, Artificial Sequence
  Description of Artificial Sequence: Synthetic oligonucleotide
gagacagauucugggagu

SEQ ID NO: 75865 - RNA, 18 nt, Artificial Sequence
  Description of Artificial Sequence: Synthetic oligonucleotide
uuccugagacagauucug

SEQ ID NO: 75866 - RNA, 18 nt, Artificial Sequence
  Description of Artificial Sequence: Synthetic oligonucleotide
uacccuuccugagacaga

SEQ ID NO: 75867 - RNA, 18 nt, Artificial Sequence
  Description of Artificial Sequence: Synthetic oligonucleotide
aaccuuacccuuccugag

SEQ ID NO: 75868 - RNA, 18 nt, Artificial Sequence
  Description of Artificial Sequence: Synthetic oligonucleotide
cugagaaccuuacccuuc

SEQ ID NO: 75869 - RNA, 18 nt, Artificial Sequence
  Description of Artificial Sequence: Synthetic oligonucleotide
agugucugagaaccuuac

SEQ ID NO: 75870 - RNA, 18 nt, Artificial Sequence
  Description of Artificial Sequence: Synthetic oligonucleotide
ucggcagugucugagaac

SEQ ID NO: 75871 - RNA, 18 nt, Artificial Sequence
  Description of Artificial Sequence: Synthetic oligonucleotide
ugaugucggcagugucug

SEQ ID NO: 75872 - RNA, 18 nt, Artificial Sequence
  Description of Artificial Sequence: Synthetic oligonucleotide
aaugcugaugucggcagu

SEQ ID NO: 75873 - RNA, 18 nt, Artificial Sequence
  Description of Artificial Sequence: Synthetic oligonucleotide
gagacaaugcugaugucg

SEQ ID NO: 75874 - RNA, 18 nt, Artificial Sequence
  Description of Artificial Sequence: Synthetic oligonucleotide
uacacgagacaaugcuga

SEQ ID NO: 75875 - RNA, 18 nt, Artificial Sequence
  Description of Artificial Sequence: Synthetic oligonucleotide
agcuguacacgagacaau

SEQ ID NO: 75876 - RNA, 18 nt, Artificial Sequence
  Description of Artificial Sequence: Synthetic oligonucleotide
aagggagcuguacacgag

SEQ ID NO: 75877 - RNA, 18 nt, Artificial Sequence
  Description of Artificial Sequence: Synthetic oligonucleotide
cagggaagggagcuguac

SEQ ID NO: 75878 - RNA, 18 nt, Artificial Sequence
  Description of Artificial Sequence: Synthetic oligonucleotide
cccugcagggaagggagc

SEQ ID NO: 75879 - RNA, 18 nt, Artificial Sequence
  Description of Artificial Sequence: Synthetic oligonucleotide
gggcgcccugcagggaag

SEQ ID NO: 75880 - RNA, 18 nt, Artificial Sequence
  Description of Artificial Sequence: Synthetic oligonucleotide
cuuguccaguugucuccc

SEQ ID NO: 75881 - RNA, 18 nt, Artificial Sequence
  Description of Artificial Sequence: Synthetic oligonucleotide
gaaaucuuguccaguugu

SEQ ID NO: 75882 - RNA, 18 nt, Artificial Sequence
  Description of Artificial Sequence: Synthetic oligonucleotide
aguaggaaaucuugucca

SEQ ID NO: 75883 - RNA, 18 nt, Artificial Sequence
  Description of Artificial Sequence: Synthetic oligonucleotide
gagaaaguaggaaaucuu

SEQ ID NO: 75884 - RNA, 18 nt, Artificial Sequence
  Description of Artificial Sequence: Synthetic oligonucleotide
uucaggagaaaguaggaa

SEQ ID NO: 75885 - RNA, 18 nt, Artificial Sequence
  Description of Artificial Sequence: Synthetic oligonucleotide
uggguuucaggagaaagu

SEQ ID NO: 75886 - RNA, 18 nt, Artificial Sequence
  Description of Artificial Sequence: Synthetic oligonucleotide
ggcuuuggguuucaggag

SEQ ID NO: 75887 - RNA, 18 nt, Artificial Sequence
  Description of Artificial Sequence: Synthetic oligonucleotide
accagggcuuuggguuuc

SEQ ID NO: 75888 - RNA, 18 nt, Artificial Sequence
  Description of Artificial Sequence: Synthetic oligonucleotide
cuuuuaccagggcuuugg

SEQ ID NO: 75889 - RNA, 18 nt, Artificial Sequence
  Description of Artificial Sequence: Synthetic oligonucleotide
uaucccuuuuaccagggc

SEQ ID NO: 75890 - RNA, 18 nt, Artificial Sequence
  Description of Artificial Sequence: Synthetic oligonucleotide
cuguguaucccuuuuacc

SEQ ID NO: 75891 - RNA, 18 nt, Artificial Sequence
  Description of Artificial Sequence: Synthetic oligonucleotide
caguccuguguaucccuu

SEQ ID NO: 75892 - RNA, 18 nt, Artificial Sequence
  Description of Artificial Sequence: Synthetic oligonucleotide
cuuuucaguccuguguau

SEQ ID NO: 75893 - RNA, 18 nt, Artificial Sequence
  Description of Artificial Sequence: Synthetic oligonucleotide
auucccuuuucaguccug

SEQ ID NO: 75894 - RNA, 18 nt, Artificial Sequence
  Description of Artificial Sequence: Synthetic oligonucleotide
aaaugauucccuuuucag

SEQ ID NO: 75895 - RNA, 18 nt, Artificial Sequence
  Description of Artificial Sequence: Synthetic oligonucleotide
gugaaaaaugauucccuu

SEQ ID NO: 75896 - RNA, 18 nt, Artificial Sequence
  Description of Artificial Sequence: Synthetic oligonucleotide
guacagugaaaaaugauu

SEQ ID NO: 75897 - RNA, 18 nt, Artificial Sequence
  Description of Artificial Sequence: Synthetic oligonucleotide
auaauguacagugaaaaa

SEQ ID NO: 75898 - RNA, 18 nt, Artificial Sequence
  Description of Artificial Sequence: Synthetic oligonucleotide
gguuuauaauguacagug

SEQ ID NO: 75899 - RNA, 18 nt, Artificial Sequence
  Description of Artificial Sequence: Synthetic oligonucleotide
cugaagguuuauaaugua

SEQ ID NO: 75900 - RNA, 18 nt, Artificial Sequence
  Description of Artificial Sequence: Synthetic oligonucleotide
agcuucugaagguuuaua

SEQ ID NO: 75901 - RNA, 18 nt, Artificial Sequence
  Description of Artificial Sequence: Synthetic oligonucleotide
aaaauagcuucugaaggu

SEQ ID NO: 75902 - RNA, 18 nt, Artificial Sequence
  Description of Artificial Sequence: Synthetic oligonucleotide
uuaaaaaaauagcuucug

SEQ ID NO: 75903 - RNA, 18 nt, Artificial Sequence
  Description of Artificial Sequence: Synthetic oligonucleotide
auagcuuaaaaaaauagc

SEQ ID NO: 75904 - RNA, 18 nt, Artificial Sequence
  Description of Artificial Sequence: Synthetic oligonucleotide
ugcugauagcuuaaaaaa

SEQ ID NO: 75905 - RNA, 18 nt, Artificial Sequence
  Description of Artificial Sequence: Synthetic oligonucleotide
aguauugcugauagcuua

SEQ ID NO: 75906 - RNA, 18 nt, Artificial Sequence
  Description of Artificial Sequence: Synthetic oligonucleotide
ugaugaguauugcugaua

SEQ ID NO: 75907 - RNA, 18 nt, Artificial Sequence
  Description of Artificial Sequence: Synthetic oligonucleotide
ugcucugaugaguauugc

SEQ ID NO: 75908 - RNA, 18 nt, Artificial Sequence
  Description of Artificial Sequence: Synthetic oligonucleotide
cuagcugcucugaugagu

SEQ ID NO: 75909 - RNA, 18 nt, Artificial Sequence
  Description of Artificial Sequence: Synthetic oligonucleotide
aagagcuagcugcucuga

SEQ ID NO: 75910 - RNA, 18 nt, Artificial Sequence
  Description of Artificial Sequence: Synthetic oligonucleotide
gaccaaagagcuagcugc

SEQ ID NO: 75911 - RNA, 18 nt, Artificial Sequence
  Description of Artificial Sequence: Synthetic oligonucleotide
aaauagaccaaagagcua

SEQ ID NO: 75912 - RNA, 18 nt, Artificial Sequence
  Description of Artificial Sequence: Synthetic oligonucleotide
gcagaaaauagaccaaag

SEQ ID NO: 75913 - RNA, 18 nt, Artificial Sequence
  Description of Artificial Sequence: Synthetic oligonucleotide
uuucugcagaaaauagac

SEQ ID NO: 75914 - RNA, 18 nt, Artificial Sequence
  Description of Artificial Sequence: Synthetic oligonucleotide
gcaaauuucugcagaaaa

SEQ ID NO: 75915 - RNA, 18 nt, Artificial Sequence
  Description of Artificial Sequence: Synthetic oligonucleotide
gaguugcaaauuucugca

SEQ ID NO: 75916 - RNA, 18 nt, Artificial Sequence
  Description of Artificial Sequence: Synthetic oligonucleotide
ucagugaguugcaaauuu

SEQ ID NO: 75917 - RNA, 18 nt, Artificial Sequence
  Description of Artificial Sequence: Synthetic oligonucleotide
gagaaucagugaguugca

SEQ ID NO: 75918 - RNA, 18 nt, Artificial Sequence
  Description of Artificial Sequence: Synthetic oligonucleotide
auguagagaaucagugag

SEQ ID NO: 75919 - RNA, 18 nt, Artificial Sequence
  Description of Artificial Sequence: Synthetic oligonucleotide
agagcauguagagaauca

SEQ ID NO: 75920 - RNA, 18 nt, Artificial Sequence
  Description of Artificial Sequence: Synthetic oligonucleotide
gaaaaagagcauguagag

SEQ ID NO: 75921 - RNA, 18 nt, Artificial Sequence
  Description of Artificial Sequence: Synthetic oligonucleotide
ucacagaaaaagagcaug

SEQ ID NO: 75922 - RNA, 18 nt, Artificial Sequence
  Description of Artificial Sequence: Synthetic oligonucleotide
aguuaucacagaaaaaga

SEQ ID NO: 75923 - RNA, 18 nt, Artificial Sequence
  Description of Artificial Sequence: Synthetic oligonucleotide
ugcagaguuaucacagaa

SEQ ID NO: 75924 - RNA, 18 nt, Artificial Sequence
  Description of Artificial Sequence: Synthetic oligonucleotide
gccuuugcagaguuauca

SEQ ID NO: 75925 - RNA, 18 nt, Artificial Sequence
  Description of Artificial Sequence: Synthetic oligonucleotide
cccaggccuuugcagagu

SEQ ID NO: 75926 - RNA, 18 nt, Artificial Sequence
  Description of Artificial Sequence: Synthetic oligonucleotide
gccagcccaggccuuugc

SEQ ID NO: 75927 - RNA, 18 nt, Artificial Sequence
  Description of Artificial Sequence: Synthetic oligonucleotide
gccaggccagcccaggcc

SEQ ID NO: 75928 - RNA, 18 nt, Artificial Sequence
  Description of Artificial Sequence: Synthetic oligonucleotide
caacugccaggccagccc

SEQ ID NO: 75929 - RNA, 18 nt, Artificial Sequence
  Description of Artificial Sequence: Synthetic oligonucleotide
cuguucaacugccaggcc

SEQ ID NO: 75930 - RNA, 18 nt, Artificial Sequence
  Description of Artificial Sequence: Synthetic oligonucleotide
ucccucuguucaacugcc

SEQ ID NO: 75931 - RNA, 18 nt, Artificial Sequence
  Description of Artificial Sequence: Synthetic oligonucleotide
gucucucccucuguucaa

SEQ ID NO: 75932 - RNA, 18 nt, Artificial Sequence
  Description of Artificial Sequence: Synthetic oligonucleotide
gguuagucucucccucug

SEQ ID NO: 75933 - RNA, 18 nt, Artificial Sequence
  Description of Artificial Sequence: Synthetic oligonucleotide
cucaagguuagucucucc

SEQ ID NO: 75934 - RNA, 18 nt, Artificial Sequence
  Description of Artificial Sequence: Synthetic oligonucleotide
ucugacucaagguuaguc

SEQ ID NO: 75935 - RNA, 18 nt, Artificial Sequence
  Description of Artificial Sequence: Synthetic oligonucleotide
uguuuucugacucaaggu

SEQ ID NO: 75936 - RNA, 18 nt, Artificial Sequence
  Description of Artificial Sequence: Synthetic oligonucleotide
uucucuguuuucugacuc

SEQ ID NO: 75937 - RNA, 18 nt, Artificial Sequence
  Description of Artificial Sequence: Synthetic oligonucleotide
acccuuucucuguuuucu

SEQ ID NO: 75938 - RNA, 18 nt, Artificial Sequence
  Description of Artificial Sequence: Synthetic oligonucleotide
aaauuacccuuucucugu

SEQ ID NO: 75939 - RNA, 18 nt, Artificial Sequence
  Description of Artificial Sequence: Synthetic oligonucleotide
aaaggaaauuacccuuuc

SEQ ID NO: 75940 - RNA, 18 nt, Artificial Sequence
  Description of Artificial Sequence: Synthetic oligonucleotide
gaagcaaaggaaauuacc

SEQ ID NO: 75941 - RNA, 18 nt, Artificial Sequence
  Description of Artificial Sequence: Synthetic oligonucleotide
aauuugaagcaaaggaaa

SEQ ID NO: 75942 - RNA, 18 nt, Artificial Sequence
  Description of Artificial Sequence: Synthetic oligonucleotide
ccuugaauuugaagcaaa

SEQ ID NO: 75943 - RNA, 18 nt, Artificial Sequence
  Description of Artificial Sequence: Synthetic oligonucleotide
gaaggccuugaauuugaa

SEQ ID NO: 75944 - RNA, 18 nt, Artificial Sequence
  Description of Artificial Sequence: Synthetic oligonucleotide
cguuggaaggccuugaau

SEQ ID NO: 75945 - RNA, 18 nt, Artificial Sequence
  Description of Artificial Sequence: Synthetic oligonucleotide
gggcguuggaaggccuug

SEQ ID NO: 75946 - RNA, 18 nt, Artificial Sequence
  Description of Artificial Sequence: Synthetic oligonucleotide
gagaaugauaguaaaggg

SEQ ID NO: 75947 - RNA, 18 nt, Artificial Sequence
  Description of Artificial Sequence: Synthetic oligonucleotide
ccacugagaaugauagua

SEQ ID NO: 75948 - RNA, 18 nt, Artificial Sequence
  Description of Artificial Sequence: Synthetic oligonucleotide
gagucccacugagaauga

SEQ ID NO: 75949 - RNA, 18 nt, Artificial Sequence
  Description of Artificial Sequence: Synthetic oligonucleotide
gaucagagucccacugag

SEQ ID NO: 75950 - RNA, 18 nt, Artificial Sequence
  Description of Artificial Sequence: Synthetic oligonucleotide
uaugggaucagaguccca

SEQ ID NO: 75951 - RNA, 18 nt, Artificial Sequence
  Description of Artificial Sequence: Synthetic oligonucleotide
aagaauaugggaucagag

SEQ ID NO: 75952 - RNA, 18 nt, Artificial Sequence
  Description of Artificial Sequence: Synthetic oligonucleotide
cuguuaagaauaugggau

SEQ ID NO: 75953 - RNA, 18 nt, Artificial Sequence
  Description of Artificial Sequence: Synthetic oligonucleotide
aagaucuguuaagaauau

SEQ ID NO: 75954 - RNA, 18 nt, Artificial Sequence
  Description of Artificial Sequence: Synthetic oligonucleotide
gaguaaagaucuguuaag

SEQ ID NO: 75955 - RNA, 18 nt, Artificial Sequence
  Description of Artificial Sequence: Synthetic oligonucleotide
cucaagaguaaagaucug

SEQ ID NO: 75956 - RNA, 18 nt, Artificial Sequence
  Description of Artificial Sequence: Synthetic oligonucleotide
cauuucucaagaguaaag

SEQ ID NO: 75957 - RNA, 18 nt, Artificial Sequence
  Description of Artificial Sequence: Synthetic oligonucleotide
uuauucauuucucaagag

SEQ ID NO: 75958 - RNA, 18 nt, Artificial Sequence
  Description of Artificial Sequence: Synthetic oligonucleotide
aaagcuuauucauuucuc

SEQ ID NO: 75959 - RNA, 18 nt, Artificial Sequence
  Description of Artificial Sequence: Synthetic oligonucleotide
gagagaaagcuuauucau

SEQ ID NO: 75960 - RNA, 18 nt, Artificial Sequence
  Description of Artificial Sequence: Synthetic oligonucleotide
uuucugagagaaagcuua

SEQ ID NO: 75961 - RNA, 18 nt, Artificial Sequence
  Description of Artificial Sequence: Synthetic oligonucleotide
cagcauuucugagagaaa

SEQ ID NO: 75962 - RNA, 18 nt, Artificial Sequence
  Description of Artificial Sequence: Synthetic oligonucleotide
agggacagcauuucugag

SEQ ID NO: 75963 - RNA, 18 nt, Artificial Sequence
  Description of Artificial Sequence: Synthetic oligonucleotide
uguauagggacagcauuu

SEQ ID NO: 75964 - RNA, 18 nt, Artificial Sequence
  Description of Artificial Sequence: Synthetic oligonucleotide
ucuaguguauagggacag

SEQ ID NO: 75965 - RNA, 18 nt, Artificial Sequence
  Description of Artificial Sequence: Synthetic oligonucleotide
uuuugucuaguguauagg

SEQ ID NO: 75966 - RNA, 18 nt, Artificial Sequence
  Description of Artificial Sequence: Synthetic oligonucleotide
cucaguuuugucuagugu

SEQ ID NO: 75967 - RNA, 18 nt, Artificial Sequence
  Description of Artificial Sequence: Synthetic oligonucleotide
acaggcucaguuuugucu

SEQ ID NO: 75968 - RNA, 18 nt, Artificial Sequence
  Description of Artificial Sequence: Synthetic oligonucleotide
cuuauacaggcucaguuu

SEQ ID NO: 75969 - RNA, 18 nt, Artificial Sequence
  Description of Artificial Sequence: Synthetic oligonucleotide
uauuccuuauacaggcuc

SEQ ID NO: 75970 - RNA, 18 nt, Artificial Sequence
  Description of Artificial Sequence: Synthetic oligonucleotide
ccauuuauuccuuauaca

SEQ ID NO: 75971 - RNA, 18 nt, Artificial Sequence
  Description of Artificial Sequence: Synthetic oligonucleotide
cgcucccauuuauuccuu

SEQ ID NO: 75972 - RNA, 18 nt, Artificial Sequence
  Description of Artificial Sequence: Synthetic oligonucleotide
uucggcgcucccauuuau

SEQ ID NO: 75973 - RNA, 18 nt, Artificial Sequence
  Description of Artificial Sequence: Synthetic oligonucleotide
agcuuuucggcgcuccca

SEQ ID NO: 75974 - RNA, 18 nt, Artificial Sequence
  Description of Artificial Sequence: Synthetic oligonucleotide
uagggagcuuuucggcgc

SEQ ID NO: 75975 - RNA, 18 nt, Artificial Sequence
  Description of Artificial Sequence: Synthetic oligonucleotide
cuuuuuagggagcuuuuc

SEQ ID NO: 75976 - RNA, 18 nt, Artificial Sequence
  Description of Artificial Sequence: Synthetic oligonucleotide
aguuuuucauucacuucu

SEQ ID NO: 75977 - RNA, 18 nt, Artificial Sequence
  Description of Artificial Sequence: Synthetic oligonucleotide
cucgaaguuuuucauuca

SEQ ID NO: 75978 - RNA, 18 nt, Artificial Sequence
  Description of Artificial Sequence: Synthetic oligonucleotide
uguaucucgaaguuuuuc

SEQ ID NO: 75979 - RNA, 18 nt, Artificial Sequence
  Description of Artificial Sequence: Synthetic oligonucleotide
ucugcuguaucucgaagu

SEQ ID NO: 75980 - RNA, 18 nt, Artificial Sequence
  Description of Artificial Sequence: Synthetic oligonucleotide
ucccgucugcuguaucuc

SEQ ID NO: 75981 - RNA, 18 nt, Artificial Sequence
  Description of Artificial Sequence: Synthetic oligonucleotide
aaaggucccgucugcugu

SEQ ID NO: 75982 - RNA, 18 nt, Artificial Sequence
  Description of Artificial Sequence: Synthetic oligonucleotide
accaaaaaggucccgucu

SEQ ID NO: 75983 - RNA, 18 nt, Artificial Sequence
  Description of Artificial Sequence: Synthetic oligonucleotide
cucguaccaaaaaggucc

SEQ ID NO: 75984 - RNA, 18 nt, Artificial Sequence
  Description of Artificial Sequence: Synthetic oligonucleotide
cgcaucucguaccaaaaa

SEQ ID NO: 75985 - RNA, 18 nt, Artificial Sequence
  Description of Artificial Sequence: Synthetic oligonucleotide
guagacgcaucucguacc

SEQ ID NO: 75986 - RNA, 18 nt, Artificial Sequence
  Description of Artificial Sequence: Synthetic oligonucleotide
uuuuaguagacgcaucuc

SEQ ID NO: 75987 - RNA, 18 nt, Artificial Sequence
  Description of Artificial Sequence: Synthetic oligonucleotide
augcauuuuaguagacgc

SEQ ID NO: 75988 - RNA, 18 nt, Artificial Sequence
  Description of Artificial Sequence: Synthetic oligonucleotide
ucaccaugcauuuuagua

SEQ ID NO: 75989 - RNA, 18 nt, Artificial Sequence
  Description of Artificial Sequence: Synthetic oligonucleotide
uauaaucaccaugcauuu

SEQ ID NO: 75990 - RNA, 18 nt, Artificial Sequence
  Description of Artificial Sequence: Synthetic oligonucleotide
aagaguauaaucaccaug

SEQ ID NO: 75991 - RNA, 18 nt, Artificial Sequence
  Description of Artificial Sequence: Synthetic oligonucleotide
aguguaagaguauaauca

SEQ ID NO: 75992 - RNA, 18 nt, Artificial Sequence
  Description of Artificial Sequence: Synthetic oligonucleotide
uucagcuauauucccugg

SEQ ID NO: 75993 - RNA, 18 nt, Artificial Sequence
  Description of Artificial Sequence: Synthetic oligonucleotide
cuaauuucagcuauauuc

SEQ ID NO: 75994 - RNA, 18 nt, Artificial Sequence
  Description of Artificial Sequence: Synthetic oligonucleotide
aaacccuaauuucagcua

SEQ ID NO: 75995 - RNA, 18 nt, Artificial Sequence
  Description of Artificial Sequence: Synthetic oligonucleotide
gcccaaaacccuaauuuc

SEQ ID NO: 75996 - RNA, 18 nt, Artificial Sequence
  Description of Artificial Sequence: Synthetic oligonucleotide
uaucagcccaaaacccua

SEQ ID NO: 75997 - RNA, 18 nt, Artificial Sequence
  Description of Artificial Sequence: Synthetic oligonucleotide
uuuaauaucagcccaaaa

SEQ ID NO: 75998 - RNA, 18 nt, Artificial Sequence
  Description of Artificial Sequence: Synthetic oligonucleotide
uauguuuuaauaucagcc

SEQ ID NO: 75999 - RNA, 18 nt, Artificial Sequence
  Description of Artificial Sequence: Synthetic oligonucleotide
ggaaauauguuuuaauau

SEQ ID NO: 76000 - RNA, 18 nt, Artificial Sequence
  Description of Artificial Sequence: Synthetic oligonucleotide
aauaaggaaauauguuuu

SEQ ID NO: 76001 - RNA, 18 nt, Artificial Sequence
  Description of Artificial Sequence: Synthetic oligonucleotide
uuuggaauaaggaaauau

SEQ ID NO: 76002 - RNA, 18 nt, Artificial Sequence
  Description of Artificial Sequence: Synthetic oligonucleotide
aacauuuuggaauaagga

SEQ ID NO: 76003 - RNA, 18 nt, Artificial Sequence
  Description of Artificial Sequence: Synthetic oligonucleotide
guauuaacauuuuggaau

SEQ ID NO: 76004 - RNA, 18 nt, Artificial Sequence
  Description of Artificial Sequence: Synthetic oligonucleotide
gcccaaaacccuaauuuc

SEQ ID NO: 76005 - RNA, 18 nt, Artificial Sequence
  Description of Artificial Sequence: Synthetic oligonucleotide
uaucagcccaaaacccua

SEQ ID NO: 76006 - RNA, 18 nt, Artificial Sequence
  Description of Artificial Sequence: Synthetic oligonucleotide
uuuaauaucagcccaaaa

SEQ ID NO: 76007 - RNA, 18 nt, Artificial Sequence
  Description of Artificial Sequence: Synthetic oligonucleotide
uauguuuuaauaucagcc

SEQ ID NO: 76008 - RNA, 18 nt, Artificial Sequence
  Description of Artificial Sequence: Synthetic oligonucleotide
ggaaauauguuuuaauau

SEQ ID NO: 76009 - RNA, 18 nt, Artificial Sequence
  Description of Artificial Sequence: Synthetic oligonucleotide
aauaaggaaauauguuuu

SEQ ID NO: 76010 - RNA, 18 nt, Artificial Sequence
  Description of Artificial Sequence: Synthetic oligonucleotide
uuuggaauaaggaaauau

SEQ ID NO: 76011 - RNA, 18 nt, Artificial Sequence
  Description of Artificial Sequence: Synthetic oligonucleotide
aacauuuuggaauaagga

SEQ ID NO: 76012 - RNA, 18 nt, Artificial Sequence
  Description of Artificial Sequence: Synthetic oligonucleotide
guauuaacauuuuggaau

SEQ ID NO: 76013 - RNA, 18 nt, Artificial Sequence
  Description of Artificial Sequence: Synthetic oligonucleotide
uaaagguauuaacauuuu

SEQ ID NO: 76014 - RNA, 18 nt, Artificial Sequence
  Description of Artificial Sequence: Synthetic oligonucleotide
aaaaauaaagguauuaac

SEQ ID NO: 76015 - RNA, 18 nt, Artificial Sequence
  Description of Artificial Sequence: Synthetic oligonucleotide
uuuguuauuucccccuuu

SEQ ID NO: 76016 - RNA, 18 nt, Artificial Sequence
  Description of Artificial Sequence: Synthetic oligonucleotide
auuaauuuguuauuuccc

SEQ ID NO: 76017 - RNA, 18 nt, Artificial Sequence
  Description of Artificial Sequence: Synthetic oligonucleotide
uuuugauuaauuuguuau

SEQ ID NO: 76018 - RNA, 18 nt, Artificial Sequence
  Description of Artificial Sequence: Synthetic oligonucleotide
aaauauuuugauuaauuu

SEQ ID NO: 76019 - RNA, 18 nt, Artificial Sequence
  Description of Artificial Sequence: Synthetic oligonucleotide
cgaugaaauauuuugauu

SEQ ID NO: 76020 - RNA, 18 nt, Artificial Sequence
  Description of Artificial Sequence: Synthetic oligonucleotide
caucucgaugaaauauuu

SEQ ID NO: 76021 - RNA, 18 nt, Artificial Sequence
  Description of Artificial Sequence: Synthetic oligonucleotide
uuucccaucucgaugaaa

SEQ ID NO: 76022 - RNA, 18 nt, Artificial Sequence
  Description of Artificial Sequence: Synthetic oligonucleotide
ccauauuucccaucucga

SEQ ID NO: 76023 - RNA, 18 nt, Artificial Sequence
  Description of Artificial Sequence: Synthetic oligonucleotide
agaagccauauuucccau

SEQ ID NO: 76024 - RNA, 18 nt, Artificial Sequence
  Description of Artificial Sequence: Synthetic oligonucleotide
gucagagaagccauauuu

SEQ ID NO: 76025 - RNA, 18 nt, Artificial Sequence
  Description of Artificial Sequence: Synthetic oligonucleotide
aaugggucagagaagcca

SEQ ID NO: 76026 - RNA, 18 nt, Artificial Sequence
  Description of Artificial Sequence: Synthetic oligonucleotide
agguuaaugggucagaga

SEQ ID NO: 76027 - RNA, 18 nt, Artificial Sequence
  Description of Artificial Sequence: Synthetic oligonucleotide
acugaagguuaauggguc

SEQ ID NO: 76028 - RNA, 18 nt, Artificial Sequence
  Description of Artificial Sequence: Synthetic oligonucleotide
acagaacugaagguuaau

SEQ ID NO: 76029 - RNA, 18 nt, Artificial Sequence
  Description of Artificial Sequence: Synthetic oligonucleotide
caaccacagaacugaagg

SEQ ID NO: 76030 - RNA, 18 nt, Artificial Sequence
  Description of Artificial Sequence: Synthetic oligonucleotide
uaauucaaccacagaacu

SEQ ID NO: 76031 - RNA, 18 nt, Artificial Sequence
  Description of Artificial Sequence: Synthetic oligonucleotide
uuuauuaauucaaccaca

SEQ ID NO: 76032 - RNA, 18 nt, Artificial Sequence
  Description of Artificial Sequence: Synthetic oligonucleotide
agugguuuauuaauucaa

SEQ ID NO: 76033 - RNA, 18 nt, Artificial Sequence
  Description of Artificial Sequence: Synthetic oligonucleotide
ccgguagugguuuauuaa

SEQ ID NO: 76034 - RNA, 18 nt, Artificial Sequence
  Description of Artificial Sequence: Synthetic oligonucleotide
ucauuccgguagugguuu

SEQ ID NO: 76035 - RNA, 18 nt, Artificial Sequence
  Description of Artificial Sequence: Synthetic oligonucleotide
gagauucauuccgguagu

SEQ ID NO: 76036 - RNA, 18 nt, Artificial Sequence
  Description of Artificial Sequence: Synthetic oligonucleotide
agcuagagauucauuccg

SEQ ID NO: 76037 - RNA, 18 nt, Artificial Sequence
  Description of Artificial Sequence: Synthetic oligonucleotide
uacugagcuagagauuca

SEQ ID NO: 76038 - RNA, 18 nt, Artificial Sequence
  Description of Artificial Sequence: Synthetic oligonucleotide
gauuauacugagcuagag

SEQ ID NO: 76039 - RNA, 18 nt, Artificial Sequence
  Description of Artificial Sequence: Synthetic oligonucleotide
uuugggauuauacugagc

SEQ ID NO: 76040 - RNA, 18 nt, Artificial Sequence
  Description of Artificial Sequence: Synthetic oligonucleotide
uccaauuugggauuauac

SEQ ID NO: 76041 - RNA, 18 nt, Artificial Sequence
  Description of Artificial Sequence: Synthetic oligonucleotide
ucacauccaauuugggau

SEQ ID NO: 76042 - RNA, 18 nt, Artificial Sequence
  Description of Artificial Sequence: Synthetic oligonucleotide
uaauuucacauccaauuu

SEQ ID NO: 76043 - RNA, 18 nt, Artificial Sequence
  Description of Artificial Sequence: Synthetic oligonucleotide
uaaaguaauuucacaucc

SEQ ID NO: 76044 - RNA, 18 nt, Artificial Sequence
  Description of Artificial Sequence: Synthetic oligonucleotide
cuggauaaaguaauuuca

SEQ ID NO: 76045 - RNA, 18 nt, Artificial Sequence
  Description of Artificial Sequence: Synthetic oligonucleotide
ggauacuggauaaaguaa

SEQ ID NO: 76046 - RNA, 18 nt, Artificial Sequence
  Description of Artificial Sequence: Synthetic oligonucleotide
uauuuggauacuggauaa

SEQ ID NO: 76047 - RNA, 18 nt, Artificial Sequence
  Description of Artificial Sequence: Synthetic oligonucleotide
guugguauuuggauacug

SEQ ID NO: 76048 - RNA, 18 nt, Artificial Sequence
  Description of Artificial Sequence: Synthetic oligonucleotide
caagauccgggagaguca

SEQ ID NO: 76049 - RNA, 18 nt, Artificial Sequence
  Description of Artificial Sequence: Synthetic oligonucleotide
cucugcaagauccgggag

SEQ ID NO: 76050 - RNA, 18 nt, Artificial Sequence
  Description of Artificial Sequence: Synthetic oligonucleotide
aacugcucugcaagaucc

SEQ ID NO: 76051 - RNA, 18 nt, Artificial Sequence
  Description of Artificial Sequence: Synthetic oligonucleotide
gggcaaacugcucugcaa

SEQ ID NO: 76052 - RNA, 18 nt, Artificial Sequence
  Description of Artificial Sequence: Synthetic oligonucleotide
uugauaagaagaggcggg

SEQ ID NO: 76053 - RNA, 18 nt, Artificial Sequence
  Description of Artificial Sequence: Synthetic oligonucleotide
agcuugauaagaagaggc

SEQ ID NO: 76054 - RNA, 18 nt, Artificial Sequence
  Description of Artificial Sequence: Synthetic oligonucleotide
ccacgagcuugauaagaa

SEQ ID NO: 76055 - RNA, 18 nt, Artificial Sequence
  Description of Artificial Sequence: Synthetic oligonucleotide
ggcuuccacgagcuugau

SEQ ID NO: 76056 - RNA, 18 nt, Artificial Sequence
  Description of Artificial Sequence: Synthetic oligonucleotide
ucaauggcuuccacgagc

SEQ ID NO: 76057 - RNA, 18 nt, Artificial Sequence
  Description of Artificial Sequence: Synthetic oligonucleotide
ucuuuucaauggcuucca

SEQ ID NO: 76058 - RNA, 18 nt, Artificial Sequence
  Description of Artificial Sequence: Synthetic oligonucleotide
augcccucuagcagucug

SEQ ID NO: 76059 - RNA, 18 nt, Artificial Sequence
  Description of Artificial Sequence: Synthetic oligonucleotide
aacugaugcccucuagca

SEQ ID NO: 76060 - RNA, 18 nt, Artificial Sequence
  Description of Artificial Sequence: Synthetic oligonucleotide
aaaggaacugaugcccuc

SEQ ID NO: 76061 - RNA, 18 nt, Artificial Sequence
  Description of Artificial Sequence: Synthetic oligonucleotide
agaacaaaggaacugaug

SEQ ID NO: 76062 - RNA, 18 nt, Artificial Sequence
  Description of Artificial Sequence: Synthetic oligonucleotide
aggguagaacaaaggaac

SEQ ID NO: 76063 - RNA, 18 nt, Artificial Sequence
  Description of Artificial Sequence: Synthetic oligonucleotide
aaauaaggguagaacaaa

SEQ ID NO: 76064 - RNA, 18 nt, Artificial Sequence
  Description of Artificial Sequence: Synthetic oligonucleotide
ccaugaaauaaggguaga

SEQ ID NO: 76065 - RNA, 18 nt, Artificial Sequence
  Description of Artificial Sequence: Synthetic oligonucleotide
aagagccaugaaauaagg

SEQ ID NO: 76066 - RNA, 18 nt, Artificial Sequence
  Description of Artificial Sequence: Synthetic oligonucleotide
auaauaagagccaugaaa

SEQ ID NO: 76067 - RNA, 18 nt, Artificial Sequence
  Description of Artificial Sequence: Synthetic oligonucleotide
gacaaauaauaagagcca

SEQ ID NO: 76068 - RNA, 18 nt, Artificial Sequence
  Description of Artificial Sequence: Synthetic oligonucleotide
caagagacaaauaauaag

SEQ ID NO: 76069 - RNA, 18 nt, Artificial Sequence
  Description of Artificial Sequence: Synthetic oligonucleotide
augcacaagagacaaaua

SEQ ID NO: 76070 - RNA, 18 nt, Artificial Sequence
  Description of Artificial Sequence: Synthetic oligonucleotide
aaugaaugcacaagagac

SEQ ID NO: 76071 - RNA, 18 nt, Artificial Sequence
  Description of Artificial Sequence: Synthetic oligonucleotide
uacuuaaugaaugcacaa

SEQ ID NO: 76072 - RNA, 18 nt, Artificial Sequence
  Description of Artificial Sequence: Synthetic oligonucleotide
aaauuuacuuaaugaaug

SEQ ID NO: 76073 - RNA, 18 nt, Artificial Sequence
  Description of Artificial Sequence: Synthetic oligonucleotide
guaggaaauuuacuuaau

SEQ ID NO: 76074 - RNA, 18 nt, Artificial Sequence
  Description of Artificial Sequence: Synthetic oligonucleotide
ugguaguaggaaauuuac

SEQ ID NO: 76075 - RNA, 18 nt, Artificial Sequence
  Description of Artificial Sequence: Synthetic oligonucleotide
auagcugguaguaggaaa

SEQ ID NO: 76076 - RNA, 18 nt, Artificial Sequence
  Description of Artificial Sequence: Synthetic oligonucleotide
uggacauagcugguagua

SEQ ID NO: 76077 - RNA, 18 nt, Artificial Sequence
  Description of Artificial Sequence: Synthetic oligonucleotide
guaucuggacauagcugg

SEQ ID NO: 76078 - RNA, 18 nt, Artificial Sequence
  Description of Artificial Sequence: Synthetic oligonucleotide
gcagaguaucuggacaua

SEQ ID NO: 76079 - RNA, 18 nt, Artificial Sequence
  Description of Artificial Sequence: Synthetic oligonucleotide
guccagcagaguaucugg

SEQ ID NO: 76080 - RNA, 18 nt, Artificial Sequence
  Description of Artificial Sequence: Synthetic oligonucleotide
ugaguguccagcagagua

SEQ ID NO: 76081 - RNA, 18 nt, Artificial Sequence
  Description of Artificial Sequence: Synthetic oligonucleotide
caguuugaguguccagca

SEQ ID NO: 76082 - RNA, 18 nt, Artificial Sequence
  Description of Artificial Sequence: Synthetic oligonucleotide
ccaaacaguuugaguguc

SEQ ID NO: 76083 - RNA, 18 nt, Artificial Sequence
  Description of Artificial Sequence: Synthetic oligonucleotide
uagccccaaacaguuuga

SEQ ID NO: 76084 - RNA, 18 nt, Artificial Sequence
  Description of Artificial Sequence: Synthetic oligonucleotide
guacuuagccccaaacag

SEQ ID NO: 76085 - RNA, 18 nt, Artificial Sequence
  Description of Artificial Sequence: Synthetic oligonucleotide
ucccaguacuuagcccca

SEQ ID NO: 76086 - RNA, 18 nt, Artificial Sequence
  Description of Artificial Sequence: Synthetic oligonucleotide
auuuuucccaguacuuag

SEQ ID NO: 76087 - RNA, 18 nt, Artificial Sequence
  Description of Artificial Sequence: Synthetic oligonucleotide
gagacauuuuucccagua

SEQ ID NO: 76088 - RNA, 18 nt, Artificial Sequence
  Description of Artificial Sequence: Synthetic oligonucleotide
agacugagacauuuuucc

SEQ ID NO: 76089 - RNA, 18 nt, Artificial Sequence
  Description of Artificial Sequence: Synthetic oligonucleotide
auuauagacugagacauu

SEQ ID NO: 76090 - RNA, 18 nt, Artificial Sequence
  Description of Artificial Sequence: Synthetic oligonucleotide
uagaaauuauagacugag

SEQ ID NO: 76091 - RNA, 18 nt, Artificial Sequence
  Description of Artificial Sequence: Synthetic oligonucleotide
agaguuagaaauuauaga

SEQ ID NO: 76092 - RNA, 18 nt, Artificial Sequence
  Description of Artificial Sequence: Synthetic oligonucleotide
aaucuagaguuagaaauu

SEQ ID NO: 76093 - RNA, 18 nt, Artificial Sequence
  Description of Artificial Sequence: Synthetic oligonucleotide
augauaaucuagaguuag

SEQ ID NO: 76094 - RNA, 18 nt, Artificial Sequence
  Description of Artificial Sequence: Synthetic oligonucleotide
acuacaugauaaucuaga

SEQ ID NO: 76095 - RNA, 18 nt, Artificial Sequence
  Description of Artificial Sequence: Synthetic oligonucleotide
uggaaacuacaugauaau

SEQ ID NO: 76096 - RNA, 18 nt, Artificial Sequence
  Description of Artificial Sequence: Synthetic oligonucleotide
ccauauggaaacuacaug

SEQ ID NO: 76097 - RNA, 18 nt, Artificial Sequence
  Description of Artificial Sequence: Synthetic oligonucleotide
aguuuccauauggaaacu

SEQ ID NO: 76098 - RNA, 18 nt, Artificial Sequence
  Description of Artificial Sequence: Synthetic oligonucleotide
uuaauaguuuccauaugg

SEQ ID NO: 76099 - RNA, 18 nt, Artificial Sequence
  Description of Artificial Sequence: Synthetic oligonucleotide
agaauuuaauaguuucca

SEQ ID NO: 76100 - RNA, 18 nt, Artificial Sequence
  Description of Artificial Sequence: Synthetic oligonucleotide
uaugaagaauuuaauagu

SEQ ID NO: 76101 - RNA, 18 nt, Artificial Sequence
  Description of Artificial Sequence: Synthetic oligonucleotide
uaaauuaugaagaauuua

SEQ ID NO: 76102 - RNA, 18 nt, Artificial Sequence
  Description of Artificial Sequence: Synthetic oligonucleotide
uuuauuaaauuaugaaga

SEQ ID NO: 76103 - RNA, 18 nt, Artificial Sequence
  Description of Artificial Sequence: Synthetic oligonucleotide
ucauauuuauuaaauuau

SEQ ID NO: 76104 - RNA, 18 nt, Artificial Sequence
  Description of Artificial Sequence: Synthetic oligonucleotide
guuaaucauauuuauuaa

SEQ ID NO: 76105 - RNA, 18 nt, Artificial Sequence
  Description of Artificial Sequence: Synthetic oligonucleotide
agaaaguuaaucauauuu

SEQ ID NO: 76106 - RNA, 18 nt, Artificial Sequence
  Description of Artificial Sequence: Synthetic oligonucleotide
uuuccauauggaaacuac

SEQ ID NO: 76107 - RNA, 18 nt, Artificial Sequence
  Description of Artificial Sequence: Synthetic oligonucleotide
aauaguuuccauauggaa

SEQ ID NO: 76108 - RNA, 18 nt, Artificial Sequence
  Description of Artificial Sequence: Synthetic oligonucleotide
aauuuaauaguuuccaua

SEQ ID NO: 76109 - RNA, 18 nt, Artificial Sequence
  Description of Artificial Sequence: Synthetic oligonucleotide
ugaagaauuuaauaguuu

SEQ ID NO: 76110 - RNA, 18 nt, Artificial Sequence
  Description of Artificial Sequence: Synthetic oligonucleotide
aauuaugaagaauuuaau

SEQ ID NO: 76111 - RNA, 18 nt, Artificial Sequence
  Description of Artificial Sequence: Synthetic oligonucleotide
uauuaaauuaugaagaau

SEQ ID NO: 76112 - RNA, 18 nt, Artificial Sequence
  Description of Artificial Sequence: Synthetic oligonucleotide
auauuuauuaaauuauga

SEQ ID NO: 76113 - RNA, 18 nt, Artificial Sequence
  Description of Artificial Sequence: Synthetic oligonucleotide
uaaucauauuuauuaaau

SEQ ID NO: 76114 - RNA, 18 nt, Artificial Sequence
  Description of Artificial Sequence: Synthetic oligonucleotide
aaaguuaaucauauuuau

SEQ ID NO: 76115 - RNA, 18 nt, Artificial Sequence
  Description of Artificial Sequence: Synthetic oligonucleotide
agaagaaaguuaaucaua

SEQ ID NO: 76116 - RNA, 18 nt, Artificial Sequence
  Description of Artificial Sequence: Synthetic oligonucleotide
cucuaagaagaaaguuaa

SEQ ID NO: 76117 - RNA, 18 nt, Artificial Sequence
  Description of Artificial Sequence: Synthetic oligonucleotide
cuggccucuaagaagaaa

SEQ ID NO: 76118 - RNA, 18 nt, Artificial Sequence
  Description of Artificial Sequence: Synthetic oligonucleotide
accaucuggccucuaaga

SEQ ID NO: 76119 - RNA, 18 nt, Artificial Sequence
  Description of Artificial Sequence: Synthetic oligonucleotide
gcaaaaccaucuggccuc

SEQ ID NO: 76120 - RNA, 18 nt, Artificial Sequence
  Description of Artificial Sequence: Synthetic oligonucleotide
uuuuggcaaaaccaucug

SEQ ID NO: 76121 - RNA, 18 nt, Artificial Sequence
  Description of Artificial Sequence: Synthetic oligonucleotide
gauaauuuuggcaaaacc

SEQ ID NO: 76122 - RNA, 18 nt, Artificial Sequence
  Description of Artificial Sequence: Synthetic oligonucleotide
auguugauaauuuuggca

SEQ ID NO: 76123 - RNA, 18 nt, Artificial Sequence
  Description of Artificial Sequence: Synthetic oligonucleotide
cuggcauguugauaauuu

SEQ ID NO: 76124 - RNA, 18 nt, Artificial Sequence
  Description of Artificial Sequence: Synthetic oligonucleotide
cuuaccuggcauguugau

SEQ ID NO: 76125 - RNA, 18 nt, Artificial Sequence
  Description of Artificial Sequence: Synthetic oligonucleotide
uuaaucuuaccuggcaug

SEQ ID NO: 76126 - RNA, 18 nt, Artificial Sequence
  Description of Artificial Sequence: Synthetic oligonucleotide
uacuauuaaucuuaccug

SEQ ID NO: 76127 - RNA, 18 nt, Artificial Sequence
  Description of Artificial Sequence: Synthetic oligonucleotide
acuccuacuauuaaucuu

SEQ ID NO: 76128 - RNA, 18 nt, Artificial Sequence
  Description of Artificial Sequence: Synthetic oligonucleotide
agucaacuccuacuauua

SEQ ID NO: 76129 - RNA, 18 nt, Artificial Sequence
  Description of Artificial Sequence: Synthetic oligonucleotide
uuggaagucaacuccuac

SEQ ID NO: 76130 - RNA, 18 nt, Artificial Sequence
  Description of Artificial Sequence: Synthetic oligonucleotide
uauucuuggaagucaacu

SEQ ID NO: 76131 - RNA, 18 nt, Artificial Sequence
  Description of Artificial Sequence: Synthetic oligonucleotide
ccaaauauucuuggaagu

SEQ ID NO: 76132 - RNA, 18 nt, Artificial Sequence
  Description of Artificial Sequence: Synthetic oligonucleotide
guguaccaaauauucuug

SEQ ID NO: 76133 - RNA, 18 nt, Artificial Sequence
  Description of Artificial Sequence: Synthetic oligonucleotide
uagauguguaccaaauau

SEQ ID NO: 76134 - RNA, 18 nt, Artificial Sequence
  Description of Artificial Sequence: Synthetic oligonucleotide
uguucuagauguguacca

SEQ ID NO: 76135 - RNA, 18 nt, Artificial Sequence
  Description of Artificial Sequence: Synthetic oligonucleotide
guaucuguucuagaugug

SEQ ID NO: 76136 - RNA, 18 nt, Artificial Sequence
  Description of Artificial Sequence: Synthetic oligonucleotide
auccaguaucuguucuag

SEQ ID NO: 76137 - RNA, 18 nt, Artificial Sequence
  Description of Artificial Sequence: Synthetic oligonucleotide
uuuccauccaguaucugu

SEQ ID NO: 76138 - RNA, 18 nt, Artificial Sequence
  Description of Artificial Sequence: Synthetic oligonucleotide
uccaguuuccauccagua

SEQ ID NO: 76139 - RNA, 18 nt, Artificial Sequence
  Description of Artificial Sequence: Synthetic oligonucleotide
gacauuccaguuuccauc

SEQ ID NO: 76140 - RNA, 18 nt, Artificial Sequence
  Description of Artificial Sequence: Synthetic oligonucleotide
ccagagacauuccaguuu

SEQ ID NO: 76141 - RNA, 18 nt, Artificial Sequence
  Description of Artificial Sequence: Synthetic oligonucleotide
ugcugccagagacauucc

SEQ ID NO: 76142 - RNA, 18 nt, Artificial Sequence
  Description of Artificial Sequence: Synthetic oligonucleotide
gaggcugcugccagagac

SEQ ID NO: 76143 - RNA, 18 nt, Artificial Sequence
  Description of Artificial Sequence: Synthetic oligonucleotide
ccugugaggcugcugcca

SEQ ID NO: 76144 - RNA, 18 nt, Artificial Sequence
  Description of Artificial Sequence: Synthetic oligonucleotide
gagaaccugugaggcugc

SEQ ID NO: 76145 - RNA, 18 nt, Artificial Sequence
  Description of Artificial Sequence: Synthetic oligonucleotide
cucuggagaaccugugag

SEQ ID NO: 76146 - RNA, 18 nt, Artificial Sequence
  Description of Artificial Sequence: Synthetic oligonucleotide
cagcucucuggagaaccu

SEQ ID NO: 76147 - RNA, 18 nt, Artificial Sequence
  Description of Artificial Sequence: Synthetic oligonucleotide
aaacacagcucucuggag

SEQ ID NO: 76148 - RNA, 18 nt, Artificial Sequence
  Description of Artificial Sequence: Synthetic oligonucleotide
augcaaaacacagcucuc

SEQ ID NO: 76149 - RNA, 18 nt, Artificial Sequence
  Description of Artificial Sequence: Synthetic oligonucleotide
cauguaugcaaaacacag

SEQ ID NO: 76150 - RNA, 18 nt, Artificial Sequence
  Description of Artificial Sequence: Synthetic oligonucleotide
cagaccauguaugcaaaa

SEQ ID NO: 76151 - RNA, 18 nt, Artificial Sequence
  Description of Artificial Sequence: Synthetic oligonucleotide
gaccacagaccauguaug

SEQ ID NO: 76152 - RNA, 18 nt, Artificial Sequence
  Description of Artificial Sequence: Synthetic oligonucleotide
agaguugaacauuccaga

SEQ ID NO: 76153 - RNA, 18 nt, Artificial Sequence
  Description of Artificial Sequence: Synthetic oligonucleotide
uguauagaguugaacauu

SEQ ID NO: 76154 - RNA, 18 nt, Artificial Sequence
  Description of Artificial Sequence: Synthetic oligonucleotide
uguucuguauagaguuga

SEQ ID NO: 76155 - RNA, 18 nt, Artificial Sequence
  Description of Artificial Sequence: Synthetic oligonucleotide
cucuguguucuguauaga

SEQ ID NO: 76156 - RNA, 18 nt, Artificial Sequence
  Description of Artificial Sequence: Synthetic oligonucleotide
uggagcucuguguucugu

SEQ ID NO: 76157 - RNA, 18 nt, Artificial Sequence
  Description of Artificial Sequence: Synthetic oligonucleotide
guugcuggagcucugugu

SEQ ID NO: 76158 - RNA, 18 nt, Artificial Sequence
  Description of Artificial Sequence: Synthetic oligonucleotide
gccagguugcuggagcuc

SEQ ID NO: 76159 - RNA, 18 nt, Artificial Sequence
  Description of Artificial Sequence: Synthetic oligonucleotide
auucugccagguugcugg

SEQ ID NO: 76160 - RNA, 18 nt, Artificial Sequence
  Description of Artificial Sequence: Synthetic oligonucleotide
ucguaauucugccagguu

SEQ ID NO: 76161 - RNA, 18 nt, Artificial Sequence
  Description of Artificial Sequence: Synthetic oligonucleotide
agcugucguaauucugcc

SEQ ID NO: 76162 - RNA, 18 nt, Artificial Sequence
  Description of Artificial Sequence: Synthetic oligonucleotide
caagaagcugucguaauu

SEQ ID NO: 76163 - RNA, 18 nt, Artificial Sequence
  Description of Artificial Sequence: Synthetic oligonucleotide
acaaucaagaagcugucg

SEQ ID NO: 76164 - RNA, 18 nt, Artificial Sequence
  Description of Artificial Sequence: Synthetic oligonucleotide
aguuuuucauucacuucu

SEQ ID NO: 76165 - RNA, 18 nt, Artificial Sequence
  Description of Artificial Sequence: Synthetic oligonucleotide
cucgaaguuuuucauuca

SEQ ID NO: 76166 - RNA, 18 nt, Artificial Sequence
  Description of Artificial Sequence: Synthetic oligonucleotide
uguaucucgaaguuuuuc

SEQ ID NO: 76167 - RNA, 18 nt, Artificial Sequence
  Description of Artificial Sequence: Synthetic oligonucleotide
ucugcuguaucucgaagu

SEQ ID NO: 76168 - RNA, 18 nt, Artificial Sequence
  Description of Artificial Sequence: Synthetic oligonucleotide
ucccgucugcuguaucuc

SEQ ID NO: 76169 - RNA, 18 nt, Artificial Sequence
  Description of Artificial Sequence: Synthetic oligonucleotide
aaaggucccgucugcugu

SEQ ID NO: 76170 - RNA, 18 nt, Artificial Sequence
  Description of Artificial Sequence: Synthetic oligonucleotide
accaaaaaggucccgucu

SEQ ID NO: 76171 - RNA, 18 nt, Artificial Sequence
  Description of Artificial Sequence: Synthetic oligonucleotide
cucguaccaaaaaggucc

SEQ ID NO: 76172 - RNA, 18 nt, Artificial Sequence
  Description of Artificial Sequence: Synthetic oligonucleotide
cgcaucucguaccaaaaa

SEQ ID NO: 76173 - RNA, 18 nt, Artificial Sequence
  Description of Artificial Sequence: Synthetic oligonucleotide
guagacgcaucucguacc

SEQ ID NO: 76174 - RNA, 18 nt, Artificial Sequence
  Description of Artificial Sequence: Synthetic oligonucleotide
uuuuaguagacgcaucuc

SEQ ID NO: 76175 - RNA, 18 nt, Artificial Sequence
  Description of Artificial Sequence: Synthetic oligonucleotide
augcauuuuaguagacgc

SEQ ID NO: 76176 - RNA, 18 nt, Artificial Sequence
  Description of Artificial Sequence: Synthetic oligonucleotide
ucaccaugcauuuuagua

SEQ ID NO: 76177 - RNA, 18 nt, Artificial Sequence
  Description of Artificial Sequence: Synthetic oligonucleotide
uauaaucaccaugcauuu

SEQ ID NO: 76178 - RNA, 18 nt, Artificial Sequence
  Description of Artificial Sequence: Synthetic oligonucleotide
aagaguauaaucaccaug

SEQ ID NO: 76179 - RNA, 18 nt, Artificial Sequence
  Description of Artificial Sequence: Synthetic oligonucleotide
aguguaagaguauaauca

SEQ ID NO: 76180 - RNA, 18 nt, Artificial Sequence
  Description of Artificial Sequence: Synthetic oligonucleotide
uucagcuauauucccugg

SEQ ID NO: 76181 - RNA, 18 nt, Artificial Sequence
  Description of Artificial Sequence: Synthetic oligonucleotide
cuaauuucagcuauauuc

SEQ ID NO: 76182 - RNA, 18 nt, Artificial Sequence
  Description of Artificial Sequence: Synthetic oligonucleotide
aaacccuaauuucagcua

SEQ ID NO: 76183 - RNA, 18 nt, Artificial Sequence
  Description of Artificial Sequence: Synthetic oligonucleotide
gcccaaaacccuaauuuc

SEQ ID NO: 76184 - RNA, 18 nt, Artificial Sequence
  Description of Artificial Sequence: Synthetic oligonucleotide
uaucagcccaaaacccua

SEQ ID NO: 76185 - RNA, 18 nt, Artificial Sequence
  Description of Artificial Sequence: Synthetic oligonucleotide
uuuaauaucagcccaaaa

SEQ ID NO: 76186 - RNA, 18 nt, Artificial Sequence
  Description of Artificial Sequence: Synthetic oligonucleotide
uauguuuuaauaucagcc

SEQ ID NO: 76187 - RNA, 18 nt, Artificial Sequence
  Description of Artificial Sequence: Synthetic oligonucleotide
ggaaauauguuuuaauau

SEQ ID NO: 76188 - RNA, 18 nt, Artificial Sequence
  Description of Artificial Sequence: Synthetic oligonucleotide
aauaaggaaauauguuuu

SEQ ID NO: 76189 - RNA, 18 nt, Artificial Sequence
  Description of Artificial Sequence: Synthetic oligonucleotide
uuuggaauaaggaaauau

SEQ ID NO: 76190 - RNA, 18 nt, Artificial Sequence
  Description of Artificial Sequence: Synthetic oligonucleotide
aacauuuuggaauaagga

SEQ ID NO: 76191 - RNA, 18 nt, Artificial Sequence
  Description of Artificial Sequence: Synthetic oligonucleotide
guauuaacauuuuggaau

SEQ ID NO: 76192 - RNA, 18 nt, Artificial Sequence
  Description of Artificial Sequence: Synthetic oligonucleotide
gcccaaaacccuaauuuc

SEQ ID NO: 76193 - RNA, 18 nt, Artificial Sequence
  Description of Artificial Sequence: Synthetic oligonucleotide
uaucagcccaaaacccua

SEQ ID NO: 76194 - RNA, 18 nt, Artificial Sequence
  Description of Artificial Sequence: Synthetic oligonucleotide
uuuaauaucagcccaaaa

SEQ ID NO: 76195 - RNA, 18 nt, Artificial Sequence
  Description of Artificial Sequence: Synthetic oligonucleotide
uauguuuuaauaucagcc

SEQ ID NO: 76196 - RNA, 18 nt, Artificial Sequence
  Description of Artificial Sequence: Synthetic oligonucleotide
ggaaauauguuuuaauau

SEQ ID NO: 76197 - RNA, 18 nt, Artificial Sequence
  Description of Artificial Sequence: Synthetic oligonucleotide
aauaaggaaauauguuuu

SEQ ID NO: 76198 - RNA, 18 nt, Artificial Sequence
  Description of Artificial Sequence: Synthetic oligonucleotide
uuuggaauaaggaaauau

SEQ ID NO: 76199 - RNA, 18 nt, Artificial Sequence
  Description of Artificial Sequence: Synthetic oligonucleotide
aacauuuuggaauaagga

SEQ ID NO: 76200 - RNA, 18 nt, Artificial Sequence
  Description of Artificial Sequence: Synthetic oligonucleotide
guauuaacauuuuggaau

SEQ ID NO: 76201 - RNA, 18 nt, Artificial Sequence
  Description of Artificial Sequence: Synthetic oligonucleotide
uaaagguauuaacauuuu

SEQ ID NO: 76202 - RNA, 18 nt, Artificial Sequence
  Description of Artificial Sequence: Synthetic oligonucleotide
aaaaauaaagguauuaac

SEQ ID NO: 76203 - RNA, 18 nt, Artificial Sequence
  Description of Artificial Sequence: Synthetic oligonucleotide
uuuguuauuucccccuuu

SEQ ID NO: 76204 - RNA, 18 nt, Artificial Sequence
  Description of Artificial Sequence: Synthetic oligonucleotide
auuaauuuguuauuuccc

SEQ ID NO: 76205 - RNA, 18 nt, Artificial Sequence
  Description of Artificial Sequence: Synthetic oligonucleotide
uuuugauuaauuuguuau

SEQ ID NO: 76206 - RNA, 18 nt, Artificial Sequence
  Description of Artificial Sequence: Synthetic oligonucleotide
aaauauuuugauuaauuu

SEQ ID NO: 76207 - RNA, 18 nt, Artificial Sequence
  Description of Artificial Sequence: Synthetic oligonucleotide
cgaugaaauauuuugauu

SEQ ID NO: 76208 - RNA, 18 nt, Artificial Sequence
  Description of Artificial Sequence: Synthetic oligonucleotide
caucucgaugaaauauuu

SEQ ID NO: 76209 - RNA, 18 nt, Artificial Sequence
  Description of Artificial Sequence: Synthetic oligonucleotide
uuucccaucucgaugaaa

SEQ ID NO: 76210 - RNA, 18 nt, Artificial Sequence
  Description of Artificial Sequence: Synthetic oligonucleotide
ccauauuucccaucucga

SEQ ID NO: 76211 - RNA, 18 nt, Artificial Sequence
  Description of Artificial Sequence: Synthetic oligonucleotide
agaagccauauuucccau

SEQ ID NO: 76212 - RNA, 18 nt, Artificial Sequence
  Description of Artificial Sequence: Synthetic oligonucleotide
gucagagaagccauauuu

SEQ ID NO: 76213 - RNA, 18 nt, Artificial Sequence
  Description of Artificial Sequence: Synthetic oligonucleotide
aaugggucagagaagcca

SEQ ID NO: 76214 - RNA, 18 nt, Artificial Sequence
  Description of Artificial Sequence: Synthetic oligonucleotide
agguuaaugggucagaga

SEQ ID NO: 76215 - RNA, 18 nt, Artificial Sequence
  Description of Artificial Sequence: Synthetic oligonucleotide
acugaagguuaauggguc

SEQ ID NO: 76216 - RNA, 18 nt, Artificial Sequence
  Description of Artificial Sequence: Synthetic oligonucleotide
acagaacugaagguuaau

SEQ ID NO: 76217 - RNA, 18 nt, Artificial Sequence
  Description of Artificial Sequence: Synthetic oligonucleotide
caaccacagaacugaagg

SEQ ID NO: 76218 - RNA, 18 nt, Artificial Sequence
  Description of Artificial Sequence: Synthetic oligonucleotide
uaauucaaccacagaacu

SEQ ID NO: 76219 - RNA, 18 nt, Artificial Sequence
  Description of Artificial Sequence: Synthetic oligonucleotide
uuuauuaauucaaccaca

SEQ ID NO: 76220 - RNA, 18 nt, Artificial Sequence
  Description of Artificial Sequence: Synthetic oligonucleotide
agugguuuauuaauucaa

SEQ ID NO: 76221 - RNA, 18 nt, Artificial Sequence
  Description of Artificial Sequence: Synthetic oligonucleotide
ccgguagugguuuauuaa

SEQ ID NO: 76222 - RNA, 18 nt, Artificial Sequence
  Description of Artificial Sequence: Synthetic oligonucleotide
ucauuccgguagugguuu

SEQ ID NO: 76223 - RNA, 18 nt, Artificial Sequence
  Description of Artificial Sequence: Synthetic oligonucleotide
gagauucauuccgguagu

SEQ ID NO: 76224 - RNA, 18 nt, Artificial Sequence
  Description of Artificial Sequence: Synthetic oligonucleotide
agcuagagauucauuccg

SEQ ID NO: 76225 - RNA, 18 nt, Artificial Sequence
  Description of Artificial Sequence: Synthetic oligonucleotide
uacugagcuagagauuca

SEQ ID NO: 76226 - RNA, 18 nt, Artificial Sequence
  Description of Artificial Sequence: Synthetic oligonucleotide
gauuauacugagcuagag

SEQ ID NO: 76227 - RNA, 18 nt, Artificial Sequence
  Description of Artificial Sequence: Synthetic oligonucleotide
uuugggauuauacugagc

SEQ ID NO: 76228 - RNA, 18 nt, Artificial Sequence
  Description of Artificial Sequence: Synthetic oligonucleotide
uccaauuugggauuauac

SEQ ID NO: 76229 - RNA, 18 nt, Artificial Sequence
  Description of Artificial Sequence: Synthetic oligonucleotide
ucacauccaauuugggau

SEQ ID NO: 76230 - RNA, 18 nt, Artificial Sequence
  Description of Artificial Sequence: Synthetic oligonucleotide
uaauuucacauccaauuu

SEQ ID NO: 76231 - RNA, 18 nt, Artificial Sequence
  Description of Artificial Sequence: Synthetic oligonucleotide
uaaaguaauuucacaucc

SEQ ID NO: 76232 - RNA, 18 nt, Artificial Sequence
  Description of Artificial Sequence: Synthetic oligonucleotide
cuggauaaaguaauuuca

SEQ ID NO: 76233 - RNA, 18 nt, Artificial Sequence
  Description of Artificial Sequence: Synthetic oligonucleotide
ggauacuggauaaaguaa

SEQ ID NO: 76234 - RNA, 18 nt, Artificial Sequence
  Description of Artificial Sequence: Synthetic oligonucleotide
uauuuggauacuggauaa

SEQ ID NO: 76235 - RNA, 18 nt, Artificial Sequence
  Description of Artificial Sequence: Synthetic oligonucleotide
guugguauuuggauacug

SEQ ID NO: 76236 - RNA, 18 nt, Artificial Sequence
  Description of Artificial Sequence: Synthetic oligonucleotide
aguuuuucauucacuucu

SEQ ID NO: 76237 - RNA, 18 nt, Artificial Sequence
  Description of Artificial Sequence: Synthetic oligonucleotide
cucgaaguuuuucauuca

SEQ ID NO: 76238 - RNA, 18 nt, Artificial Sequence
  Description of Artificial Sequence: Synthetic oligonucleotide
uguaucucgaaguuuuuc

SEQ ID NO: 76239 - RNA, 18 nt, Artificial Sequence
  Description of Artificial Sequence: Synthetic oligonucleotide
ucugcuguaucucgaagu

SEQ ID NO: 76240 - RNA, 18 nt, Artificial Sequence
  Description of Artificial Sequence: Synthetic oligonucleotide
ucccgucugcuguaucuc

SEQ ID NO: 76241 - RNA, 18 nt, Artificial Sequence
  Description of Artificial Sequence: Synthetic oligonucleotide
aaaggucccgucugcugu

SEQ ID NO: 76242 - RNA, 18 nt, Artificial Sequence
  Description of Artificial Sequence: Synthetic oligonucleotide
accaaaaaggucccgucu

SEQ ID NO: 76243 - RNA, 18 nt, Artificial Sequence
  Description of Artificial Sequence: Synthetic oligonucleotide
cucguaccaaaaaggucc

SEQ ID NO: 76244 - RNA, 18 nt, Artificial Sequence
  Description of Artificial Sequence: Synthetic oligonucleotide
cgcaucucguaccaaaaa

SEQ ID NO: 76245 - RNA, 18 nt, Artificial Sequence
  Description of Artificial Sequence: Synthetic oligonucleotide
guagacgcaucucguacc

SEQ ID NO: 76246 - RNA, 18 nt, Artificial Sequence
  Description of Artificial Sequence: Synthetic oligonucleotide
uuuuaguagacgcaucuc

SEQ ID NO: 76247 - RNA, 18 nt, Artificial Sequence
  Description of Artificial Sequence: Synthetic oligonucleotide
augcauuuuaguagacgc

SEQ ID NO: 76248 - RNA, 18 nt, Artificial Sequence
  Description of Artificial Sequence: Synthetic oligonucleotide
ucaccaugcauuuuagua

SEQ ID NO: 76249 - RNA, 18 nt, Artificial Sequence
  Description of Artificial Sequence: Synthetic oligonucleotide
uauaaucaccaugcauuu

SEQ ID NO: 76250 - RNA, 18 nt, Artificial Sequence
  Description of Artificial Sequence: Synthetic oligonucleotide
aagaguauaaucaccaug

SEQ ID NO: 76251 - RNA, 18 nt, Artificial Sequence
  Description of Artificial Sequence: Synthetic oligonucleotide
aguguaagaguauaauca

SEQ ID NO: 76252 - RNA, 18 nt, Artificial Sequence
  Description of Artificial Sequence: Synthetic oligonucleotide
uucagcuauauucccugg

SEQ ID NO: 76253 - RNA, 18 nt, Artificial Sequence
  Description of Artificial Sequence: Synthetic oligonucleotide
cuaauuucagcuauauuc

SEQ ID NO: 76254 - RNA, 18 nt, Artificial Sequence
  Description of Artificial Sequence: Synthetic oligonucleotide
aaacccuaauuucagcua

SEQ ID NO: 76255 - RNA, 18 nt, Artificial Sequence
  Description of Artificial Sequence: Synthetic oligonucleotide
gcccaaaacccuaauuuc

SEQ ID NO: 76256 - RNA, 18 nt, Artificial Sequence
  Description of Artificial Sequence: Synthetic oligonucleotide
uaucagcccaaaacccua

SEQ ID NO: 76257 - RNA, 18 nt, Artificial Sequence
  Description of Artificial Sequence: Synthetic oligonucleotide
uuuaauaucagcccaaaa

SEQ ID NO: 76258 - RNA, 18 nt, Artificial Sequence
  Description of Artificial Sequence: Synthetic oligonucleotide
uauguuuuaauaucagcc

SEQ ID NO: 76259 - RNA, 18 nt, Artificial Sequence
  Description of Artificial Sequence: Synthetic oligonucleotide
ggaaauauguuuuaauau

SEQ ID NO: 76260 - RNA, 18 nt, Artificial Sequence
  Description of Artificial Sequence: Synthetic oligonucleotide
aauaaggaaauauguuuu

SEQ ID NO: 76261 - RNA, 18 nt, Artificial Sequence
  Description of Artificial Sequence: Synthetic oligonucleotide
uuuggaauaaggaaauau

SEQ ID NO: 76262 - RNA, 18 nt, Artificial Sequence
  Description of Artificial Sequence: Synthetic oligonucleotide
aacauuuuggaauaagga

SEQ ID NO: 76263 - RNA, 18 nt, Artificial Sequence
  Description of Artificial Sequence: Synthetic oligonucleotide
guauuaacauuuuggaau

SEQ ID NO: 76264 - RNA, 18 nt, Artificial Sequence
  Description of Artificial Sequence: Synthetic oligonucleotide
gcccaaaacccuaauuuc

SEQ ID NO: 76265 - RNA, 18 nt, Artificial Sequence
  Description of Artificial Sequence: Synthetic oligonucleotide
uaucagcccaaaacccua

SEQ ID NO: 76266 - RNA, 18 nt, Artificial Sequence
  Description of Artificial Sequence: Synthetic oligonucleotide
uuuaauaucagcccaaaa

SEQ ID NO: 76267 - RNA, 18 nt, Artificial Sequence
  Description of Artificial Sequence: Synthetic oligonucleotide
uauguuuuaauaucagcc

SEQ ID NO: 76268 - RNA, 18 nt, Artificial Sequence
  Description of Artificial Sequence: Synthetic oligonucleotide
ggaaauauguuuuaauau

SEQ ID NO: 76269 - RNA, 18 nt, Artificial Sequence
  Description of Artificial Sequence: Synthetic oligonucleotide
aauaaggaaauauguuuu

SEQ ID NO: 76270 - RNA, 18 nt, Artificial Sequence
  Description of Artificial Sequence: Synthetic oligonucleotide
uuuggaauaaggaaauau

SEQ ID NO: 76271 - RNA, 18 nt, Artificial Sequence
  Description of Artificial Sequence: Synthetic oligonucleotide
aacauuuuggaauaagga

SEQ ID NO: 76272 - RNA, 18 nt, Artificial Sequence
  Description of Artificial Sequence: Synthetic oligonucleotide
guauuaacauuuuggaau

SEQ ID NO: 76273 - RNA, 18 nt, Artificial Sequence
  Description of Artificial Sequence: Synthetic oligonucleotide
uaaagguauuaacauuuu

SEQ ID NO: 76274 - RNA, 18 nt, Artificial Sequence
  Description of Artificial Sequence: Synthetic oligonucleotide
aaaaauaaagguauuaac

SEQ ID NO: 76275 - RNA, 18 nt, Artificial Sequence
  Description of Artificial Sequence: Synthetic oligonucleotide
uuuguuauuucccccuuu

SEQ ID NO: 76276 - RNA, 18 nt, Artificial Sequence
  Description of Artificial Sequence: Synthetic oligonucleotide
auuaauuuguuauuuccc

SEQ ID NO: 76277 - RNA, 18 nt, Artificial Sequence
  Description of Artificial Sequence: Synthetic oligonucleotide
uuuugauuaauuuguuau

SEQ ID NO: 76278 - RNA, 18 nt, Artificial Sequence
  Description of Artificial Sequence: Synthetic oligonucleotide
aaauauuuugauuaauuu

SEQ ID NO: 76279 - RNA, 18 nt, Artificial Sequence
  Description of Artificial Sequence: Synthetic oligonucleotide
cgaugaaauauuuugauu

SEQ ID NO: 76280 - RNA, 18 nt, Artificial Sequence
  Description of Artificial Sequence: Synthetic oligonucleotide
caucucgaugaaauauuu

SEQ ID NO: 76281 - RNA, 18 nt, Artificial Sequence
  Description of Artificial Sequence: Synthetic oligonucleotide
uuucccaucucgaugaaa

SEQ ID NO: 76282 - RNA, 18 nt, Artificial Sequence
  Description of Artificial Sequence: Synthetic oligonucleotide
ccauauuucccaucucga

SEQ ID NO: 76283 - RNA, 18 nt, Artificial Sequence
  Description of Artificial Sequence: Synthetic oligonucleotide
agaagccauauuucccau

SEQ ID NO: 76284 - RNA, 18 nt, Artificial Sequence
  Description of Artificial Sequence: Synthetic oligonucleotide
gucagagaagccauauuu

SEQ ID NO: 76285 - RNA, 18 nt, Artificial Sequence
  Description of Artificial Sequence: Synthetic oligonucleotide
aaugggucagagaagcca

SEQ ID NO: 76286 - RNA, 18 nt, Artificial Sequence
  Description of Artificial Sequence: Synthetic oligonucleotide
agguuaaugggucagaga

SEQ ID NO: 76287 - RNA, 18 nt, Artificial Sequence
  Description of Artificial Sequence: Synthetic oligonucleotide
acugaagguuaauggguc

SEQ ID NO: 76288 - RNA, 18 nt, Artificial Sequence
  Description of Artificial Sequence: Synthetic oligonucleotide
acagaacugaagguuaau

SEQ ID NO: 76289 - RNA, 18 nt, Artificial Sequence
  Description of Artificial Sequence: Synthetic oligonucleotide
caaccacagaacugaagg

SEQ ID NO: 76290 - RNA, 18 nt, Artificial Sequence
  Description of Artificial Sequence: Synthetic oligonucleotide
uaauucaaccacagaacu

SEQ ID NO: 76291 - RNA, 18 nt, Artificial Sequence
  Description of Artificial Sequence: Synthetic oligonucleotide
uuuauuaauucaaccaca

SEQ ID NO: 76292 - RNA, 18 nt, Artificial Sequence
  Description of Artificial Sequence: Synthetic oligonucleotide
agugguuuauuaauucaa

SEQ ID NO: 76293 - RNA, 18 nt, Artificial Sequence
  Description of Artificial Sequence: Synthetic oligonucleotide
ccgguagugguuuauuaa

SEQ ID NO: 76294 - RNA, 18 nt, Artificial Sequence
  Description of Artificial Sequence: Synthetic oligonucleotide
ucauuccgguagugguuu

SEQ ID NO: 76295 - RNA, 18 nt, Artificial Sequence
  Description of Artificial Sequence: Synthetic oligonucleotide
gagauucauuccgguagu

SEQ ID NO: 76296 - RNA, 18 nt, Artificial Sequence
  Description of Artificial Sequence: Synthetic oligonucleotide
agcuagagauucauuccg

SEQ ID NO: 76297 - RNA, 18 nt, Artificial Sequence
  Description of Artificial Sequence: Synthetic oligonucleotide
uacugagcuagagauuca

SEQ ID NO: 76298 - RNA, 18 nt, Artificial Sequence
  Description of Artificial Sequence: Synthetic oligonucleotide
gauuauacugagcuagag

SEQ ID NO: 76299 - RNA, 18 nt, Artificial Sequence
  Description of Artificial Sequence: Synthetic oligonucleotide
uuugggauuauacugagc

SEQ ID NO: 76300 - RNA, 18 nt, Artificial Sequence
  Description of Artificial Sequence: Synthetic oligonucleotide
uccaauuugggauuauac

SEQ ID NO: 76301 - RNA, 18 nt, Artificial Sequence
  Description of Artificial Sequence: Synthetic oligonucleotide
ucacauccaauuugggau

SEQ ID NO: 76302 - RNA, 18 nt, Artificial Sequence
  Description of Artificial Sequence: Synthetic oligonucleotide
uaauuucacauccaauuu

SEQ ID NO: 76303 - RNA, 18 nt, Artificial Sequence
  Description of Artificial Sequence: Synthetic oligonucleotide
uaaaguaauuucacaucc

SEQ ID NO: 76304 - RNA, 18 nt, Artificial Sequence
  Description of Artificial Sequence: Synthetic oligonucleotide
cuggauaaaguaauuuca

SEQ ID NO: 76305 - RNA, 18 nt, Artificial Sequence
  Description of Artificial Sequence: Synthetic oligonucleotide
ggauacuggauaaaguaa

SEQ ID NO: 76306 - RNA, 18 nt, Artificial Sequence
  Description of Artificial Sequence: Synthetic oligonucleotide
uauuuggauacuggauaa

SEQ ID NO: 76307 - RNA, 18 nt, Artificial Sequence
  Description of Artificial Sequence: Synthetic oligonucleotide
guugguauuuggauacug

SEQ ID NO: 76308 - RNA, 18 nt, Artificial Sequence
  Description of Artificial Sequence: Synthetic oligonucleotide
aguuuuucauucacuucu

SEQ ID NO: 76309 - RNA, 18 nt, Artificial Sequence
  Description of Artificial Sequence: Synthetic oligonucleotide
cucgaaguuuuucauuca

SEQ ID NO: 76310 - RNA, 18 nt, Artificial Sequence
  Description of Artificial Sequence: Synthetic oligonucleotide
uguaucucgaaguuuuuc

SEQ ID NO: 76311 - RNA, 18 nt, Artificial Sequence
  Description of Artificial Sequence: Synthetic oligonucleotide
ucugcuguaucucgaagu

SEQ ID NO: 76312 - RNA, 18 nt, Artificial Sequence
  Description of Artificial Sequence: Synthetic oligonucleotide
ucccgucugcuguaucuc

SEQ ID NO: 76313 - RNA, 18 nt, Artificial Sequence
  Description of Artificial Sequence: Synthetic oligonucleotide
aaaggucccgucugcugu

SEQ ID NO: 76314 - RNA, 18 nt, Artificial Sequence
  Description of Artificial Sequence: Synthetic oligonucleotide
accaaaaaggucccgucu

SEQ ID NO: 76315 - RNA, 18 nt, Artificial Sequence
  Description of Artificial Sequence: Synthetic oligonucleotide
cucguaccaaaaaggucc

SEQ ID NO: 76316 - RNA, 18 nt, Artificial Sequence
  Description of Artificial Sequence: Synthetic oligonucleotide
cgcaucucguaccaaaaa

SEQ ID NO: 76317 - RNA, 18 nt, Artificial Sequence
  Description of Artificial Sequence: Synthetic oligonucleotide
guagacgcaucucguacc

SEQ ID NO: 76318 - RNA, 18 nt, Artificial Sequence
  Description of Artificial Sequence: Synthetic oligonucleotide
uuuuaguagacgcaucuc

SEQ ID NO: 76319 - RNA, 18 nt, Artificial Sequence
  Description of Artificial Sequence: Synthetic oligonucleotide
augcauuuuaguagacgc

SEQ ID NO: 76320 - RNA, 18 nt, Artificial Sequence
  Description of Artificial Sequence: Synthetic oligonucleotide
ucaccaugcauuuuagua

SEQ ID NO: 76321 - RNA, 18 nt, Artificial Sequence
  Description of Artificial Sequence: Synthetic oligonucleotide
uauaaucaccaugcauuu

SEQ ID NO: 76322 - RNA, 18 nt, Artificial Sequence
  Description of Artificial Sequence: Synthetic oligonucleotide
aagaguauaaucaccaug

SEQ ID NO: 76323 - RNA, 18 nt, Artificial Sequence
  Description of Artificial Sequence: Synthetic oligonucleotide
aguguaagaguauaauca

SEQ ID NO: 76324 - RNA, 18 nt, Artificial Sequence
  Description of Artificial Sequence: Synthetic oligonucleotide
uucagcuauauucccugg

SEQ ID NO: 76325 - RNA, 18 nt, Artificial Sequence
  Description of Artificial Sequence: Synthetic oligonucleotide
cuaauuucagcuauauuc

SEQ ID NO: 76326 - RNA, 18 nt, Artificial Sequence
  Description of Artificial Sequence: Synthetic oligonucleotide
aaacccuaauuucagcua

SEQ ID NO: 76327 - RNA, 18 nt, Artificial Sequence
  Description of Artificial Sequence: Synthetic oligonucleotide
gcccaaaacccuaauuuc

SEQ ID NO: 76328 - RNA, 18 nt, Artificial Sequence
  Description of Artificial Sequence: Synthetic oligonucleotide
uaucagcccaaaacccua

SEQ ID NO: 76329 - RNA, 18 nt, Artificial Sequence
  Description of Artificial Sequence: Synthetic oligonucleotide
uuuaauaucagcccaaaa

SEQ ID NO: 76330 - RNA, 18 nt, Artificial Sequence
  Description of Artificial Sequence: Synthetic oligonucleotide
uauguuuuaauaucagcc

SEQ ID NO: 76331 - RNA, 18 nt, Artificial Sequence
  Description of Artificial Sequence: Synthetic oligonucleotide
ggaaauauguuuuaauau

SEQ ID NO: 76332 - RNA, 18 nt, Artificial Sequence
  Description of Artificial Sequence: Synthetic oligonucleotide
aauaaggaaauauguuuu

SEQ ID NO: 76333 - RNA, 18 nt, Artificial Sequence
  Description of Artificial Sequence: Synthetic oligonucleotide
uuuggaauaaggaaauau

SEQ ID NO: 76334 - RNA, 18 nt, Artificial Sequence
  Description of Artificial Sequence: Synthetic oligonucleotide
aacauuuuggaauaagga

SEQ ID NO: 76335 - RNA, 18 nt, Artificial Sequence
  Description of Artificial Sequence: Synthetic oligonucleotide
guauuaacauuuuggaau

SEQ ID NO: 76336 - RNA, 18 nt, Artificial Sequence
  Description of Artificial Sequence: Synthetic oligonucleotide
gcccaaaacccuaauuuc

SEQ ID NO: 76337 - RNA, 18 nt, Artificial Sequence
  Description of Artificial Sequence: Synthetic oligonucleotide
uaucagcccaaaacccua

SEQ ID NO: 76338 - RNA, 18 nt, Artificial Sequence
  Description of Artificial Sequence: Synthetic oligonucleotide
uuuaauaucagcccaaaa

SEQ ID NO: 76339 - RNA, 18 nt, Artificial Sequence
  Description of Artificial Sequence: Synthetic oligonucleotide
uauguuuuaauaucagcc

SEQ ID NO: 76340 - RNA, 18 nt, Artificial Sequence
  Description of Artificial Sequence: Synthetic oligonucleotide
ggaaauauguuuuaauau

SEQ ID NO: 76341 - RNA, 18 nt, Artificial Sequence
  Description of Artificial Sequence: Synthetic oligonucleotide
aauaaggaaauauguuuu

SEQ ID NO: 76342 - RNA, 18 nt, Artificial Sequence
  Description of Artificial Sequence: Synthetic oligonucleotide
uuuggaauaaggaaauau

SEQ ID NO: 76343 - RNA, 18 nt, Artificial Sequence
  Description of Artificial Sequence: Synthetic oligonucleotide
aacauuuuggaauaagga

SEQ ID NO: 76344 - RNA, 18 nt, Artificial Sequence
  Description of Artificial Sequence: Synthetic oligonucleotide
guauuaacauuuuggaau

SEQ ID NO: 76345 - RNA, 18 nt, Artificial Sequence
  Description of Artificial Sequence: Synthetic oligonucleotide
uaaagguauuaacauuuu

SEQ ID NO: 76346 - RNA, 18 nt, Artificial Sequence
  Description of Artificial Sequence: Synthetic oligonucleotide
aaaaauaaagguauuaac

SEQ ID NO: 76347 - RNA, 18 nt, Artificial Sequence
  Description of Artificial Sequence: Synthetic oligonucleotide
uuuguuauuucccccuuu

SEQ ID NO: 76348 - RNA, 18 nt, Artificial Sequence
  Description of Artificial Sequence: Synthetic oligonucleotide
auuaauuuguuauuuccc

SEQ ID NO: 76349 - RNA, 18 nt, Artificial Sequence
  Description of Artificial Sequence: Synthetic oligonucleotide
uuuugauuaauuuguuau

SEQ ID NO: 76350 - RNA, 18 nt, Artificial Sequence
  Description of Artificial Sequence: Synthetic oligonucleotide
aaauauuuugauuaauuu

SEQ ID NO: 76351 - RNA, 18 nt, Artificial Sequence
  Description of Artificial Sequence: Synthetic oligonucleotide
cgaugaaauauuuugauu

SEQ ID NO: 76352 - RNA, 18 nt, Artificial Sequence
  Description of Artificial Sequence: Synthetic oligonucleotide
caucucgaugaaauauuu

SEQ ID NO: 76353 - RNA, 18 nt, Artificial Sequence
  Description of Artificial Sequence: Synthetic oligonucleotide
uuucccaucucgaugaaa

SEQ ID NO: 76354 - RNA, 18 nt, Artificial Sequence
  Description of Artificial Sequence: Synthetic oligonucleotide
ccauauuucccaucucga

SEQ ID NO: 76355 - RNA, 18 nt, Artificial Sequence
  Description of Artificial Sequence: Synthetic oligonucleotide
agaagccauauuucccau

SEQ ID NO: 76356 - RNA, 18 nt, Artificial Sequence
  Description of Artificial Sequence: Synthetic oligonucleotide
gucagagaagccauauuu

SEQ ID NO: 76357 - RNA, 18 nt, Artificial Sequence
  Description of Artificial Sequence: Synthetic oligonucleotide
aaugggucagagaagcca

SEQ ID NO: 76358 - RNA, 18 nt, Artificial Sequence
  Description of Artificial Sequence: Synthetic oligonucleotide
agguuaaugggucagaga

SEQ ID NO: 76359 - RNA, 18 nt, Artificial Sequence
  Description of Artificial Sequence: Synthetic oligonucleotide
acugaagguuaauggguc

SEQ ID NO: 76360 - RNA, 18 nt, Artificial Sequence
  Description of Artificial Sequence: Synthetic oligonucleotide
acagaacugaagguuaau

SEQ ID NO: 76361 - RNA, 18 nt, Artificial Sequence
  Description of Artificial Sequence: Synthetic oligonucleotide
caaccacagaacugaagg

SEQ ID NO: 76362 - RNA, 18 nt, Artificial Sequence
  Description of Artificial Sequence: Synthetic oligonucleotide
uaauucaaccacagaacu

SEQ ID NO: 76363 - RNA, 18 nt, Artificial Sequence
  Description of Artificial Sequence: Synthetic oligonucleotide
uuuauuaauucaaccaca

SEQ ID NO: 76364 - RNA, 18 nt, Artificial Sequence
  Description of Artificial Sequence: Synthetic oligonucleotide
agugguuuauuaauucaa

SEQ ID NO: 76365 - RNA, 18 nt, Artificial Sequence
  Description of Artificial Sequence: Synthetic oligonucleotide
ccgguagugguuuauuaa

SEQ ID NO: 76366 - RNA, 18 nt, Artificial Sequence
  Description of Artificial Sequence: Synthetic oligonucleotide
ucauuccgguagugguuu

SEQ ID NO: 76367 - RNA, 18 nt, Artificial Sequence
  Description of Artificial Sequence: Synthetic oligonucleotide
gagauucauuccgguagu

SEQ ID NO: 76368 - RNA, 18 nt, Artificial Sequence
  Description of Artificial Sequence: Synthetic oligonucleotide
agcuagagauucauuccg

SEQ ID NO: 76369 - RNA, 18 nt, Artificial Sequence
  Description of Artificial Sequence: Synthetic oligonucleotide
uacugagcuagagauuca

SEQ ID NO: 76370 - RNA, 18 nt, Artificial Sequence
  Description of Artificial Sequence: Synthetic oligonucleotide
gauuauacugagcuagag

SEQ ID NO: 76371 - RNA, 18 nt, Artificial Sequence
  Description of Artificial Sequence: Synthetic oligonucleotide
uuugggauuauacugagc

SEQ ID NO: 76372 - RNA, 18 nt, Artificial Sequence
  Description of Artificial Sequence: Synthetic oligonucleotide
uccaauuugggauuauac

SEQ ID NO: 76373 - RNA, 18 nt, Artificial Sequence
  Description of Artificial Sequence: Synthetic oligonucleotide
ucacauccaauuugggau

SEQ ID NO: 76374 - RNA, 18 nt, Artificial Sequence
  Description of Artificial Sequence: Synthetic oligonucleotide
uaauuucacauccaauuu

SEQ ID NO: 76375 - RNA, 18 nt, Artificial Sequence
  Description of Artificial Sequence: Synthetic oligonucleotide
uaaaguaauuucacaucc
